(12) United States Patent
Sorek et al.

(10) Patent No.: US 9,353,359 B2
(45) Date of Patent: May 31, 2016

(54) BACTERIAL ANTI-PHAGE DEFENSE SYSTEMS

(71) Applicant: Yeda Research and Development Co. Ltd., Rehovot (IL)

(72) Inventors: Rotem Sorek, Rehovot (IL); Hila Sberro, Rehovot (IL); Azita Leavitt, Rehovot (IL)

(73) Assignee: Yeda Research and Development Co. Ltd., Rehovot (IL)

( * ) Notice: Subject to any disclaimer, the term of this patent is extended or adjusted under 35 U.S.C. 154(b) by 0 days.

(21) Appl. No.: 14/140,793

(22) Filed: Dec. 26, 2013

(65) Prior Publication Data

US 2014/0178353 A1     Jun. 26, 2014

Related U.S. Application Data

(60) Provisional application No. 61/745,838, filed on Dec. 26, 2012.

(51) Int. Cl.
| | |
|---|---|
| *C07K 14/00* | (2006.01) |
| *C12N 9/22* | (2006.01) |
| *C12N 9/12* | (2006.01) |
| *C07K 14/81* | (2006.01) |
| *A61K 38/00* | (2006.01) |

(52) U.S. Cl.
CPC .............. *C12N 9/22* (2013.01); *C07K 14/8107* (2013.01); *C12N 9/1241* (2013.01); *A61K 38/00* (2013.01)

(58) Field of Classification Search
CPC ...................................................... C07K 14/00
See application file for complete search history.

(56) References Cited

U.S. PATENT DOCUMENTS

| | | | |
|---|---|---|---|
| 5,994,118 | A | 11/1999 | Moineau et al. |
| 7,169,911 | B2 | 1/2007 | Durmaz et al. |
| 7,550,576 | B2 | 6/2009 | Klaenhammer et al. |
| 7,754,868 | B2 | 7/2010 | Klaenhammer et al. |

OTHER PUBLICATIONS

Copeland et al. 2007; Complete sequence of Pseudomonus mendocina ymp. EMBL: ABP83335.*
Lucas et al. 2008; Complete sequence of Acidithiobacillus ferrooxidans ATCC 53993. EMBL: ACH83539.1.*
Kerfeld et al. 2009; Complete sequence of plasmid of Amonifex degensii KC4. EMBL: ACX53253.1.*
Lee et al. 2006; Sequence analysis of two cryptic plasmids from Bifidobacterium longum pJO10A and construction of a shuttle cloning vector. Applied Environmental Microbiology 72:527-535. EMBL: ACD97784.1. Alignment Only Being Sent.*
Chenoll et al. 2012; Safety assessment of strain Bifidobacterium longum CECT 7347, a probiotic able to reduce the toxicity and inflammatory potential of gliadin-derived peptides, based on phenotypic traits, whole genome sequencing, and murine trials. EMBL: CCK35109.1.*
Pajon et al. 2010; The genome sequence of Bifidobacterium longum F8. EMBL CBK70404.1.*
Schell et al. 2002; The genome sequence of Bifidobacterium longum reflects its adaptation to the human gastrointestinal tract. PNAS 99:14422-14427. EMBL: AAN25255.1. Alignment Only Being Sent.*
Ward et al. 2010; The genome sequence of *Bifidobacterium* sp. Strain 12_1_47BFAA) EMBL: EFV37145.1.*
DeBoy et al. 2008; Insights into plant cell wall degradation from the genome sequence of soil bacterium Cellvibrio japonicas. J. Bacteriology. 190: 5455-5463. EMBL: ACE84112.1. Alighnment Only Being Sent.*
Larimar et al. 2006; Annotation of the draft genome assembly of delta proteobacterium MLMS-1. EMBL: EAT06598.*
Score Search Results; Percent Identity Comparison of SEQ ID No. 3001 with 45 other '793 sequences. 2015.*
Score Search Results; Percent Identity Comparison of SEQ ID No. 2773 with 45 other '793 sequences. 2015.*
Makarova et al. "Defense Islands in Bacterial and Archaeal Genomes and Prediction of Novel Defense Systems", Journal of Bacteriology, 193(21): 6039-6056, Nov. 2011.

* cited by examiner

*Primary Examiner* — Karen Cochrane Carlson

(57) ABSTRACT

An isolated polypeptide is disclosed comprising an amino acid sequence selected from the group consisting of SEQ ID NOs: 2773-5544 and 11089-11094, wherein the polypeptide has antimicrobial activity. Uses thereof for treating microbial infections are also disclosed.

10 Claims, 13 Drawing Sheets
(10 of 13 Drawing Sheet(s) Filed in Color)

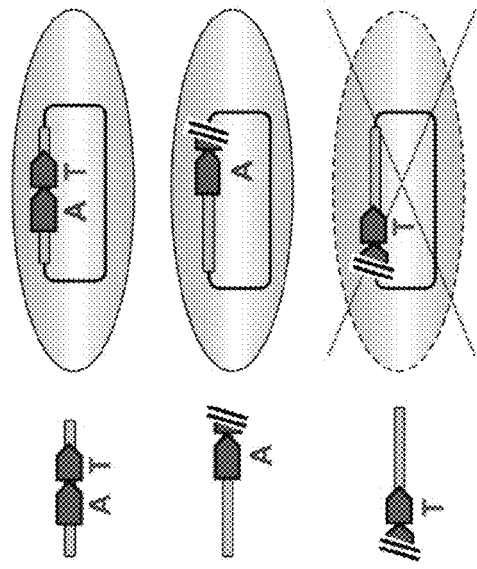
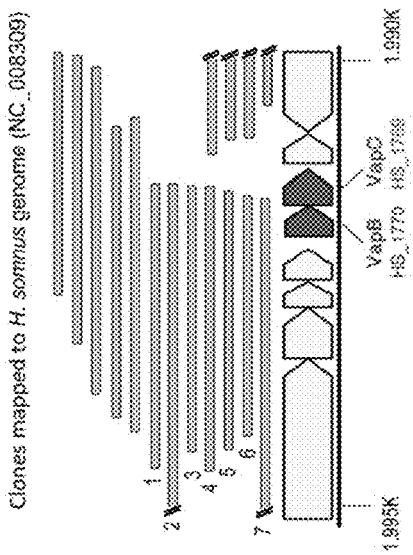

FIG.4B

| Phylum | PsyrAT | PmenAT | RlegAT | SdenAT | SanaAT |
|---|---|---|---|---|---|
| Firmicutes | 3 | 4 |  | 1 |  |
| Chlorobi | 2 |  | 5 |  | 3 |
| Bacteroidetes | 1 | 2 |  |  |  |
| Chlamydiae |  |  | 1 |  |  |
| Planctomycetes |  |  | 1 |  |  |
| Spirochaetes |  | 1 |  |  |  |
| Actinobacteria |  | 40 | 20 | 9 |  |
| Chloroflexi | 3 | 1 |  |  |  |
| Deinococcus-Thermus |  |  |  |  |  |
| Cyanobacteria | 6 | 11 | 3 |  | 1 |
| Deltaproteobacteria | 1 | 4 | 3 | 5 | 2 |
| Epsilonproteobacteria |  |  |  | 2 |  |
| Alphaproteobacteria | 1 | 6 | 16 |  | 1 |
| Betaproteobacteria | 3 | 5 | 8 | 2 | 9 |
| Gammaproteobacteria | 45 | 19 | 7 | 14 | 32 |
| Other Phyla |  | 1 | 5 |  |  |

FIG.4C

| Species | PsyrAT | PmenAT | RlegAT | SdenAT | SanaAT |
|---|---|---|---|---|---|
| Bifidobacterium species |  |  |  | 7 |  |
| Escherichia coli | 35 |  |  |  | 14 |
| Klebsiella pneumoniae |  | 1 |  |  |  |
| Legionella longbeachae |  | 1 |  |  |  |
| Legionella pneumophila |  |  | 2 |  |  |
| Mycobacterium bovis |  | 3 |  |  | 3 |
| Mycobacterium tuberculosis |  | 35 |  |  |  |
| Prevotella timonensis |  | 1 |  |  |  |
| Pseudomonas aeruginosa | 1 |  |  |  |  |
| Shigella dysenteriae | 2 |  |  |  |  |
| Yersinia enterocolitica |  |  |  |  | 1 |

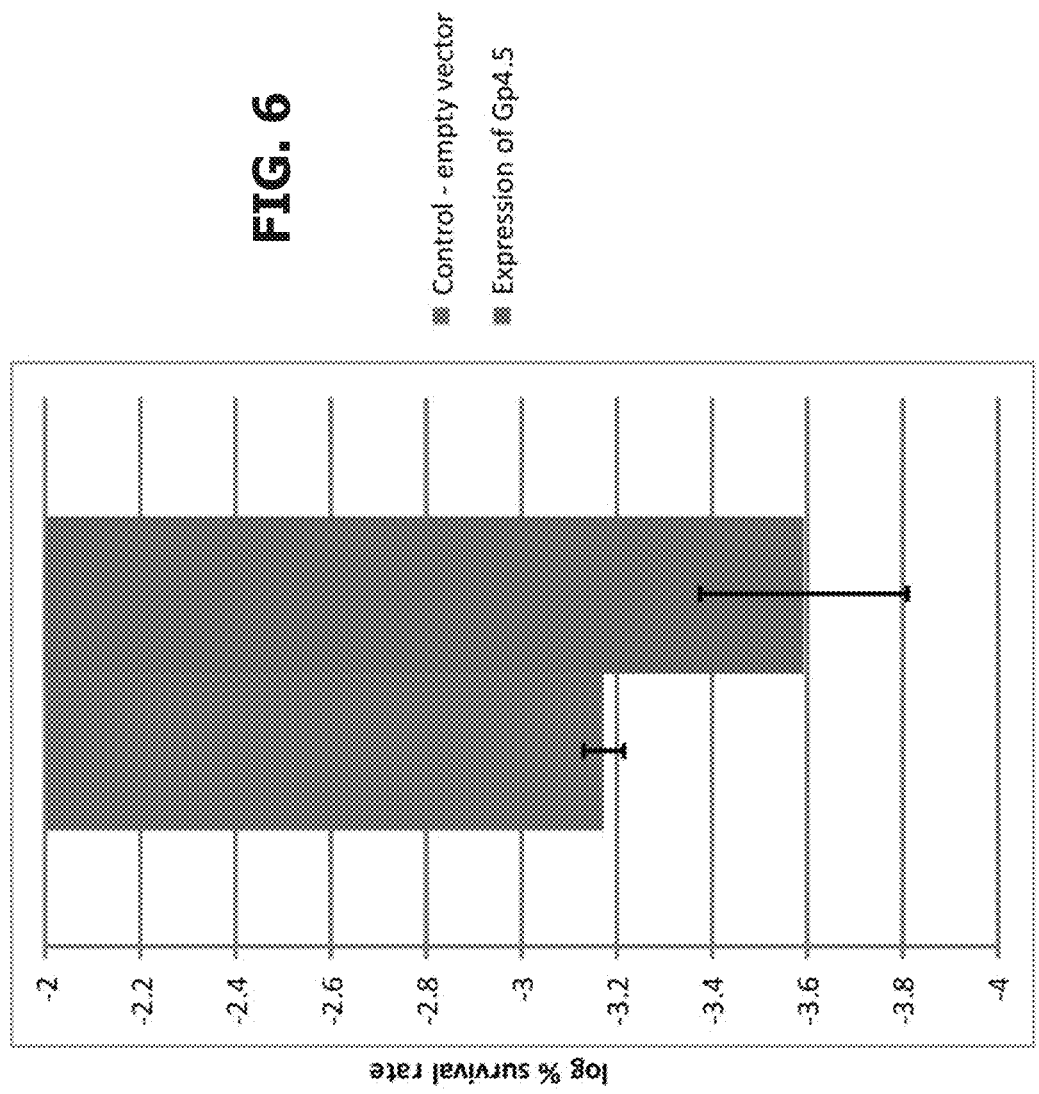

BACTERIAL ANTI-PHAGE DEFENSE SYSTEMS

RELATED APPLICATION

This application claims the benefit of priority under 35 USC §119(e) of U.S. Provisional Patent Application No. 61/745,838 filed Dec. 26, 2012, the contents of which are incorporated herein by reference in their entirety.

GOVERNMENT INTERESTS

Federally Sponsored Research

This invention was made with government support under AI082376 awarded by NIH. The government has certain rights in the invention.

SEQUENCE LISTING STATEMENT

The ASCII file, entitled 57892SequenceListing.txt, created on Nov. 11, 2013, comprising 20,497,456 bytes, submitted concurrently with the filing of this application is incorporated herein by reference.

FIELD AND BACKGROUND OF THE INVENTION

The present invention, in some embodiments thereof, relates to bacterial polypeptides that comprise toxin or antitoxin activity and, more particularly, but not exclusively, to toxin-antitoxin pairs that may be used as bacterial anti-phage defense systems.

A broad array of food products, commodity chemicals, and biotechnology products are manufactured industrially by large-scale bacterial fermentation of various substrates. Because enormous amounts of bacteria are being cultivated each day in large fermentation vats, bacteriophage contamination can rapidly bring fermentations to a halt and cause economic setbacks, and is therefore considered a serious threat in these industries. The dairy fermentation industry has openly acknowledged the problem of phage and has been working with academia and starter culture companies to develop defense strategies and systems to curtail the propagation and evolution of phages for decades.

To survive in the face of perpetual phage attacks, bacteria have developed a variety of anti-phage defense systems (Labrie et al., 2010; Stern and Sorek, 2011). These systems include restriction enzymes that recognize and cleave foreign DNA (King and Murray, 1994), abortive infection (Abi) mechanisms that lead the bacterial cell, upon phage invasion, to commit "suicide", thus protecting the colony against phage spread (Chopin et al., 2005); and the recently identified adaptive defense system called CRISPR/Cas, which uses small RNAs to target invading phage DNA (Deveau et al., 2010; Horvath and Barrangou, 2010; Sorek et al., 2008; van der Oost et al., 2009). Due to the rapid evolution and elaborated biological novelty associated with the bacteria-phage arms race, it is estimated that many additional, yet uncharacterized anti-phage defense systems are encoded by bacteria and archaea to (Makarova et al., 2011; Stern and Sorek, 2011). As part of this continuous arms race, successful phages had also developed numerous counter-resistance mechanisms to overcome bacterial defense (Labrie et al., 2010; Stern and Sorek, 2011).

The growing availability of genomic sequences has elucidated the vast dispersion of toxin-antitoxin (TA) systems in prokaryotic genomes (Shao et al., 2011). These systems (also called TA modules), composed of a toxic gene and a neutralizing gene, were first suggested to function as plasmid 'addiction molecules' (Van Melderen and Saavedra De Bast, 2009; Wozniak and Waldor, 2009), but their prevalent existence on chromosomes (Aizenman et al., 1996; Makarova et al., 2009; Shao et al., 2011) has led to the understanding that this is unlikely their major role. Accumulating evidence suggest that TA modules play pivotal roles in prokaryotic cellular biology including programmed cell death (Hazan et al., 2004), stress response (Christensen et al., 2001), generation of persister cells (Schumacher et al., 2009), biofilm formation (Kim et al., 2009) and phage defense via abortive infection (Fineran et al., 2009; Hazan and Engelberg-Kulka, 2004; Koga et al., 2011; Pecota and Wood, 1996).

The most prevalent kind of TA systems is type II systems, where both toxin and antitoxin are proteins (as opposed to types I and III where the antitoxin is a non-coding RNA (Fineran et al., 2009; Fozo et al.)). The two genes, which reside on the same operon, code for small proteins and inhibition of the toxin is carried out through protein-protein interaction. As a rule, the toxin is a stable protein and the antitoxin is unstable and degrades rapidly by one of the housekeeping bacterial proteases, usually Lon or ClpP (Aizenman et al., 1996; Cherny and Gazit, 2004; Christensen et al., 2004; Christensen et al., 2001; Christensen et al., 2003; Lehnherr and Yarmolinsky, 1995; Roberts et al., 1994; Van Melderen et al., 1996). As a result, continuous production of the antitoxin is required to prevent the toxin's deleterious effects (Van Melderen and Saavedra De Bast, 2009).

A number of reports demonstrate a role for type II TA systems in phage resistance via an Abi mechanism: the extensively studied MazEF system was shown to eliminate P1 phage infection (Hazan and Engelberg-Kulka, 2004), and the recently identified RnlA toxin which is activated following T4 phage infection degrades phage mRNAs (Koga et al., 2011). Type I and Type III TA systems (hok/sok and ToxIN, to respectively) were also shown to provide resistance against phages (Fineran et al., 2009; Pecota and Wood, 1996). However, based on their presence in bacterial 'defense islands', it was hypothesized that TA systems play a much wider role in phage defense (Makarova et al., 2011).

The usage of Abi systems for biotech purposes, especially in protecting dairy industry bacteria from bacteriophages is disclosed in U.S. Pat. Nos. 7,754,868, 7,550,576, 7,169,911 and 5,994,118.

To date, at least 12 families of type II TA systems have been described (Masuda et al., 2012; Shao et al., 2011). Members of these families are widespread in bacterial and archaeal genomes and undergo extensive horizontal gene transfer (Guglielmini et al., 2008; Makarova et al., 2009; Pandey and Gerdes, 2005; Shao et al., 2011). Computational studies based on the 'guilt by association' principle (gene neighbors of known toxins/antitoxins are suspected as antitoxins/toxins themselves) and on other characteristics of TA systems have recently predicted several novel TA families (Leplae et al., 2011; Makarova et al., 2009), which are yet to be validated experimentally.

SUMMARY OF THE INVENTION

According to an aspect of some embodiments of the present invention there is provided an isolated polypeptide comprising an amino acid sequence selected from the group consisting of SEQ ID NOs: 2773-5544 and 11089-11094, wherein the polypeptide has antimicrobial activity.

According to an aspect of some embodiments of the present invention there is provided an isolated polypeptide comprising an amino acid sequence selected from the group consisting of SEQ ID NOs: 8317-11088, wherein the polypeptide protects a microbe from an activity of a toxin.

According to an aspect of some embodiments of the present invention there is provided an isolated polynucleotide comprising a nucleic acid sequence encoding an isolated polypeptide comprising an amino acid sequence selected from the group consisting of SEQ ID NOs: 2773-5544 and 11089-11094, wherein the polypeptide has antimicrobial activity.

According to an aspect of some embodiments of the present invention there is provided an isolated polynucleotide comprising a nucleic acid sequence encoding a polypeptide comprising an amino acid sequence selected from the group consisting of SEQ ID NOs: 8317-11088, wherein the polypeptide protects a microbe from an activity of a toxin.

According to an aspect of some embodiments of the present invention there is provided an anti-microbial composition, comprising a carrier and as an active ingredient an isolated polypeptide comprising an amino acid sequence selected from the group consisting of SEQ ID NOs: 2773-5544 and 11089-11094.

According to an aspect of some embodiments of the present invention there is provided an anti-microbial composition, comprising a carrier and as an active ingredient an isolated polynucleotide comprising a nucleic acid sequence which encodes a polypeptide comprising an amino acid sequence selected from the group consisting of SEQ ID NOs: 2773-5544 and 11089-11094.

According to an aspect of some embodiments of the present invention there is provided method of treating an infection in a subject in need thereof, the method comprising administering to the subject a therapeutically effective amount of the anti-microbial composition described herein, thereby treating the infection.

According to an aspect of some embodiments of the present invention there is provided a solid support coated with an isolated polypeptide comprising an amino acid sequence selected from the group consisting of SEQ ID NOs: 2773-5544.

According to an aspect of some embodiments of the present invention there is provided a method of killing a microbe, the method comprising contacting the microbe with an isolated peptide comprising an amino acid sequence selected from the group consisting of SEQ ID NOs: 2773-5544, thereby killing the microbe.

According to an aspect of some embodiments of the present invention there is provided a method of protecting a microbe from a toxin comprising expressing in the microbe the polypeptide comprising an amino acid sequence selected from the group consisting of SEQ ID NOs: 8317-11088, wherein the polypeptide protects a microbe from an activity of a toxin.

According to an aspect of some embodiments of the present invention there is provided an isolated bacterial population genetically modified to express a toxin and a to cognate antitoxin thereof, the bacterial population being resistant to a lytic activity of a bacteriophage, wherein the toxin comprises an amino acid sequence selected from the group consisting of SEQ ID NOs: 2773-3117, wherein when the toxin comprises an amino acid sequence selected from the group consisting of SEQ ID NO: 2773-2804, the antitoxin comprises an amino acid sequence selected from the group consisting of SEQ ID NO:8317-8348, wherein when the toxin comprises an amino acid sequence selected from the group consisting of SEQ ID NO: 2805-2871, the antitoxin comprises an amino acid sequence selected from the group consisting of SEQ ID NO:8349-8415, wherein when the toxin comprises an amino acid sequence selected from the group consisting of SEQ ID NO: 2872-2935, the antitoxin comprises an amino acid sequence selected from the group consisting of SEQ ID NO:8416-8479, wherein when the toxin comprises an amino acid sequence selected from the group consisting of SEQ ID NO: 2936-3030, the antitoxin comprises an amino acid selected from the group consisting of SEQ ID NO:8480-8574, wherein when the toxin comprises an amino acid sequence selected from the group consisting of SEQ ID NO: 3031-3078, the antitoxin comprises an amino acid sequence selected from the group consisting of SEQ ID NO: 8575-8622, wherein when the toxin comprises an amino acid sequence selected from the group consisting of SEQ ID NO: 3079-3087, the antitoxin comprises an amino acid sequence selected from the group consisting of SEQ ID NO:8623-8631, wherein when the toxin comprises an amino acid sequence selected from the group consisting of SEQ ID NO: 3088-3094, the antitoxin comprises an amino acid sequence selected from the group consisting of SEQ ID NO:8632-8638, wherein when the toxin comprises an amino acid sequence selected from the group consisting of SEQ ID NO: 3095-3109, the antitoxin comprises an amino acid sequence selected from the group consisting of SEQ ID NO:8639-8653, wherein when the toxin comprises an amino acid sequence selected from the group consisting of SEQ ID NO: 3110-3117, the antitoxin comprises an amino acid sequence selected from the group consisting of SEQ ID NO:8654-8661.

According to an aspect of some embodiments of the present invention there is provided a method of protecting a bacterial population from phage attack, the method comprising expressing in the bacterial population a toxin and a cognate antitoxin thereof, wherein the toxin comprises an amino acid sequence selected from the group consisting of SEQ ID NOs: 2773-3117, wherein when the toxin comprises an amino acid sequence selected from the group consisting of SEQ ID NO: 2773-2804, the antitoxin comprises an amino acid sequence selected from the group consisting of SEQ ID NO:8317-8348, wherein when the toxin comprises an amino acid sequence selected from the group consisting of SEQ ID NO: 2805-2871, the antitoxin comprises an amino acid sequence selected from the group consisting of SEQ ID NO:8349-8415, wherein when the toxin comprises an amino acid sequence selected from the group consisting of SEQ ID NO: 2872-2935, the antitoxin comprises an amino acid sequence selected from the group consisting of SEQ ID NO:8416-8479, wherein when the toxin comprises an amino acid sequence selected from the group consisting of SEQ ID NO: 2936-3030, the antitoxin comprises an amino acid selected from the group consisting of SEQ ID NO:8480-8574, wherein when the toxin comprises an amino acid sequence selected from the group consisting of SEQ ID NO: 3031-3078, the antitoxin comprises an amino acid sequence selected from the group consisting of SEQ ID NO: 8575-8622, wherein when the toxin comprises an amino acid sequence selected from the group consisting of SEQ ID NO: 3079-3087, the antitoxin comprises an amino acid sequence selected from the group consisting of SEQ ID NO:8623-8631, wherein when the toxin comprises an amino acid sequence selected from the group consisting of SEQ ID NO: 3088-3094, the antitoxin comprises an amino acid sequence selected from the group consisting of SEQ ID NO:8632-8638, wherein when the toxin comprises an amino acid sequence selected from the group consisting of SEQ ID NO:

3095-3109, the antitoxin comprises an amino acid sequence selected from the group consisting of SEQ ID NO:8639-8653, wherein when the toxin comprises an amino acid sequence selected from the group consisting of SEQ ID NO: 3110-3117, the antitoxin comprises an amino acid sequence selected from the group consisting of SEQ ID NO:8654-8661.

According to an aspect of some embodiments of the present invention there is provided a nucleic acid system comprising:

(i) a first isolated polynucleotide which encodes a toxin, the toxin having an amino acid sequence selected from the group consisting of SEQ ID NOs: 2773-5544; and (ii) a second isolated polynucleotide which encodes a cognate antitoxin to the toxin, the antitoxin having an amino acid sequence selected from the group consisting of SEQ ID NOs: 8317-11088.

According to some embodiments of the invention, the isolated polypeptide comprises an amino acid sequence selected from the group consisting of SEQ ID NOs. 2773-3117 and 11089-11094.

According to some embodiments of the invention, the amino acid sequence consists of the sequences selected from the group as set forth in SEQ ID NOs: 2773-5544.

According to some embodiments of the invention, the isolated polypeptide comprises an amino acid sequence selected from the group consisting of SEQ ID NOs. 8317-8661.

According to some embodiments of the invention, the amino acid sequence consists of the sequences selected from the group as set forth in SEQ ID NOs: 8317-11088.

According to some embodiments of the invention, the isolated peptide comprises at least one naturally occurring amino acid.

According to some embodiments of the invention, the isolated peptide comprises a synthetic amino acid.

According to some embodiments of the invention, the isolated peptide is attached to a cell penetrating agent.

According to some embodiments of the invention, the attached is covalently attached.

According to some embodiments of the invention, the cell penetrating agent is a peptide agent.

According to some embodiments of the invention, the isolated peptide is attached to a sustained-release enhancing agent.

According to some embodiments of the invention, the sustained-release enhancing agent is selected from the group consisting of hyaluronic acid (HA), alginic acid (AA), polyhydroxyethyl methacrylate (Poly-HEMA), polyethylene glycol (PEG), glyme and polyisopropylacrylamide.

According to some embodiments of the invention, the isolated polynucleotide to comprises a nucleic acid sequence selected from the group consisting of SEQ ID NOs: 1-2772.

According to some embodiments of the invention, the isolated polynucleotide comprises a nucleic acid sequence selected from the group consisting of SEQ ID NOs: 5545-8316.

According to some embodiments of the invention, the carrier is a pharmaceutically acceptable carrier.

According to some embodiments of the invention, the antimicrobial composition is formulated for topical application.

According to some embodiments of the invention, the nucleic acid sequence is selected from the group consisting of SEQ ID NOs: 1-2772 and 11095-11100.

According to some embodiments of the invention, the carrier is a pharmaceutically acceptable carrier.

According to some embodiments of the invention, the method further comprises administering to the subject an antibiotic.

According to some embodiments of the invention, the contacting is effected in vivo.

According to some embodiments of the invention, the contacting is effected ex vivo.

According to some embodiments of the invention, the microbe comprises a bacteria.

According to some embodiments of the invention, the isolated polynucleotide is operably linked to a promoter.

According to some embodiments of the invention, the bacterial population is a lactic acid bacterial population.

According to some embodiments of the invention, the bacterial population is of a species selected from the group consisting of *Lactococcus* species, *Streptococcus* species, *Lactobacillus* species, *Leuconostoc* species, *Oenococcus* species, *Pediococcus* species and *Bifidobacterium*.

According to some embodiments of the invention, when the toxin comprises an amino acid sequence selected from the group consisting of SEQ ID NO: 2805-2871, the bacteriophage comprises WT T7 strain.

According to some embodiments of the invention, the first isolated polynucleotide encodes a toxin having an amino acid sequence selected from the group consisting of SEQ ID NOs: 2773-3117; and the second isolated polynucleotide encodes an antitoxin having an amino acid sequence selected from the group consisting of SEQ ID NOs: 8317-8661.

According to some embodiments of the invention, the first isolated polynucleotide and the second isolated polynucleotide are comprised in a non-identical expression vector.

According to some embodiments of the invention, the antimicrobial composition is for treating an infection.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawings will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-D illustrate that data derived from whole-genome shotgun sequencing exposes toxin-antitoxin pairs. (A) The "Sanger" based process of DNA sequencing involves random genome fragmentation and transformation of DNA fragments into *E. coli*. (B) In a DNA locus spanning a toxin/antitoxin (TA) gene pair, random fragmentation leaving the toxin detached from its cognate antitoxin leads to *E. coli* growth arrest, whereas a fragment containing both genes, or the antitoxin alone, will be propagated and sequenced. (C) A known family of toxin/antitoxin gene pairs, of the VapBC type, was found in 11 of the analyzed genomes. In 7/11 cases the gene pair follows the "TA cloning pattern", significantly higher than the number expected by chance ($p=4\times10^{-3}$). (D) The VapBC locus in *Haemophilus somnus* 129T (accession NC_008309, locus tags HS_1769-HS_1770). Shown are clones (brown) mapped to the reference genome at that locus. Clones covering the antitoxin but not the toxin are numbered. Only five of the 22 clones covering both toxin and antitoxin are shown.

Figure 2:
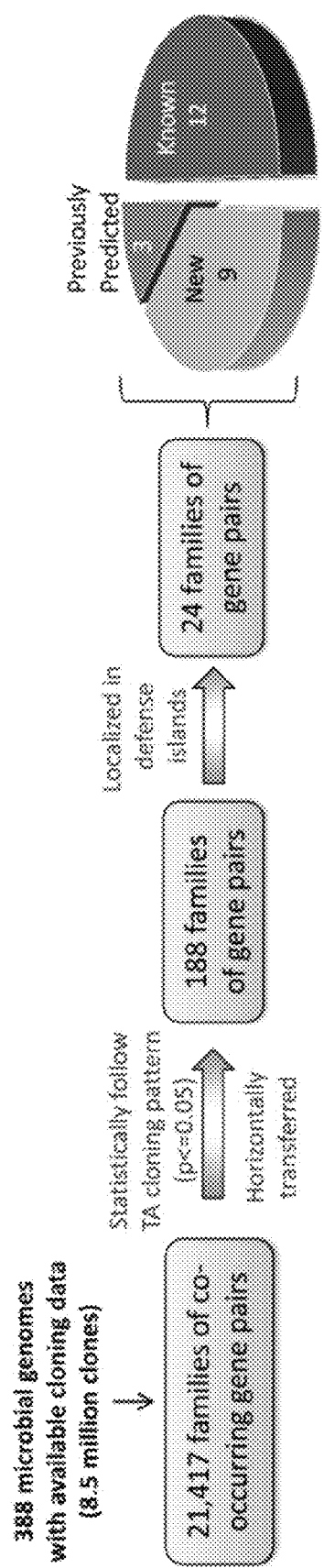

FIG. 2 is a diagram of the workflow for systematic discovery of families of toxin/antitoxin associated with anti-phage defense.

Figure 3A:
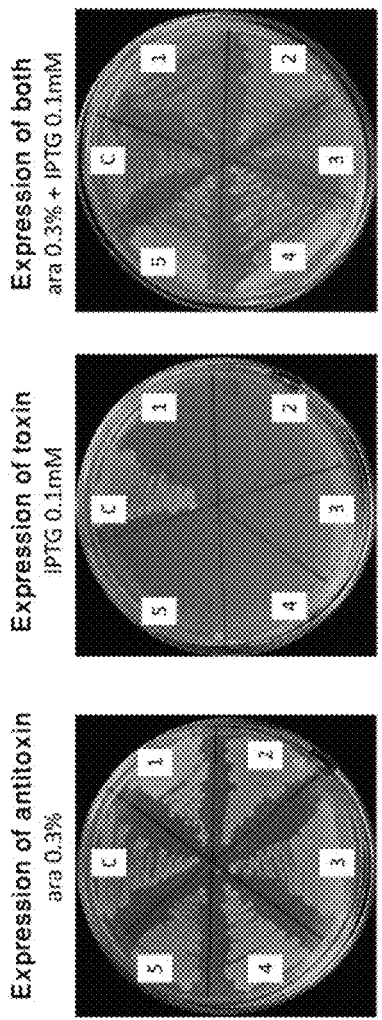
Figure 3B:
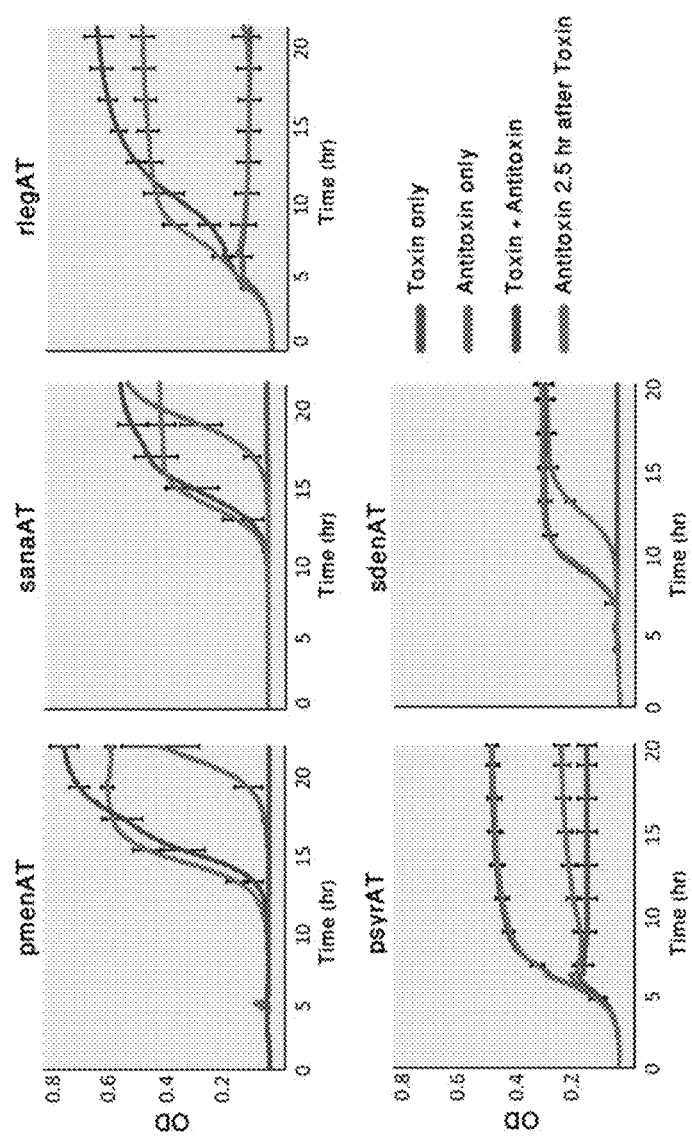
Figure 3C:
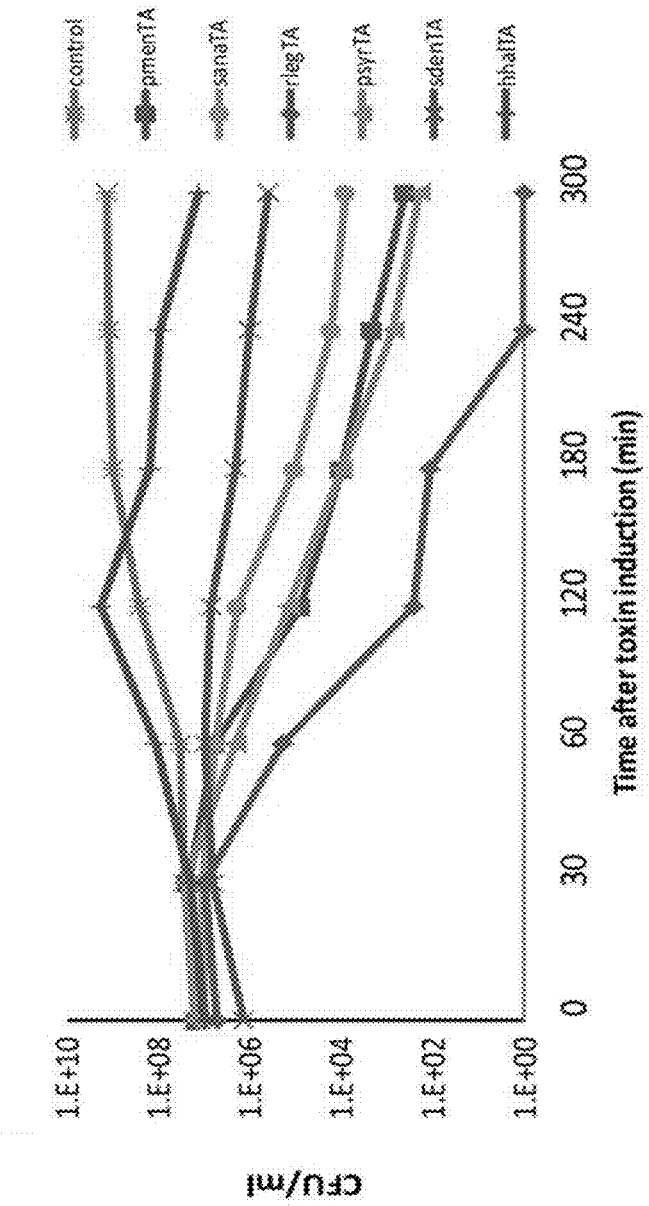

FIGS. 3A-C are graphs and diagrams illustrating properties of novel, experimentally verified TA systems (A) growth of bacteria when only antitoxin is induced (left), only toxin is induced (middle) and both are induced together (right). Toxin and antitoxin were cloned on pRSF (IPTG inducible promoter) and pBAD (arabinose inducible), respectively, in *E. coli* BL21 (DE3) pLysS. C, control bacteria with empty plasmids; 1-pmen system; 2-sana system; 3-psyr system; 4-rleg system; 5-sden system. (B) Kinetics of *E. coli* BL21 (DE3) pLysS growth when toxin and antitoxin are co-expressed simultaneously (purple), alone (red and blue for toxin and antitoxin, respectively) or when antitoxin is induced 2.5 hrs following toxin induction (green). Kinetic measurements were performed on biological triplicates in technical duplicates. (C) Viability assays for cells following exposure to toxin. Transcription of toxin was induced by 100 μM IPTG. At increasing time points following toxin induction (30, 60, 120, 180, 240 and 300 mins) cells were plated on LB-plates containing 0.3% arabinose and no IPTG, to activate antitoxin expression. Colony forming units (CFUs) were determined by colony counting.

Figure 4A:
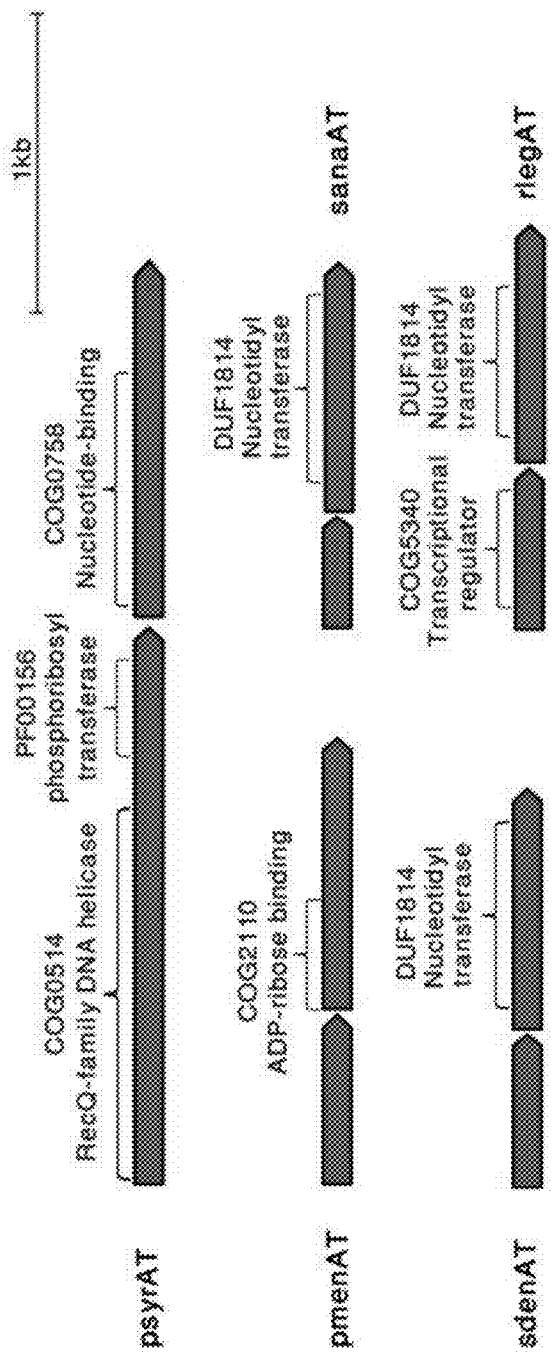

FIG. 4A illustrates operon and domain organization of the validated families Representative pair of each family is shown. For each pair, red and blue genes denote toxin and antitoxin, respectively.

FIGS. 4B-C are tables showing distribution of novel TA system among (B) different bacterial phyla and (C) human associated bacteria. Number of instances of each system within a phylum/bacterial species is indicated, with darker colors indicating higher number of instances.

FIGS. 5A-F illustrate that T7 Gp 4.5 antagonizes abortive infection by interacting with Lon. (A) Illustration of the plaque forming unit (PFU) assays on *E. coli* harboring toxin/antitoxin systems. Efficiency of plating (EOP) was calculated by dividing the number of PFUs obtained for a bacterial lawn expressing the toxin+antitoxin by the number of PFUs obtained on a lawn expressing the antitoxin alone. Bars in panels B, C and E represent average±SD of three independent EOP experiments. (B) EOP experiments with *E. coli* harboring the sanaAT system when infected by WT T7 (left) or by T7Δ4.3Δ4.5Δ4.7 (right). (C) EOP experiments with WT *E. coli* (left) and *E. coli* expressing Gp4.5 (right), when infected by T7Δ4.3Δ4.5Δ4.7. (D) EOP experiments with WT *E. coli* (left) and *E. coli* lacking lon (right), when infected by T7Δ4.3Δ4.5Δ4.7. (E) Co-immunoprecipitation of Lon and 4.5. The *E. coli* Lon protease was Flag-tagged at the N-terminus and expressed within *E. coli* BL21 (DE3) with or without co-expression of gene 4.5. Samples were analyzed by 15% SDS-PAGE. Three left lanes, total soluble proteins; three lanes on the right, following immunoprecipitation with anti-Flag antibody. Co-immunoprecipitation of Lon and 4.5 was validated by mass spectrometry analysis. Numbers on the left denote protein marker sizes in kDa. (F) Western blot analysis on reciprocal co-IP with flag-tagged Gp4.5 and his-tagged Lon Immunoprecipitation was done with anti-Flag antibody.

FIG. 6 is a bar graph demonstrating that expression of gene 4.5 within *E. coli* results in reduced number of persister bacteria. Bacteria were exposed to ampicillin for 5 hours and % formation of persister bacteria was measured. Experiments were performed in triplicates and error bars represent standard error.

Figure 7:
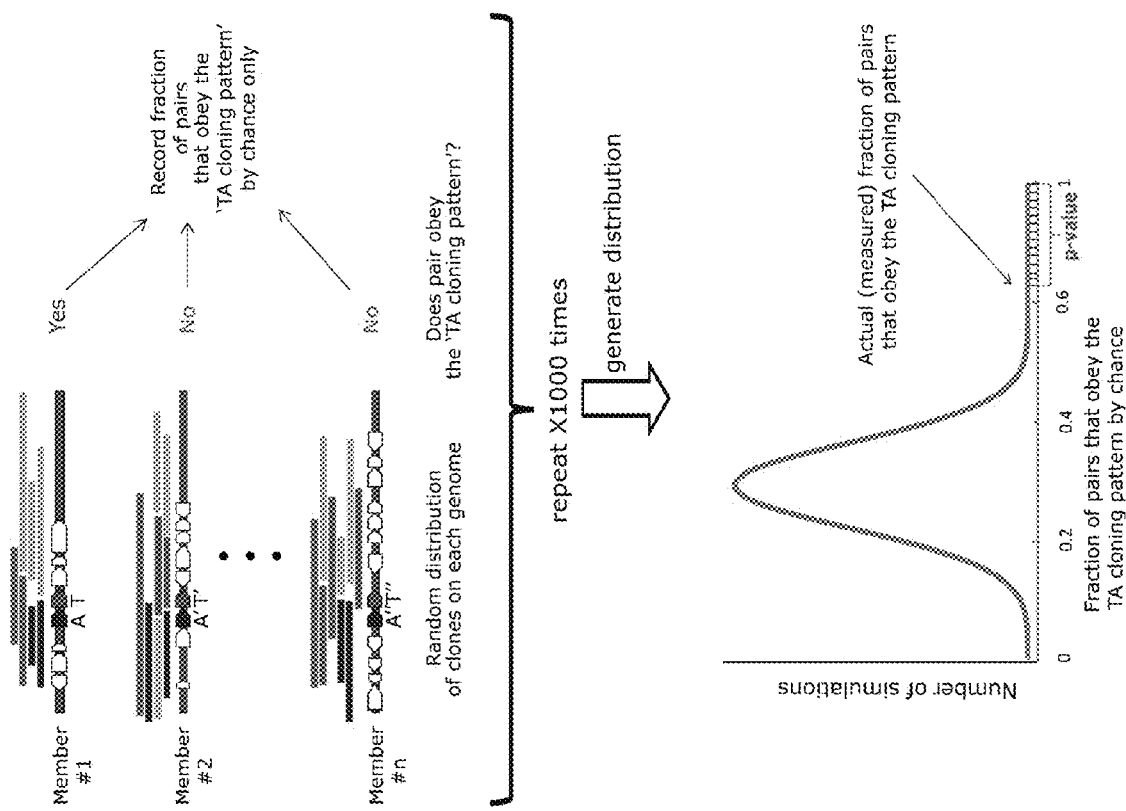

FIG. 7 illustrates the statistical assessment of a family of gene pairs as possibly encoding a toxin-antitoxin module. In each genome where a member of the to family exist, the sequencing clones are re-distributed randomly (maintaining the number of clones and their sizes, but shuffling their positions on the genome). The "TA cloning pattern" for each member is then evaluated based on the randomly distributed clones, and the fraction of members obeying the "TA cloning pattern" by chance is recorded (in the illustration: red, clones that span only the toxin; blue, clones that span only the antitoxin; green, clones that span both genes). This procedure is repeated 1000 times, generating a distribution of fractions. The p-value for a family is determined by comparing the actual fraction of pairs that obey the "TA cloning pattern" to the distribution of fractions obtained using the random clone shuffling.

Figure 8:
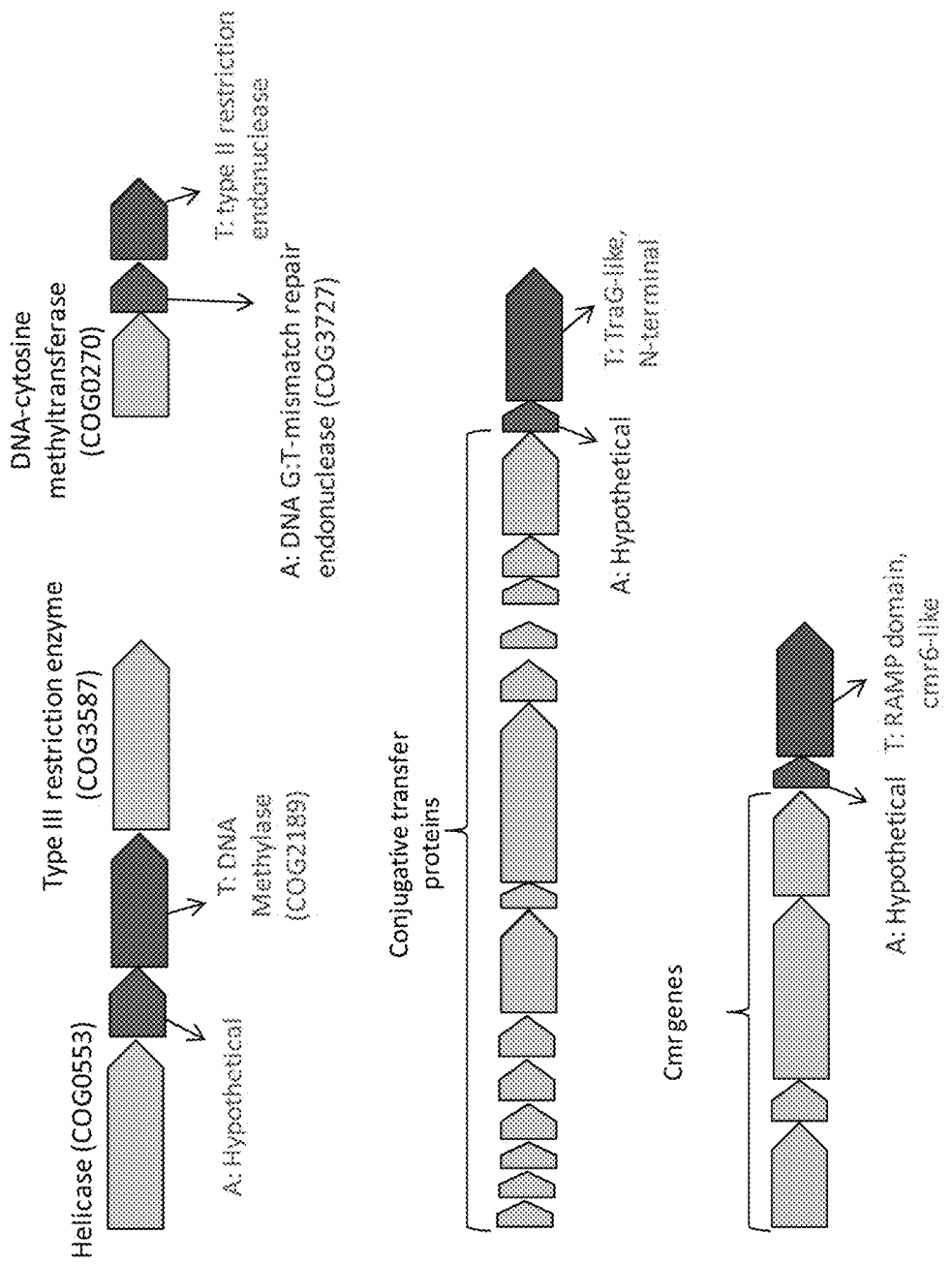

FIG. 8 is a diagram illustrating that predicted new TA systems associate with complex genomic environments. Shown are the schematic environments of 4 systems that are associated with other genes and hence suspected as participating in multi-gene defense systems. Blue and red genes denote putative antitoxin and toxin, respectively; gray genes denote genes associated with the TA system.

Figure 9A:
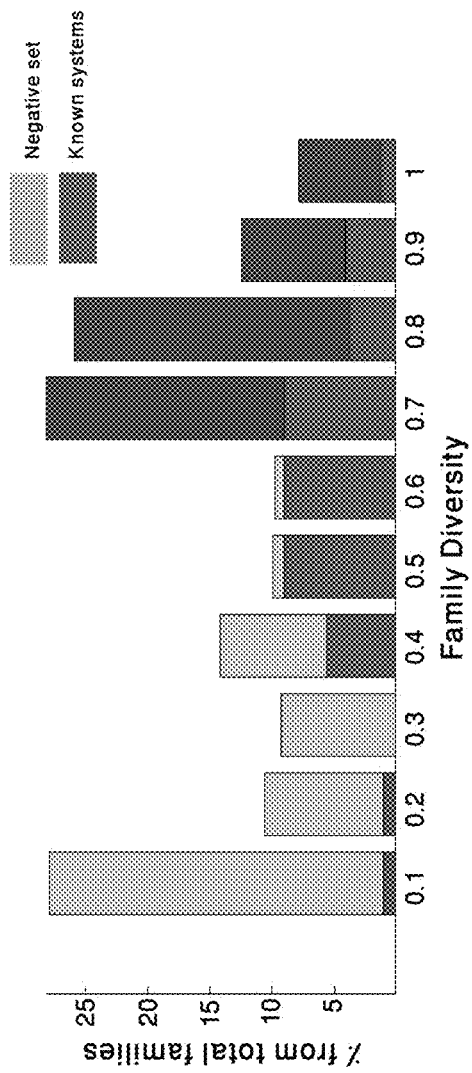
Figure 9B:
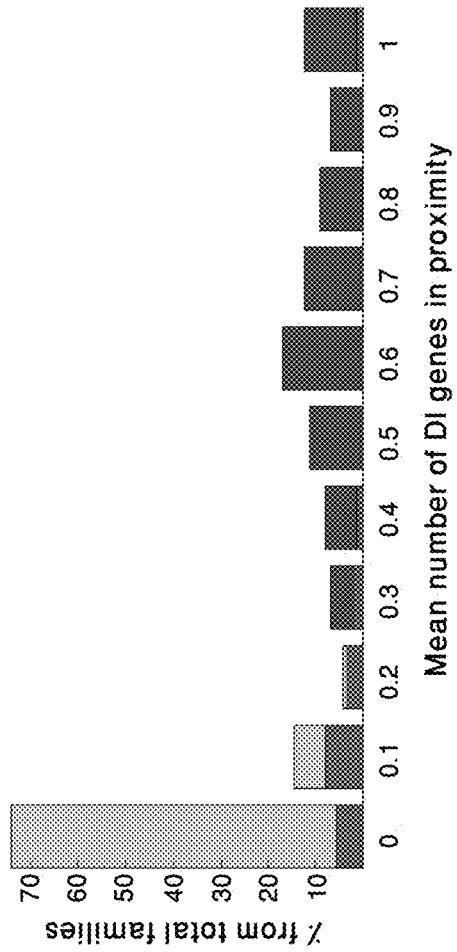

FIGS. 9A-B are bar graphs illustrating properties of known TA families. The 21,417 analyzed families of gene pairs were divided into two sets: a positive set which contains all families in which at least one pair is a known TA system ('Known systems') and a negative which contains the remaining families ('Negative set'). (A) The family diversity measurement for known TA systems (black) as compared to the negative set (light gray) (B) Mean number of defense island (DI) genes localized+/−5 genes away from known TA families (black) as compared to families in the negative set (light gray).

DESCRIPTION OF SPECIFIC EMBODIMENTS
OF THE INVENTION

The present invention, in some embodiments thereof, relates to bacterial polypeptides that comprise toxin and/or antitoxin activity and, more particularly, but not exclusively, to toxin-antitoxin pairs that may be used as bacterial antiphage defense systems.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The toxin-antitoxin (TA) complex of bacteria includes a pair of polypeptides that is encoded by bacterial plasmids or chromosomes. It is postulated that in bacteria these polypeptides function to induce programmed cell death or growth inhibition in response to starvation, phage infection or other adverse conditions. The antitoxins neutralize the cognate toxins by forming tight complexes therewith or by other means. The antitoxins are unstable due to degradation by cellular proteases (e.g., Lon or Clp), whereas toxins are stable polypeptides. Toxin-antitoxin pair examples include the pemI-pemK genes of plasmid R100, the phd-doc genes of phage P1, and the ccdA-ccdB genes, of plasmid F. Several toxin-antitoxin encoding gene analogues have been identified on the *E. coli* K-12 chromosome, such as mazE-mazF.

In numerous cases where TA systems were studied experimentally, cloning of the toxin was nearly impossible in the absence of the cognate antitoxin. Based on this concept the present inventors reasoned that data derived from Sanger-based whole genome shotgun sequencing can experimentally and systematically reveal active TA pairs. In such a genome sequencing process, randomly fragmented DNA pieces of the genome are serially cloned and propagated within *E. coli* prior to sequencing. The ends of the cloned fragments are then sequenced, and overlapping sequences are used for genome assembly (FIG. 1A). It has been shown that analysis of clone distribution patterns can reveal genes toxic to bacteria, which are uncloneable and cause gaps (Kimelman et al., 2012; Sorek et al., 2007). However, the toxin in a TA pair is not expected to cause a gap, since the adjacent antitoxin will sometimes be found on the same clone, neutralizing the toxic effect. Nevertheless, random fragments that contain the toxin but not the antitoxin will cause cell death and will be absent from the set of clones covering the genome (FIG. 1B).

Figure 5A:
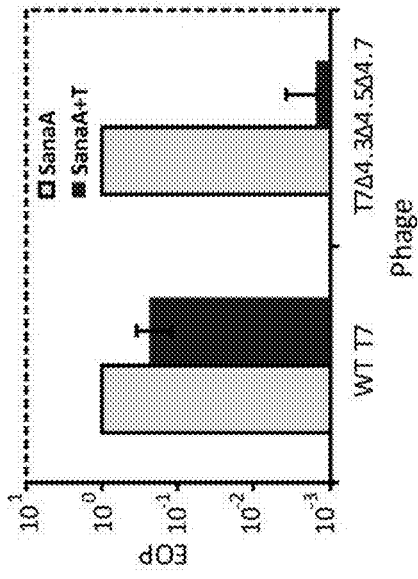
Figure 5B:
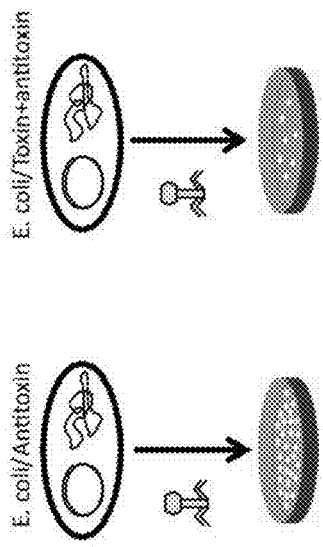

The present inventors took advantage of this typical biased cloning pattern to systematically detect toxin-antitoxin gene pairs within hundreds of microbial genomes. The analyses, while retrieving many known TA systems, also exposed 9 novel families of TA modules widespread in numerous bacterial species. These systems were subsequently experimentally validated as TA systems (FIGS. 3A-C). By engineering these systems into new bacteria, the present inventors showed that the toxin-antitoxin pairs can protect the engineered bacteria from phage attacks (FIGS. 5A-B). Such engineered bacteria can be utilized in the dairy industry, where phages cause serious annual losses, as well as in other industries that rely on large-scale bacterial fermentation for biotechnological production. Infection experiments with T7 phage and multiple T7 phage deletion mutants further showed that two of these new TA pairs provide resistance against T7, and also revealed a general anti-TA mechanism encoded by the phage (FIGS. 5C-F). Specifically, the present inventors discovered a phage peptide that inhibits toxin-antitoxin systems by inhibiting Lon protease. This peptide was further shown to inhibit the formation of bacterial persistence, thus active as a mechanism to reduce antibiotics resistance among bacteria.

Thus, according to one aspect of the present invention there is provided an isolated polypeptide comprising an amino acid sequence at least 90% homologous to a sequence selected from the group consisting of SEQ ID NOs: 2773-5544 and 11089-11094, wherein the polypeptide has antimicrobial activity.

The phrase "antimicrobial activity" as used herein, refers to an ability to suppress, control, inhibit or kill microorganisms, such as bacteria, archaea and fungi. Thus for example the antimicrobial activity may comprise bactericidal or bacteriostatic activity, or both.

According to a preferred embodiment, the isolated polypeptide comprises an amino acid sequence at least 60%, at least 70%, at least 80%, at least 90% or at least 95% homologous to SEQ ID NOs: 2773-5544.

According to a preferred embodiment, the isolated polypeptide comprises an amino acid sequence at least 60%, at least 70%, at least 80%, at least 90% or at least 95% homologous to SEQ ID NOs: 2773-3117.

According to a preferred embodiment, the isolated polypeptide comprises an amino acid sequence at least 60%, at least 70%, at least 80%, at least 90% or at least 95% homologous to SEQ ID NOs: 11089-11094. Such polypeptides are capable of inhibiting (decreasing activity by more than 10%, 20%, 30%, 40%, 50%, 60%, 70%, 80% or 90%) a member of the Lon protease family. Lon proteases are ATP-dependent serine peptidases belonging to the MEROPS peptidase family S16 (lon protease family, clan SF).

According to another aspect of the present invention there is provided an isolated polypeptide comprising an amino acid sequence at least 60%, at least 70%, at least 80%, at least 90% or at least 95% homologous to any one of SEQ ID NOs: 8317-11088, wherein the polypeptide protects a microbe from an activity of a toxin. Such polypeptides may be expressed in microbial populations thereby protecting the microbial population from the toxic effect of the toxin. Methods of expressing polypeptides are described herein below.

Polypeptides which protect microbes from an activity of a toxin (i.e. antitoxin) may have a Ki of $1 \times 10^{(-5)}$ M-$1 \times 10^{(-10)}$ M for the toxin.

According to another embodiment, the sequence selected from the group consisting of SEQ ID NOs. 8317-8661.

According to still another embodiment, the peptides of the present invention consist of the amino acid sequences selected from the group consisting of SEQ ID NOs: 2773-5544 or SEQ ID NO:8317-11088 or SEQ ID NOs: 11089-11094.

Homology may be determined using BlastP software of the National Center of Biotechnology Information (NCBI) using default parameters). The homolog may also refer to an ortholog, a deletion, insertion, or substitution variant, including an amino acid substitution.

The term "peptide" as used herein encompasses native peptides (either degradation products, synthetically synthesized peptides or recombinant peptides) and peptidomimetics (typically, synthetically synthesized peptides), as well as peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, backbone modifications, and residue modification. Methods for preparing peptidomimetic compounds are well known in the art and are specified, for example, in Quantitative Drug Design, C. A. Ramsden Gd., Chapter 17.2, F. Choplin Pergamon Press (1992), which is incorporated by reference as if fully set forth herein. Further details in this respect are provided hereinunder.

Peptide bonds (—CO—NH—) within the peptide may be substituted, for example, to by N-methylated amide bonds (—N(CH3)-CO—), ester bonds (—C(=O)—O—), ketomethylene bonds (—CO—CH2-), sulfinylmethylene bonds (—S(=O)—CH2-), α-aza bonds (—NH—N(R)—CO—), wherein R is any alkyl (e.g., methyl), amine bonds (—CH2-NH—), sulfide bonds (—CH2-S—), ethylene bonds (—CH2-CH2-), hydroxyethylene bonds (—CH(OH)—CH2-), thioamide bonds (—CS—NH—), olefinic double bonds (—CH=CH—), fluorinated olefinic double bonds (—CF=CH—), retro amide bonds (—NH—CO—), peptide derivatives (—N(R)—CH2-CO—), wherein R is the "normal" side chain, naturally present on the carbon atom.

These modifications can occur at any of the bonds along the peptide chain and even at several (2-3) bonds at the same time.

Natural aromatic amino acids, Trp, Tyr and Phe, may be substituted by non-natural aromatic amino acids such as 1,2, 3,4-tetrahydroisoquinoline-3-carboxylic acid (Tic), naphthylalanine, ring-methylated derivatives of Phe, halogenated derivatives of Phe or O-methyl-Tyr.

The peptides of some embodiments of the invention may also include one or more modified amino acids or one or more non-amino acid monomers (e.g. fatty acids, complex carbohydrates etc.).

The term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Tables 1 and 2 below list naturally occurring amino acids (Table 1), and non-conventional or modified amino acids (e.g., synthetic, Table 2) which can be used with some embodiments of the invention.

TABLE 1

| Amino Acid | Three-Letter Abbreviation | One-letter Symbol |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic Acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |
| Any amino acid as above | Xaa | X |

TABLE 2

| Non-conventional amino acid | Code | Non-conventional amino acid | Code |
|---|---|---|---|
| ornithine | Orn | hydroxyproline | Hyp |
| α-aminobutyric acid | Abu | aminonorbornyl-carboxylate | Norb |
| D-alanine | Dala | aminocyclopropane-carboxylate | Cpro |
| D-arginine | Darg | N-(3-guanidinopropyl)glycine | Narg |
| D-asparagine | Dasn | N-(carbamylmethyl)glycine | Nasn |
| D-aspartic acid | Dasp | N-(carboxymethyl)glycine | Nasp |
| D-cysteine | Dcys | N-(thiomethyl)glycine | Ncys |
| D-glutamine | Dgln | N-(2-carbamylethyl)glycine | Ngln |
| D-glutamic acid | Dglu | N-(2-carboxyethyl)glycine | Nglu |
| D-histidine | Dhis | N-(imidazolylethyl)glycine | Nhis |
| D-isoleucine | Dile | N-(1-methylpropyl)glycine | Nile |
| D-leucine | Dleu | N-(2-methylpropyl)glycine | Nleu |
| D-lysine | Dlys | N-(4-aminobutyl)glycine | Nlys |
| D-methionine | Dmet | N-(2-methylthioethyl)glycine | Nmet |
| D-ornithine | Dorn | N-(3-aminopropyl)glycine | Norn |
| D-phenylalanine | Dphe | N-benzylglycine | Nphe |
| D-proline | Dpro | N-(hydroxymethyl)glycine | Nser |
| D-serine | Dser | N-(1-hydroxyethyl)glycine | Nthr |
| D-threonine | Dthr | N-(3-indolylethyl) glycine | Nhtrp |
| D-tryptophan | Dtrp | N-(p-hydroxyphenyl)glycine | Ntyr |
| D-tyrosine | Dtyr | N-(1-methylethyl)glycine | Nval |
| D-valine | Dval | N-methylglycine | Nmgly |
| D-N-methylalanine | Dnmala | L-N-methylalanine | Nmala |
| D-N-methylarginine | Dnmarg | L-N-methylarginine | Nmarg |
| D-N-methylasparagine | Dnmasn | L-N-methylasparagine | Nmasn |
| D-N-methylasparatate | Dnmasp | L-N-methylaspartic acid | Nmasp |
| D-N-methylcysteine | Dnmcys | L-N-methylcysteine | Nmcys |
| D-N-methylglutamine | Dnmgln | L-N-methylglutamine | Nmgln |
| D-N-methylglutamate | Dnmglu | L-N-methylglutamic acid | Nmglu |
| D-N-methylhistidine | Dnmhis | L-N-methylhistidine | Nmhis |
| D-N-methylisoleucine | Dnmile | L-N-methylisolleucine | Nmile |
| D-N-methylleucine | Dnmleu | L-N-methylleucine | Nmleu |
| D-N-methyllysine | Dnmlys | L-N-methyllysine | Nmlys |
| D-N-methylmethionine | Dnmmet | L-N-methylmethionine | Nmmet |
| D-N-methylornithine | Dnmorn | L-N-methylornithine | Nmorn |
| D-N-methylphenylalanine | Dnmphe | L-N-methylphenylalanine | Nmphe |
| D-N-methylproline | Dnmpro | L-N-methylproline | Nmpro |
| D-N-methylserine | Dnmser | L-N-methylserine | Nmser |
| D-N-methylthreonine | Dnmthr | L-N-methylthreonine | Nmthr |
| D-N-methyltryptophan | Dnmtrp | L-N-methyltryptophan | Nmtrp |
| D-N-methyltyrosine | Dnmtyr | L-N-methyltyrosine | Nmtyr |
| D-N-methylvaline | Dnmval | L-N-methylvaline | Nmval |
| L-norleucine | Nle | L-N-methylnorleucine | Nmnle |

TABLE 2-continued

| Non-conventional amino acid | Code | Non-conventional amino acid | Code |
|---|---|---|---|
| L-norvaline | Nva | L-N-methylnorvaline | Nmnva |
| L-ethylglycine | Etg | L-N-methyl-ethylglycine | Nmetg |
| L-t-butylglycine | Tbug | L-N-methyl-t-butylglycine | Nmtbug |
| L-homophenylalanine | Hphe | L-N-methyl-homophenylalanine | Nmhphe |
| α-naphthylalanine | Anap | N-methyl-α-naphthylalanine | Nmanap |
| penicillamine | Pen | N-methylpenicillamine | Nmpen |
| γ-aminobutyric acid | Gabu | N-methyl-γ-aminobutyrate | Nmgabu |
| cyclohexylalanine | Chexa | N-methyl-cyclohexylalanine | Nmchexa |
| cyclopentylalanine | Cpen | N-methyl-cyclopentylalanine | Nmcpen |
| α-amino-α-methylbutyrate | Aabu | N-methyl-α-amino-α-methylbutyrate | Nmaabu |
| α-aminoisobutyric acid | Aib | N-methyl-α-aminoisobutyrate | Nmaib |
| D-α-methylarginine | Dmarg | L-α-methylarginine | Marg |
| D-α-methylasparagine | Dmasn | L-α-methylasparagine | Masn |
| D-α-methylaspartate | Dmasp | L-α-methylaspartate | Masp |
| D-α-methylcysteine | Dmcys | L-α-methylcysteine | Mcys |
| D-α-methylglutamine | Dmgln | L-α-methylglutamine | Mgln |
| D-α-methyl glutamic acid | Dmglu | L-α-methylglutamate | Mglu |
| D-α-methylhistidine | Dmhis | L-α-methylhistidine | Mhis |
| D-α-methylisoleucine | Dmile | L-α-methylisoleucine | Mile |
| D-α-methylleucine | Dmleu | L-α-methylleucine | Mleu |
| D-α-methyllysine | Dmlys | L-α-methyllysine | Mlys |
| D-α-methylmethionine | Dmmet | L-α-methylmethionine | Mmet |
| D-α-methylornithine | Dmorn | L-α-methylornithine | Morn |
| D-α-methylphenylalanine | Dmphe | L-α-methylphenylalanine | Mphe |
| D-α-methylproline | Dmpro | L-α-methylproline | Mpro |
| D-α-methylserine | Dmser | L-α-methylserine | Mser |
| D-α-methylthreonine | Dmthr | L-α-methylthreonine | Mthr |
| D-α-methyltryptophan | Dmtrp | L-α-methyltryptophan | Mtrp |
| D-α-methyltyrosine | Dmtyr | L-α-methyltyrosine | Mtyr |
| D-α-methylvaline | Dmval | L-α-methylvaline | Mval |
| N-cyclobutylglycine | Ncbut | L-α-methylnorvaline | Mnva |
| N-cycloheptylglycine | Nchep | L-α-methylethylglycine | Metg |
| N-cyclohexylglycine | Nchex | L-α-methyl-t-butylglycine | Mtbug |
| N-cyclodecylglycine | Ncdec | L-α-methyl-homophenylalanine | Mhphe |
| N-cyclododecylglycine | Ncdod | α-methyl-α-naphthylalanine | Manap |
| N-cyclooctylglycine | Ncoct | α-methylpenicillamine | Mpen |
| N-cyclopropylglycine | Ncpro | α-methyl-γ-aminobutyrate | Mgabu |
| N-cycloundecylglycine | Ncund | α-methyl-cyclohexylalanine | Mchexa |
| N-(2-aminoethyl)glycine | Naeg | α-methyl-cyclopentylalanine | Mcpen |
| N-(2,2-diphenylethyl)glycine | Nbhm | N-(N-(2,2-diphenylethyl)carbamylmethyl-glycine | Nnbhm |
| N-(3,3-diphenylpropyl)glycine | Nbhe | N-(N-(3,3-diphenylpropyl)carbamylmethyl-glycine | Nnbhe |
| 1-carboxy-1-(2,2-diphenyl ethylamino)cyclopropane | Nmbc | 1,2,3,4-tetrahydroisoquinoline-3-carboxylic acid | Tic |
| phosphoserine | pSer | phosphothreonine | pThr |
| phosphotyrosine | pTyr | O-methyl-tyrosine | |
| 2-aminoadipic acid | | hydroxylysine | |

The peptides of some embodiments of the invention are preferably utilized in a linear form, although it will be appreciated that in cases where cyclicization does not severely interfere with peptide characteristics, cyclic forms of the peptide can also be utilized.

Since the present peptides are preferably utilized in therapeutics or diagnostics which require the peptides to be in soluble form, the peptides of some embodiments of the invention preferably include one or more non-natural or natural polar amino acids, including but not limited to serine and threonine which are capable of increasing peptide solubility due to their hydroxyl-containing side chain.

The amino acids of the peptides of the present invention may be substituted either conservatively or non-conservatively.

The term "conservative substitution" as used herein, refers to the replacement of an amino acid present in the native sequence in the peptide with a naturally or non-naturally occurring amino or a peptidomimetics having similar steric properties. Where the side-chain of the native amino acid to be replaced is either polar or hydrophobic, the conservative substitution should be with a naturally occurring amino acid, a non-naturally occurring amino acid or with a peptidomimetic moiety which is also polar or hydrophobic (in addition to having the same steric properties as the side-chain of the replaced amino acid).

As naturally occurring amino acids are typically grouped according to their properties, conservative substitutions by naturally occurring amino acids can be easily determined bearing in mind the fact that in accordance with the invention replacement of charged amino acids by sterically similar non-charged amino acids are considered as conservative substitutions.

For producing conservative substitutions by non-naturally occurring amino acids it is also possible to use amino acid analogs (synthetic amino acids) well known in the art. A peptidomimetic of the naturally occurring amino acid is well documented in the literature known to the skilled practitioner.

When affecting conservative substitutions the substituting amino acid should have the same or a similar functional group in the side chain as the original amino acid.

The phrase "non-conservative substitutions" as used herein refers to replacement of the amino acid as present in the parent sequence by another naturally or non-naturally occurring amino acid, having different electrochemical and/or steric properties. Thus, the side chain of the substituting amino acid can be significantly larger (or smaller) than the side chain of the native amino acid being substituted and/or can have functional groups with significantly different electronic properties than the amino acid being substituted. Examples of non-conservative substitutions of this type include the substitution of phenylalanine or cyclohexylmethyl glycine for alanine, isoleucine for glycine, or —NH—CH[(—CH$_2$)$_5$—COOH]—CO— for aspartic acid. Those non-conservative substitutions which fall under the scope of the present invention are those which still constitute a peptide having anti-bacterial properties.

The N and C termini of the peptides of the present invention may be protected by function groups. Suitable functional groups are described in Green and Wuts, "Protecting Groups in Organic Synthesis", John Wiley and Sons, Chapters 5 and 7, 1991, the teachings of which are incorporated herein by reference. Preferred protecting groups are those that facilitate transport of the compound attached thereto into a cell, for example, by reducing the hydrophilicity and increasing the lipophilicity of the compounds.

The peptides of the present invention may be attached (either covalently or non-covalently) to a penetrating agent.

As used herein the phrase "penetrating agent" refers to an agent which enhances translocation of any of the attached peptide across a cell membrane.

According to one embodiment, the penetrating agent is a peptide and is attached to the antimicrobial peptide (either directly or non-directly) via a peptide bond.

Typically, peptide penetrating agents have an amino acid composition containing either a high relative abundance of positively charged amino acids such as lysine or arginine, or have sequences that contain an alternating pattern of polar/charged amino acids and non-polar, hydrophobic amino acids.

The peptides of the present invention can be biochemically synthesized such as by using standard solid phase techniques. These methods include exclusive solid phase synthesis, partial solid phase synthesis methods, fragment condensation, to classical solution synthesis. Solid phase polypeptide synthesis procedures are well known in the art and further described by John Morrow Stewart and Janis Dillaha Young, Solid Phase Polypeptide Syntheses (2nd Ed., Pierce Chemical Company, 1984).

Large scale peptide synthesis is described by Andersson Biopolymers 2000; 55(3):227-50.

Synthetic peptides can be purified by preparative high performance liquid chromatography [Creighton T. (1983) Proteins, structures and molecular principles. WH Freeman and Co. N.Y.] and the composition of which can be confirmed via amino acid sequencing.

Recombinant techniques may also be used to generate the peptides of the present invention. To produce a peptide of the present invention using recombinant technology, a polynucleotide encoding the peptide of the present invention is ligated into a nucleic acid expression vector, which comprises the polynucleotide sequence under the transcriptional control of a cis-regulatory sequence (e.g., promoter sequence) suitable for directing constitutive, tissue specific or inducible transcription of the polypeptides of the present invention in the host cells.

A variety of prokaryotic or eukaryotic cells can be used as host-expression systems to express the polypeptides of some embodiments of the invention. These include, but are not limited to; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of some embodiments of the invention.

Examples of bacterial constructs include the pET series of *E. coli* expression vectors [Studier et al. (1990) Methods in Enzymol. 185:60-89).

Other than containing the necessary elements for the transcription and translation of the inserted coding sequence, the expression construct of some embodiments of the invention can also include sequences engineered to enhance stability, production, purification, yield or toxicity of the expressed antimicrobial peptide. For example, the expression of a fusion protein or a cleavable fusion protein to comprising the antimicrobial peptides of some embodiments of the invention and a heterologous protein can be engineered. Such a fusion protein can be designed so that the fusion protein can be readily isolated by affinity chromatography; e.g., by immobilization on a column specific for the heterologous protein. Where a cleavage site is engineered between the antimicrobial and the heterologous protein, the antimicrobial can be released from the chromatographic column by treatment with an appropriate enzyme or agent that disrupts the cleavage site [e.g., see Booth et al. (1988) Immunol. Lett. 19:65-70; and Gardella et al., (1990) J. Biol. Chem. 265:15854-15859].

Recovery of the recombinant peptide is effected following an appropriate time in culture. The phrase "recovering the recombinant peptide" refers to collecting the whole fermentation medium containing the polypeptide and need not imply additional steps of separation or purification. Notwithstanding the above, polypeptides of some embodiments of the invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

In addition to being synthesizable in host cells, the peptides of the present invention can also be synthesized using in vitro expression systems. These methods are well known in the art and the components of the system are commercially available.

The peptides disclosed herein, which comprise anti-microbial properties may be used to kill microbes.

Thus, according to another aspect of the present invention there is provided a method of killing a microbe, the method comprising contacting the microbe with the isolated peptides comprising an amino acid sequence selected from the group consisting of SEQ ID NOs: 2773-5544 and 11089-11094.

According to a particular embodiment, the peptide used for killing a microbe comprises the sequence 11089-11094.

The microbe may be for example a gram-positive or gram negative bacteria.

The term "Gram-positive bacteria" as used herein refers to bacteria characterized by having as part of their cell wall structure peptidoglycan as well as polysaccharides and/or teichoic acids and are characterized by their blue-violet color reaction in the Gram-staining procedure. Representative Gram-positive bacteria include: *Actinomyces* spp., *Bacillus anthracis*, *Bifidobacterium* spp., *Clostridium botulinum*, *Clostridium perfringens*, *Clostridium* spp., *Clostridium tetani*, *Corynebacterium diphtheriae*, *Corynebacterium jeikeium*, *Enterococcus faecalis*, *Enterococcus faecium*, *Erysipelothrix rhusiopathiae*, *Eubacterium* spp., *Gardnerella vaginalis*, *Gemella morbillorum*, *Leuconostoc* spp., *Mycobacterium abcessus*, *Mycobacterium avium complex*, *Mycobacterium chelonae*, *Mycobacterium fortuitum*, *Mycobacterium haemophilium*, *Mycobacterium kansasii*, *Mycobacterium leprae*, *Mycobacterium marinum*, *Mycobacterium scrofulaceum*, *Mycobacterium smegmatis*, *Mycobacterium terrae*, *Mycobacterium tuberculosis*, *Mycobacterium ulcerans*, *Nocardia* spp., *Peptococcus niger*, *Peptostreptococcus* spp., *Proprionibacterium* spp., *Staphylococcus aureus*, *Staphylococcus auricularis*, *Staphylococcus capitis*, *Staphylococcus cohnii*, *Staphylococcus epidermidis*, *Staphylococcus haemolyticus*, *Staphylococcus hominis*, *Staphylococcus lugdanensis*, *Staphylococcus saccharolyticus*, *Staphylococcus saprophyticus*, *Staphylococcus schleiferi*, *Staphylococcus similans*, *Staphylococcus warneri*, *Staphylococcus xylosus*, *Streptococcus agalactiae* (group B *streptococcus*), *Streptococcus anginosus*, *Streptococcus bovis*, *Streptococcus canis*, *Streptococcus equi*, *Streptococcus milleri*, *Streptococcus mitior*, *Streptococcus mutans*, *Streptococcus pneumoniae*, *Streptococcus pyogenes* (group A *streptococcus*), *Streptococcus salivarius*, *Streptococcus sanguis*.

The term "Gram-negative bacteria" as used herein refer to bacteria characterized by the presence of a double membrane surrounding each bacterial cell. Representative Gram-negative bacteria include *Acinetobacter calcoaceticus*, *Actinobacillus actinomycetemcomitans*, *Aeromonas hydrophila*, *Alcaligenes xylosoxidans*, *Bacteroides*, *Bacteroides fragilis*, *Bartonella bacilliformis*, *Bordetella* spp., *Borrelia burgdorferi*, *Branhamella catarrhalis*, *Brucella* spp., *Campylobacter* spp., *Chalmydia pneumoniae*, *Chlamydia psittaci*, *Chlamydia trachomatis*, to *Chromobacterium violaceum*, *Citrobacter* spp., *Eikenella corrodens*, *Enterobacter aerogenes*, *Escherichia coli*, *Flavobacterium meningosepticum*, *Fusobacterium* spp., *Haemophilus influenzae*, *Haemophilus* spp., *Helicobacter pylori*, *Klebsiella* spp., *Legionella* spp., *Leptospira* spp., *Moraxella catarrhalis*, *Morganella morganii*, *Mycoplasma pneumoniae*, *Neisseria gonorrhoeae*, *Neisseria meningitidis*, *Pasteurella multocida*, *Plesiomonas shigelloides*, *Prevotella* spp., *Proteus* spp., *Providencia rettgeri*, *Pseudomonas aeruginosa*, *Pseudomonas* spp., *Rickettsia prowazekii*, *Rickettsia rickettsii*, *Rochalimaea* spp., *Salmonella* spp., *Salmonella typhi*, *Serratia marcescens*, *Shigella* spp., *Treponema carateum*, *Treponema pallidum*, *Treponema pallidum endemicum*, *Treponema pertenue*, *Veillonella* spp., *Vibrio cholerae*, *Vibrio vulnificus*, *Yersinia enterocolitica*, *Yersinia pestis*.

As used herein the term "contacting" refers to the positioning of the peptides of the present invention such that they are in direct or indirect contact with the bacterial cells. Thus, the present invention contemplates both applying the peptides of the present invention to a desirable surface and/or directly to the bacterial cells.

According to another embodiment the surface is comprised in a biological tissue, such as for example, mammalian tissues e.g. the skin.

It will be appreciated that the microbes may be comprised inside a particular organism, (e.g. intracellularly or extracellularly) for example inside a mammalian body or inside a plant. In this case, the contacting may be effected by administering the peptides per se or by transfecting the cells of the organism with a nucleic acid construct which comprises a nucleic acid sequence which encodes the peptides of the present invention.

Thus, the present invention contemplates polynucleotide sequences encoding the antimicrobial polypeptides disclosed herein. Such polynucleotide sequences are set forth in SEQ ID NOs: 1-2772.

Such a nucleic acid construct includes a promoter sequence for directing transcription of the polynucleotide sequence in the cell in a constitutive or inducible manner.

Constitutive promoters suitable for use with some embodiments of the invention are promoter sequences which are active under most environmental conditions and most types of cells such as the cytomegalovirus (CMV) and Rous sarcoma virus (RSV). Inducible promoters suitable for use with some embodiments of the invention include for example the tetracycline-inducible promoter (Zabala M, et al., Cancer Res. 2004, 64(8): 2799-804) or pathogen-inducible promoters. Such promoters include those from pathogenesis-related proteins (PR proteins), which are induced following infection by a pathogen.

The nucleic acid construct (also referred to herein as an "expression vector") of some embodiments of the invention includes additional sequences which render this vector suitable for replication and integration in prokaryotes, eukaryotes, or preferably both (e.g., shuttle vectors). In addition, a typical cloning vectors may also contain a transcription and translation initiation sequence, transcription and translation terminator and a polyadenylation signal. By way of example, such constructs will typically include a 5' LTR, a tRNA binding site, a packaging signal, an origin of second-strand DNA synthesis, and a 3' LTR or a portion thereof.

The nucleic acid construct of some embodiments of the invention typically includes a signal sequence for secretion of the peptide from a host cell in which it is placed. Preferably the signal sequence for this purpose is a mammalian signal sequence or the signal sequence of the polypeptide variants of some embodiments of the invention.

The nucleic acid constructs described herein will have a plurality of restriction sites for insertion of the sequence of the invention so that it is under transcriptional regulation of the regulatory regions. Selectable marker genes that ensure maintenance of the vector in the cell can also be included in the expression vector. Preferred selectable markers include those which confer resistance to drugs such as ampicillin, chloramphenicol, erythromycin, kanamycin (neomycin), and tetracycline (Davies et al. (1978) Annu. Rev. Microbiol. 32:469). Selectable markers can also allow a cell to grow on minimal medium, or in the presence of toxic metabolite and can include biosynthetic genes, such as those in the histidine, tryptophan, and leucine biosynthetic pathways.

Preferably, the promoter utilized by the nucleic acid construct of some embodiments of the invention is active in the specific cell population transformed. Examples of cell type-specific and/or tissue-specific promoters include promoters such as albumin that is liver specific [Pinkert et al., (1987) Genes Dev. 1:268-277], to lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166).

In the construction of the expression vector, the promoter is preferably positioned approximately the same distance from the heterologous transcription start site as it is from the transcription start site in its natural setting. As is known in the art, however, some variation in this distance can be accommodated without loss of promoter function.

Recombinant viral vectors are useful for in vivo expression of the antimicrobial peptides of the invention since they offer advantages such as lateral infection and targeting specificity. Lateral infection is inherent in the life cycle of, for example, retrovirus and is the process by which a single infected cell produces many progeny virions that bud off and infect neighboring cells. The result is that a large area becomes rapidly infected, most of which was not initially infected by the original viral particles. This is in contrast to vertical-type of infection in which the infectious agent spreads only through daughter progeny. Viral vectors can also be produced that are unable to spread laterally. This characteristic can be useful if the desired purpose is to introduce a specified gene into only a localized number of targeted cells.

Various methods can be used to introduce the expression vector of some embodiments of the invention into cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et at. [Biotechniques 4 (6): 504-512, 1986] and include, for example, stable or transient transfection, lipofection, to electroporation and infection with recombinant viral vectors. In addition, see U.S. Pat. Nos. 5,464,764 and 5,487,992 for positive-negative selection methods.

Exemplary methods of introducing expression vectors into bacterial cells include for example conventional transformation or transfection techniques, or by phage-mediated infection. As used herein, the terms "transformation," "transduction," "conjugation," and "protoplast fusion" are intended to refer to a variety of art-recognized techniques for introducing foreign nucleic acid (e.g., DNA) into a cell, including calcium phosphate or calcium chloride co-precipitation, DEAE-dextran-mediated transfection, lipofection, or electroporation.

Introduction of nucleic acids by viral infection offers several advantages over other methods such as lipofection and electroporation, since higher transfection efficiency can be obtained due to the infectious nature of viruses.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of some embodiments of the invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Where appropriate, the polynucleotides may be optimized for increased expression in the transformed organism. For example, the polynucleotides can be synthesized using preferred codons for improved expression. For optimal expression in plants or fungi, the pre- and propeptide sequences may be needed. The propeptide segments may play a role in aiding correct peptide folding.

Since the polypeptides comprising an amino acid sequence selected from the group consisting of SEQ ID NOs: 2773-5544 and 11089-11094 have antimicrobial activity, the present invention contemplates use thereof for treating infection in a mammalian subject.

According to one embodiment, the peptides are used to treat a topical infection (i.e. infection of the skin) and are provided in a topical formulation.

According to another embodiment, the peptides are used to treat an infection inside the body. In this case, the peptides (or polynucleotides encoding same) may be provided ex vivo or in vivo.

Accordingly, the present invention contemplates contacting cells with the polypeptides comprising an amino acid sequence selected from the group consisting of SEQ ID NOs: 2773-5544 and 11089-11094 (or with expression constructs that encode the peptides) per se or as part of a pharmaceutical composition.

According to a particular embodiment, the peptide used in the pharmaceutical composition comprises the sequence 11089-11094.

The peptides may be used alone or together with additional antimicrobial agents (e.g. antibiotic and/or additional antimicrobial peptides).

Exemplary antibiotics include, but are not limited to aminoglycoside antibiotics, cephalosporins, quinolone antibiotics, macrolide antibiotics, penicillins, sulfonamides, tetracyclines and carbapenems. It will be appreciated that since the peptides of embodiments of this invention enhance the antibacterial effect of the antibiotic, doses of the antibiotic may be lower (e.g. 20% lower, 30% lower, 40% lower, 50% lower, 60% lower, 70% lower, 80% lower or even 90% lower than those currently in use.

The pharmaceutical compositions of the present invention are administered to a subject in need thereof in order to prevent or treat a bacterial infection.

As used herein, the term "subject in need thereof" refers to a mammal, preferably a human subject.

As used herein, the term "treating" refers to curing, reversing, attenuating, alleviating, minimizing, suppressing or halting the deleterious effects of a pathogen infection.

The phrase "pharmaceutical composition", as used herein refers to a preparation of one or more of the active ingredients described herein with other chemical components such as physiologically suitable carriers and excipients. The purpose of a pharmaceutical composition is to facilitate administration of a compound to an organism.

As used herein the term "active ingredient" refers to peptides of the present invention accountable for the intended biological effect. It will be appreciated that a polynucleotide encoding a peptide of the present invention may be administered directly into a subject (as is, or part of a pharmaceutical composition) where it is translated in the target cells i.e. by gene therapy. Accordingly, the phrase "active ingredient" also includes such polynucleotides.

Hereinafter, the phrases "physiologically acceptable carrier" and "pharmaceutically acceptable carrier," which may be used interchangeably, refer to a carrier or a diluent that does not cause significant irritation to an organism and does not abrogate the biological activity and properties of the administered compound. An adjuvant is included under these phrases.

Herein, the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils, and polyethylene glycols.

Techniques for formulation and administration of drugs may be found in the latest edition of "Remington's Pharmaceutical Sciences," Mack Publishing Co., Easton, Pa., which is herein fully incorporated by reference and are further described herein below.

It will be appreciated that the peptides of the present invention can be provided to the individual with additional active agents to achieve an improved therapeutic effect as compared to treatment with each agent by itself.

Exemplary additional agents include antibiotics (e.g. rifampicin, chloramphenicol and spectinomycin).

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the invention may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, to such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions, which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The preparations described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain to formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The preparation of the present invention may also be formulated in rectal compositions such as suppositories or retention enemas, using, e.g., conventional suppository bases such as cocoa butter or other glycerides.

The preparation of the present invention may also be formulated as a topical composition, such as a spray, a cream, a mouthwash, a wipe, a foam, a soap, an oil, a solution, a lotion, an ointment, a paste and a gel.

Pharmaceutical compositions suitable for use in context of the present invention include compositions wherein the active ingredients are contained in an amount effective to achieve the intended purpose. More specifically, a therapeutically effective amount means an amount of active ingredients effective to prevent, alleviate or ameliorate symptoms of disease or prolong the survival of the subject being treated.

Determination of a therapeutically effective amount is well within the capability of those skilled in the art.

For any preparation used in the methods of the invention, the therapeutically effective amount or dose can be estimated initially from in vitro assays. For example, a dose can be formulated in animal models and such information can be used to more accurately determine useful doses in humans.

Toxicity and therapeutic efficacy of the active ingredients described herein can to be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition. [See e.g., Fingl, et al., (1975) "The Pharmacological Basis of Therapeutics", Ch. 1 p. 1].

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc.

As mentioned, the peptides described herein which comprise antitoxin activity may be expressed in microbial populations, thereby protecting the microbial population from the toxic effect of a toxin.

Thus, the present invention further contemplates polynucleotide sequences encoding the antitoxin polypeptides disclosed herein. Such polynucleotide sequences are set forth in SEQ ID NOs: 5548-8316.

The present inventors have further discovered novel toxin antitoxin pairs that may be expressed in bacterial populations. Expression therein may serve to protect the bacterial population from the lytic effect of a bacteriophage (i.e. impart resistance to the bacteriophage).

Such pairs are summarized in Table 3 herein below.

TABLE 3

| Toxin polypeptide sequences | | Antitoxin polypeptide sequences | |
|---|---|---|---|
| SEQ ID NO: | designation | SEQ ID NO: | designation |
| 2773 | >Toxin: Lferr_1303 | 8317 | >Antitoxin: Lferr_1302 |
| 2774 | >Toxin: Adeg_2177 | 8318 | >Antitoxin: Adeg_2178 |
| 2775 | >Toxin: BLD_0338 | 8319 | >Antitoxin: BLD_0339 |
| 2776 | >Toxin: HMPREF0175_1783 | 8320 | >Antitoxin: HMPREF0175_1782 |
| 2777 | >Toxin: BIL_08340 | 8321 | >Antitoxin: BIL_08350 |
| 2778 | >Toxin: BL1460 | 8322 | >Antitoxin: BL1461 |
| 2779 | >Toxin: HMPREF0177_01212 | 8323 | >Antitoxin: HMPREF0177_01213 |
| 2780 | >Toxin: CJA_3634 | 8324 | >Antitoxin: CJA_3633 |
| 2781 | >Toxin: MldDRAFT_1473 | 8325 | >Antitoxin: MldDRAFT_1471 |
| 2782 | >Toxin: MldDRAFT_0420 | 8326 | >Antitoxin: MldDRAFT_0418 |
| 2783 | >Toxin: MldDRAFT_4398 | 8327 | >Antitoxin: MldDRAFT_4397 |
| 2784 | >Toxin: MldDRAFT_1876 | 8328 | >Antitoxin: MldDRAFT_1875 |
| 2785 | >Toxin: DaAHT2_0326 | 8329 | >Antitoxin: DaAHT2_0325 |
| 2786 | >Toxin: Elen_0846 | 8330 | >Antitoxin: Elen_0847 |
| 2787 | >Toxin: HCAN_1210 | 8331 | >Antitoxin: HCAN_1209 |
| 2788 | >Toxin: MELB17_24172 | 8332 | >Antitoxin: MELB17_24167 |
| 2789 | >Toxin: Mmwyl1_3205 | 8333 | >Antitoxin: Mmwyl1_3204 |
| 2790 | >Toxin: Pat9b_4701 | 8334 | >Antitoxin: Pat9b_4700 |
| 2791 | >Toxin: HMPREF06201504_1504 | 8335 | >Antitoxin: HMPREF0620_1505 |
| 2792 | >Toxin: Pecwa_0953 | 8336 | >Antitoxin: Pecwa_0952 |
| 2793 | >Toxin: plu0453 | 8337 | >Antitoxin: plu0454 |
| 2794 | >Toxin: plu3932 | 8338 | >Antitoxin: plu3931 |
| 2795 | >Toxin: HMPREF0693_2530 | 8339 | >Antitoxin: HMPREF0693_2531 |
| 2796 | >Toxin: PMI2316 | 8340 | >Antitoxin: PMI2317 |
| 2797 | >Toxin: PMI2493 | 8341 | >Antitoxin: PMI2492 |
| 2798 | >Toxin: Sden_0300 | 8342 | >Antitoxin: Sden_0299 |
| 2799 | >Toxin: Veis_2844 | 8343 | >Antitoxin: Veis_2845 |
| 2800 | >Toxin: XNC1_4222 | 8344 | >Antitoxin: XNC1_4221 |
| 2801 | >Toxin: BloniC5_010100004089 | 8345 | >Antitoxin: BloniC5_010100004094 |
| 2802 | >Toxin: BloniC5_010100007713 | 8346 | >Antitoxin: BloniC5_010100007718 |
| 2803 | >Toxin: HcanM9_010100006460 | 8347 | >Antitoxin: PROVRUST_02882 |
| 2804 | >Toxin: PROVRUST_02881 | 8348 | >Antitoxin: HcanM9_010100006455 |
| 2805 | >Toxin: AcdelDRAFT_0026 | 8349 | >Antitoxin: AcdelDRAFT_0025 |
| 2806 | >Toxin: Ajs_0911 | 8350 | >Antitoxin: Ajs_0912 |
| 2807 | >Toxin: A20C1_10775 | 8351 | >Antitoxin: A20C1_10770 |
| 2808 | >Toxin: Astex_0661 | 8352 | >Antitoxin: Astex_0662 |
| 2809 | >Toxin: bll1927 | 8353 | >Antitoxin: bll1928 |
| 2810 | >Toxin: HMPREF0183_2010 | 8354 | >Antitoxin: HMPREF0183_2009 |
| 2811 | >Toxin: CAP2UW1_0236 | 8355 | >Antitoxin: CAP2UW1_0235 |
| 2812 | >Toxin: pc2001 | 8356 | >Antitoxin: pc2002 |
| 2813 | >Toxin: Clim_1931 | 8357 | >Antitoxin: Clim_1932 |

TABLE 3-continued

| | Toxin polypeptide sequences | | Antitoxin polypeptide sequences |
|---|---|---|---|
| SEQ ID NO: | designation | SEQ ID NO: | designation |
| 2814 | >Toxin: Cpha266__0654 | 8358 | >Antitoxin: Cpha266__0653 |
| 2815 | >Toxin: Cvib__0668 | 8359 | >Antitoxin: Cvib__0667 |
| 2816 | >Toxin: Cwoe__5578 | 8360 | >Antitoxin: Cwoe__5577 |
| 2817 | >Toxin: cgR__0545 | 8361 | >Antitoxin: cgR__0546 |
| 2818 | >Toxin: Daci__0082 | 8362 | >Antitoxin: Daci__0083 |
| 2819 | >Toxin: Dole__3139 | 8363 | >Antitoxin: Dole__3138 |
| 2820 | >Toxin: Dbac__1303 | 8364 | >Antitoxin: Dbac__1304 |
| 2821 | >Toxin: Elen__3086 | 8365 | >Antitoxin: Elen__3085 |
| 2822 | >Toxin: HMPREF1023__01420 | 8366 | >Antitoxin: HMPREF1023__01419 |
| 2823 | >Toxin: Smed__6434 | 8367 | >Antitoxin: Smed__6433 |
| 2824 | >Toxin: Smed__5454 | 8368 | >Antitoxin: Smed__5453 |
| 2825 | >Toxin: Smed__6434 | 8369 | >Antitoxin: Smed__6433 |
| 2826 | >Toxin: GobsU__010100024456 | 8370 | >Antitoxin: GobsU__010100024461 |
| 2827 | >Toxin: gsr2662 | 8371 | >Antitoxin: glr2661 |
| 2828 | >Toxin: Gbro__4918 | 8372 | >Antitoxin: Gbro__4917 |
| 2829 | >Toxin: GPA__34760 | 8373 | >Antitoxin: GPA__34770 |
| 2830 | >Toxin: Intca__2903 | 8374 | >Antitoxin: Intca__2902 |
| 2831 | >Toxin: LLO__0649 | 8375 | >Antitoxin: LLO__0650 |
| 2832 | >Toxin: LLO__2898 | 8376 | >Antitoxin: LLO__2899 |
| 2833 | >Toxin: LNTAR__09414 | 8377 | >Antitoxin: LNTAR__09419 |
| 2834 | >Toxin: LNTAR__09681 | 8378 | >Antitoxin: LNTAR__09686 |
| 2835 | >Toxin: SPV1__04688 | 8379 | >Antitoxin: SPV1__04693 |
| 2836 | >Toxin: MexAM1__META2p1274 | 8380 | >Antitoxin: MexAM1__META2p1275 |
| 2837 | >Toxin: HMPREF0580__0585 | 8381 | >Antitoxin: HMPREF0580__0584 |
| 2838 | >Toxin: HMPREF0577__2238 | 8382 | >Antitoxin: HMPREF0577__2237 |
| 2839 | >Toxin: HMPREF9278__0956 | 8383 | >Antitoxin: HMPREF9278__0957 |
| 2840 | >Toxin: MLBr__02284 | 8384 | >Antitoxin: MLBr__02283 |
| 2841 | >Toxin: ML2284 | 8385 | >Antitoxin: ML2283 |
| 2842 | >Toxin: MMAR__3595 | 8386 | >Antitoxin: MMAR__3594 |
| 2843 | >Toxin: Namu__4516 | 8387 | >Antitoxin: Namu__4515 |
| 2844 | >Toxin: Nhal__3749 | 8388 | >Antitoxin: Nhal__3750 |
| 2845 | >Toxin: Olsu__1425 | 8389 | >Antitoxin: Olsu__1426 |
| 2846 | >Toxin: Plut__0508 | 8390 | >Antitoxin: Plut__0507 |
| 2847 | >Toxin: Ppha__0787 | 8391 | >Antitoxin: Ppha__0786 |
| 2848 | >Toxin: PHZ__p0168 | 8392 | >Antitoxin: PHZ__p0169 |
| 2849 | >Toxin: Pnap__4573 | 8393 | >Antitoxin: Pnap__4574 |
| 2850 | >Toxin: Bpro__1527 | 8394 | >Antitoxin: Bpro__1528 |
| 2851 | >Toxin: PFREUD__01930 | 8395 | >Antitoxin: PFREUD__01920 |
| 2852 | >Toxin: CRD__00786 | 8396 | >Antitoxin: CRD__00785 |
| 2853 | >Toxin: Rleg__6339 | 8397 | >Antitoxin: Rleg__6340 |
| 2854 | >Toxin: Rleg__6554 | 8398 | >Antitoxin: Rleg__6555 |
| 2855 | >Toxin: pRL100221 | 8399 | >Antitoxin: pRL100220 |
| 2856 | >Toxin: Arad__0082 | 8400 | >Antitoxin: Arad__0081 |
| 2857 | >Toxin: NGR__b00520 | 8401 | >Antitoxin: NGR__b00510 |
| 2858 | >Toxin: Rvan__1799 | 8402 | >Antitoxin: Rvan__1798 |
| 2859 | >Toxin: Rpdx1__0873 | 8403 | >Antitoxin: Rpdx1__0874 |
| 2860 | >Toxin: Rpdx1__1938 | 8404 | >Antitoxin: Rpdx1__1937 |
| 2861 | >Toxin: Shel__25040 | 8405 | >Antitoxin: Shel__25030 |
| 2862 | >Toxin: RS9917__04250 | 8406 | >Antitoxin: RS9917__04255 |
| 2863 | >Toxin: Sfum__2054 | 8407 | >Antitoxin: Sfum__2055 |
| 2864 | >Toxin: Vapar__5649 | 8408 | >Antitoxin: Vapar__5648 |
| 2865 | >Toxin: VDG1235__790 | 8409 | >Antitoxin: VDG1235__4870 |
| 2866 | >Toxin: XOO__2997 | 8410 | >Antitoxin: XOO__2998 |
| 2867 | >Toxin: Xoryp__010100009970 | 8411 | >Antitoxin: Xoryp__010100009965 |
| 2868 | >Toxin: XOO3154 | 8412 | >Antitoxin: XOO3155 |
| 2869 | >Toxin: PXO__01415 | 8413 | >Antitoxin: PXO__01414 |
| 2870 | >Toxin: Xcel__2876 | 8414 | >Antitoxin: Xcel__2875 |
| 2871 | >Toxin: ObacDRAFT__3823 | 8415 | >Antitoxin: ObacDRAFT__3824 |
| 2872 | >Toxin: HMPREF0016__02714 | 8416 | >Antitoxin: HMPREF0016__02713 |
| 2873 | >Toxin: NIES39__A02090 | 8417 | >Antitoxin: NIES39__A02080 |
| 2874 | >Toxin: Cpha266__1126 | 8418 | >Antitoxin: Cpha266__1127 |
| 2875 | >Toxin: PCC8801__1532 | 8419 | >Antitoxin: PCC8801__1533 |
| 2876 | >Toxin: Dehly__0318 | 8420 | >Antitoxin: Dehly__0317 |
| 2877 | >Toxin: Dhaf__0673 | 8421 | >Antitoxin: Dhaf__0674 |
| 2878 | >Toxin: DSY0713 | 8422 | >Antitoxin: DSY0714 |
| 2879 | >Toxin: DP0406 | 8423 | >Antitoxin: DP0407 |
| 2880 | >Toxin: Dtox__1318 | 8424 | >Antitoxin: Dtox__1319 |
| 2881 | >Toxin: HMPREF0358__0171 | 8425 | >Antitoxin: HMPREF0358__0170 |
| 2882 | >Toxin: ECABU__c38650 | 8426 | >Antitoxin: ECABU__c38640 |
| 2883 | >Toxin: ECCG__03832 | 8427 | >Antitoxin: ECCG__03831 |
| 2884 | >Toxin: ECDG__04005 | 8428 | >Antitoxin: ECDG__04004 |
| 2885 | >Toxin: ECIAI39__3917 | 8429 | >Antitoxin: ECIAI39__3916 |
| 2886 | >Toxin: HMPREF9549__04273 | 8430 | >Antitoxin: HMPREF9549__04274 |
| 2887 | >Toxin: HMPREF9553__03184 | 8431 | >Antitoxin: HMPREF9553__03183 |
| 2888 | >Toxin: HMPREF9530__02209 | 8432 | >Antitoxin: HMPREF9530__02210 |
| 2889 | >Toxin: HMPREF9531__03250 | 8433 | >Antitoxin: HMPREF9531__03251 |
| 2890 | >Toxin: HMPREF9534__00693 | 8434 | >Antitoxin: HMPREF9534__00692 |

TABLE 3-continued

| SEQ ID NO: | Toxin polypeptide sequences designation | SEQ ID NO: | Antitoxin polypeptide sequences designation |
|---|---|---|---|
| 2891 | >Toxin: ECO103_4157 | 8435 | >Antitoxin: ECO103_4156 |
| 2892 | >Toxin: ECSF_3257 | 8436 | >Antitoxin: ECSF_3256 |
| 2893 | >Toxin: EscoliO157_010100006036 | 8437 | >Antitoxin: EscoliO157_010100006031 |
| 2894 | >Toxin: EsccoliO157_010100001300 | 8438 | >Antitoxin: EsccoliO157_010100001305 |
| 2895 | >Toxin: EschcoliO157_010100002315 | 8439 | >Antitoxin: EshcoliO157_010100002320 |
| 2896 | >Toxin: EcoliO157_010100000650 | 8440 | >Antitoxin: EcoliO157_010100000645 |
| 2897 | >Toxin: EcoliO157_010100000480 | 8441 | >Antitoxin: EcolO157_010100000475 |
| 2898 | >Toxin: EcolO15_010100000460 | 8442 | >Antitoxin: EcolO15_010100000455 |
| 2899 | >Toxin: EcolO_010100000490 | 8443 | >Antitoxin: EcolO_010100000485 |
| 2900 | >Toxin: EcolO1_010100003356 | 8444 | >Antitoxin: EcolO1_010100003351 |
| 2901 | >Toxin: Z4801 | 8445 | >Antitoxin: Z4799 |
| 2902 | >Toxin: ESCCO14588_0146 | 8446 | >Antitoxin: ESCCO14588_0145 |
| 2903 | >Toxin: ECP_3530 | 8447 | >Antitoxin: ECP_3529 |
| 2904 | >Toxin: c4223 | 8448 | >Antitoxin: c4222 |
| 2905 | >Toxin: EcSMS35_3718 | 8449 | >Antitoxin: EcSMS35_3717 |
| 2906 | >Toxin: HMPREF9098_1123 | 8450 | >Antitoxin: HMPREF9098_1124 |
| 2907 | >Toxin: L8106_27027 | 8451 | >Antitoxin: L8106_27022 |
| 2908 | >Toxin: FB2170_11841 | 8452 | >Antitoxin: FB2170_11846 |
| 2909 | >Toxin: Maqu_0559 | 8453 | >Antitoxin: Maqu_0560 |
| 2910 | >Toxin: MC7420_773 | 8454 | >Antitoxin: MC7420_724 |
| 2911 | >Toxin: NB231_14358 | 8455 | >Antitoxin: NB231_14363 |
| 2912 | >Toxin: NE2520 | 8456 | >Antitoxin: NE2521 |
| 2913 | >Toxin: alr3451 | 8457 | >Antitoxin: alr3452 |
| 2914 | >Toxin: OSCT_2233 | 8458 | >Antitoxin: OSCT_2234 |
| 2915 | >Toxin: Ppha_1436 | 8459 | >Antitoxin: Ppha_1435 |
| 2916 | >Toxin: plu4452 | 8460 | >Antitoxin: plu4453 |
| 2917 | >Toxin: Pnap_2963 | 8461 | >Antitoxin: Pnap_2962 |
| 2918 | >Toxin: PstuA_020100002503 | 8462 | >Antitoxin: PstuA_020100002498 |
| 2919 | >Toxin: PA39016_001140007 | 8463 | >Antitoxin: PA39016_001140006 |
| 2920 | >Toxin: Psyr_3804 | 8464 | >Antitoxin: Psyr_3805 |
| 2921 | >Toxin: Rcas_2468 | 8465 | >Antitoxin: Rcas_2467 |
| 2922 | >Toxin: Sbal_4347 | 8466 | >Antitoxin: Sbal_4346 |
| 2923 | >Toxin: SD1617_2224 | 8467 | >Antitoxin: SD1617_2223 |
| 2924 | >Toxin: SDY_3582 | 8468 | >Antitoxin: SDY_3581 |
| 2925 | >Toxin: TERTU_3911 | 8469 | >Antitoxin: TERTU_3910 |
| 2926 | >Toxin: Tery_1571 | 8470 | >Antitoxin: Tery_1570 |
| 2927 | >Toxin: VFA_000662 | 8471 | >Antitoxin: VFA_000663 |
| 2928 | >Toxin: EcolE2_01000162 | 8472 | >Antitoxin: EcolE2_01000163 |
| 2929 | >Toxin: EcolM6_010100020382 | 8473 | >Antitoxin: EcolM6_010100020377 |
| 2930 | >Toxin: EcolM_010100020768 | 8474 | >Antitoxin: EcolM_010100020763 |
| 2931 | >Toxin: EcolB_01001160 | 8475 | >Antitoxin: EcolB_01001159 |
| 2932 | >Toxin: EcolF_01001475 | 8476 | >Antitoxin: EcolF_01001476 |
| 2933 | >Toxin: EschercoliO157_010100002920 | 8477 | >Antitoxin: EschercoliO157_010100002925 |
| 2934 | >Toxin: EschericoliO157_010100015347 | 8478 | >Antitoxin: EschericoliO157_010100015342 |
| 2935 | >Toxin: EschericcoliO157_010100003780 | 8479 | >Antitoxin: EschericcoliO157_010100003785 |
| 2936 | >Toxin: Aave_0160 | 8480 | >Antitoxin: Aave_0161 |
| 2937 | >Toxin: Amir_6975 | 8481 | >Antitoxin: Amir_6976 |
| 2938 | >Toxin: VSAL_I0392 | 8482 | >Antitoxin: VSAL_I0391 |
| 2939 | >Toxin: Mlg_0502 | 8483 | >Antitoxin: Mlg_0503 |
| 2940 | >Toxin: AmaxDRAFT_5193 | 8484 | >Antitoxin: AmaxDRAFT_5192 |
| 2941 | >Toxin: AmaxDRAFT_5205 | 8485 | >Antitoxin: AmaxDRAFT_5204 |
| 2942 | >Toxin: NIES39_K04470 | 8486 | >Antitoxin: NIES39_K04480 |
| 2943 | >Toxin: AplaP_010100002817 | 8487 | >Antitoxin: AplaP_010100002812 |
| 2944 | >Toxin: SI859A1_01336 | 8488 | >Antitoxin: SI859A1_01337 |
| 2945 | >Toxin: bthur0013_57000 | 8489 | >Antitoxin: bthur0013_57010 |
| 2946 | >Toxin: BGP_2335 | 8490 | >Antitoxin: BGP_2336 |
| 2947 | >Toxin: BHWA1_01320 | 8491 | >Antitoxin: BHWA1_01319 |
| 2948 | >Toxin: CAP2UW1_4295 | 8492 | >Antitoxin: CAP2UW1_4296 |
| 2949 | >Toxin: Cyan7822_4726 | 8493 | >Antitoxin: Cyan7822_4725 |
| 2950 | >Toxin: HMPREF0321_1867 | 8494 | >Antitoxin: HMPREF0321_1868 |
| 2951 | >Toxin: HMPREF0326_02542 | 8495 | >Antitoxin: HMPREF0326_02543 |
| 2952 | >Toxin: Dd1591_0935 | 8496 | >Antitoxin: Dd1591_0936 |
| 2953 | >Toxin: NT01EI_3442 | 8497 | >Antitoxin: NT01EI_3441 |
| 2954 | >Toxin: ETAE_3072 | 8498 | >Antitoxin: ETAE_3073 |
| 2955 | >Toxin: ETAF_2777 | 8499 | >Antitoxin: ETAF_2776 |
| 2956 | >Toxin: ENHAE0001_1187 | 8500 | >Antitoxin: ENHAE0001_1188 |
| 2957 | >Toxin: E2348C_1093 | 8501 | >Antitoxin: E2348C_1092 |
| 2958 | >Toxin: E4_010100008678 | 8502 | >Antitoxin: E4_010100008683 |
| 2959 | >Toxin: HMPREF0381_2362 | 8503 | >Antitoxin: HMPREF0381_2361 |
| 2960 | >Toxin: Glov_2199 | 8504 | >Antitoxin: Glov_2198 |
| 2961 | >Toxin: glr3370 | 8505 | >Antitoxin: glr3371 |
| 2962 | >Toxin: GDI0970 | 8506 | >Antitoxin: GDI0971 |
| 2963 | >Toxin: KPK_4974 | 8507 | >Antitoxin: KPK_4973 |
| 2964 | >Toxin: HMPREF0554_2331 | 8508 | >Antitoxin: HMPREF0554_2332 |

TABLE 3-continued

| SEQ ID NO: | Toxin polypeptide sequences designation | SEQ ID NO: | Antitoxin polypeptide sequences designation |
|---|---|---|---|
| 2965 | >Toxin: L8106_04306 | 8509 | >Antitoxin: L8106_04311 |
| 2966 | >Toxin: MELB17_05794 | 8510 | >Antitoxin: MELB17_05789 |
| 2967 | >Toxin: Micau_0029 | 8511 | >Antitoxin: Micau_0028 |
| 2968 | >Toxin: Mb0060 | 8512 | >Antitoxin: Mb0061 |
| 2969 | >Toxin: BCG_0090 | 8513 | >Antitoxin: BCG_0091 |
| 2970 | >Toxin: JTY_0060 | 8514 | >Antitoxin: JTY_0061 |
| 2971 | >Toxin: Mtub2_010100014508 | 8515 | >Antitoxin: Mtub2_010100014513 |
| 2972 | >Toxin: Mtube_010100000751 | 8516 | >Antitoxin: Mtube_010100000756 |
| 2973 | >Toxin: MT0065 | 8517 | >Antitoxin: MT0066 |
| 2974 | >Toxin: TBFG_10058 | 8518 | >Antitoxin: TBFG_10059 |
| 2975 | >Toxin: MRA_0061 | 8519 | >Antitoxin: MRA_0062 |
| 2976 | >Toxin: Rv0059 | 8520 | >Antitoxin: Rv0060 |
| 2977 | >Toxin: TBMG_00058 | 8521 | >Antitoxin: TBMG_00059 |
| 2978 | >Toxin: MtubK4_020200000305 | 8522 | >Antitoxin: MtubK4_020200000310 |
| 2979 | >Toxin: MtubKR_020200000315 | 8523 | >Antitoxin: MtubKR_020200000320 |
| 2980 | >Toxin: MtubKV_020200000310 | 8524 | >Antitoxin: MtubKV_020200000315 |
| 2981 | >Toxin: TMAG_00729 | 8525 | >Antitoxin: TMAG_00730 |
| 2982 | >Toxin: MtubS_010100002549 | 8526 | >Antitoxin: MtubS_010100002554 |
| 2983 | >Toxin: MtubSUM_010100000319 | 8527 | >Antitoxin: MtubSUM_010100000324 |
| 2984 | >Toxin: MtubSUMu_010100000950 | 8528 | >Antitoxin: MtubSUMu_010100000955 |
| 2985 | >Toxin: MtubSUMu0_010100002539 | 8529 | >Antitoxin: MtubSUMu0_010100002544 |
| 2986 | >Toxin: MtubSUMu00_010100001797 | 8530 | >Antitoxin: MtubSUMu00_010100001802 |
| 2987 | >Toxin: MtubSUMu007_010100002479 | 8531 | >Antitoxin: MtubSUMu007_010100002484 |
| 2988 | >Toxin: MtubSUMu008_010100002534 | 8532 | >Antitoxin: MtubSUMu008_010100002539 |
| 2989 | >Toxin: MtubSUMu009_010100020343 | 8533 | >Antitoxin: MtubSUMu009_010100020348 |
| 2990 | >Toxin: MtubSUMu01_010100020402 | 8534 | >Antitoxin: MtubSUMu01_010100020407 |
| 2991 | >Toxin: MtubSUNMu011_010100020688 | 8535 | >Antitoxin: MtubSUMu011_010100020693 |
| 2992 | >Toxin: MtubSUMu012_010100000252 | 8536 | >Antitoxin: MtubSUMu012_010100000257 |
| 2993 | >Toxin: Nhal_3405 | 8537 | >Antitoxin: Nhal_3406 |
| 2994 | >Toxin: NE1363 | 8538 | >Antitoxin: NE1364 |
| 2995 | >Toxin: OSCI_3800101 | 8539 | >Antitoxin: OSCI_3800102 |
| 2996 | >Toxin: Plav_2928 | 8540 | >Antitoxin: Plav_2929 |
| 2997 | >Toxin: PC1_0863 | 8541 | >Antitoxin: PC1_0862 |
| 2998 | >Toxin: PBAL39_20435 | 8542 | >Antitoxin: PBAL39_20430 |
| 2999 | >Toxin: HMPREF9019_0398 | 8543 | >Antitoxin: HMPREF9019_0397 |
| 3000 | >Toxin: PSEEN0280 | 8544 | >Antitoxin: PSEEN0281 |
| 3001 | >Toxin: Pmen_0565 | 8545 | >Antitoxin: Pmen_0566 |
| 3002 | >Toxin: Rpal_2100 | 8546 | >Antitoxin: Rpal_2099 |
| 3003 | >Toxin: RoseRS_0296 | 8547 | >Antitoxin: RoseRS_0297 |
| 3004 | >Toxin: ISM_01070 | 8548 | >Antitoxin: ISM_01065 |
| 3005 | >Toxin: RflaF_010100007781 | 8549 | >Antitoxin: RflaF_010100007776 |
| 3006 | >Toxin: Sputcn32_3528 | 8550 | >Antitoxin: Sputcn32_3529 |
| 3007 | >Toxin: STAUR_1046 | 8551 | >Antitoxin: STAUR_1047 |
| 3008 | >Toxin: sll8002 | 8552 | >Antitoxin: sll8001 |
| 3009 | >Toxin: Slip_1960 | 8553 | >Antitoxin: Slip_1959 |
| 3010 | >Toxin: Tmz1t_3595 | 8554 | >Antitoxin: Tmz1t_3594 |
| 3011 | >Toxin: TaqDRAFT_4249 | 8555 | >Antitoxin: TaqDRAFT_4250 |
| 3012 | >Toxin: Tbd_1490 | 8556 | >Antitoxin: Tbd_1489 |
| 3013 | >Toxin: ZZM4_0145 | 8557 | >Antitoxin: ZZM4_0144 |
| 3014 | >Toxin: APCC8_010100024013 | 8558 | >Antitoxin: APCC8_010100024018 |
| 3015 | >Toxin: APCC8_010100024078 | 8559 | >Antitoxin: APCC8_010100024083 |
| 3016 | >Toxin: DthioDRAFT_0920 | 8560 | >Antitoxin: DthioDRAFT_0919 |
| 3017 | >Toxin: MettuDRAFT_1183 | 8561 | >Antitoxin: MettuDRAFT_1184 |
| 3018 | >Toxin: Mtub0_010100020641 | 8562 | >Antitoxin: Mtub0_010100020646 |
| 3019 | >Toxin: Mtub9_010100021293 | 8563 | >Antitoxin: Mtub9_010100021298 |
| 3020 | >Toxin: MtubC_01003315 | 8564 | >Antitoxin: MtubC_01003316 |
| 3021 | >Toxin: MtubCP_010100002512 | 8565 | >Antitoxin: MtubCP_010100002517 |
| 3022 | >Toxin: MtubE_010100020484 | 8566 | >Antitoxin: MtubE_010100020489 |
| 3023 | >Toxin: MtubG1_010100021149 | 8567 | >Antitoxin: MtubG1_010100021154 |
| 3024 | >Toxin: MtubH_010100021035 | 8568 | >Antitoxin: MtubH_010100021040 |
| 3025 | >Toxin: MtubK8_010100002630 | 8569 | >Antitoxin: MtubK8_010100002635 |
| 3026 | >Toxin: MtubKZN_010100019149 | 8570 | >Antitoxin: MtubKZN_010100019144 |
| 3027 | >Toxin: MtubT1_010100000475 | 8571 | >Antitoxin: MtubT1_010100000480 |
| 3028 | >Toxin: MtubT_010100021213 | 8572 | >Antitoxin: MtubT_010100021218 |
| 3029 | >Toxin: MtubT9_010100002236 | 8573 | >Antitoxin: MtubT9_010100002241 |
| 3030 | >Toxin: PROVRUST_01477 | 8574 | >Antitoxin: PROVRUST_01478 |
| 3031 | >Toxin: AcdelDRAFT_0253 | 8575 | >Antitoxin: AcdelDRAFT_0254 |
| 3032 | >Toxin: Ajs_1569 | 8576 | >Antitoxin: Ajs_1570 |
| 3033 | >Toxin: BURPS1106A_2452 | 8577 | >Antitoxin: BURPS1106A_2451 |
| 3034 | >Toxin: Bpse14_010100013779 | 8578 | >Antitoxin: Bpse14_010100013774 |
| 3035 | >Toxin: Bpseu9_010100040554 | 8579 | >Antitoxin: Bpseu9_010100040549 |
| 3036 | >Toxin: BpseB_010100013291 | 8580 | >Antitoxin: BpseB_010100013286 |

TABLE 3-continued

| SEQ ID NO: | Toxin polypeptide sequences designation | SEQ ID NO: | Antitoxin polypeptide sequences designation |
|---|---|---|---|
| 3037 | >Toxin: BUH_2443 | 8581 | >Antitoxin: BUH_2442 |
| 3038 | >Toxin: Clim_0213 | 8582 | >Antitoxin: Clim_0214 |
| 3039 | >Toxin: MldDRAFT_0262 | 8583 | >Antitoxin: MldDRAFT_0261 |
| 3040 | >Toxin: Dalk_1149 | 8584 | >Antitoxin: Dalk_1150 |
| 3041 | >Toxin: HMPREF0358_4229 | 8585 | >Antitoxin: HMPREF0358_4228 |
| 3042 | >Toxin: ECABU_c33410 | 8586 | >Antitoxin: ECABU_c33400 |
| 3043 | >Toxin: ECFG_02048 | 8587 | >Antitoxin: ECFG_02047 |
| 3044 | >Toxin: ECGG_01859 | 8588 | >Antitoxin: ECGG_01858 |
| 3045 | >Toxin: HMPREF9346_01205 | 8589 | >Antitoxin: HMPREF9346_01204 |
| 3046 | >Toxin: HMPREF9552_04316 | 8590 | >Antitoxin: HMPREF9552_04315 |
| 3047 | >Toxin: HMPREF9531_00622 | 8591 | >Antitoxin: HMPREF9531_00623 |
| 3048 | >Toxin: HMPREF9534_00156 | 8592 | >Antitoxin: HMPREF9534_00157 |
| 3049 | >Toxin: HMPREF9534_02242 | 8593 | >Antitoxin: HMPREF9534_02241 |
| 3050 | >Toxin: ECUMN_3416 | 8594 | >Antitoxin: ECUMN_3415 |
| 3051 | >Toxin: c3682 | 8595 | >Antitoxin: c3681 |
| 3052 | >Toxin: EschWDRAFT_2732 | 8596 | >Antitoxin: EschWDRAFT_2733 |
| 3053 | >Toxin: ECW_m4651 | 8597 | >Antitoxin: ECW_m4650 |
| 3054 | >Toxin: ESCG_00445 | 8598 | >Antitoxin: ESCG_00444 |
| 3055 | >Toxin: LDG_1702 | 8599 | >Antitoxin: LDG_1703 |
| 3056 | >Toxin: LPC_1887 | 8600 | >Antitoxin: LPC_1888 |
| 3057 | >Toxin: Ipl0200 | 8601 | >Antitoxin: Ipl0199 |
| 3058 | >Toxin: Ipp2408 | 8602 | >Antitoxin: Ipp2409 |
| 3059 | >Toxin: Mslp34_2080 | 8603 | >Antitoxin: Mslp34_2081 |
| 3060 | >Toxin: Plut_0717 | 8604 | >Antitoxin: Plut_0716 |
| 3061 | >Toxin: Ppha_1969 | 8605 | >Antitoxin: Ppha_1968 |
| 3062 | >Toxin: SKA34_21022 | 8606 | >Antitoxin: SKA34_21027 |
| 3063 | >Toxin: PAU_03952 | 8607 | >Antitoxin: PAU_03953 |
| 3064 | >Toxin: plu4270 | 8608 | >Antitoxin: plu4271 |
| 3065 | >Toxin: PSHAb0102 | 8609 | >Antitoxin: PSHAb0101 |
| 3066 | >Toxin: RC1_3156 | 8610 | >Antitoxin: RC1_3157 |
| 3067 | >Toxin: Sbal_4457 | 8611 | >Antitoxin: Sbal_4456 |
| 3068 | >Toxin: Shewana3_4161 | 8612 | >Antitoxin: Shewana3_4160 |
| 3069 | >Toxin: slr5102 | 8613 | >Antitoxin: slr5101 |
| 3070 | >Toxin: Vels_3691 | 8614 | >Antitoxin: Vels_3690 |
| 3071 | >Toxin: VIBHAR_06811 | 8615 | >Antitoxin: VIBHAR_06812 |
| 3072 | >Toxin: pVT1_52 | 8616 | >Antitoxin: pVT1_51 |
| 3073 | >Toxin: VV20181 | 8617 | >Antitoxin: VV20180 |
| 3074 | >Toxin: VVM_01405 | 8618 | >Antitoxin: VVM_01404 |
| 3075 | >Toxin: VSWAT3_18743 | 8619 | >Antitoxin: VSWAT3_18738 |
| 3076 | >Toxin: yaldo0001_40550 | 8620 | >Antitoxin: yaldo0001_40560 |
| 3077 | >Toxin: YE4109 | 8621 | >Antitoxin: YE4110 |
| 3078 | >Toxin: EcolH5_010100022792 | 8622 | >Antitoxin: EcolH5_010100022787 |
| 3079 | >Toxin: Nham_0582 | 8623 | >Antitoxin: Nham_0581 |
| 3080 | >Toxin: Swol_1548 | 8624 | >Antitoxin: Swol_1549 |
| 3081 | >Toxin: Ppro_0237 | 8625 | >Antitoxin: Ppro_0238 |
| 3082 | >Toxin: Aave_0159 | 8626 | >Antitoxin: Aave_0158 |
| 3083 | >Toxin: Cthe_0519 | 8627 | >Antitoxin: Cthe_0520 |
| 3084 | >Toxin: Daci_4205 | 8628 | >Antitoxin: Daci_4206 |
| 3085 | >Toxin: Nther_0364 | 8629 | >Antitoxin: Nther_0363 |
| 3086 | >Toxin: Ppha_1128 | 8630 | >Antitoxin: Ppha_1127 |
| 3087 | >Toxin: Afer_1394 | 8631 | >Antitoxin: Afer_1395 |
| 3088 | >Toxin: Mmar10_3055 | 8632 | >Antitoxin: Mmar10_3056 |
| 3089 | >Toxin: Hhal_0412 | 8633 | >Antitoxin: Hhal_0413 |
| 3090 | >Toxin: Rsph17029_3386 | 8634 | >Antitoxin: Rsph17029_3385 |
| 3091 | >Toxin: Acry_3581 | 8635 | >Antitoxin: Acry_3582 |
| 3092 | >Toxin: Spro_0571 | 8636 | >Antitoxin: Spro_0572 |
| 3093 | >Toxin: PputGB1_4746 | 8637 | >Antitoxin: PputGB1_4747 |
| 3094 | >Toxin: Glov_0294 | 8638 | >Antitoxin: Glov_0295 |
| 3095 | >Toxin: Psyr_1426 | 8639 | >Antitoxin: Psyr_1427 |
| 3096 | >Toxin: Bxe_A1177 | 8640 | >Antitoxin: Bxe_A1178 |
| 3097 | >Toxin: Rmet_2360 | 8641 | >Antitoxin: Rmet_2359 |
| 3098 | >Toxin: Ajs_1249 | 8642 | >Antitoxin: Ajs_1250 |
| 3099 | >Toxin: Ajs_1391 | 8643 | >Antitoxin: Ajs_1392 |
| 3100 | >Toxin: Ajs_2179 | 8644 | >Antitoxin: Ajs_2180 |
| 3101 | >Toxin: Mpe_A2401 | 8645 | >Antitoxin: Mpe_A2400 |
| 3102 | >Toxin: Plav_3431 | 8646 | >Antitoxin: Plav_3430 |
| 3103 | >Toxin: Spro_4161 | 8647 | >Antitoxin: Spro_4162 |
| 3104 | >Toxin: Daci_4186 | 8648 | >Antitoxin: Daci_4185 |
| 3105 | >Toxin: Tmz1t_0941 | 8649 | >Antitoxin: Tmz1t_0942 |
| 3106 | >Toxin: Tgr7_2866 | 8650 | >Antitoxin: Tgr7_2865 |
| 3107 | >Toxin: Avin_36380 | 8651 | >Antitoxin: Avin_36370 |
| 3108 | >Toxin: Rpic12D_0690 | 8652 | >Antitoxin: Rpic12D_0689 |
| 3109 | >Toxin: Dd1591_0428 | 8653 | >Antitoxin: Dd1591_0429 |
| 3110 | >Toxin: Mbar_A1358 | 8654 | >Antitoxin: Mbar_A1357 |
| 3111 | >Toxin: RoseRS_2587 | 8655 | >Antitoxin: RoseRS_2588 |
| 3112 | >Toxin: Rcas_4238 | 8656 | >Antitoxin: Rcas_4239 |
| 3113 | >Toxin: TRQ2_0318 | 8657 | >Antitoxin: TRQ2_0317 |

TABLE 3-continued

| SEQ ID NO: | Toxin polypeptide sequences designation | SEQ ID NO: | Antitoxin polypeptide sequences designation |
|---|---|---|---|
| 3114 | >Toxin: Clim_0935 | 8658 | >Antitoxin: Clim_0934 |
| 3115 | >Toxin: Paes_1991 | 8659 | >Antitoxin: Paes_1990 |
| 3116 | >Toxin: Cagg_3810 | 8660 | >Antitoxin: Cagg_3811 |
| 3117 | >Toxin: Cagg_3824 | 8661 | >Antitoxin: Cagg_3825 |
| 3118 | >Toxin: Ava_B0311 | 8662 | >Antitoxin: Ava_B0312 |
| 3119 | >Toxin: Sfri_2090 | 8663 | >Antitoxin: Sfri_2089 |
| 3120 | >Toxin: Pnap_4584 | 8664 | >Antitoxin: Pnap_4583 |
| 3121 | >Toxin: Mpe_B0172 | 8665 | >Antitoxin: Mpe_B0171 |
| 3122 | >Toxin: Fjoh_3012 | 8666 | >Antitoxin: Fjoh_3013 |
| 3123 | >Toxin: Swit_5328 | 8667 | >Antitoxin: Swit_5327 |
| 3124 | >Toxin: MADE_00121 | 8668 | >Antitoxin: MADE_00120 |
| 3125 | >Toxin: Tmz1t_2113 | 8669 | >Antitoxin: Tmz1t_2114 |
| 3126 | >Toxin: Mnod_0641 | 8670 | >Antitoxin: Mnod_0642 |
| 3127 | >Toxin: Amir_0591 | 8671 | >Antitoxin: Amir_0592 |
| 3128 | >Toxin: Mfl052 | 8672 | >Antitoxin: Mfl051 |
| 3129 | >Toxin: Bcep18194_B0245 | 8673 | >Antitoxin: Bcep18194_B0246 |
| 3130 | >Toxin: RPC_2242 | 8674 | >Antitoxin: RPC_2243 |
| 3131 | >Toxin: Pden_4165 | 8675 | >Antitoxin: Pden_4164 |
| 3132 | >Toxin: Swit_2282 | 8676 | >Antitoxin: Swit_2281 |
| 3133 | >Toxin: Mext_2035 | 8677 | >Antitoxin: Mext_2036 |
| 3134 | >Toxin: Mpop_1996 | 8678 | >Antitoxin: Mpop_1997 |
| 3135 | >Toxin: Gdia_2649 | 8679 | >Antitoxin: Gdia_2650 |
| 3136 | >Toxin: Msil_0447 | 8680 | >Antitoxin: Msil_0446 |
| 3137 | >Toxin: Mchl_2310 | 8681 | >Antitoxin: Mchl_2311 |
| 3138 | >Toxin: Avi_1240 | 8682 | >Antitoxin: Avi_1242 |
| 3139 | >Toxin: Caci_6778 | 8683 | >Antitoxin: Caci_6779 |
| 3140 | >Toxin: Tfu_0002 | 8684 | >Antitoxin: Tfu_0003 |
| 3141 | >Toxin: Mmcs_0002 | 8685 | >Antitoxin: Mmcs_0003 |
| 3142 | >Toxin: Arth_0002 | 8686 | >Antitoxin: Arth_0003 |
| 3143 | >Toxin: Noca_0002 | 8687 | >Antitoxin: Noca_0003 |
| 3144 | >Toxin: Mkms_0010 | 8688 | >Antitoxin: Mkms_0011 |
| 3145 | >Toxin: Mvan_0002 | 8689 | >Antitoxin: Mvan_0003 |
| 3146 | >Toxin: Mjls_0002 | 8690 | >Antitoxin: Mjls_0003 |
| 3147 | >Toxin: Mflv_0826 | 8691 | >Antitoxin: Mflv_0825 |
| 3148 | >Toxin: Strop_0003 | 8692 | >Antitoxin: Strop_0004 |
| 3149 | >Toxin: Sare_0002 | 8693 | >Antitoxin: Sare_0003 |
| 3150 | >Toxin: Achl_0002 | 8694 | >Antitoxin: Achl_0003 |
| 3151 | >Toxin: Amir_0002 | 8695 | >Antitoxin: Amir_0003 |
| 3152 | >Toxin: Bcav_0002 | 8696 | >Antitoxin: Bcav_0003 |
| 3153 | >Toxin: Ksed_00020 | 8697 | >Antitoxin: Ksed_00030 |
| 3154 | >Toxin: Caci_0002 | 8698 | >Antitoxin: Caci_0003 |
| 3155 | >Toxin: Svir_00020 | 8699 | >Antitoxin: Svir_00030 |
| 3156 | >Toxin: Namu_0002 | 8700 | >Antitoxin: Namu_0003 |
| 3157 | >Toxin: B21_04046 | 8701 | >Antitoxin: B21_04047 |
| 3158 | >Toxin: RS05352 | 8702 | >Antitoxin: RS05353 |
| 3159 | >Toxin: PSPTO_2507 | 8703 | >Antitoxin: PSPTO_2508 |
| 3160 | >Toxin: Psyr_2311 | 8704 | >Antitoxin: Psyr_2312 |
| 3161 | >Toxin: RPB_2618 | 8705 | >Antitoxin: RPB_2619 |
| 3162 | >Toxin: Rfer_0277 | 8706 | >Antitoxin: Rfer_0278 |
| 3163 | >Toxin: Pden_4294 | 8707 | >Antitoxin: Pden_4293 |
| 3164 | >Toxin: Noca_0421 | 8708 | >Antitoxin: Noca_0420 |
| 3165 | >Toxin: Aave_1295 | 8709 | >Antitoxin: Aave_1296 |
| 3166 | >Toxin: Pnap_0622 | 8710 | >Antitoxin: Pnap_0621 |
| 3167 | >Toxin: Ent638_0383 | 8711 | >Antitoxin: Ent638_0384 |
| 3168 | >Toxin: BBta_1616 | 8712 | >Antitoxin: BBta_1615 |
| 3169 | >Toxin: Smed_1972 | 8713 | >Antitoxin: Smed_1971 |
| 3170 | >Toxin: Mmwyl1_0005 | 8714 | >Antitoxin: Mmwyl1_0006 |
| 3171 | >Toxin: YpsIP31758_1619 | 8715 | >Antitoxin: YpsIP31758_1620 |
| 3172 | >Toxin: Xaut_0312 | 8716 | >Antitoxin: Xaut_0313 |
| 3173 | >Toxin: EcHS_A4466 | 8717 | >Antitoxin: EcHS_A4465 |
| 3174 | >Toxin: EcE24377A_4780 | 8718 | >Antitoxin: EcE24377A_4782 |
| 3175 | >Toxin: Franean1_3622 | 8719 | >Antitoxin: Franean1_3621 |
| 3176 | >Toxin: YpAngola_A2844 | 8720 | >Antitoxin: YpAngola_A2843 |
| 3177 | >Toxin: Mext_4022 | 8721 | >Antitoxin: Mext_4023 |
| 3178 | >Toxin: EcolC_3795 | 8722 | >Antitoxin: EcolC_3794 |
| 3179 | >Toxin: YPK_1727 | 8723 | >Antitoxin: YPK_1728 |
| 3180 | >Toxin: Xfasm12_0209 | 8724 | >Antitoxin: Xfasm12_0208 |
| 3181 | >Toxin: EcSMS35_4690 | 8725 | >Antitoxin: EcSMS35_4691 |
| 3182 | >Toxin: Lcho_1439 | 8726 | >Antitoxin: Lcho_1440 |
| 3183 | >Toxin: Mrad2831_0164 | 8727 | >Antitoxin: Mrad2831_0163 |
| 3184 | >Toxin: Mrad2831_5255 | 8728 | >Antitoxin: Mrad2831_5256 |
| 3185 | >Toxin: XfasM23_0185 | 8729 | >Antitoxin: XfasM23_0184 |
| 3186 | >Toxin: PXO_03749 | 8730 | >Antitoxin: PXO_03748 |
| 3187 | >Toxin: SbBS512_E4752 | 8731 | >Antitoxin: SbBS512_E4753 |
| 3188 | >Toxin: Rpal_2976 | 8732 | >Antitoxin: Rpal_2977 |
| 3189 | >Toxin: Gbem_2877 | 8733 | >Antitoxin: Gbem_2876 |
| 3190 | >Toxin: M446_0617 | 8734 | >Antitoxin: M446_0618 |

TABLE 3-continued

| | Toxin polypeptide sequences | | Antitoxin polypeptide sequences |
|---|---|---|---|
| SEQ ID NO: | designation | SEQ ID NO: | designation |
| 3191 | >Toxin: ECH74115_5728 | 8735 | >Antitoxin: ECH74115_5729 |
| 3192 | >Toxin: Rleg2_2511 | 8736 | >Antitoxin: Rleg2_2510 |
| 3193 | >Toxin: Rleg2_6179 | 8737 | >Antitoxin: Rleg2_6178 |
| 3194 | >Toxin: Mchl_4391 | 8738 | >Antitoxin: Mchl_4392 |
| 3195 | >Toxin: Achl_0581 | 8739 | >Antitoxin: Achl_0580 |
| 3196 | >Toxin: A2cp1_3290 | 8740 | >Antitoxin: A2cp1_3289 |
| 3197 | >Toxin: Avi_2793 | 8741 | >Antitoxin: Avi_2792 |
| 3198 | >Toxin: Amir_0551 | 8742 | >Antitoxin: Amir_0552 |
| 3199 | >Toxin: Rleg_2766 | 8743 | >Antitoxin: Rleg_2765 |
| 3200 | >Toxin: PC1_4290 | 8744 | >Antitoxin: PC1_4289 |
| 3201 | >Toxin: Cpin_0640 | 8745 | >Antitoxin: Cpin_0639 |
| 3202 | >Toxin: Caci_0025 | 8746 | >Antitoxin: Caci_0026 |
| 3203 | >Toxin: CPR_1661 | 8747 | >Antitoxin: CPR_1660 |
| 3204 | >Toxin: SAG0378 | 8748 | >Antitoxin: SAG0379 |
| 3205 | >Toxin: BCE_3854 | 8749 | >Antitoxin: BCE_3853 |
| 3206 | >Toxin: LMOf2365_1339 | 8750 | >Antitoxin: LMOf2365_1340 |
| 3207 | >Toxin: GBAA_3953 | 8751 | >Antitoxin: GBAA_3952 |
| 3208 | >Toxin: BAS3667 | 8752 | >Antitoxin: BAS3666 |
| 3209 | >Toxin: BT9727_3557 | 8753 | >Antitoxin: BT9727_3556 |
| 3210 | >Toxin: Mfl292 | 8754 | >Antitoxin: Mfl293 |
| 3211 | >Toxin: BCZK3575 | 8755 | >Antitoxin: BCZK3574 |
| 3212 | >Toxin: DET0985 | 8756 | >Antitoxin: DET0984 |
| 3213 | >Toxin: SACOL1285 | 8757 | >Antitoxin: SACOL1286 |
| 3214 | >Toxin: SERP0833 | 8758 | >Antitoxin: SERP0834 |
| 3215 | >Toxin: PMN2A_1023 | 8759 | >Antitoxin: PMN2A_1024 |
| 3216 | >Toxin: Ava_1870 | 8760 | >Antitoxin: Ava_1869 |
| 3217 | >Toxin: Syncc9902_0594 | 8761 | >Antitoxin: Syncc9902_0593 |
| 3218 | >Toxin: Syncc9605_2079 | 8762 | >Antitoxin: Syncc9605_2080 |
| 3219 | >Toxin: PMT9312_1585 | 8763 | >Antitoxin: PMT9312_1586 |
| 3220 | >Toxin: Synpcc7942_2022 | 8764 | >Antitoxin: Synpcc7942_2021 |
| 3221 | >Toxin: Dgeo_1234 | 8765 | >Antitoxin: Dgeo_1235 |
| 3222 | >Toxin: Moth_1047 | 8766 | >Antitoxin: Moth_1048 |
| 3223 | >Toxin: Tery_3978 | 8767 | >Antitoxin: Tery_3977 |
| 3224 | >Toxin: CPF_1943 | 8768 | >Antitoxin: CPF_1942 |
| 3225 | >Toxin: Swol_0897 | 8769 | >Antitoxin: Swol_0898 |
| 3226 | >Toxin: OEOE_0430 | 8770 | >Antitoxin: OEOE_0431 |
| 3227 | >Toxin: LEUM_1358 | 8771 | >Antitoxin: LEUM_1357 |
| 3228 | >Toxin: LGAS_0811 | 8772 | >Antitoxin: LGAS_0812 |
| 3229 | >Toxin: LACR_0814 | 8773 | >Antitoxin: LACR_0815 |
| 3230 | >Toxin: STER_0380 | 8774 | >Antitoxin: STER_0381 |
| 3231 | >Toxin: Dvul_2431 | 8775 | >Antitoxin: Dvul_2432 |
| 3232 | >Toxin: P9515_16721 | 8776 | >Antitoxin: P9515_16731 |
| 3233 | >Toxin: A9601_16961 | 8777 | >Antitoxin: A9601_16971 |
| 3234 | >Toxin: P9303_04151 | 8778 | >Antitoxin: P9303_04141 |
| 3235 | >Toxin: NATL1_18931 | 8779 | >Antitoxin: NATL1_18941 |
| 3236 | >Toxin: Cthe_0994 | 8780 | >Antitoxin: Cthe_0993 |
| 3237 | >Toxin: P9301_16831 | 8781 | >Antitoxin: P9301_16841 |
| 3238 | >Toxin: Dred_1960 | 8782 | >Antitoxin: Dred_1959 |
| 3239 | >Toxin: DehaBAV1_0876 | 8783 | >Antitoxin: DehaBAV1_0875 |
| 3240 | >Toxin: SaurJH9_1326 | 8784 | >Antitoxin: SaurJH9_1327 |
| 3241 | >Toxin: Lreu_0696 | 8785 | >Antitoxin: Lreu_0697 |
| 3242 | >Toxin: RoseRS_3749 | 8786 | >Antitoxin: RoseRS_3750 |
| 3243 | >Toxin: SaurJH1_1352 | 8787 | >Antitoxin: SaurJH1_1353 |
| 3244 | >Toxin: Bcer98_2468 | 8788 | >Antitoxin: Bcer98_2467 |
| 3245 | >Toxin: Rcas_1134 | 8789 | >Antitoxin: Rcas_1133 |
| 3246 | >Toxin: Haur_0473 | 8790 | >Antitoxin: Haur_0474 |
| 3247 | >Toxin: P9211_16141 | 8791 | >Antitoxin: P9211_16151 |
| 3248 | >Toxin: Cphy_2777 | 8792 | >Antitoxin: Cphy_2776 |
| 3249 | >Toxin: BcerKBAB4_3638 | 8793 | >Antitoxin: BcerKBAB4_3637 |
| 3250 | >Toxin: Teth514_1648 | 8794 | >Antitoxin: Teth514_1647 |
| 3251 | >Toxin: Daud_0923 | 8795 | >Antitoxin: Daud_0924 |
| 3252 | >Toxin: Nther_1441 | 8796 | >Antitoxin: Nther_1442 |
| 3253 | >Toxin: MARTH_orf784 | 8797 | >Antitoxin: MARTH_orf786 |
| 3254 | >Toxin: BCAH187_A3863 | 8798 | >Antitoxin: BCAH187_A3862 |
| 3255 | >Toxin: Dtur_1206 | 8799 | >Antitoxin: Dtur_1207 |
| 3256 | >Toxin: BCB4264_A3914 | 8800 | >Antitoxin: BCB4264_A3913 |
| 3257 | >Toxin: PCC7424_2359 | 8801 | >Antitoxin: PCC7424_2358 |
| 3258 | >Toxin: PCC8801_2712 | 8802 | >Antitoxin: PCC8801_2711 |
| 3259 | >Toxin: BCG9842_B1330 | 8803 | >Antitoxin: BCG9842_B1331 |
| 3260 | >Toxin: DvMF_2515 | 8804 | >Antitoxin: DvMF_2514 |
| 3261 | >Toxin: BCAH820_3828 | 8805 | >Antitoxin: BCAH820_3827 |
| 3262 | >Toxin: Dhaf_3679 | 8806 | >Antitoxin: Dhaf_3678 |
| 3263 | >Toxin: Hore_07820 | 8807 | >Antitoxin: Hore_07830 |
| 3264 | >Toxin: Ccel_0454 | 8808 | >Antitoxin: Ccel_0455 |
| 3265 | >Toxin: Ddes_0061 | 8809 | >Antitoxin: Ddes_0060 |
| 3266 | >Toxin: Cyan7425_2089 | 8810 | >Antitoxin: Cyan7425_2090 |
| 3267 | >Toxin: Athe_1049 | 8811 | >Antitoxin: Athe_1050 |

TABLE 3-continued

| Toxin polypeptide sequences | | Antitoxin polypeptide sequences | |
|---|---|---|---|
| SEQ ID NO: | designation | SEQ ID NO: | designation |
| 3268 | >Toxin: Afer_0636 | 8812 | >Antitoxin: Afer_0637 |
| 3269 | >Toxin: Dbac_2412 | 8813 | >Antitoxin: Dbac_2413 |
| 3270 | >Toxin: GWCH70_1152 | 8814 | >Antitoxin: GWCH70_1153 |
| 3271 | >Toxin: Elen_1812 | 8815 | >Antitoxin: Elen_1811 |
| 3272 | >Toxin: Cagg_3683 | 8816 | >Antitoxin: Cagg_3682 |
| 3273 | >Toxin: Ccur_08060 | 8817 | >Antitoxin: Ccur_08050 |
| 3274 | >Toxin: Apre_0607 | 8818 | >Antitoxin: Apre_0608 |
| 3275 | >Toxin: Cyan8802_3391 | 8819 | >Antitoxin: Cyan8802_3392 |
| 3276 | >Toxin: Dtox_3191 | 8820 | >Antitoxin: Dtox_3190 |
| 3277 | >Toxin: Aaci_1432 | 8821 | >Antitoxin: Aaci_1433 |
| 3278 | >Toxin: Dret_0497 | 8822 | >Antitoxin: Dret_0496 |
| 3279 | >Toxin: Ent638_3663 | 8823 | >Antitoxin: Ent638_3662 |
| 3280 | >Toxin: SbBS512_E3548 | 8824 | >Antitoxin: SbBS512_E3550 |
| 3281 | >Toxin: SNSL254_A3604 | 8825 | >Antitoxin: SNSL254_A3603 |
| 3282 | >Toxin: SeHA_C3639 | 8826 | >Antitoxin: SeHA_C3638 |
| 3283 | >Toxin: SeSA_A3534 | 8827 | >Antitoxin: SeSA_A3533 |
| 3284 | >Toxin: SeAg_B3532 | 8828 | >Antitoxin: SeAg_B3531 |
| 3285 | >Toxin: SeD_A3701 | 8829 | >Antitoxin: SeD_A3700 |
| 3286 | >Toxin: ECH74115_4545 | 8830 | >Antitoxin: ECH74115_4543 |
| 3287 | >Toxin: Patl_0700 | 8831 | >Antitoxin: Patl_0699 |
| 3288 | >Toxin: Shewmr7_0726 | 8832 | >Antitoxin: Shewmr7_0725 |
| 3289 | >Toxin: Dvul_2762 | 8833 | >Antitoxin: Dvul_2763 |
| 3290 | >Toxin: Sbal_1288 | 8834 | >Antitoxin: Sbal_1287 |
| 3291 | >Toxin: VC0395_1052 | 8835 | >Antitoxin: VC0395_1053 |
| 3292 | >Toxin: PSPA7_0699 | 8836 | >Antitoxin: PSPA7_0700 |
| 3293 | >Toxin: PSPA7_5057 | 8837 | >Antitoxin: PSPA7_5056 |
| 3294 | >Toxin: Mmwyl1_0582 | 8838 | >Antitoxin: Mmwyl1_0583 |
| 3295 | >Toxin: VIBHAR_05030 | 8839 | >Antitoxin: VIBHAR_05029 |
| 3296 | >Toxin: YPK_0902 | 8840 | >Antitoxin: YPK_0901 |
| 3297 | >Toxin: SNSL254_A2931 | 8841 | >Antitoxin: SNSL254_A2932 |
| 3298 | >Toxin: SeHA_C3487 | 8842 | >Antitoxin: SeHA_C3488 |
| 3299 | >Toxin: SeAg_B2795 | 8843 | >Antitoxin: SeAg_B2796 |
| 3300 | >Toxin: VSAL_I1032 | 8844 | >Antitoxin: VSAL_I1031 |
| 3301 | >Toxin: Dde_0244 | 8845 | >Antitoxin: Dde_0243 |
| 3302 | >Toxin: RSc2303 | 8846 | >Antitoxin: RSc2304 |
| 3303 | >Toxin: RS02977 | 8847 | >Antitoxin: RS02976 |
| 3304 | >Toxin: Tbd_1300 | 8848 | >Antitoxin: Tbd_1299 |
| 3305 | >Toxin: Tbd_1439 | 8849 | >Antitoxin: Tbd_1438 |
| 3306 | >Toxin: Nmul_A2583 | 8850 | >Antitoxin: Nmul_A2584 |
| 3307 | >Toxin: Mfla_1336 | 8851 | >Antitoxin: Mfla_1337 |
| 3308 | >Toxin: Rmet_4706 | 8852 | >Antitoxin: Rmet_4707 |
| 3309 | >Toxin: Pput_2293 | 8853 | >Antitoxin: Pput_2292 |
| 3310 | >Toxin: PputGB1_2459 | 8854 | >Antitoxin: PputGB1_2458 |
| 3311 | >Toxin: PputW619_2468 | 8855 | >Antitoxin: PputW619_2467 |
| 3312 | >Toxin: Lcho_3884 | 8856 | >Antitoxin: Lcho_3883 |
| 3313 | >Toxin: Avin_29100 | 8857 | >Antitoxin: Avin_29110 |
| 3314 | >Toxin: GBAA_2803 | 8858 | >Antitoxin: GBAA_2804 |
| 3315 | >Toxin: BAS2613 | 8859 | >Antitoxin: BAS2614 |
| 3316 | >Toxin: BCZK2530 | 8860 | >Antitoxin: BCZK2531 |
| 3317 | >Toxin: Moth_1254 | 8861 | >Antitoxin: Moth_1255 |
| 3318 | >Toxin: Cthe_2752 | 8862 | >Antitoxin: Cthe_2753 |
| 3319 | >Toxin: Haur_2771 | 8863 | >Antitoxin: Haur_2772 |
| 3320 | >Toxin: Cphy_3555 | 8864 | >Antitoxin: Cphy_3554 |
| 3321 | >Toxin: Teth514_2351 | 8865 | >Antitoxin: Teth514_2352 |
| 3322 | >Toxin: BCAH187_A2853 | 8866 | >Antitoxin: BCAH187_A2854 |
| 3323 | >Toxin: BCAH820_2811 | 8867 | >Antitoxin: BCAH820_2812 |
| 3324 | >Toxin: Dhaf_1135 | 8868 | >Antitoxin: Dhaf_1136 |
| 3325 | >Toxin: Hore_14040 | 8869 | >Antitoxin: Hore_14050 |
| 3326 | >Toxin: Apar_1232 | 8870 | >Antitoxin: Apar_1233 |
| 3327 | >Toxin: Dtox_2072 | 8871 | >Antitoxin: Dtox_2071 |
| 3328 | >Toxin: SO_1986 | 8872 | >Antitoxin: SO_1985 |
| 3329 | >Toxin: PSPTO_1043 | 8873 | >Antitoxin: PSPTO_1042 |
| 3330 | >Toxin: Psyr_0892 | 8874 | >Antitoxin: Psyr_0891 |
| 3331 | >Toxin: CPS_1377 | 8875 | >Antitoxin: CPS_1378 |
| 3332 | >Toxin: RPB_0486 | 8876 | >Antitoxin: RPB_0487 |
| 3333 | >Toxin: Jann_4021 | 8877 | >Antitoxin: Jann_4022 |
| 3334 | >Toxin: Sde_2471 | 8878 | >Antitoxin: Sde_2472 |
| 3335 | >Toxin: Sden_3374 | 8879 | >Antitoxin: Sden_3373 |
| 3336 | >Toxin: RPD_0340 | 8880 | >Antitoxin: RPD_0339 |
| 3337 | >Toxin: TM1040_0415 | 8881 | >Antitoxin: TM1040_0416 |
| 3338 | >Toxin: Patl_1332 | 8882 | >Antitoxin: Patl_1333 |
| 3339 | >Toxin: Rru_A0722 | 8883 | >Antitoxin: Rru_A0721 |
| 3340 | >Toxin: Shewmr7_2347 | 8884 | >Antitoxin: Shewmr7_2348 |
| 3341 | >Toxin: RSP_1092 | 8885 | >Antitoxin: RSP_1093 |
| 3342 | >Toxin: Shewmr4_2275 | 8886 | >Antitoxin: Shewmr4_2276 |
| 3343 | >Toxin: Mmar10_0274 | 8887 | >Antitoxin: Mmar10_0275 |
| 3344 | >Toxin: Sfri_2318 | 8888 | >Antitoxin: Sfri_2319 |

TABLE 3-continued

| | Toxin polypeptide sequences | | Antitoxin polypeptide sequences |
|---|---|---|---|
| SEQ ID NO: | designation | SEQ ID NO: | designation |
| 3345 | >Toxin: Shewana3_2465 | 8889 | >Antitoxin: Shewana3_2466 |
| 3346 | >Toxin: Sama_2036 | 8890 | >Antitoxin: Sama_2037 |
| 3347 | >Toxin: Ping_0995 | 8891 | >Antitoxin: Ping_0996 |
| 3348 | >Toxin: Aave_3570 | 8892 | >Antitoxin: Aave_3569 |
| 3349 | >Toxin: Maqu_0518 | 8893 | >Antitoxin: Maqu_0517 |
| 3350 | >Toxin: Sbal_2597 | 8894 | >Antitoxin: Sbal_2598 |
| 3351 | >Toxin: Rsph17029_2755 | 8895 | >Antitoxin: Rsph17029_2756 |
| 3352 | >Toxin: Shew_1476 | 8896 | >Antitoxin: Shew_1477 |
| 3353 | >Toxin: Sputcn32_2322 | 8897 | >Antitoxin: Sputcn32_2323 |
| 3354 | >Toxin: Rsph17025_2936 | 8898 | >Antitoxin: Rsph17025_2935 |
| 3355 | >Toxin: VC0395_A1891 | 8899 | >Antitoxin: VC0395_A1890 |
| 3356 | >Toxin: BBta_2959 | 8900 | >Antitoxin: BBta_2958 |
| 3357 | >Toxin: Mmwyl1_4075 | 8901 | >Antitoxin: Mmwyl1_4076 |
| 3358 | >Toxin: Shew185_2636 | 8902 | >Antitoxin: Shew185_2637 |
| 3359 | >Toxin: Plav_1868 | 8903 | >Antitoxin: Plav_1867 |
| 3360 | >Toxin: Xaut_1629 | 8904 | >Antitoxin: Xaut_1630 |
| 3361 | >Toxin: VIBHAR_03284 | 8905 | >Antitoxin: VIBHAR_03283 |
| 3362 | >Toxin: Dshi_0366 | 8906 | >Antitoxin: Dshi_0365 |
| 3363 | >Toxin: Sbal195_2711 | 8907 | >Antitoxin: Sbal195_2712 |
| 3364 | >Toxin: Caul_1554 | 8908 | >Antitoxin: Caul_1553 |
| 3365 | >Toxin: Swoo_2780 | 8909 | >Antitoxin: Swoo_2779 |
| 3366 | >Toxin: Rpal_0551 | 8910 | >Antitoxin: Rpal_0550 |
| 3367 | >Toxin: Smal_1959 | 8911 | >Antitoxin: Smal_1960 |
| 3368 | >Toxin: MADE_01437 | 8912 | >Antitoxin: MADE_01438 |
| 3369 | >Toxin: Sbal223_1749 | 8913 | >Antitoxin: Sbal223_1748 |
| 3370 | >Toxin: Avi_0089 | 8914 | >Antitoxin: Avi_0090 |
| 3371 | >Toxin: CPR_1140 | 8915 | >Antitoxin: CPR_1139 |
| 3372 | >Toxin: SAG0350 | 8916 | >Antitoxin: SAG0349 |
| 3373 | >Toxin: CPF_1328 | 8917 | >Antitoxin: CPF_1327 |
| 3374 | >Toxin: OEOE_1587 | 8918 | >Antitoxin: OEOE_1588 |
| 3375 | >Toxin: LEUM_0315 | 8919 | >Antitoxin: LEUM_0314 |
| 3376 | >Toxin: LACR_0826 | 8920 | >Antitoxin: LACR_0825 |
| 3377 | >Toxin: STER_0435 | 8921 | >Antitoxin: STER_0434 |
| 3378 | >Toxin: Lreu_0986 | 8922 | >Antitoxin: Lreu_0987 |
| 3379 | >Toxin: Cphy_0519 | 8923 | >Antitoxin: Cphy_0518 |
| 3380 | >Toxin: Shel_01090 | 8924 | >Antitoxin: Shel_01080 |
| 3381 | >Toxin: Jann_0512 | 8925 | >Antitoxin: Jann_0513 |
| 3382 | >Toxin: TM1040_2567 | 8926 | >Antitoxin: TM1040_2566 |
| 3383 | >Toxin: Rru_A1858 | 8927 | >Antitoxin: Rru_A1857 |
| 3384 | >Toxin: RSP_1668 | 8928 | >Antitoxin: RSP_1669 |
| 3385 | >Toxin: Mmar10_1577 | 8929 | >Antitoxin: Mmar10_1576 |
| 3386 | >Toxin: Pden_1402 | 8930 | >Antitoxin: Pden_1401 |
| 3387 | >Toxin: Rsph17029_0301 | 8931 | >Antitoxin: Rsph17029_0302 |
| 3388 | >Toxin: Rsph17025_2578 | 8932 | >Antitoxin: Rsph17025_2577 |
| 3389 | >Toxin: Acry_0529 | 8933 | >Antitoxin: Acry_0530 |
| 3390 | >Toxin: Plav_2866 | 8934 | >Antitoxin: Plav_2867 |
| 3391 | >Toxin: Dshi_0192 | 8935 | >Antitoxin: Dshi_0193 |
| 3392 | >Toxin: Gdia_0378 | 8936 | >Antitoxin: Gdia_0377 |
| 3393 | >Toxin: B21_03041 | 8937 | >Antitoxin: B21_03040 |
| 3394 | >Toxin: PSPTO_4425 | 8938 | >Antitoxin: PSPTO_4424 |
| 3395 | >Toxin: Psyr_4119 | 8939 | >Antitoxin: Psyr_4118 |
| 3396 | >Toxin: Csal_2206 | 8940 | >Antitoxin: Csal_2205 |
| 3397 | >Toxin: HS_0753 | 8941 | >Antitoxin: HS_0754 |
| 3398 | >Toxin: Ent638_3665 | 8942 | >Antitoxin: Ent638_3664 |
| 3399 | >Toxin: Mmwyl1_2399 | 8943 | >Antitoxin: Mmwyl1_2398 |
| 3400 | >Toxin: EcHS_A3419 | 8944 | >Antitoxin: EcHS_A3418 |
| 3401 | >Toxin: EcE24377A_3713 | 8945 | >Antitoxin: EcE24377A_3712 |
| 3402 | >Toxin: Spro_4348 | 8946 | >Antitoxin: Spro_4347 |
| 3403 | >Toxin: COXBURSA331_A1940 | 8947 | >Antitoxin: COXBURSA331_A1939 |
| 3404 | >Toxin: YpAngola_A1133 | 8948 | >Antitoxin: YpAngola_A1132 |
| 3405 | >Toxin: EcolC_0476 | 8949 | >Antitoxin: EcolC_0477 |
| 3406 | >Toxin: YPK_0525 | 8950 | >Antitoxin: YPK_0526 |
| 3407 | >Toxin: SbBS512_E3546 | 8951 | >Antitoxin: SbBS512_E3547 |
| 3408 | >Toxin: SNSL254_A3607 | 8952 | >Antitoxin: SNSL254_A3605 |
| 3409 | >Toxin: SeSA_A3536 | 8953 | >Antitoxin: SeSA_A3535 |
| 3410 | >Toxin: SeD_A3704 | 8954 | >Antitoxin: SeD_A3702 |
| 3411 | >Toxin: ECH74115_4547 | 8955 | >Antitoxin: ECH74115_4546 |
| 3412 | >Toxin: Dd703_3638 | 8956 | >Antitoxin: Dd703_3637 |
| 3413 | >Toxin: Dd1591_3796 | 8957 | >Antitoxin: Dd1591_3795 |
| 3414 | >Toxin: PC1_0293 | 8958 | >Antitoxin: PC1_0294 |
| 3415 | >Toxin: B21_03060 | 8959 | >Antitoxin: B21_03059 |
| 3416 | >Toxin: SO_4097 | 8960 | >Antitoxin: SO_4096 |
| 3417 | >Toxin: PP_0934 | 8961 | >Antitoxin: PP_0935 |
| 3418 | >Toxin: PSPTO_4471 | 8962 | >Antitoxin: PSPTO_4470 |
| 3419 | >Toxin: MCA0101 | 8963 | >Antitoxin: MCA0102 |
| 3420 | >Toxin: Psyr_4162 | 8964 | >Antitoxin: Psyr_4161 |
| 3421 | >Toxin: Psyc_0484 | 8965 | >Antitoxin: Psyc_0485 |

TABLE 3-continued

| SEQ ID NO: | Toxin polypeptide sequences designation | SEQ ID NO: | Antitoxin polypeptide sequences designation |
|---|---|---|---|
| 3422 | >Toxin: CPS_4559 | 8966 | >Antitoxin: CPS_4558 |
| 3423 | >Toxin: Daro_0115 | 8967 | >Antitoxin: Daro_0114 |
| 3424 | >Toxin: Tbd_0261 | 8968 | >Antitoxin: Tbd_0262 |
| 3425 | >Toxin: Tcr_1631 | 8969 | >Antitoxin: Tcr_1632 |
| 3426 | >Toxin: Nmul_A0319 | 8970 | >Antitoxin: Nmul_A0318 |
| 3427 | >Toxin: Sde_3191 | 8971 | >Antitoxin: Sde_3190 |
| 3428 | >Toxin: Mfla_2492 | 8972 | >Antitoxin: Mfla_2493 |
| 3429 | >Toxin: Sden_3333 | 8973 | >Antitoxin: Sden_3332 |
| 3430 | >Toxin: Csal_2239 | 8974 | >Antitoxin: Csal_2238 |
| 3431 | >Toxin: Pcryo_0479 | 8975 | >Antitoxin: Pcryo_0480 |
| 3432 | >Toxin: Rmet_0052 | 8976 | >Antitoxin: Rmet_0053 |
| 3433 | >Toxin: BCI_0048 | 8977 | >Antitoxin: BCI_0047 |
| 3434 | >Toxin: Patl_0184 | 8978 | >Antitoxin: Patl_0185 |
| 3435 | >Toxin: Rru_A0471 | 8979 | >Antitoxin: Rru_A0472 |
| 3436 | >Toxin: HS_1126 | 8980 | >Antitoxin: HS_1125 |
| 3437 | >Toxin: Shewmr7_0480 | 8981 | >Antitoxin: Shewmr7_0481 |
| 3438 | >Toxin: Shewmr4_3471 | 8982 | >Antitoxin: Shewmr4_3470 |
| 3439 | >Toxin: Mlg_0170 | 8983 | >Antitoxin: Mlg_0171 |
| 3440 | >Toxin: Sfri_3737 | 8984 | >Antitoxin: Sfri_3736 |
| 3441 | >Toxin: PA14_58130 | 8985 | >Antitoxin: PA14_58120 |
| 3442 | >Toxin: Mmc1_1413 | 8986 | >Antitoxin: Mmc1_1414 |
| 3443 | >Toxin: Shewana3_3647 | 8987 | >Antitoxin: Shewana3_3646 |
| 3444 | >Toxin: Sama_0468 | 8988 | >Antitoxin: Sama_0469 |
| 3445 | >Toxin: Ping_1123 | 8989 | >Antitoxin: Ping_1124 |
| 3446 | >Toxin: Aave_0295 | 8990 | >Antitoxin: Aave_0296 |
| 3447 | >Toxin: Ajs_0240 | 8991 | >Antitoxin: Ajs_0241 |
| 3448 | >Toxin: Veis_1609 | 8992 | >Antitoxin: Veis_1608 |
| 3449 | >Toxin: Hhal_1006 | 8993 | >Antitoxin: Hhal_1007 |
| 3450 | >Toxin: Maqu_2727 | 8994 | >Antitoxin: Maqu_2726 |
| 3451 | >Toxin: Sbal_3821 | 8995 | >Antitoxin: Sbal_3820 |
| 3452 | >Toxin: Shew_0404 | 8996 | >Antitoxin: Shew_0405 |
| 3453 | >Toxin: Pnuc_2022 | 8997 | >Antitoxin: Pnuc_2023 |
| 3454 | >Toxin: Ent638_3686 | 8998 | >Antitoxin: Ent638_3685 |
| 3455 | >Toxin: Pmen_0857 | 8999 | >Antitoxin: Pmen_0858 |
| 3456 | >Toxin: Sputcn32_0575 | 9000 | >Antitoxin: Sputcn32_0576 |
| 3457 | >Toxin: VC0395_A2835 | 9001 | >Antitoxin: VC0395_A2836 |
| 3458 | >Toxin: Pput_0974 | 9002 | >Antitoxin: Pput_0975 |
| 3459 | >Toxin: PsycPRwf_0421 | 9003 | >Antitoxin: PsycPRwf_0422 |
| 3460 | >Toxin: PSPA7_5094 | 9004 | >Antitoxin: PSPA7_5093 |
| 3461 | >Toxin: Mmwyl1_1938 | 9005 | >Antitoxin: Mmwyl1_1939 |
| 3462 | >Toxin: Shew185_0498 | 9006 | >Antitoxin: Shew185_0499 |
| 3463 | >Toxin: YpsIP31758_0399 | 9007 | >Antitoxin: YpsIP31758_0400 |
| 3464 | >Toxin: VIBHAR_03684 | 9008 | >Antitoxin: VIBHAR_03683 |
| 3465 | >Toxin: EcHS_A3439 | 9009 | >Antitoxin: EcHS_A3438 |
| 3466 | >Toxin: EcE24377A_3733 | 9010 | >Antitoxin: EcE24377A_3731 |
| 3467 | >Toxin: Ssed_0559 | 9011 | >Antitoxin: Ssed_0560 |
| 3468 | >Toxin: Spro_4410 | 9012 | >Antitoxin: Spro_4409 |
| 3469 | >Toxin: Spea_3753 | 9013 | >Antitoxin: Spea_3752 |
| 3470 | >Toxin: Sbal195_0519 | 9014 | >Antitoxin: Sbal195_0520 |
| 3471 | >Toxin: COXBURSA331_A1647 | 9015 | >Antitoxin: COXBURSA331_A1646 |
| 3472 | >Toxin: YpAngola_A1197 | 9016 | >Antitoxin: YpAngola_A1196 |
| 3473 | >Toxin: PputGB1_0941 | 9017 | >Antitoxin: PputGB1_0942 |
| 3474 | >Toxin: EcolC_0457 | 9018 | >Antitoxin: EcolC_0458 |
| 3475 | >Toxin: PputW619_4281 | 9019 | >Antitoxin: PputW619_4280 |
| 3476 | >Toxin: YPK_0466 | 9020 | >Antitoxin: YPK_0467 |
| 3477 | >Toxin: Swoo_4401 | 9021 | >Antitoxin: Swoo_4400 |
| 3478 | >Toxin: Xfasm12_0669 | 9022 | >Antitoxin: Xfasm12_0670 |
| 3479 | >Toxin: EcSMS35_3545 | 9023 | >Antitoxin: EcSMS35_3544 |
| 3480 | >Toxin: Lcho_0503 | 9024 | >Antitoxin: Lcho_0502 |
| 3481 | >Toxin: Pnec_1739 | 9025 | >Antitoxin: Pnec_1740 |
| 3482 | >Toxin: XfasM23_0588 | 9026 | >Antitoxin: XfasM23_0589 |
| 3483 | >Toxin: SbBS512_E3281 | 9027 | >Antitoxin: SbBS512_E3280 |
| 3484 | >Toxin: Smal_3453 | 9028 | >Antitoxin: Smal_3452 |
| 3485 | >Toxin: SNSL254_A3636 | 9029 | >Antitoxin: SNSL254_A3635 |
| 3486 | >Toxin: SeHA_C3671 | 9030 | >Antitoxin: SeHA_C3670 |
| 3487 | >Toxin: SeSA_A3565 | 9031 | >Antitoxin: SeSA_A3564 |
| 3488 | >Toxin: MADE_00265 | 9032 | >Antitoxin: MADE_00266 |
| 3489 | >Toxin: SeAg_B3564 | 9033 | >Antitoxin: SeAg_B3563 |
| 3490 | >Toxin: Lferr_2193 | 9034 | >Antitoxin: Lferr_2194 |
| 3491 | >Toxin: SeD_A3733 | 9035 | >Antitoxin: SeD_A3732 |
| 3492 | >Toxin: VSAL_I0484 | 9036 | >Antitoxin: VSAL_I0485 |
| 3493 | >Toxin: ECH74115_4566 | 9037 | >Antitoxin: ECH74115_4565 |
| 3494 | >Toxin: Tmz1t_0237 | 9038 | >Antitoxin: Tmz1t_0238 |
| 3495 | >Toxin: Sbal223_0523 | 9039 | >Antitoxin: Sbal223_0524 |
| 3496 | >Toxin: AFE_2563 | 9040 | >Antitoxin: AFE_2564 |
| 3497 | >Toxin: Tgr7_0513 | 9041 | >Antitoxin: Tgr7_0512 |
| 3498 | >Toxin: Dtpsy_0234 | 9042 | >Antitoxin: Dtpsy_0235 |

TABLE 3-continued

| | Toxin polypeptide sequences | | Antitoxin polypeptide sequences |
|---|---|---|---|
| SEQ ID NO: | designation | SEQ ID NO: | designation |
| 3499 | >Toxin: Avin__12660 | 9043 | >Antitoxin: Avin__12670 |
| 3500 | >Toxin: Dd703__3676 | 9044 | >Antitoxin: Dd703__3675 |
| 3501 | >Toxin: Dd1591__3834 | 9045 | >Antitoxin: Dd1591__3833 |
| 3502 | >Toxin: PC1__0253 | 9046 | >Antitoxin: PC1__0254 |
| 3503 | >Toxin: Nwi__1700 | 9047 | >Antitoxin: Nwi__1701 |
| 3504 | >Toxin: Noc__2148 | 9048 | >Antitoxin: Noc__2149 |
| 3505 | >Toxin: RPB__2392 | 9049 | >Antitoxin: RPB__2391 |
| 3506 | >Toxin: RPC__3329 | 9050 | >Antitoxin: RPC__3330 |
| 3507 | >Toxin: RPD__3059 | 9051 | >Antitoxin: RPD__3060 |
| 3508 | >Toxin: Nham__2421 | 9052 | >Antitoxin: Nham__2422 |
| 3509 | >Toxin: Meso__1370 | 9053 | >Antitoxin: Meso__1369 |
| 3510 | >Toxin: Ping__2499 | 9054 | >Antitoxin: Ping__2498 |
| 3511 | >Toxin: BBta__4778 | 9055 | >Antitoxin: BBta__4779 |
| 3512 | >Toxin: Xaut__4540 | 9056 | >Antitoxin: Xaut__4541 |
| 3513 | >Toxin: Rpal__3560 | 9057 | >Antitoxin: Rpal__3561 |
| 3514 | >Toxin: M446__2256 | 9058 | >Antitoxin: M446__2255 |
| 3515 | >Toxin: Msil__0751 | 9059 | >Antitoxin: Msil__0752 |
| 3516 | >Toxin: Mnod__0353 | 9060 | >Antitoxin: Mnod__0354 |
| 3517 | >Toxin: Francci3__0679 | 9061 | >Antitoxin: Francci3__0680 |
| 3518 | >Toxin: Dgeo__0887 | 9062 | >Antitoxin: Dgeo__0888 |
| 3519 | >Toxin: Mmcs__1228 | 9063 | >Antitoxin: Mmcs__1229 |
| 3520 | >Toxin: Arth__1129 | 9064 | >Antitoxin: Arth__1130 |
| 3521 | >Toxin: Mkms__1245 | 9065 | >Antitoxin: Mkms__1246 |
| 3522 | >Toxin: Mvan__1587 | 9066 | >Antitoxin: Mvan__1588 |
| 3523 | >Toxin: Mjls__1254 | 9067 | >Antitoxin: Mjls__1255 |
| 3524 | >Toxin: Mflv__4846 | 9068 | >Antitoxin: Mflv__4845 |
| 3525 | >Toxin: TBFG__13349 | 9069 | >Antitoxin: TBFG__13348 |
| 3526 | >Toxin: Cphamn1__2514 | 9070 | >Antitoxin: Cphamn1__2515 |
| 3527 | >Toxin: Paes__2255 | 9071 | >Antitoxin: Paes__2256 |
| 3528 | >Toxin: Achl__1202 | 9072 | >Antitoxin: Achl__1203 |
| 3529 | >Toxin: Amir__6464 | 9073 | >Antitoxin: Amir__6463 |
| 3530 | >Toxin: Bcav__2952 | 9074 | >Antitoxin: Bcav__2951 |
| 3531 | >Toxin: Bfae__21330 | 9075 | >Antitoxin: Bfae__21320 |
| 3532 | >Toxin: Mlut__04830 | 9076 | >Antitoxin: Mlut__04840 |
| 3533 | >Toxin: Caci__0770 | 9077 | >Antitoxin: Caci__0771 |
| 3534 | >Toxin: Svir__05360 | 9078 | >Antitoxin: Svir__05370 |
| 3535 | >Toxin: Jden__0819 | 9079 | >Antitoxin: Jden__0820 |
| 3536 | >Toxin: Namu__1309 | 9080 | >Antitoxin: Namu__1310 |
| 3537 | >Toxin: SERP2170 | 9081 | >Antitoxin: SERP2169 |
| 3538 | >Toxin: Moth__0607 | 9082 | >Antitoxin: Moth__0606 |
| 3539 | >Toxin: Swol__1512 | 9083 | >Antitoxin: Swol__1513 |
| 3540 | >Toxin: Dred__2469 | 9084 | >Antitoxin: Dred__2470 |
| 3541 | >Toxin: Gdia__2026 | 9085 | >Antitoxin: Gdia__2027 |
| 3542 | >Toxin: Ksed__17560 | 9086 | >Antitoxin: Ksed__17550 |
| 3543 | >Toxin: Elen__1387 | 9087 | >Antitoxin: Elen__1386 |
| 3544 | >Toxin: Ccur__00390 | 9088 | >Antitoxin: Ccur__00380 |
| 3545 | >Toxin: Apre__1243 | 9089 | >Antitoxin: Apre__1242 |
| 3546 | >Toxin: Shel__11050 | 9090 | >Antitoxin: Shel__11040 |
| 3547 | >Toxin: Apar__0696 | 9091 | >Antitoxin: Apar__0695 |
| 3548 | >Toxin: Dtox__3044 | 9092 | >Antitoxin: Dtox__3045 |
| 3549 | >Toxin: PG0071 | 9093 | >Antitoxin: PG0070 |
| 3550 | >Toxin: CHU__1037 | 9094 | >Antitoxin: CHU__1036 |
| 3551 | >Toxin: Fjoh__2903 | 9095 | >Antitoxin: Fjoh__2902 |
| 3552 | >Toxin: Oter__2576 | 9096 | >Antitoxin: Oter__2577 |
| 3553 | >Toxin: Aasi__0289 | 9097 | >Antitoxin: Aasi__0288 |
| 3554 | >Toxin: Coch__1756 | 9098 | >Antitoxin: Coch__1757 |
| 3555 | >Toxin: Phep__4279 | 9099 | >Antitoxin: Phep__4278 |
| 3556 | >Toxin: Dfer__3015 | 9100 | >Antitoxin: Dfer__3014 |
| 3557 | >Toxin: Cpin__1279 | 9101 | >Antitoxin: Cpin__1278 |
| 3558 | >Toxin: CPR__2094 | 9102 | >Antitoxin: CPR__2093 |
| 3559 | >Toxin: CPF__2382 | 9103 | >Antitoxin: CPF__2381 |
| 3560 | >Toxin: Cthe__0163 | 9104 | >Antitoxin: Cthe__0164 |
| 3561 | >Toxin: Cphy__2548 | 9105 | >Antitoxin: Cphy__2547 |
| 3562 | >Toxin: Dhaf__4334 | 9106 | >Antitoxin: Dhaf__4333 |
| 3563 | >Toxin: Hore__14100 | 9107 | >Antitoxin: Hore__14090 |
| 3564 | >Toxin: Ccel__1323 | 9108 | >Antitoxin: Ccel__1324 |
| 3565 | >Toxin: Apre__0929 | 9109 | >Antitoxin: Apre__0930 |
| 3566 | >Toxin: PSPTO__5284 | 9110 | >Antitoxin: PSPTO__5283 |
| 3567 | >Toxin: Psyr__4842 | 9111 | >Antitoxin: Psyr__4841 |
| 3568 | >Toxin: Sde__0348 | 9112 | >Antitoxin: Sde__0349 |
| 3569 | >Toxin: Spro__3823 | 9113 | >Antitoxin: Spro__3822 |
| 3570 | >Toxin: COXBURSA331__A1734 | 9114 | >Antitoxin: COXBURSA331__A1733 |
| 3571 | >Toxin: YpAngola__A3240 | 9115 | >Antitoxin: YpAngola__A3239 |
| 3572 | >Toxin: YPK__1034 | 9116 | >Antitoxin: YPK__1035 |
| 3573 | >Toxin: SeHA__C3216 | 9117 | >Antitoxin: SeHA__C3215 |
| 3574 | >Toxin: SeSA__A3167 | 9118 | >Antitoxin: SeSA__A3166 |
| 3575 | >Toxin: SeAg__B3150 | 9119 | >Antitoxin: SeAg__B3149 |

TABLE 3-continued

| Toxin polypeptide sequences | | Antitoxin polypeptide sequences | |
|---|---|---|---|
| SEQ ID NO: | designation | SEQ ID NO: | designation |
| 3576 | >Toxin: SeD_A3330 | 9120 | >Antitoxin: SeD_A3329 |
| 3577 | >Toxin: Dd703_3016 | 9121 | >Antitoxin: Dd703_3015 |
| 3578 | >Toxin: PC1_0905 | 9122 | >Antitoxin: PC1_0906 |
| 3579 | >Toxin: Rfer_3786 | 9123 | >Antitoxin: Rfer_3785 |
| 3580 | >Toxin: Bpro_0265 | 9124 | >Antitoxin: Bpro_0266 |
| 3581 | >Toxin: Aave_0347 | 9125 | >Antitoxin: Aave_0348 |
| 3582 | >Toxin: Ajs_0287 | 9126 | >Antitoxin: Ajs_0288 |
| 3583 | >Toxin: Pnap_0212 | 9127 | >Antitoxin: Pnap_0213 |
| 3584 | >Toxin: Veis_1273 | 9128 | >Antitoxin: Veis_1274 |
| 3585 | >Toxin: Mpe_A3434 | 9129 | >Antitoxin: Mpe_A3433 |
| 3586 | >Toxin: Daci_0400 | 9130 | >Antitoxin: Daci_0401 |
| 3587 | >Toxin: Lcho_3990 | 9131 | >Antitoxin: Lcho_3989 |
| 3588 | >Toxin: Dtpsy_0282 | 9132 | >Antitoxin: Dtpsy_0283 |
| 3589 | >Toxin: Vapar_4904 | 9133 | >Antitoxin: Vapar_4903 |
| 3590 | >Toxin: Csal_1644 | 9134 | >Antitoxin: Csal_1645 |
| 3591 | >Toxin: Patl_1767 | 9135 | >Antitoxin: Patl_1766 |
| 3592 | >Toxin: CHU_1081 | 9136 | >Antitoxin: CHU_1080 |
| 3593 | >Toxin: Sfri_1851 | 9137 | >Antitoxin: Sfri_1850 |
| 3594 | >Toxin: Fjoh_2211 | 9138 | >Antitoxin: Fjoh_2212 |
| 3595 | >Toxin: Spro_3043 | 9139 | >Antitoxin: Spro_3042 |
| 3596 | >Toxin: Caul_4167 | 9140 | >Antitoxin: Caul_4168 |
| 3597 | >Toxin: MADE_01800 | 9141 | >Antitoxin: MADE_01799 |
| 3598 | >Toxin: Phep_2288 | 9142 | >Antitoxin: Phep_2287 |
| 3599 | >Toxin: Dfer_5124 | 9143 | >Antitoxin: Dfer_5125 |
| 3600 | >Toxin: Mpal_0372 | 9144 | >Antitoxin: Mpal_0371 |
| 3601 | >Toxin: Shewmr7_0701 | 9145 | >Antitoxin: Shewmr7_0702 |
| 3602 | >Toxin: Sbal_1270 | 9146 | >Antitoxin: Sbal_1271 |
| 3603 | >Toxin: Ent638_1343 | 9147 | >Antitoxin: Ent638_1344 |
| 3604 | >Toxin: VC0395_1075 | 9148 | >Antitoxin: VC0395_1074 |
| 3605 | >Toxin: EcHS_A0912 | 9149 | >Antitoxin: EcHS_A0913 |
| 3606 | >Toxin: EcolC_2792 | 9150 | >Antitoxin: EcolC_2791 |
| 3607 | >Toxin: YPK_0884 | 9151 | >Antitoxin: YPK_0885 |
| 3608 | >Toxin: Mbar_A3105 | 9152 | >Antitoxin: Mbar_A3104 |
| 3609 | >Toxin: BURPS1710b_A1055 | 9153 | >Antitoxin: BURPS1710b_A1054 |
| 3610 | >Toxin: Pcar_2990 | 9154 | >Antitoxin: Pcar_2991 |
| 3611 | >Toxin: Plut_1064 | 9155 | >Antitoxin: Plut_1065 |
| 3612 | >Toxin: Nmul_A1660 | 9156 | >Antitoxin: Nmul_A1659 |
| 3613 | >Toxin: BTH_II0420 | 9157 | >Antitoxin: BTH_II0421 |
| 3614 | >Toxin: Rfer_1162 | 9158 | >Antitoxin: Rfer_1163 |
| 3615 | >Toxin: Bxe_A1880 | 9159 | >Antitoxin: Bxe_A1881 |
| 3616 | >Toxin: Bxe_C0048 | 9160 | >Antitoxin: Bxe_C0047 |
| 3617 | >Toxin: Patl_2669 | 9161 | >Antitoxin: Patl_2670 |
| 3618 | >Toxin: RSP_3930 | 9162 | >Antitoxin: RSP_3931 |
| 3619 | >Toxin: Sfri_3050 | 9163 | >Antitoxin: Sfri_3051 |
| 3620 | >Toxin: Ping_0464 | 9164 | >Antitoxin: Ping_0465 |
| 3621 | >Toxin: Pnap_2335 | 9165 | >Antitoxin: Pnap_2334 |
| 3622 | >Toxin: Rsph17029_4098 | 9166 | >Antitoxin: Rsph17029_4099 |
| 3623 | >Toxin: BMA10247_A0148 | 9167 | >Antitoxin: BMA10247_A0149 |
| 3624 | >Toxin: BURPS668_A2793 | 9168 | >Antitoxin: BURPS668_A2792 |
| 3625 | >Toxin: BURPS1106A_A2651 | 9169 | >Antitoxin: BURPS1106A_A2650 |
| 3626 | >Toxin: BBta_1439 | 9170 | >Antitoxin: BBta_1438 |
| 3627 | >Toxin: Mmwyl1_1955 | 9171 | >Antitoxin: Mmwyl1_1956 |
| 3628 | >Toxin: Dshi_0436 | 9172 | >Antitoxin: Dshi_0437 |
| 3629 | >Toxin: Bind_2774 | 9173 | >Antitoxin: Bind_2775 |
| 3630 | >Toxin: Bphy_1128 | 9174 | >Antitoxin: Bphy_1127 |
| 3631 | >Toxin: Bphyt_5559 | 9175 | >Antitoxin: Bphyt_5558 |
| 3632 | >Toxin: Rpal_1056 | 9176 | >Antitoxin: Rpal_1055 |
| 3633 | >Toxin: Paes_0889 | 9177 | >Antitoxin: Paes_0890 |
| 3634 | >Toxin: Avin_19680 | 9178 | >Antitoxin: Avin_19690 |
| 3635 | >Toxin: Dbac_0951 | 9179 | >Antitoxin: Dbac_0950 |
| 3636 | >Toxin: Fjoh_2893 | 9180 | >Antitoxin: Fjoh_2892 |
| 3637 | >Toxin: Coch_1073 | 9181 | >Antitoxin: Coch_1072 |
| 3638 | >Toxin: Phep_0306 | 9182 | >Antitoxin: Phep_0307 |
| 3639 | >Toxin: Dfer_4782 | 9183 | >Antitoxin: Dfer_4783 |
| 3640 | >Toxin: Cpin_0735 | 9184 | >Antitoxin: Cpin_1736 |
| 3641 | >Toxin: Cpin_2192 | 9185 | >Antitoxin: Cpin_2193 |
| 3642 | >Toxin: Cpin_3748 | 9186 | >Antitoxin: Cpin_3747 |
| 3643 | >Toxin: DET1408 | 9187 | >Antitoxin: DET1409 |
| 3644 | >Toxin: Dgeo_1103 | 9188 | >Antitoxin: Dgeo_1102 |
| 3645 | >Toxin: Moth_2402 | 9189 | >Antitoxin: Moth_2403 |
| 3646 | >Toxin: Dred_3174 | 9190 | >Antitoxin: Dred_3175 |
| 3647 | >Toxin: DehaBAV1_1215 | 9191 | >Antitoxin: DehaBAV1_1216 |
| 3648 | >Toxin: Daud_2173 | 9192 | >Antitoxin: Daud_2174 |
| 3649 | >Toxin: Elen_1088 | 9193 | >Antitoxin: Elen_1087 |
| 3650 | >Toxin: Ccur_09300 | 9194 | >Antitoxin: Ccur_09310 |
| 3651 | >Toxin: Shel_23670 | 9195 | >Antitoxin: Shel_23680 |
| 3652 | >Toxin: Dtox_0059 | 9196 | >Antitoxin: Dtox_0058 |

TABLE 3-continued

| SEQ ID NO: | Toxin polypeptide sequences designation | SEQ ID NO: | Antitoxin polypeptide sequences designation |
|---|---|---|---|
| 3653 | >Toxin: Aacl_2782 | 9197 | >Antitoxin: Aacl_2783 |
| 3654 | >Toxin: RSc0621 | 9198 | >Antitoxin: RSc0620 |
| 3655 | >Toxin: Daro_2593 | 9199 | >Antitoxin: Daro_2592 |
| 3656 | >Toxin: Bpro_0540 | 9200 | >Antitoxin: Bpro_0541 |
| 3657 | >Toxin: Bpro_2731 | 9201 | >Antitoxin: Bpro_2730 |
| 3658 | >Toxin: Spro_1511 | 9202 | >Antitoxin: Spro_1510 |
| 3659 | >Toxin: Dacl_3133 | 9203 | >Antitoxin: Dacl_3134 |
| 3660 | >Toxin: Bphy_5021 | 9204 | >Antitoxin: Bphy_5020 |
| 3661 | >Toxin: Gdia_1698 | 9205 | >Antitoxin: Gdia_1697 |
| 3662 | >Toxin: Gdia_2752 | 9206 | >Antitoxin: Gdia_2751 |
| 3663 | >Toxin: Vapar_2991 | 9207 | >Antitoxin: Vapar_2990 |
| 3664 | >Toxin: Ajs_3305 | 9208 | >Antitoxin: Ajs_3304 |
| 3665 | >Toxin: TBFG_12339 | 9209 | >Antitoxin: TBFG_12340 |
| 3666 | >Toxin: Oter_4149 | 9210 | >Antitoxin: Oter_4150 |
| 3667 | >Toxin: M446_6662 | 9211 | >Antitoxin: M446_6663 |
| 3668 | >Toxin: Dtpsy_2658 | 9212 | >Antitoxin: Dtpsy_2657 |
| 3669 | >Toxin: Bcav_0146 | 9213 | >Antitoxin: Bcav_0145 |
| 3670 | >Toxin: Bfae_28370 | 9214 | >Antitoxin: Bfae_28380 |
| 3671 | >Toxin: RSc1117 | 9215 | >Antitoxin: RSc1118 |
| 3672 | >Toxin: Reut_A1076 | 9216 | >Antitoxin: Reut_A1077 |
| 3673 | >Toxin: Rmet_1040 | 9217 | >Antitoxin: Rmet_1041 |
| 3674 | >Toxin: TM1040_1846 | 9218 | >Antitoxin: TM1040_1845 |
| 3675 | >Toxin: RSP_0777 | 9219 | >Antitoxin: RSP_0776 |
| 3676 | >Toxin: Pden_1840 | 9220 | >Antitoxin: Pden_1839 |
| 3677 | >Toxin: BMASAVP1_A2201 | 9221 | >Antitoxin: BMASAVP1_A2200 |
| 3678 | >Toxin: Rsph17029_2433 | 9222 | >Antitoxin: Rsph17029_2432 |
| 3679 | >Toxin: BMA10247_1474 | 9223 | >Antitoxin: BMA10247_1473 |
| 3680 | >Toxin: BURPS668_2584 | 9224 | >Antitoxin: BURPS668_2583 |
| 3681 | >Toxin: BURPS1106A_2639 | 9225 | >Antitoxin: BURPS1106A_2638 |
| 3682 | >Toxin: Rsph17025_0402 | 9226 | >Antitoxin: Rsph17025_0403 |
| 3683 | >Toxin: Glov_0758 | 9227 | >Antitoxin: Glov_0759 |
| 3684 | >Toxin: PSPTO_0935 | 9228 | >Antitoxin: PSPTO_0936 |
| 3685 | >Toxin: Psyr_0803 | 9229 | >Antitoxin: Psyr_0804 |
| 3686 | >Toxin: Psyc_0758 | 9230 | >Antitoxin: Psyc_0757 |
| 3687 | >Toxin: Noc_1003 | 9231 | >Antitoxin: Noc_1004 |
| 3688 | >Toxin: Bcep18194_B0278 | 9232 | >Antitoxin: Bcep18194_B0277 |
| 3689 | >Toxin: Rru_A0901 | 9233 | >Antitoxin: Rru_A0900 |
| 3690 | >Toxin: Ping_1268 | 9234 | >Antitoxin: Ping_1269 |
| 3691 | >Toxin: Pnap_4659 | 9235 | >Antitoxin: Pnap_4660 |
| 3692 | >Toxin: PsycPRwf_0082 | 9236 | >Antitoxin: PsycPRwf_0083 |
| 3693 | >Toxin: YpsIP31758_3791 | 9237 | >Antitoxin: YpsIP31758_3792 |
| 3694 | >Toxin: YpAngola_A0660 | 9238 | >Antitoxin: YpAngola_A0659 |
| 3695 | >Toxin: YPK_3879 | 9239 | >Antitoxin: YPK_3880 |
| 3696 | >Toxin: ECH74115_1348 | 9240 | >Antitoxin: ECH74115_1347 |
| 3697 | >Toxin: Tbd_0567 | 9241 | >Antitoxin: Tbd_0566 |
| 3698 | >Toxin: Mmc1_3717 | 9242 | >Antitoxin: Mmc1_3716 |
| 3699 | >Toxin: Pden_4150 | 9243 | >Antitoxin: Pden_4151 |
| 3700 | >Toxin: Pnuc_1157 | 9244 | >Antitoxin: Pnuc_1156 |
| 3701 | >Toxin: Rsph17025_3918 | 9245 | >Antitoxin: Rsph17025_3917 |
| 3702 | >Toxin: BBta_3671 | 9246 | >Antitoxin: BBta_3672 |
| 3703 | >Toxin: Dshi_2807 | 9247 | >Antitoxin: Dshi_2806 |
| 3704 | >Toxin: Mpop_4156 | 9248 | >Antitoxin: Mpop_4157 |
| 3705 | >Toxin: Mnod_7668 | 9249 | >Antitoxin: Mnod_7669 |
| 3706 | >Toxin: YpsIP31758_1279 | 9250 | >Antitoxin: YpsIP31758_1280 |
| 3707 | >Toxin: Spro_3465 | 9251 | >Antitoxin: Spro_3464 |
| 3708 | >Toxin: YpAngola_A2785 | 9252 | >Antitoxin: YpAngola_A2784 |
| 3709 | >Toxin: YPK_1392 | 9253 | >Antitoxin: YPK_1393 |
| 3710 | >Toxin: Dd703_3212 | 9254 | >Antitoxin: Dd703_3211 |
| 3711 | >Toxin: Dd1591_3291 | 9255 | >Antitoxin: Dd1591_3290 |
| 3712 | >Toxin: PC1_0756 | 9256 | >Antitoxin: PC1_0757 |
| 3713 | >Toxin: Dde_0128 | 9257 | >Antitoxin: Dde_0127 |
| 3714 | >Toxin: Rfer_3566 | 9258 | >Antitoxin: Rfer_3565 |
| 3715 | >Toxin: RPC_4427 | 9259 | >Antitoxin: RPC_4426 |
| 3716 | >Toxin: Rmet_2589 | 9260 | >Antitoxin: Rmet_2590 |
| 3717 | >Toxin: Bcen_1535 | 9261 | >Antitoxin: Bcen_1534 |
| 3718 | >Toxin: Rxyl_2989 | 9262 | >Antitoxin: Rxyl_2988 |
| 3719 | >Toxin: Moth_0726 | 9263 | >Antitoxin: Moth_0727 |
| 3720 | >Toxin: Bcen2424_6294 | 9264 | >Antitoxin: Bcen2424_6295 |
| 3721 | >Toxin: Bmul_6106 | 9265 | >Antitoxin: Bmul_6107 |
| 3722 | >Toxin: Bcenmc03_6953 | 9266 | >Antitoxin: Bcenmc03_6954 |
| 3723 | >Toxin: BamMC406_5964 | 9267 | >Antitoxin: BamMC406_5963 |
| 3724 | >Toxin: Oter_2151 | 9268 | >Antitoxin: Oter_2150 |
| 3725 | >Toxin: Bphy_5836 | 9269 | >Antitoxin: Bphy_5837 |
| 3726 | >Toxin: SNSL254_A0178 | 9270 | >Antitoxin: SNSL254_A0179 |
| 3727 | >Toxin: SeSA_A0181 | 9271 | >Antitoxin: SeSA_A0182 |
| 3728 | >Toxin: SeAg_B0194 | 9272 | >Antitoxin: SeAg_B0195 |
| 3729 | >Toxin: SeD_A0177 | 9273 | >Antitoxin: SeD_A0178 |

TABLE 3-continued

| SEQ ID NO: | Toxin polypeptide sequences designation | SEQ ID NO: | Antitoxin polypeptide sequences designation |
|---|---|---|---|
| 3730 | >Toxin: Mnod_8221 | 9274 | >Antitoxin: Mnod_8220 |
| 3731 | >Toxin: Phep_0524 | 9275 | >Antitoxin: Phep_0523 |
| 3732 | >Toxin: Dd703_0691 | 9276 | >Antitoxin: Dd703_0692 |
| 3733 | >Toxin: Dd1591_0648 | 9277 | >Antitoxin: Dd1591_0649 |
| 3734 | >Toxin: PC1_3536 | 9278 | >Antitoxin: PC1_3535 |
| 3735 | >Toxin: SO_0666 | 9279 | >Antitoxin: SO_0665 |
| 3736 | >Toxin: Mfla_2701 | 9280 | >Antitoxin: Mfla_2702 |
| 3737 | >Toxin: Bpro_3782 | 9281 | >Antitoxin: Bpro_3781 |
| 3738 | >Toxin: VC0395_A0764 | 9282 | >Antitoxin: VC0395_A0765 |
| 3739 | >Toxin: Shew185_2088 | 9283 | >Antitoxin: Shew185_2087 |
| 3740 | >Toxin: Sbal195_2135 | 9284 | >Antitoxin: Sbal195_2134 |
| 3741 | >Toxin: Tgr7_1642 | 9285 | >Antitoxin: Tgr7_1643 |
| 3742 | >Toxin: Avi_3008 | 9286 | >Antitoxin: Avi_3009 |
| 3743 | >Toxin: Dde_0309 | 9287 | >Antitoxin: Dde_0308 |
| 3744 | >Toxin: YpsIP31758_2058 | 9288 | >Antitoxin: YpsIP31758_2057 |
| 3745 | >Toxin: YpAngola_A2450 | 9289 | >Antitoxin: YpAngola_A2449 |
| 3746 | >Toxin: YPK_2170 | 9290 | >Antitoxin: YPK_2169 |
| 3747 | >Toxin: DvMF_2349 | 9291 | >Antitoxin: DvMF_2348 |
| 3748 | >Toxin: Avi_2178 | 9292 | >Antitoxin: Avi_2179 |
| 3749 | >Toxin: Dd703_1873 | 9293 | >Antitoxin: Dd703_1872 |
| 3750 | >Toxin: Dd1591_2093 | 9294 | >Antitoxin: Dd1591_2092 |
| 3751 | >Toxin: Dret_2124 | 9295 | >Antitoxin: Dret_2123 |
| 3752 | >Toxin: Ent638_0215 | 9296 | >Antitoxin: Ent638_0214 |
| 3753 | >Toxin: YpsIP31758_3844 | 9297 | >Antitoxin: YpsIP31758_3845 |
| 3754 | >Toxin: Spro_0292 | 9298 | >Antitoxin: Spro_0291 |
| 3755 | >Toxin: YpAngola_A0464 | 9299 | >Antitoxin: YpAngola_A0463 |
| 3756 | >Toxin: YPK_0356 | 9300 | >Antitoxin: YPK_0355 |
| 3757 | >Toxin: Dd703_3708 | 9301 | >Antitoxin: Dd703_3709 |
| 3758 | >Toxin: Dd1591_3862 | 9302 | >Antitoxin: Dd1591_3863 |
| 3759 | >Toxin: PC1_0224 | 9303 | >Antitoxin: PC1_0223 |
| 3760 | >Toxin: CPS_3479 | 9304 | >Antitoxin: CPS_3478 |
| 3761 | >Toxin: Sden_1676 | 9305 | >Antitoxin: Sden_1677 |
| 3762 | >Toxin: BCl_0426 | 9306 | >Antitoxin: BCl_0425 |
| 3763 | >Toxin: Sbal_2404 | 9307 | >Antitoxin: Sbal_2403 |
| 3764 | >Toxin: Ent638_1631 | 9308 | >Antitoxin: Ent638_1632 |
| 3765 | >Toxin: Sputcn32_2156 | 9309 | >Antitoxin: Sputcn32_2155 |
| 3766 | >Toxin: Shew185_2393 | 9310 | >Antitoxin: Shew185_2392 |
| 3767 | >Toxin: Spea_1545 | 9311 | >Antitoxin: Spea_1546 |
| 3768 | >Toxin: Sbal195_2509 | 9312 | >Antitoxin: Sbal195_2508 |
| 3769 | >Toxin: Sbal223_1954 | 9313 | >Antitoxin: Sbal223_1955 |
| 3770 | >Toxin: Dd1591_1648 | 9314 | >Antitoxin: Dd1591_1649 |
| 3771 | >Toxin: PC1_2477 | 9315 | >Antitoxin: PC1_2476 |
| 3772 | >Toxin: B21_02512 | 9316 | >Antitoxin: B21_02513 |
| 3773 | >Toxin: SO_3428 | 9317 | >Antitoxin: SO_3429 |
| 3774 | >Toxin: GSU0148 | 9318 | >Antitoxin: GSU0147 |
| 3775 | >Toxin: MCA0389 | 9319 | >Antitoxin: MCA0388 |
| 3776 | >Toxin: Noc_0926 | 9320 | >Antitoxin: Noc_0925 |
| 3777 | >Toxin: Pcar_2408 | 9321 | >Antitoxin: Pcar_2407 |
| 3778 | >Toxin: Gmet_0201 | 9322 | >Antitoxin: Gmet_0200 |
| 3779 | >Toxin: Tcr_1590 | 9323 | >Antitoxin: Tcr_1591 |
| 3780 | >Toxin: Mfla_0568 | 9324 | >Antitoxin: Mfla_0569 |
| 3781 | >Toxin: Csal_0625 | 9325 | >Antitoxin: Csal_0624 |
| 3782 | >Toxin: Patl_3015 | 9326 | >Antitoxin: Patl_3016 |
| 3783 | >Toxin: Shewmr7_1198 | 9327 | >Antitoxin: Shewmr7_1197 |
| 3784 | >Toxin: Shewmr4_1127 | 9328 | >Antitoxin: Shewmr4_1126 |
| 3785 | >Toxin: Mlg_1481 | 9329 | >Antitoxin: Mlg_1482 |
| 3786 | >Toxin: Mmc1_0013 | 9330 | >Antitoxin: Mmc1_0012 |
| 3787 | >Toxin: Shewana3_1128 | 9331 | >Antitoxin: Shewana3_1127 |
| 3788 | >Toxin: Ppro_3176 | 9332 | >Antitoxin: Ppro_3177 |
| 3789 | >Toxin: Sama_1048 | 9333 | >Antitoxin: Sama_1047 |
| 3790 | >Toxin: Hhal_1653 | 9334 | >Antitoxin: Hhal_1654 |
| 3791 | >Toxin: Sbal_3115 | 9335 | >Antitoxin: Sbal_3116 |
| 3792 | >Toxin: Shew_1217 | 9336 | >Antitoxin: Shew_1216 |
| 3793 | >Toxin: Ent638_3172 | 9337 | >Antitoxin: Ent638_3173 |
| 3794 | >Toxin: Sputcn32_2745 | 9338 | >Antitoxin: Sputcn32_2746 |
| 3795 | >Toxin: VC0395_A0072 | 9339 | >Antitoxin: VC0395_A0071 |
| 3796 | >Toxin: Gura_0222 | 9340 | >Antitoxin: Gura_0221 |
| 3797 | >Toxin: Shew185_3124 | 9341 | >Antitoxin: Shew185_3125 |
| 3798 | >Toxin: YpsIP31758_3238 | 9342 | >Antitoxin: YpsIP31758_3239 |
| 3799 | >Toxin: VIBHAR_03511 | 9343 | >Antitoxin: VIBHAR_03512 |
| 3800 | >Toxin: EcHS_A2833 | 9344 | >Antitoxin: EcHS_A2834 |
| 3801 | >Toxin: Spro_0843 | 9345 | >Antitoxin: Spro_0842 |
| 3802 | >Toxin: Sbal195_3267 | 9346 | >Antitoxin: Sbal195_3268 |
| 3803 | >Toxin: COXBURSA331_A0883 | 9347 | >Antitoxin: COXBURSA331_A0882 |
| 3804 | >Toxin: EcolC_1015 | 9348 | >Antitoxin: EcolC_1014 |
| 3805 | >Toxin: YPK_3373 | 9349 | >Antitoxin: YPK_3374 |
| 3806 | >Toxin: EcSMS35_2820 | 9350 | >Antitoxin: EcSMS35_2821 |

TABLE 3-continued

| Toxin polypeptide sequences | | Antitoxin polypeptide sequences | |
|---|---|---|---|
| SEQ ID NO: | designation | SEQ ID NO: | designation |
| 3807 | >Toxin: PXO_00147 | 9351 | >Antitoxin: PXO_00148 |
| 3808 | >Toxin: SbBS512_E3180 | 9352 | >Antitoxin: SbBS512_E3179 |
| 3809 | >Toxin: Smal_1478 | 9353 | >Antitoxin: Smal_1477 |
| 3810 | >Toxin: SNSL254_A3029 | 9354 | >Antitoxin: SNSL254_A3030 |
| 3811 | >Toxin: SeHA_C3013 | 9355 | >Antitoxin: SeHA_C3014 |
| 3812 | >Toxin: SeSA_A2978 | 9356 | >Antitoxin: SeSA_A2979 |
| 3813 | >Toxin: MADE_02846 | 9357 | >Antitoxin: MADE_02847 |
| 3814 | >Toxin: Gbem_3633 | 9358 | >Antitoxin: Gbem_3632 |
| 3815 | >Toxin: SeAg_B2946 | 9359 | >Antitoxin: SeAg_B2947 |
| 3816 | >Toxin: Lferr_1052 | 9360 | >Antitoxin: Lferr_1051 |
| 3817 | >Toxin: SeD_A3136 | 9361 | >Antitoxin: SeD_A3137 |
| 3818 | >Toxin: ECH74115_3944 | 9362 | >Antitoxin: ECH74115_3945 |
| 3819 | >Toxin: Sbal223_1250 | 9363 | >Antitoxin: Sbal223_1249 |
| 3820 | >Toxin: AFE_0934 | 9364 | >Antitoxin: AFE_0933 |
| 3821 | >Toxin: Tgr7_1289 | 9365 | >Antitoxin: Tgr7_1288 |
| 3822 | >Toxin: Dd703_0998 | 9366 | >Antitoxin: Dd703_0997 |
| 3823 | >Toxin: Dd1591_0983 | 9367 | >Antitoxin: Dd1591_0982 |
| 3824 | >Toxin: PC1_3211 | 9368 | >Antitoxin: PC1_3212 |
| 3825 | >Toxin: GM21_3738 | 9369 | >Antitoxin: GM21_3737 |
| 3826 | >Toxin: Bpro_1133 | 9370 | >Antitoxin: Bpro_1134 |
| 3827 | >Toxin: Aave_0898 | 9371 | >Antitoxin: Aave_0899 |
| 3828 | >Toxin: Ajs_3581 | 9372 | >Antitoxin: Ajs_3580 |
| 3829 | >Toxin: Pnap_3357 | 9373 | >Antitoxin: Pnap_3356 |
| 3830 | >Toxin: Veis_3024 | 9374 | >Antitoxin: Veis_3023 |
| 3831 | >Toxin: Mpe_A3193 | 9375 | >Antitoxin: Mpe_A3192 |
| 3832 | >Toxin: Dacl_1569 | 9376 | >Antitoxin: Dacl_1570 |
| 3833 | >Toxin: Lcho_3974 | 9377 | >Antitoxin: Lcho_3973 |
| 3834 | >Toxin: Dtpsy_2904 | 9378 | >Antitoxin: Dtpsy_2903 |
| 3835 | >Toxin: Vapar_4629 | 9379 | >Antitoxin: Vapar_4628 |
| 3836 | >Toxin: RSc0670 | 9380 | >Antitoxin: RSc0669 |
| 3837 | >Toxin: PP_4990 | 9381 | >Antitoxin: PP_4991 |
| 3838 | >Toxin: PSPTO_5032 | 9382 | >Antitoxin: PSPTO_5033 |
| 3839 | >Toxin: Psyr_0490 | 9383 | >Antitoxin: Psyr_0489 |
| 3840 | >Toxin: Psyc_1816 | 9384 | >Antitoxin: Psyc_1817 |
| 3841 | >Toxin: Daro_3897 | 9385 | >Antitoxin: Daro_3898 |
| 3842 | >Toxin: Reut_A2621 | 9386 | >Antitoxin: Reut_A2622 |
| 3843 | >Toxin: Tbd_2550 | 9387 | >Antitoxin: Tbd_2551 |
| 3844 | >Toxin: Noc_0129 | 9388 | >Antitoxin: Noc_0130 |
| 3845 | >Toxin: Rfer_1373 | 9389 | >Antitoxin: Rfer_1372 |
| 3846 | >Toxin: Sde_3632 | 9390 | >Antitoxin: Sde_3633 |
| 3847 | >Toxin: Mfla_1244 | 9391 | >Antitoxin: Mfla_1243 |
| 3848 | >Toxin: Bpro_1138 | 9392 | >Antitoxin: Bpro_1137 |
| 3849 | >Toxin: Pcryo_2099 | 9393 | >Antitoxin: Pcryo_2100 |
| 3850 | >Toxin: Rmet_0671 | 9394 | >Antitoxin: Rmet_0670 |
| 3851 | >Toxin: Mlg_0357 | 9395 | >Antitoxin: Mlg_0356 |
| 3852 | >Toxin: PA14_05340 | 9396 | >Antitoxin: PA14_05330 |
| 3853 | >Toxin: Aave_0903 | 9397 | >Antitoxin: Aave_0902 |
| 3854 | >Toxin: Ajs_3576 | 9398 | >Antitoxin: Ajs_3577 |
| 3855 | >Toxin: Pnap_3352 | 9399 | >Antitoxin: Pnap_3353 |
| 3856 | >Toxin: Veis_3019 | 9400 | >Antitoxin: Veis_3020 |
| 3857 | >Toxin: Mpe_A3188 | 9401 | >Antitoxin: Mpe_A3189 |
| 3858 | >Toxin: Maqu_3769 | 9402 | >Antitoxin: Maqu_3768 |
| 3859 | >Toxin: Pmen_0405 | 9403 | >Antitoxin: Pmen_0404 |
| 3860 | >Toxin: Pput_4864 | 9404 | >Antitoxin: Pput_4865 |
| 3861 | >Toxin: PsycPRwf_2157 | 9405 | >Antitoxin: PsycPRwf_2158 |
| 3862 | >Toxin: PSPA7_0510 | 9406 | >Antitoxin: PSPA7_0509 |
| 3863 | >Toxin: Dacl_1574 | 9407 | >Antitoxin: Dacl_1573 |
| 3864 | >Toxin: PputGB1_5040 | 9408 | >Antitoxin: PputGB1_5041 |
| 3865 | >Toxin: PputW619_0474 | 9409 | >Antitoxin: PputW619_0473 |
| 3866 | >Toxin: Lcho_3969 | 9410 | >Antitoxin: Lcho_3970 |
| 3867 | >Toxin: PXO_01604 | 9411 | >Antitoxin: PXO_01603 |
| 3868 | >Toxin: Rpic_0614 | 9412 | >Antitoxin: Rpic_0613 |
| 3869 | >Toxin: Smal_3087 | 9413 | >Antitoxin: Smal_3088 |
| 3870 | >Toxin: Tmz1t_3690 | 9414 | >Antitoxin: Tmz1t_3689 |
| 3871 | >Toxin: Tgr7_2902 | 9415 | >Antitoxin: Tgr7_2903 |
| 3872 | >Toxin: Dtpsy_2899 | 9416 | >Antitoxin: Dtpsy_2900 |
| 3873 | >Toxin: Vapar_4624 | 9417 | >Antitoxin: Vapar_4625 |
| 3874 | >Toxin: Rpic12D_0562 | 9418 | >Antitoxin: Rpic12D_0561 |
| 3875 | >Toxin: Jann_2718 | 9419 | >Antitoxin: Jann_2719 |
| 3876 | >Toxin: TM1040_1520 | 9420 | >Antitoxin: TM1040_1521 |
| 3877 | >Toxin: Rru_A2437 | 9421 | >Antitoxin: Rru_A2438 |
| 3878 | >Toxin: RSP_0193 | 9422 | >Antitoxin: RSP_0194 |
| 3879 | >Toxin: Pden_1269 | 9423 | >Antitoxin: Pden_1268 |
| 3880 | >Toxin: Rsph17029_1826 | 9424 | >Antitoxin: Rsph17029_1827 |
| 3881 | >Toxin: Rsph17025_1452 | 9425 | >Antitoxin: Rsph17025_1451 |
| 3882 | >Toxin: Acry_0172 | 9426 | >Antitoxin: Acry_0171 |
| 3883 | >Toxin: Swit_2553 | 9427 | >Antitoxin: Swit_2554 |

TABLE 3-continued

| Toxin polypeptide sequences | | Antitoxin polypeptide sequences | |
|---|---|---|---|
| SEQ ID NO: | designation | SEQ ID NO: | designation |
| 3884 | >Toxin: Plav__3295 | 9428 | >Antitoxin: Plav__3296 |
| 3885 | >Toxin: Dshi__1392 | 9429 | >Antitoxin: Dshi__1391 |
| 3886 | >Toxin: RSc2588 | 9430 | >Antitoxin: RSc2587 |
| 3887 | >Toxin: BTH_I0808 | 9431 | >Antitoxin: BTH_I0809 |
| 3888 | >Toxin: Rmet__1336 | 9432 | >Antitoxin: Rmet__1337 |
| 3889 | >Toxin: Rmet__1546 | 9433 | >Antitoxin: Rmet__1547 |
| 3890 | >Toxin: Bamb__2000 | 9434 | >Antitoxin: Bamb__2001 |
| 3891 | >Toxin: Shewana3__1278 | 9435 | >Antitoxin: Shewana3__1279 |
| 3892 | >Toxin: Aave__0722 | 9436 | >Antitoxin: Aave__0723 |
| 3893 | >Toxin: Pnap__4191 | 9437 | >Antitoxin: Pnap__4192 |
| 3894 | >Toxin: PSPA7__3710 | 9438 | >Antitoxin: PSPA7__3709 |
| 3895 | >Toxin: PSPA7__3723 | 9439 | >Antitoxin: PSPA7__3722 |
| 3896 | >Toxin: Daci__0442 | 9440 | >Antitoxin: Daci__0441 |
| 3897 | >Toxin: Bmul__2346 | 9441 | >Antitoxin: Bmul__2347 |
| 3898 | >Toxin: Rpic__2641 | 9442 | >Antitoxin: Rpic__2642 |
| 3899 | >Toxin: Tmz1t__2064 | 9443 | >Antitoxin: Tmz1t__2063 |
| 3900 | >Toxin: Tgr7__1891 | 9444 | >Antitoxin: Tgr7__1892 |
| 3901 | >Toxin: Dtpsy__1314 | 9445 | >Antitoxin: Dtpsy__1315 |
| 3902 | >Toxin: Dtpsy__3510 | 9446 | >Antitoxin: Dtpsy__3509 |
| 3903 | >Toxin: Avin__35760 | 9447 | >Antitoxin: Avin__35750 |
| 3904 | >Toxin: Avin__35850 | 9448 | >Antitoxin: Avin__35840 |
| 3905 | >Toxin: CPR__1601 | 9449 | >Antitoxin: CPR__1602 |
| 3906 | >Toxin: Ent638__4115 | 9450 | >Antitoxin: Ent638__4116 |
| 3907 | >Toxin: VC0395__0010 | 9451 | >Antitoxin: VC0395__0011 |
| 3908 | >Toxin: EcHS_A3965 | 9452 | >Antitoxin: EcHS_A3964 |
| 3909 | >Toxin: EcE24377A__4265 | 9453 | >Antitoxin: EcE24377A__4264 |
| 3910 | >Toxin: Spro__4900 | 9454 | >Antitoxin: Spro__4901 |
| 3911 | >Toxin: EcolC__4245 | 9455 | >Antitoxin: EcolC__4246 |
| 3912 | >Toxin: EcSMS35__4117 | 9456 | >Antitoxin: EcSMS35__4116 |
| 3913 | >Toxin: Nther__2687 | 9457 | >Antitoxin: Nther__2688 |
| 3914 | >Toxin: SNSL254_A4165 | 9458 | >Antitoxin: SNSL254_A4164 |
| 3915 | >Toxin: SeSA_A4094 | 9459 | >Antitoxin: SeSA_A4093 |
| 3916 | >Toxin: SeAg_B4109 | 9460 | >Antitoxin: SeAg_B4108 |
| 3917 | >Toxin: SeD_A4274 | 9461 | >Antitoxin: SeD_A4273 |
| 3918 | >Toxin: ECH74115__5185 | 9462 | >Antitoxin: ECH74115__5184 |
| 3919 | >Toxin: Aaci__2279 | 9463 | >Antitoxin: Aaci__2280 |
| 3920 | >Toxin: Adeh__0013 | 9464 | >Antitoxin: Adeh__0014 |
| 3921 | >Toxin: Anae109__0014 | 9465 | >Antitoxin: Anae109__0015 |
| 3922 | >Toxin: Dole__1190 | 9466 | >Antitoxin: Dole__1189 |
| 3923 | >Toxin: AnaeK__0013 | 9467 | >Antitoxin: AnaeK__0014 |
| 3924 | >Toxin: Dtur__0950 | 9468 | >Antitoxin: Dtur__0951 |
| 3925 | >Toxin: A2cp1__0013 | 9469 | >Antitoxin: A2cp1__0014 |
| 3926 | >Toxin: Dbac__0487 | 9470 | >Antitoxin: Dbac__0486 |
| 3927 | >Toxin: Dret__1117 | 9471 | >Antitoxin: Dret__1116 |
| 3928 | >Toxin: Reut_B4429 | 9472 | >Antitoxin: Reut_B4430 |
| 3929 | >Toxin: Noc__1239 | 9473 | >Antitoxin: Noc__1240 |
| 3930 | >Toxin: Pcar__2552 | 9474 | >Antitoxin: Pcar__2553 |
| 3931 | >Toxin: Adeh__0797 | 9475 | >Antitoxin: Adeh__0798 |
| 3932 | >Toxin: Nham__4186 | 9476 | >Antitoxin: Nham__4185 |
| 3933 | >Toxin: Acid345__3002 | 9477 | >Antitoxin: Acid345__3001 |
| 3934 | >Toxin: CHU__2211 | 9478 | >Antitoxin: CHU__2210 |
| 3935 | >Toxin: Fjoh__1636 | 9479 | >Antitoxin: Fjoh__1637 |
| 3936 | >Toxin: RoseRS__4141 | 9480 | >Antitoxin: RoseRS__4142 |
| 3937 | >Toxin: Anae109__0842 | 9481 | >Antitoxin: Anae109__0843 |
| 3938 | >Toxin: Rcas__1464 | 9482 | >Antitoxin: Rcas__1465 |
| 3939 | >Toxin: Mext__0217 | 9483 | >Antitoxin: Mext__0218 |
| 3940 | >Toxin: Mrad2831__6224 | 9484 | >Antitoxin: Mrad2831__6225 |
| 3941 | >Toxin: Oter__3933 | 9485 | >Antitoxin: Oter__3932 |
| 3942 | >Toxin: Mpop__0019 | 9486 | >Antitoxin: Mpop__0020 |
| 3943 | >Toxin: Amuc__1872 | 9487 | >Antitoxin: Amuc__1873 |
| 3944 | >Toxin: AnaeK__0845 | 9488 | >Antitoxin: AnaeK__0846 |
| 3945 | >Toxin: M446__5823 | 9489 | >Antitoxin: M446__5822 |
| 3946 | >Toxin: Gdia__0834 | 9490 | >Antitoxin: Gdia__0833 |
| 3947 | >Toxin: Mchl__0161 | 9491 | >Antitoxin: Mchl__0162 |
| 3948 | >Toxin: A2cp1__0849 | 9492 | >Antitoxin: A2cp1__0850 |
| 3949 | >Toxin: Mnod__6892 | 9493 | >Antitoxin: Mnod__6891 |
| 3950 | >Toxin: Rleg__5954 | 9494 | >Antitoxin: Rleg__5953 |
| 3951 | >Toxin: Phep__0290 | 9495 | >Antitoxin: Phep__0291 |
| 3952 | >Toxin: Dfer__3475 | 9496 | >Antitoxin: Dfer__3474 |
| 3953 | >Toxin: Cagg__3385 | 9497 | >Antitoxin: Cagg__3384 |
| 3954 | >Toxin: Cpin__0527 | 9498 | >Antitoxin: Cpin__0526 |
| 3955 | >Toxin: Arth__2706 | 9499 | >Antitoxin: Arth__2705 |
| 3956 | >Toxin: Noca__1440 | 9500 | >Antitoxin: Noca__1441 |
| 3957 | >Toxin: Strop__0973 | 9501 | >Antitoxin: Strop__0974 |
| 3958 | >Toxin: Franean1__5838 | 9502 | >Antitoxin: Franean1__5837 |
| 3959 | >Toxin: Sare__0910 | 9503 | >Antitoxin: Sare__0911 |
| 3960 | >Toxin: Achl__2437 | 9504 | >Antitoxin: Achl__2436 |

TABLE 3-continued

| Toxin polypeptide sequences | | Antitoxin polypeptide sequences | |
|---|---|---|---|
| SEQ ID NO: | designation | SEQ ID NO: | designation |
| 3961 | >Toxin: Bfae_20600 | 9505 | >Antitoxin: Bfae_20590 |
| 3962 | >Toxin: Mlut_14700 | 9506 | >Antitoxin: Mlut_14690 |
| 3963 | >Toxin: Ksed_08660 | 9507 | >Antitoxin: Ksed_08670 |
| 3964 | >Toxin: Caci_7585 | 9508 | >Antitoxin: Caci_7584 |
| 3965 | >Toxin: Svir_30890 | 9509 | >Antitoxin: Svir_30880 |
| 3966 | >Toxin: Jden_1822 | 9510 | >Antitoxin: Jden_1821 |
| 3967 | >Toxin: Rfer_2071 | 9511 | >Antitoxin: Rfer_2070 |
| 3968 | >Toxin: Bpro_2703 | 9512 | >Antitoxin: Bpro_2704 |
| 3969 | >Toxin: Aave_1588 | 9513 | >Antitoxin: Aave_1587 |
| 3970 | >Toxin: Ajs_3149 | 9514 | >Antitoxin: Ajs_3150 |
| 3971 | >Toxin: Pnap_2537 | 9515 | >Antitoxin: Pnap_2538 |
| 3972 | >Toxin: Veis_4366 | 9516 | >Antitoxin: Veis_4365 |
| 3973 | >Toxin: Mpe_A1578 | 9517 | >Antitoxin: Mpe_A1577 |
| 3974 | >Toxin: Pnuc_0828 | 9518 | >Antitoxin: Pnuc_0827 |
| 3975 | >Toxin: Daci_2856 | 9519 | >Antitoxin: Daci_2855 |
| 3976 | >Toxin: Lcho_1899 | 9520 | >Antitoxin: Lcho_1898 |
| 3977 | >Toxin: Pnec_1011 | 9521 | >Antitoxin: Pnec_1012 |
| 3978 | >Toxin: Dtpsy_2496 | 9522 | >Antitoxin: Dtpsy_2497 |
| 3979 | >Toxin: Vapar_2587 | 9523 | >Antitoxin: Vapar_2586 |
| 3980 | >Toxin: Daro_0008 | 9524 | >Antitoxin: Daro_0007 |
| 3981 | >Toxin: Nmul_A2694 | 9525 | >Antitoxin: Nmul_A2693 |
| 3982 | >Toxin: Sama_2952 | 9526 | >Antitoxin: Sama_2951 |
| 3983 | >Toxin: Hhal_0366 | 9527 | >Antitoxin: Hhal_0365 |
| 3984 | >Toxin: Swoo_3314 | 9528 | >Antitoxin: Swoo_3313 |
| 3985 | >Toxin: DvMF_1096 | 9529 | >Antitoxin: DvMF_1097 |
| 3986 | >Toxin: Tgr7_0082 | 9530 | >Antitoxin: Tgr7_0081 |
| 3987 | >Toxin: Avin_50630 | 9531 | >Antitoxin: Avin_50640 |
| 3988 | >Toxin: BR0817 | 9532 | >Antitoxin: BR0818 |
| 3989 | >Toxin: Nwi_1872 | 9533 | >Antitoxin: Nwi_1871 |
| 3990 | >Toxin: RPB_2589 | 9534 | >Antitoxin: RPB_2590 |
| 3991 | >Toxin: RPC_2419 | 9535 | >Antitoxin: RPC_2420 |
| 3992 | >Toxin: RPD_2870 | 9536 | >Antitoxin: RPD_2869 |
| 3993 | >Toxin: Nham_2205 | 9537 | >Antitoxin: Nham_2204 |
| 3994 | >Toxin: Rru_A1571 | 9538 | >Antitoxin: Rru_A1572 |
| 3995 | >Toxin: Meso_1037 | 9539 | >Antitoxin: Meso_1038 |
| 3996 | >Toxin: Mmar10_1371 | 9540 | >Antitoxin: Mmar10_1372 |
| 3997 | >Toxin: BBta_4546 | 9541 | >Antitoxin: BBta_4545 |
| 3998 | >Toxin: BOV_0812 | 9542 | >Antitoxin: BOV_0813 |
| 3999 | >Toxin: Smed_0905 | 9543 | >Antitoxin: Smed_0906 |
| 4000 | >Toxin: Oant_2408 | 9544 | >Antitoxin: Oant_2407 |
| 4001 | >Toxin: Plav_3211 | 9545 | >Antitoxin: Plav_3210 |
| 4002 | >Toxin: Xaut_4618 | 9546 | >Antitoxin: Xaut_4617 |
| 4003 | >Toxin: Mext_1070 | 9547 | >Antitoxin: Mext_1069 |
| 4004 | >Toxin: Mrad2831_2044 | 9548 | >Antitoxin: Mrad2831_2043 |
| 4005 | >Toxin: Mpop_1004 | 9549 | >Antitoxin: Mpop_1003 |
| 4006 | >Toxin: Rpal_3283 | 9550 | >Antitoxin: Rpal_3282 |
| 4007 | >Toxin: M446_4405 | 9551 | >Antitoxin: M446_4406 |
| 4008 | >Toxin: Rleg2_1276 | 9552 | >Antitoxin: Rleg2_1277 |
| 4009 | >Toxin: Msil_2933 | 9553 | >Antitoxin: Msil_2934 |
| 4010 | >Toxin: Mchl_1199 | 9554 | >Antitoxin: Mchl_1198 |
| 4011 | >Toxin: Mnod_4141 | 9555 | >Antitoxin: Mnod_4142 |
| 4012 | >Toxin: Avi_1731 | 9556 | >Antitoxin: Avi_1733 |
| 4013 | >Toxin: Rleg_1368 | 9557 | >Antitoxin: Rleg_1369 |
| 4014 | >Toxin: PMN2A_1141 | 9558 | >Antitoxin: PMN2A_1140 |
| 4015 | >Toxin: Ava_0994 | 9559 | >Antitoxin: Ava_0993 |
| 4016 | >Toxin: Noc_0362 | 9560 | >Antitoxin: Noc_0361 |
| 4017 | >Toxin: Syncc9902_1940 | 9561 | >Antitoxin: Syncc9902_1941 |
| 4018 | >Toxin: Syncc9605_0390 | 9562 | >Antitoxin: Syncc9605_0389 |
| 4019 | >Toxin: Gmet_1568 | 9563 | >Antitoxin: Gmet_1569 |
| 4020 | >Toxin: Synpcc7942_0158 | 9564 | >Antitoxin: Synpcc7942_0159 |
| 4021 | >Toxin: Nmul_A0972 | 9565 | >Antitoxin: Nmul_A0971 |
| 4022 | >Toxin: Tery_1108 | 9566 | >Antitoxin: Tery_1109 |
| 4023 | >Toxin: Mlg_1160 | 9567 | >Antitoxin: Mlg_1159 |
| 4024 | >Toxin: P9303_22891 | 9568 | >Antitoxin: P9303_22901 |
| 4025 | >Toxin: NATL1_20151 | 9569 | >Antitoxin: NATL1_20141 |
| 4026 | >Toxin: Cthe_2539 | 9570 | >Antitoxin: Cthe_2540 |
| 4027 | >Toxin: Gura_3943 | 9571 | >Antitoxin: Gura_3942 |
| 4028 | >Toxin: P9211_16891 | 9572 | >Antitoxin: P9211_16881 |
| 4029 | >Toxin: Nther_1092 | 9573 | >Antitoxin: Nther_1093 |
| 4030 | >Toxin: Cphamn1_0645 | 9574 | >Antitoxin: Cphamn1_0646 |
| 4031 | >Toxin: Gbem_1980 | 9575 | >Antitoxin: Gbem_1979 |
| 4032 | >Toxin: Dhaf_4109 | 9576 | >Antitoxin: Dhaf_4108 |
| 4033 | >Toxin: Athe_1186 | 9577 | >Antitoxin: Athe_1187 |
| 4034 | >Toxin: GM21_2240 | 9578 | >Antitoxin: GM21_2241 |
| 4035 | >Toxin: Mpal_1141 | 9579 | >Antitoxin: Mpal_1140 |
| 4036 | >Toxin: BCE_3851 | 9580 | >Antitoxin: BCE_3850 |
| 4037 | >Toxin: LMOf2365_1342 | 9581 | >Antitoxin: LMOf2365_1343 |

TABLE 3-continued

| Toxin polypeptide sequences | | Antitoxin polypeptide sequences | |
|---|---|---|---|
| SEQ ID NO: | designation | SEQ ID NO: | designation |
| 4038 | >Toxin: GBAA_3950 | 9582 | >Antitoxin: GBAA_3949 |
| 4039 | >Toxin: BAS3664 | 9583 | >Antitoxin: BAS3663 |
| 4040 | >Toxin: BT9727_3554 | 9584 | >Antitoxin: BT9727_3553 |
| 4041 | >Toxin: BCZK3572 | 9585 | >Antitoxin: BCZK3571 |
| 4042 | >Toxin: Tfu_0778 | 9586 | >Antitoxin: Tfu_0779 |
| 4043 | >Toxin: Pcar_1555 | 9587 | >Antitoxin: Pcar_1556 |
| 4044 | >Toxin: Adeh_1102 | 9588 | >Antitoxin: Adeh_1103 |
| 4045 | >Toxin: Francci3_3562 | 9589 | >Antitoxin: Francci3_3561 |
| 4046 | >Toxin: Acid345_4217 | 9590 | >Antitoxin: Acid345_4216 |
| 4047 | >Toxin: Rxyl_1411 | 9591 | >Antitoxin: Rxyl_1412 |
| 4048 | >Toxin: Sfum_1228 | 9592 | >Antitoxin: Sfum_1229 |
| 4049 | >Toxin: Acel_1515 | 9593 | >Antitoxin: Acel_1514 |
| 4050 | >Toxin: Dvul_2433 | 9594 | >Antitoxin: Dvul_2434 |
| 4051 | >Toxin: Bcer98_2465 | 9595 | >Antitoxin: Bcer98_2464 |
| 4052 | >Toxin: Franean1_1182 | 9596 | >Antitoxin: Franean1_1183 |
| 4053 | >Toxin: Dole_3035 | 9597 | >Antitoxin: Dole_3034 |
| 4054 | >Toxin: Sare_1327 | 9598 | >Antitoxin: Sare_1328 |
| 4055 | >Toxin: BcerKBAB4_3635 | 9599 | >Antitoxin: BcerKBAB4_3634 |
| 4056 | >Toxin: BCAH187_A3860 | 9600 | >Antitoxin: BCAH187_A3859 |
| 4057 | >Toxin: Dtur_1208 | 9601 | >Antitoxin: Dtur_1209 |
| 4058 | >Toxin: BCB4264_A3911 | 9602 | >Antitoxin: BCB4264_A3910 |
| 4059 | >Toxin: BCG9842_B1333 | 9603 | >Antitoxin: BCG9842_B1334 |
| 4060 | >Toxin: DvMF_2513 | 9604 | >Antitoxin: DvMF_2512 |
| 4061 | >Toxin: A2cp1_1230 | 9605 | >Antitoxin: A2cp1_1231 |
| 4062 | >Toxin: Amir_5834 | 9606 | >Antitoxin: Amir_5833 |
| 4063 | >Toxin: Dbac_2414 | 9607 | >Antitoxin: Dbac_2415 |
| 4064 | >Toxin: GWCH70_1155 | 9608 | >Antitoxin: GWCH70_1156 |
| 4065 | >Toxin: Caci_7742 | 9609 | >Antitoxin: Caci_7741 |
| 4066 | >Toxin: Svir_14570 | 9610 | >Antitoxin: Svir_14580 |
| 4067 | >Toxin: Dret_0495 | 9611 | >Antitoxin: Dret_0494 |
| 4068 | >Toxin: Namu_2207 | 9612 | >Antitoxin: Namu_2208 |
| 4069 | >Toxin: Nwi_0373 | 9613 | >Antitoxin: Nwi_0372 |
| 4070 | >Toxin: RPB_0069 | 9614 | >Antitoxin: RPB_0068 |
| 4071 | >Toxin: RPC_0508 | 9615 | >Antitoxin: RPC_0507 |
| 4072 | >Toxin: RPD_0093 | 9616 | >Antitoxin: RPD_0092 |
| 4073 | >Toxin: Nham_0466 | 9617 | >Antitoxin: Nham_0465 |
| 4074 | >Toxin: Mmar10_2381 | 9618 | >Antitoxin: Mmar10_2382 |
| 4075 | >Toxin: BBta_7609 | 9619 | >Antitoxin: BBta_7610 |
| 4076 | >Toxin: Smed_2552 | 9620 | >Antitoxin: Smed_2553 |
| 4077 | >Toxin: Plav_1578 | 9621 | >Antitoxin: Plav_1577 |
| 4078 | >Toxin: Xaut_2019 | 9622 | >Antitoxin: Xaut_2020 |
| 4079 | >Toxin: Caul_0378 | 9623 | >Antitoxin: Caul_0377 |
| 4080 | >Toxin: Bind_0430 | 9624 | >Antitoxin: Bind_0429 |
| 4081 | >Toxin: Rpal_0614 | 9625 | >Antitoxin: Rpal_0615 |
| 4082 | >Toxin: M446_2063 | 9626 | >Antitoxin: M446_2062 |
| 4083 | >Toxin: Rleg2_3582 | 9627 | >Antitoxin: Rleg2_3583 |
| 4084 | >Toxin: Msil_1898 | 9628 | >Antitoxin: Msil_1897 |
| 4085 | >Toxin: Mnod_0448 | 9629 | >Antitoxin: Mnod_0449 |
| 4086 | >Toxin: Avi_4036 | 9630 | >Antitoxin: Avi_4037 |
| 4087 | >Toxin: Rleg_3875 | 9631 | >Antitoxin: Rleg_3876 |
| 4088 | >Toxin: Arth_1982 | 9632 | >Antitoxin: Arth_1981 |
| 4089 | >Toxin: Shew185_0950 | 9633 | >Antitoxin: Shew185_0949 |
| 4090 | >Toxin: Bcer98_2848 | 9634 | >Antitoxin: Bcer98_2847 |
| 4091 | >Toxin: CHAB381_0432 | 9635 | >Antitoxin: CHAB381_0433 |
| 4092 | >Toxin: Sbal195_0985 | 9636 | >Antitoxin: Sbal195_0984 |
| 4093 | >Toxin: Cphy_0848 | 9637 | >Antitoxin: Cphy_0849 |
| 4094 | >Toxin: Sbal223_0971 | 9638 | >Antitoxin: Sbal223_0970 |
| 4095 | >Toxin: Caci_2776 | 9639 | >Antitoxin: Caci_2777 |
| 4096 | >Toxin: Rfer_0220 | 9640 | >Antitoxin: Rfer_0219 |
| 4097 | >Toxin: Bxe_A1422 | 9641 | >Antitoxin: Bxe_A1421 |
| 4098 | >Toxin: Bpro_1628 | 9642 | >Antitoxin: Bpro_1627 |
| 4099 | >Toxin: Pnap_2944 | 9643 | >Antitoxin: Pnap_2945 |
| 4100 | >Toxin: Veis_0732 | 9644 | >Antitoxin: Veis_0731 |
| 4101 | >Toxin: BBta_6640 | 9645 | >Antitoxin: BBta_6641 |
| 4102 | >Toxin: Daci_0074 | 9646 | >Antitoxin: Daci_0075 |
| 4103 | >Toxin: Bphy_1540 | 9647 | >Antitoxin: Bphy_1541 |
| 4104 | >Toxin: Bphyt_2696 | 9648 | >Antitoxin: Bphyt_2697 |
| 4105 | >Toxin: Vapar_0093 | 9649 | >Antitoxin: Vapar_0092 |
| 4106 | >Toxin: Jann_2733 | 9650 | >Antitoxin: Jann_2732 |
| 4107 | >Toxin: TM1040_2312 | 9651 | >Antitoxin: TM1040_2311 |
| 4108 | >Toxin: RSP_1856 | 9652 | >Antitoxin: RSP_1857 |
| 4109 | >Toxin: Pden_0538 | 9653 | >Antitoxin: Pden_0539 |
| 4110 | >Toxin: Rsph17029_0505 | 9654 | >Antitoxin: Rsph17029_0506 |
| 4111 | >Toxin: Rsph17025_0642 | 9655 | >Antitoxin: Rsph17025_0643 |
| 4112 | >Toxin: Dshi_2404 | 9656 | >Antitoxin: Dshi_2403 |
| 4113 | >Toxin: Bpro_3279 | 9657 | >Antitoxin: Bpro_3280 |
| 4114 | >Toxin: Aave_2105 | 9658 | >Antitoxin: Aave_2104 |

TABLE 3-continued

| | Toxin polypeptide sequences | | Antitoxin polypeptide sequences |
|---|---|---|---|
| SEQ ID NO: | designation | SEQ ID NO: | designation |
| 4115 | >Toxin: Ajs_2841 | 9659 | >Antitoxin: Ajs_2842 |
| 4116 | >Toxin: Pnap_1404 | 9660 | >Antitoxin: Pnap_1403 |
| 4117 | >Toxin: Mpe_A2319 | 9661 | >Antitoxin: Mpe_A2320 |
| 4118 | >Toxin: BMA10247_2917 | 9662 | >Antitoxin: BMA10247_2916 |
| 4119 | >Toxin: BURPS668_0556 | 9663 | >Antitoxin: BURPS668_0555 |
| 4120 | >Toxin: BURPS1106A_0571 | 9664 | >Antitoxin: BURPS1106A_0570 |
| 4121 | >Toxin: Pnuc_1002 | 9665 | >Antitoxin: Pnuc_1003 |
| 4122 | >Toxin: Dshi_1669 | 9666 | >Antitoxin: Dshi_1670 |
| 4123 | >Toxin: Daci_2370 | 9667 | >Antitoxin: Daci_2369 |
| 4124 | >Toxin: Dtpsy_2330 | 9668 | >Antitoxin: Dtpsy_2331 |
| 4125 | >Toxin: Vapar_3530 | 9669 | >Antitoxin: Vapar_3531 |
| 4126 | >Toxin: BR0659 | 9670 | >Antitoxin: BR0658 |
| 4127 | >Toxin: Meso_0948 | 9671 | >Antitoxin: Meso_0947 |
| 4128 | >Toxin: BARBAKC583_0471 | 9672 | >Antitoxin: BARBAKC583_0470 |
| 4129 | >Toxin: BOV_0652 | 9673 | >Antitoxin: BOV_0651 |
| 4130 | >Toxin: Smed_0680 | 9674 | >Antitoxin: Smed_0679 |
| 4131 | >Toxin: Oant_2629 | 9675 | >Antitoxin: Oant_2630 |
| 4132 | >Toxin: Rleg2_0996 | 9676 | >Antitoxin: Rleg2_0995 |
| 4133 | >Toxin: Rleg_1149 | 9677 | >Antitoxin: Rleg_1148 |
| 4134 | >Toxin: Reut_A3273 | 9678 | >Antitoxin: Reut_A3274 |
| 4135 | >Toxin: Bcep18194_B3076 | 9679 | >Antitoxin: Bcep18194_B3075 |
| 4136 | >Toxin: Rmet_3438 | 9680 | >Antitoxin: Rmet_3439 |
| 4137 | >Toxin: PputW619_3105 | 9681 | >Antitoxin: PputW619_3106 |
| 4138 | >Toxin: Rpic_3958 | 9682 | >Antitoxin: Rpic_3957 |
| 4139 | >Toxin: Bphyt_4351 | 9683 | >Antitoxin: Bphyt_4352 |
| 4140 | >Toxin: Rpic12D_4071 | 9684 | >Antitoxin: Rpic12D_4070 |
| 4141 | >Toxin: Ent638_2196 | 9685 | >Antitoxin: Ent638_2197 |
| 4142 | >Toxin: VC0395_A1332 | 9686 | >Antitoxin: VC0395_A1333 |
| 4143 | >Toxin: VIBHAR_01574 | 9687 | >Antitoxin: VIBHAR_01573 |
| 4144 | >Toxin: Spro_2657 | 9688 | >Antitoxin: Spro_2658 |
| 4145 | >Toxin: YpAngola_A2304 | 9689 | >Antitoxin: YpAngola_A2305 |
| 4146 | >Toxin: SNSL254_A1841 | 9690 | >Antitoxin: SNSL254_A1842 |
| 4147 | >Toxin: SeHA_C1904 | 9691 | >Antitoxin: SeHA_C1905 |
| 4148 | >Toxin: SeSA_A1846 | 9692 | >Antitoxin: SeSA_A1847 |
| 4149 | >Toxin: SeAg_B1432 | 9693 | >Antitoxin: SeAg_B1431 |
| 4150 | >Toxin: SeD_A1614 | 9694 | >Antitoxin: SeD_A1613 |
| 4151 | >Toxin: Dd703_1924 | 9695 | >Antitoxin: Dd703_1925 |
| 4152 | >Toxin: Dd1591_2162 | 9696 | >Antitoxin: Dd1591_2163 |
| 4153 | >Toxin: PC1_2015 | 9697 | >Antitoxin: PC1_2014 |
| 4154 | >Toxin: B21_03000 | 9698 | >Antitoxin: B21_02999 |
| 4155 | >Toxin: HS_0247 | 9699 | >Antitoxin: HS_0248 |
| 4156 | >Toxin: Ent638_3620 | 9700 | >Antitoxin: Ent638_3619 |
| 4157 | >Toxin: YpsIP31758_3610 | 9701 | >Antitoxin: YpsIP31758_3609 |
| 4158 | >Toxin: EcHS_A3377 | 9702 | >Antitoxin: EcHS_A3376 |
| 4159 | >Toxin: EcE24377A_3669 | 9703 | >Antitoxin: EcE24377A_3668 |
| 4160 | >Toxin: Spro_0475 | 9704 | >Antitoxin: Spro_0476 |
| 4161 | >Toxin: EcolC_0516 | 9705 | >Antitoxin: EcolC_0517 |
| 4162 | >Toxin: EcSMS35_3480 | 9706 | >Antitoxin: EcSMS35_3479 |
| 4163 | >Toxin: SbBS512_E3586 | 9707 | >Antitoxin: SbBS512_E3587 |
| 4164 | >Toxin: SNSL254_A3563 | 9708 | >Antitoxin: SNSL254_A3562 |
| 4165 | >Toxin: SeHA_C3599 | 9709 | >Antitoxin: SeHA_C3598 |
| 4166 | >Toxin: SeSA_A3494 | 9710 | >Antitoxin: SeSA_A3493 |
| 4167 | >Toxin: SeAg_B3492 | 9711 | >Antitoxin: SeAg_B3491 |
| 4168 | >Toxin: ECH74115_4506 | 9712 | >Antitoxin: ECH74115_4505 |
| 4169 | >Toxin: Dd703_3358 | 9713 | >Antitoxin: Dd703_3357 |
| 4170 | >Toxin: Dd1591_3477 | 9714 | >Antitoxin: Dd1591_3476 |
| 4171 | >Toxin: PC1_0560 | 9715 | >Antitoxin: PC1_0561 |
| 4172 | >Toxin: B21_03043 | 9716 | >Antitoxin: B21_03044 |
| 4173 | >Toxin: CPS_4344 | 9717 | >Antitoxin: CPS_4345 |
| 4174 | >Toxin: Sde_3165 | 9718 | >Antitoxin: Sde_3166 |
| 4175 | >Toxin: Csal_2208 | 9719 | >Antitoxin: Csal_2209 |
| 4176 | >Toxin: Maqu_2697 | 9720 | >Antitoxin: Maqu_2698 |
| 4177 | >Toxin: Ent638_3667 | 9721 | >Antitoxin: Ent638_3668 |
| 4178 | >Toxin: VC0395_A0102 | 9722 | >Antitoxin: VC0395_A0101 |
| 4179 | >Toxin: Mmwyl1_2401 | 9723 | >Antitoxin: Mmwyl1_2402 |
| 4180 | >Toxin: YpsIP31758_0458 | 9724 | >Antitoxin: YpsIP31758_0457 |
| 4181 | >Toxin: VIBHAR_00880 | 9725 | >Antitoxin: VIBHAR_00879 |
| 4182 | >Toxin: EcHS_A3421 | 9726 | >Antitoxin: EcHS_A3422 |
| 4183 | >Toxin: EcE24377A_3715 | 9727 | >Antitoxin: EcE24377A_3716 |
| 4184 | >Toxin: Spro_4350 | 9728 | >Antitoxin: Spro_4351 |
| 4185 | >Toxin: YpAngola_A1135 | 9729 | >Antitoxin: YpAngola_A1136 |
| 4186 | >Toxin: EcolC_0474 | 9730 | >Antitoxin: EcolC_0473 |
| 4187 | >Toxin: EcSMS35_3528 | 9731 | >Antitoxin: EcSMS35_3529 |
| 4188 | >Toxin: SbBS512_E3544 | 9732 | >Antitoxin: SbBS512_E3543 |
| 4189 | >Toxin: SNSL254_A3609 | 9733 | >Antitoxin: SNSL254_A3610 |
| 4190 | >Toxin: SeHA_C3644 | 9734 | >Antitoxin: SeHA_C3645 |
| 4191 | >Toxin: SeSA_A3538 | 9735 | >Antitoxin: SeSA_A3539 |

TABLE 3-continued

| SEQ ID NO: | Toxin polypeptide sequences designation | SEQ ID NO: | Antitoxin polypeptide sequences designation |
|---|---|---|---|
| 4192 | >Toxin: SeAg_B3537 | 9736 | >Antitoxin: SeAg_B3538 |
| 4193 | >Toxin: SeD_A3706 | 9737 | >Antitoxin: SeD_A3707 |
| 4194 | >Toxin: VSAL_I2665 | 9738 | >Antitoxin: VSAL_I2666 |
| 4195 | >Toxin: ECH74115_4549 | 9739 | >Antitoxin: ECH74115_4550 |
| 4196 | >Toxin: Dd703_3640 | 9740 | >Antitoxin: Dd703_3641 |
| 4197 | >Toxin: Dd1591_3798 | 9741 | >Antitoxin: Dd1591_3799 |
| 4198 | >Toxin: PC1_0291 | 9742 | >Antitoxin: PC1_0290 |
| 4199 | >Toxin: YpsIP31758_3940 | 9743 | >Antitoxin: YpsIP31758_3939 |
| 4200 | >Toxin: Spro_4576 | 9744 | >Antitoxin: Spro_4575 |
| 4201 | >Toxin: YpAngola_A3697 | 9745 | >Antitoxin: YpAngola_A3696 |
| 4202 | >Toxin: YPK_0256 | 9746 | >Antitoxin: YPK_0257 |
| 4203 | >Toxin: Dd703_0373 | 9747 | >Antitoxin: Dd703_0374 |
| 4204 | >Toxin: Dd1591_0297 | 9748 | >Antitoxin: Dd1591_0298 |
| 4205 | >Toxin: PC1_3849 | 9749 | >Antitoxin: PC1_3848 |
| 4206 | >Toxin: GBAA_2146 | 9750 | >Antitoxin: GBAA_2145 |
| 4207 | >Toxin: BAS1997 | 9751 | >Antitoxin: BAS1996 |
| 4208 | >Toxin: BT9727_1970 | 9752 | >Antitoxin: BT9727_1969 |
| 4209 | >Toxin: BCZK1949 | 9753 | >Antitoxin: BCZK1948 |
| 4210 | >Toxin: Daro_0816 | 9754 | >Antitoxin: Daro_0817 |
| 4211 | >Toxin: Ajs_2839 | 9755 | >Antitoxin: Ajs_2840 |
| 4212 | >Toxin: Veis_2593 | 9756 | >Antitoxin: Veis_2594 |
| 4213 | >Toxin: GSU2198 | 9757 | >Antitoxin: GSU2197 |
| 4214 | >Toxin: Gmet_2296 | 9758 | >Antitoxin: Gmet_2295 |
| 4215 | >Toxin: Dde_2378 | 9759 | >Antitoxin: Dde_2379 |
| 4216 | >Toxin: Acid345_1874 | 9760 | >Antitoxin: Acid345_1875 |
| 4217 | >Toxin: Moth_1112 | 9761 | >Antitoxin: Moth_1111 |
| 4218 | >Toxin: Sfum_0419 | 9762 | >Antitoxin: Sfum_0418 |
| 4219 | >Toxin: Dvul_2004 | 9763 | >Antitoxin: Dvul_2005 |
| 4220 | >Toxin: Gura_3127 | 9764 | >Antitoxin: Gura_3126 |
| 4221 | >Toxin: Dole_2355 | 9765 | >Antitoxin: Dole_2354 |
| 4222 | >Toxin: SYO3AOP1_0820 | 9766 | >Antitoxin: SYO3AOP1_0821 |
| 4223 | >Toxin: Gbem_0761 | 9767 | >Antitoxin: Gbem_0762 |
| 4224 | >Toxin: DvMF_1330 | 9768 | >Antitoxin: DvMF_1331 |
| 4225 | >Toxin: Ddes_1273 | 9769 | >Antitoxin: Ddes_1274 |
| 4226 | >Toxin: Dbac_0582 | 9770 | >Antitoxin: Dbac_0583 |
| 4227 | >Toxin: GM21_0777 | 9771 | >Antitoxin: GM21_0778 |
| 4228 | >Toxin: Dret_1591 | 9772 | >Antitoxin: Dret_1590 |
| 4229 | >Toxin: BR1724 | 9773 | >Antitoxin: BR1725 |
| 4230 | >Toxin: Nwi_2732 | 9774 | >Antitoxin: Nwi_2733 |
| 4231 | >Toxin: RPB_4464 | 9775 | >Antitoxin: RPB_4465 |
| 4232 | >Toxin: RPC_4764 | 9776 | >Antitoxin: RPC_4765 |
| 4233 | >Toxin: RPD_4310 | 9777 | >Antitoxin: RPD_4311 |
| 4234 | >Toxin: Nham_3529 | 9778 | >Antitoxin: Nham_3530 |
| 4235 | >Toxin: Meso_3442 | 9779 | >Antitoxin: Meso_3441 |
| 4236 | >Toxin: Mmar10_2444 | 9780 | >Antitoxin: Mmar10_2445 |
| 4237 | >Toxin: BARBAKC583_0135 | 9781 | >Antitoxin: BARBAKC583_0136 |
| 4238 | >Toxin: BBta_6921 | 9782 | >Antitoxin: BBta_6922 |
| 4239 | >Toxin: BOV_1667 | 9783 | >Antitoxin: BOV_1668 |
| 4240 | >Toxin: Smed_2648 | 9784 | >Antitoxin: Smed_2649 |
| 4241 | >Toxin: Oant_1192 | 9785 | >Antitoxin: Oant_1191 |
| 4242 | >Toxin: Plav_2110 | 9786 | >Antitoxin: Plav_2109 |
| 4243 | >Toxin: Mext_2364 | 9787 | >Antitoxin: Mext_2365 |
| 4244 | >Toxin: Mrad2831_0162 | 9788 | >Antitoxin: Mrad2831_0161 |
| 4245 | >Toxin: Bind_3470 | 9789 | >Antitoxin: Bind_3469 |
| 4246 | >Toxin: Mpop_2320 | 9790 | >Antitoxin: Mpop_2321 |
| 4247 | >Toxin: Rpal_1017 | 9791 | >Antitoxin: Rpal_1016 |
| 4248 | >Toxin: M446_5999 | 9792 | >Antitoxin: M446_6000 |
| 4249 | >Toxin: Rleg2_3234 | 9793 | >Antitoxin: Rleg2_3235 |
| 4250 | >Toxin: Msil_2280 | 9794 | >Antitoxin: Msil_2281 |
| 4251 | >Toxin: Mchl_2641 | 9795 | >Antitoxin: Mchl_2642 |
| 4252 | >Toxin: Mnod_7288 | 9796 | >Antitoxin: Mnod_7287 |
| 4253 | >Toxin: Avi_3642 | 9797 | >Antitoxin: Avi_3640 |
| 4254 | >Toxin: Rleg_3530 | 9798 | >Antitoxin: Rleg_3531 |
| 4255 | >Toxin: Sala_1670 | 9799 | >Antitoxin: Sala_1671 |
| 4256 | >Toxin: Rru_A3324 | 9800 | >Antitoxin: Rru_A3325 |
| 4257 | >Toxin: RSP_0690 | 9801 | >Antitoxin: RSP_0691 |
| 4258 | >Toxin: Rsph17029_2345 | 9802 | >Antitoxin: Rsph17029_2346 |
| 4259 | >Toxin: Smed_5929 | 9803 | >Antitoxin: Smed_5930 |
| 4260 | >Toxin: Oant_0463 | 9804 | >Antitoxin: Oant_0464 |
| 4261 | >Toxin: Xaut_0465 | 9805 | >Antitoxin: Xaut_0464 |
| 4262 | >Toxin: Dshi_0667 | 9806 | >Antitoxin: Dshi_0666 |
| 4263 | >Toxin: Rpal_0014 | 9807 | >Antitoxin: Rpal_0015 |
| 4264 | >Toxin: M446_6713 | 9808 | >Antitoxin: M446_6712 |
| 4265 | >Toxin: Msil_3665 | 9809 | >Antitoxin: Msil_3664 |
| 4266 | >Toxin: Avi_2393 | 9810 | >Antitoxin: Avi_2391 |
| 4267 | >Toxin: Rleg_4956 | 9811 | >Antitoxin: Rleg_4957 |
| 4268 | >Toxin: Mbar_A0098 | 9812 | >Antitoxin: Mbar_A0099 |

TABLE 3-continued

| Toxin polypeptide sequences | | Antitoxin polypeptide sequences | |
|---|---|---|---|
| SEQ ID NO: | designation | SEQ ID NO: | designation |
| 4269 | >Toxin: Mhun_2241 | 9813 | >Antitoxin: Mhun_2242 |
| 4270 | >Toxin: Mbur_0013 | 9814 | >Antitoxin: Mbur_0012 |
| 4271 | >Toxin: Mthe_1716 | 9815 | >Antitoxin: Mthe_1717 |
| 4272 | >Toxin: Tpen_0243 | 9816 | >Antitoxin: Tpen_0244 |
| 4273 | >Toxin: Pisl_0560 | 9817 | >Antitoxin: Pisl_0559 |
| 4274 | >Toxin: Mlab_0093 | 9818 | >Antitoxin: Mlab_0092 |
| 4275 | >Toxin: Memar_0576 | 9819 | >Antitoxin: Memar_0575 |
| 4276 | >Toxin: Pcal_1747 | 9820 | >Antitoxin: Pcal_1748 |
| 4277 | >Toxin: MmarC5_0167 | 9821 | >Antitoxin: MmarC5_0168 |
| 4278 | >Toxin: Pars_1730 | 9822 | >Antitoxin: Pars_1729 |
| 4279 | >Toxin: Msed_0103 | 9823 | >Antitoxin: Msed_0102 |
| 4280 | >Toxin: Mevan_0722 | 9824 | >Antitoxin: Mevan_0721 |
| 4281 | >Toxin: Maeo_1396 | 9825 | >Antitoxin: Maeo_1395 |
| 4282 | >Toxin: MmarC7_0656 | 9826 | >Antitoxin: MmarC7_0655 |
| 4283 | >Toxin: Mboo_0544 | 9827 | >Antitoxin: Mboo_0543 |
| 4284 | >Toxin: Cmaq_1832 | 9828 | >Antitoxin: Cmaq_1833 |
| 4285 | >Toxin: MmarC6_1262 | 9829 | >Antitoxin: MmarC6_1263 |
| 4286 | >Toxin: Nmar_0798 | 9830 | >Antitoxin: Nmar_0799 |
| 4287 | >Toxin: Tneu_1550 | 9831 | >Antitoxin: Tneu_1549 |
| 4288 | >Toxin: Hlac_2437 | 9832 | >Antitoxin: Hlac_2438 |
| 4289 | >Toxin: Huta_2304 | 9833 | >Antitoxin: Huta_2303 |
| 4290 | >Toxin: Mpal_0454 | 9834 | >Antitoxin: Mpal_0453 |
| 4291 | >Toxin: Hmuk_1840 | 9835 | >Antitoxin: Hmuk_1839 |
| 4292 | >Toxin: Moth_1750 | 9836 | >Antitoxin: Moth_1749 |
| 4293 | >Toxin: Daud_1377 | 9837 | >Antitoxin: Daud_1376 |
| 4294 | >Toxin: Nther_1816 | 9838 | >Antitoxin: Nther_1815 |
| 4295 | >Toxin: Dhaf_0220 | 9839 | >Antitoxin: Dhaf_0221 |
| 4296 | >Toxin: Hore_05640 | 9840 | >Antitoxin: Hore_05650 |
| 4297 | >Toxin: Dtox_2395 | 9841 | >Antitoxin: Dtox_2394 |
| 4298 | >Toxin: Aaci_2129 | 9842 | >Antitoxin: Aaci_2128 |
| 4299 | >Toxin: Swol_0491 | 9843 | >Antitoxin: Swol_0492 |
| 4300 | >Toxin: Sfum_0261 | 9844 | >Antitoxin: Sfum_0262 |
| 4301 | >Toxin: Franean1_1571 | 9845 | >Antitoxin: Franean1_1572 |
| 4302 | >Toxin: Glov_0185 | 9846 | >Antitoxin: Glov_0186 |
| 4303 | >Toxin: Mlut_00580 | 9847 | >Antitoxin: Mlut_00590 |
| 4304 | >Toxin: Caci_6429 | 9848 | >Antitoxin: Caci_6430 |
| 4305 | >Toxin: Namu_3589 | 9849 | >Antitoxin: Namu_3588 |
| 4306 | >Toxin: Swol_0979 | 9850 | >Antitoxin: Swol_0978 |
| 4307 | >Toxin: Dred_1882 | 9851 | >Antitoxin: Dred_1883 |
| 4308 | >Toxin: Tpet_0396 | 9852 | >Antitoxin: Tpet_0397 |
| 4309 | >Toxin: Pmob_1380 | 9853 | >Antitoxin: Pmob_1379 |
| 4310 | >Toxin: Daud_0556 | 9854 | >Antitoxin: Daud_0555 |
| 4311 | >Toxin: TRQ2_0412 | 9855 | >Antitoxin: TRQ2_0413 |
| 4312 | >Toxin: Dhaf_2730 | 9856 | >Antitoxin: Dhaf_2731 |
| 4313 | >Toxin: Dtox_2130 | 9857 | >Antitoxin: Dtox_2129 |
| 4314 | >Toxin: Aaci_1489 | 9858 | >Antitoxin: Aaci_1488 |
| 4315 | >Toxin: Rfer_2867 | 9859 | >Antitoxin: Rfer_2868 |
| 4316 | >Toxin: Meso_2435 | 9860 | >Antitoxin: Meso_2436 |
| 4317 | >Toxin: Mlg_2738 | 9861 | >Antitoxin: Mlg_2739 |
| 4318 | >Toxin: Ajs_3127 | 9862 | >Antitoxin: Ajs_3128 |
| 4319 | >Toxin: Mpe_A2221 | 9863 | >Antitoxin: Mpe_A2222 |
| 4320 | >Toxin: Smed_5505 | 9864 | >Antitoxin: Smed_5504 |
| 4321 | >Toxin: Dshi_0628 | 9865 | >Antitoxin: Dshi_0627 |
| 4322 | >Toxin: Mext_2852 | 9866 | >Antitoxin: Mext_2851 |
| 4323 | >Toxin: Mrad2831_6165 | 9867 | >Antitoxin: Mrad2831_6166 |
| 4324 | >Toxin: Mpop_2970 | 9868 | >Antitoxin: Mpop_2969 |
| 4325 | >Toxin: M446_3944 | 9869 | >Antitoxin: M446_3943 |
| 4326 | >Toxin: Mchl_3078 | 9870 | >Antitoxin: Mchl_3077 |
| 4327 | >Toxin: Mnod_3623 | 9871 | >Antitoxin: Mnod_3624 |
| 4328 | >Toxin: Dtpsy_2474 | 9872 | >Antitoxin: Dtpsy_2475 |
| 4329 | >Toxin: Vapar_1590 | 9873 | >Antitoxin: Vapar_1589 |
| 4330 | >Toxin: Mmcs_2235 | 9874 | >Antitoxin: Mmcs_2236 |
| 4331 | >Toxin: Noca_0933 | 9875 | >Antitoxin: Noca_0932 |
| 4332 | >Toxin: Mkms_2282 | 9876 | >Antitoxin: Mkms_2283 |
| 4333 | >Toxin: Mvan_0335 | 9877 | >Antitoxin: Mvan_0334 |
| 4334 | >Toxin: Mjls_2274 | 9878 | >Antitoxin: Mjls_2275 |
| 4335 | >Toxin: Strop_1773 | 9879 | >Antitoxin: Strop_1772 |
| 4336 | >Toxin: Sare_1760 | 9880 | >Antitoxin: Sare_1759 |
| 4337 | >Toxin: Amir_1992 | 9881 | >Antitoxin: Amir_1993 |
| 4338 | >Toxin: Bfae_27580 | 9882 | >Antitoxin: Bfae_27570 |
| 4339 | >Toxin: Caci_4842 | 9883 | >Antitoxin: Caci_4843 |
| 4340 | >Toxin: Svir_11380 | 9884 | >Antitoxin: Svir_11370 |
| 4341 | >Toxin: B21_02992 | 9885 | >Antitoxin: B21_02991 |
| 4342 | >Toxin: BCl_0636 | 9886 | >Antitoxin: BCl_0635 |
| 4343 | >Toxin: Ping_0813 | 9887 | >Antitoxin: Ping_0814 |
| 4344 | >Toxin: Ent638_3610 | 9888 | >Antitoxin: Ent638_3609 |
| 4345 | >Toxin: VC0395_A0168 | 9889 | >Antitoxin: VC0395_A0169 |

TABLE 3-continued

| | Toxin polypeptide sequences | | Antitoxin polypeptide sequences |
|---|---|---|---|
| SEQ ID NO: | designation | SEQ ID NO: | designation |
| 4346 | >Toxin: YpsIP31758__3600 | 9890 | >Antitoxin: YpsIP31758__3599 |
| 4347 | >Toxin: VIBHAR__03402 | 9891 | >Antitoxin: VIBHAR__03401 |
| 4348 | >Toxin: EcHS__A3368 | 9892 | >Antitoxin: EcHS__A3367 |
| 4349 | >Toxin: EcE24377A__3661 | 9893 | >Antitoxin: EcE24377A__3660 |
| 4350 | >Toxin: Spro__0485 | 9894 | >Antitoxin: Spro__0486 |
| 4351 | >Toxin: YpAngola__A3987 | 9895 | >Antitoxin: YpAngola__A3988 |
| 4352 | >Toxin: EcolC__0524 | 9896 | >Antitoxin: EcolC__0525 |
| 4353 | >Toxin: YPK__3734 | 9897 | >Antitoxin: YPK__3733 |
| 4354 | >Toxin: EcSMS35__3472 | 9898 | >Antitoxin: EcSMS35__3471 |
| 4355 | >Toxin: SbBS512__E3594 | 9899 | >Antitoxin: SbBS512__E3595 |
| 4356 | >Toxin: SNSL254__A3553 | 9900 | >Antitoxin: SNSL254__A3552 |
| 4357 | >Toxin: SeHA__C3589 | 9901 | >Antitoxin: SeHA__C3588 |
| 4358 | >Toxin: SeSA__A3483 | 9902 | >Antitoxin: SeSA__A3482 |
| 4359 | >Toxin: SeAg__B3483 | 9903 | >Antitoxin: SeAg__B3482 |
| 4360 | >Toxin: SeD__A3651 | 9904 | >Antitoxin: SeD__A3650 |
| 4361 | >Toxin: VSAL__I0594 | 9905 | >Antitoxin: VSAL__I0595 |
| 4362 | >Toxin: ECH74115__4498 | 9906 | >Antitoxin: ECH74115__4497 |
| 4363 | >Toxin: Avin__42860 | 9907 | >Antitoxin: Avin__42850 |
| 4364 | >Toxin: Dd703__3350 | 9908 | >Antitoxin: Dd703__3349 |
| 4365 | >Toxin: Dd1591__3469 | 9909 | >Antitoxin: Dd1591__3468 |
| 4366 | >Toxin: PC1__0568 | 9910 | >Antitoxin: PC1__0569 |
| 4367 | >Toxin: BCE__0330 | 9911 | >Antitoxin: BCE__0329 |
| 4368 | >Toxin: GBAA__0301 | 9912 | >Antitoxin: GBAA__0300 |
| 4369 | >Toxin: BAS0288 | 9913 | >Antitoxin: BAS0287 |
| 4370 | >Toxin: CPS__3456 | 9914 | >Antitoxin: CPS__3455 |
| 4371 | >Toxin: Tfu__1437 | 9915 | >Antitoxin: Tfu__1438 |
| 4372 | >Toxin: Saro__3197 | 9916 | >Antitoxin: Saro__3196 |
| 4373 | >Toxin: Dgeo__2423 | 9917 | >Antitoxin: Dgeo__2422 |
| 4374 | >Toxin: Sala__0217 | 9918 | >Antitoxin: Sala__0218 |
| 4375 | >Toxin: Sama__2874 | 9919 | >Antitoxin: Sama__2873 |
| 4376 | >Toxin: Swit__2131 | 9920 | >Antitoxin: Swit__2130 |
| 4377 | >Toxin: Bcer98__0282 | 9921 | >Antitoxin: Bcer98__0281 |
| 4378 | >Toxin: Franean1__0106 | 9922 | >Antitoxin: Franean1__0105 |
| 4379 | >Toxin: BcerKBAB4__0282 | 9923 | >Antitoxin: BcerKBAB4__0281 |
| 4380 | >Toxin: Caul__2841 | 9924 | >Antitoxin: Caul__2840 |
| 4381 | >Toxin: Oter__2237 | 9925 | >Antitoxin: Oter__2236 |
| 4382 | >Toxin: Smal__1106 | 9926 | >Antitoxin: Smal__1105 |
| 4383 | >Toxin: MADE__01581 | 9927 | >Antitoxin: MADE__01582 |
| 4384 | >Toxin: BCAH187__A0374 | 9928 | >Antitoxin: BCAH187__A0373 |
| 4385 | >Toxin: BCB4264__A0347 | 9929 | >Antitoxin: BCB4264__A0346 |
| 4386 | >Toxin: BCG9842__B4973 | 9930 | >Antitoxin: BCG9842__B4974 |
| 4387 | >Toxin: BCAH820__0333 | 9931 | >Antitoxin: BCAH820__0332 |
| 4388 | >Toxin: Dhaf__0786 | 9932 | >Antitoxin: Dhaf__0785 |
| 4389 | >Toxin: Ccel__1361 | 9933 | >Antitoxin: Ccel__1362 |
| 4390 | >Toxin: Amir__1211 | 9934 | >Antitoxin: Amir__1210 |
| 4391 | >Toxin: GWCH70__0387 | 9935 | >Antitoxin: GWCH70__0386 |
| 4392 | >Toxin: Elen__2127 | 9936 | >Antitoxin: Elen__2126 |
| 4393 | >Toxin: Dfer__3657 | 9937 | >Antitoxin: Dfer__3656 |
| 4394 | >Toxin: Cpin__1882 | 9938 | >Antitoxin: Cpin__1881 |
| 4395 | >Toxin: Caci__1922 | 9939 | >Antitoxin: Caci__1923 |
| 4396 | >Toxin: Apre__0211 | 9940 | >Antitoxin: Apre__0210 |
| 4397 | >Toxin: Apar__0055 | 9941 | >Antitoxin: Apar__0056 |
| 4398 | >Toxin: Dtox__2916 | 9942 | >Antitoxin: Dtox__2917 |
| 4399 | >Toxin: Tfu__2052 | 9943 | >Antitoxin: Tfu__2053 |
| 4400 | >Toxin: Cag__0777 | 9944 | >Antitoxin: Cag__0776 |
| 4401 | >Toxin: Francci3__3169 | 9945 | >Antitoxin: Francci3__3170 |
| 4402 | >Toxin: Acel__1257 | 9946 | >Antitoxin: Acel__1258 |
| 4403 | >Toxin: Mflv__3524 | 9947 | >Antitoxin: Mflv__3525 |
| 4404 | >Toxin: Strop__1894 | 9948 | >Antitoxin: Strop__1893 |
| 4405 | >Toxin: TBFG__11676 | 9949 | >Antitoxin: TBFG__11675 |
| 4406 | >Toxin: Franean1__1743 | 9950 | >Antitoxin: Franean1__1742 |
| 4407 | >Toxin: Cphamn1__1332 | 9951 | >Antitoxin: Cphamn1__1333 |
| 4408 | >Toxin: Bcav__2367 | 9952 | >Antitoxin: Bcav__2368 |
| 4409 | >Toxin: Elen__2339 | 9953 | >Antitoxin: Elen__2340 |
| 4410 | >Toxin: Svir__25570 | 9954 | >Antitoxin: Svir__25580 |
| 4411 | >Toxin: Jden__1117 | 9955 | >Antitoxin: Jden__1116 |
| 4412 | >Toxin: Mbar__A3694 | 9956 | >Antitoxin: Mbar__A3695 |
| 4413 | >Toxin: Mhun__0050 | 9957 | >Antitoxin: Mhun__0049 |
| 4414 | >Toxin: Mbur__1179 | 9958 | >Antitoxin: Mbur__1180 |
| 4415 | >Toxin: Mthe__0027 | 9959 | >Antitoxin: Mthe__0026 |
| 4416 | >Toxin: Tpen__0286 | 9960 | >Antitoxin: Tpen__0287 |
| 4417 | >Toxin: Pisl__0703 | 9961 | >Antitoxin: Pisl__0704 |
| 4418 | >Toxin: Mlab__1163 | 9962 | >Antitoxin: Mlab__1164 |
| 4419 | >Toxin: Memar__0312 | 9963 | >Antitoxin: Memar__0311 |
| 4420 | >Toxin: Pcal__2091 | 9964 | >Antitoxin: Pcal__2090 |
| 4421 | >Toxin: MmarC5__0217 | 9965 | >Antitoxin: MmarC5__0218 |
| 4422 | >Toxin: Pars__2321 | 9966 | >Antitoxin: Pars__2320 |

TABLE 3-continued

| | Toxin polypeptide sequences | | Antitoxin polypeptide sequences |
|---|---|---|---|
| SEQ ID NO: | designation | SEQ ID NO: | designation |
| 4423 | >Toxin: Msed_0033 | 9967 | >Antitoxin: Msed_0032 |
| 4424 | >Toxin: Mevan_0671 | 9968 | >Antitoxin: Mevan_0670 |
| 4425 | >Toxin: Maeo_0791 | 9969 | >Antitoxin: Maeo_0792 |
| 4426 | >Toxin: MmarC7_0606 | 9970 | >Antitoxin: MmarC7_0605 |
| 4427 | >Toxin: Mboo_1934 | 9971 | >Antitoxin: Mboo_1935 |
| 4428 | >Toxin: MmarC6_1312 | 9972 | >Antitoxin: MmarC6_1313 |
| 4429 | >Toxin: Nmar_0347 | 9973 | >Antitoxin: Nmar_0346 |
| 4430 | >Toxin: Tneu_1963 | 9974 | >Antitoxin: Tneu_1962 |
| 4431 | >Toxin: Hlac_0107 | 9975 | >Antitoxin: Hlac_0108 |
| 4432 | >Toxin: Huta_0784 | 9976 | >Antitoxin: Huta_0785 |
| 4433 | >Toxin: Mpal_2159 | 9977 | >Antitoxin: Mpal_2158 |
| 4434 | >Toxin: Hmuk_0515 | 9978 | >Antitoxin: Hmuk_0516 |
| 4435 | >Toxin: Daro_2618 | 9979 | >Antitoxin: Daro_2619 |
| 4436 | >Toxin: Ajs_1330 | 9980 | >Antitoxin: Ajs_1331 |
| 4437 | >Toxin: Pnap_4568 | 9981 | >Antitoxin: Pnap_4567 |
| 4438 | >Toxin: Mpe_A1650 | 9982 | >Antitoxin: Mpe_A1651 |
| 4439 | >Toxin: Mpe_A2673 | 9983 | >Antitoxin: Mpe_A2672 |
| 4440 | >Toxin: Daci_1741 | 9984 | >Antitoxin: Daci_1740 |
| 4441 | >Toxin: Lcho_0143 | 9985 | >Antitoxin: Lcho_0142 |
| 4442 | >Toxin: Tmz1t_2383 | 9986 | >Antitoxin: Tmz1t_2384 |
| 4443 | >Toxin: Dtpsy_1143 | 9987 | >Antitoxin: Dtpsy_1144 |
| 4444 | >Toxin: Avin_18560 | 9988 | >Antitoxin: Avin_18550 |
| 4445 | >Toxin: Tfu_2917 | 9989 | >Antitoxin: Tfu_2916 |
| 4446 | >Toxin: Francci3_0254 | 9990 | >Antitoxin: Francci3_0255 |
| 4447 | >Toxin: Mmcs_2811 | 9991 | >Antitoxin: Mmcs_2810 |
| 4448 | >Toxin: Arth_1620 | 9992 | >Antitoxin: Arth_1621 |
| 4449 | >Toxin: Mkms_2855 | 9993 | >Antitoxin: Mkms_2854 |
| 4450 | >Toxin: Mvan_3088 | 9994 | >Antitoxin: Mvan_3087 |
| 4451 | >Toxin: Mjls_2838 | 9995 | >Antitoxin: Mjls_2837 |
| 4452 | >Toxin: Mflv_3358 | 9996 | >Antitoxin: Mflv_3357 |
| 4453 | >Toxin: Strop_0824 | 9997 | >Antitoxin: Strop_0825 |
| 4454 | >Toxin: TBFG_11873 | 9998 | >Antitoxin: TBFG_11874 |
| 4455 | >Toxin: Franean1_6582 | 9999 | >Antitoxin: Franean1_6581 |
| 4456 | >Toxin: Sare_0768 | 10000 | >Antitoxin: Sare_0769 |
| 4457 | >Toxin: Achl_1614 | 10001 | >Antitoxin: Achl_1615 |
| 4458 | >Toxin: Ksed_01850 | 10002 | >Antitoxin: Ksed_01860 |
| 4459 | >Toxin: Caci_0306 | 10003 | >Antitoxin: Caci_0305 |
| 4460 | >Toxin: Svir_37270 | 10004 | >Antitoxin: Svir_37280 |
| 4461 | >Toxin: Namu_3765 | 10005 | >Antitoxin: Namu_3766 |
| 4462 | >Toxin: Syncc9605_2124 | 10006 | >Antitoxin: Syncc9605_2125 |
| 4463 | >Toxin: Rru_A3295 | 10007 | >Antitoxin: Rru_A3294 |
| 4464 | >Toxin: P9515_15031 | 10008 | >Antitoxin: P9515_15041 |
| 4465 | >Toxin: P9301_15281 | 10009 | >Antitoxin: P9301_15291 |
| 4466 | >Toxin: RoseRS_3359 | 10010 | >Antitoxin: RoseRS_3358 |
| 4467 | >Toxin: Mboo_1484 | 10011 | >Antitoxin: Mboo_1485 |
| 4468 | >Toxin: Rcas_4148 | 10012 | >Antitoxin: Rcas_4149 |
| 4469 | >Toxin: Shewana3_2170 | 10013 | >Antitoxin: Shewana3_2169 |
| 4470 | >Toxin: Veis_0272 | 10014 | >Antitoxin: Veis_0273 |
| 4471 | >Toxin: Shew185_2063 | 10015 | >Antitoxin: Shew185_2064 |
| 4472 | >Toxin: VIBHAR_02966 | 10016 | >Antitoxin: VIBHAR_02965 |
| 4473 | >Toxin: Sbal195_2110 | 10017 | >Antitoxin: Sbal195_2111 |
| 4474 | >Toxin: SeHA_C1627 | 10018 | >Antitoxin: SeHA_C1628 |
| 4475 | >Toxin: SeSA_A1555 | 10019 | >Antitoxin: SeSA_A1556 |
| 4476 | >Toxin: SeD_A1885 | 10020 | >Antitoxin: SeD_A1884 |
| 4477 | >Toxin: SO_0503 | 10021 | >Antitoxin: SO_0502 |
| 4478 | >Toxin: CPS_2452 | 10022 | >Antitoxin: CPS_2453 |
| 4479 | >Toxin: Jann_3654 | 10023 | >Antitoxin: Jann_3653 |
| 4480 | >Toxin: TM1040_0158 | 10024 | >Antitoxin: TM1040_0157 |
| 4481 | >Toxin: Sfri_2516 | 10025 | >Antitoxin: Sfri_2515 |
| 4482 | >Toxin: Shewana3_2338 | 10026 | >Antitoxin: Shewana3_2337 |
| 4483 | >Toxin: Sputcn32_3823 | 10027 | >Antitoxin: Sputcn32_3822 |
| 4484 | >Toxin: VIBHAR_05267 | 10028 | >Antitoxin: VIBHAR_05266 |
| 4485 | >Toxin: EcE24377A_3989 | 10029 | >Antitoxin: EcE24377A_3987 |
| 4486 | >Toxin: Dshi_0586 | 10030 | >Antitoxin: Dshi_0587 |
| 4487 | >Toxin: Swoo_1498 | 10031 | >Antitoxin: Swoo_1499 |
| 4488 | >Toxin: EcSMS35_A0147 | 10032 | >Antitoxin: EcSMS35_A0148 |
| 4489 | >Toxin: EcSMS35_3797 | 10033 | >Antitoxin: EcSMS35_3796 |
| 4490 | >Toxin: BR0925 | 10034 | >Antitoxin: BR0924 |
| 4491 | >Toxin: Nwi_1669 | 10035 | >Antitoxin: Nwi_1670 |
| 4492 | >Toxin: RPB_3001 | 10036 | >Antitoxin: RPB_3002 |
| 4493 | >Toxin: Jann_1716 | 10037 | >Antitoxin: Jann_1715 |
| 4494 | >Toxin: RPC_2847 | 10038 | >Antitoxin: RPC_2848 |
| 4495 | >Toxin: RPD_2449 | 10039 | >Antitoxin: RPD_2448 |
| 4496 | >Toxin: Nham_2333 | 10040 | >Antitoxin: Nham_2334 |
| 4497 | >Toxin: TM1040_1092 | 10041 | >Antitoxin: TM1040_1091 |
| 4498 | >Toxin: Meso_1786 | 10042 | >Antitoxin: Meso_1787 |
| 4499 | >Toxin: RSP_2972 | 10043 | >Antitoxin: RSP_2973 |

TABLE 3-continued

| Toxin polypeptide sequences | | Antitoxin polypeptide sequences | |
|---|---|---|---|
| SEQ ID NO: | designation | SEQ ID NO: | designation |
| 4500 | >Toxin: Mmar10_1307 | 10044 | >Antitoxin: Mmar10_1306 |
| 4501 | >Toxin: Rsph17029_1618 | 10045 | >Antitoxin: Rsph17029_1619 |
| 4502 | >Toxin: Rsph17025_1851 | 10046 | >Antitoxin: Rsph17025_1852 |
| 4503 | >Toxin: BBta_3957 | 10047 | >Antitoxin: BBta_3956 |
| 4504 | >Toxin: BOV_0919 | 10048 | >Antitoxin: BOV_0918 |
| 4505 | >Toxin: Smed_1474 | 10049 | >Antitoxin: Smed_1475 |
| 4506 | >Toxin: Oant_2261 | 10050 | >Antitoxin: Oant_2262 |
| 4507 | >Toxin: Plav_3269 | 10051 | >Antitoxin: Plav_3270 |
| 4508 | >Toxin: Xaut_4196 | 10052 | >Antitoxin: Xaut_4195 |
| 4509 | >Toxin: Dshi_1179 | 10053 | >Antitoxin: Dshi_1178 |
| 4510 | >Toxin: Mext_2985 | 10054 | >Antitoxin: Mext_2984 |
| 4511 | >Toxin: Mrad2831_1807 | 10055 | >Antitoxin: Mrad2831_1808 |
| 4512 | >Toxin: Bind_0013 | 10056 | >Antitoxin: Bind_0012 |
| 4513 | >Toxin: Mpop_3169 | 10057 | >Antitoxin: Mpop_3168 |
| 4514 | >Toxin: Rpal_2735 | 10058 | >Antitoxin: Rpal_2734 |
| 4515 | >Toxin: M446_5848 | 10059 | >Antitoxin: M446_5847 |
| 4516 | >Toxin: Rleg2_1909 | 10060 | >Antitoxin: Rleg2_1910 |
| 4517 | >Toxin: Msil_1618 | 10061 | >Antitoxin: Msil_1619 |
| 4518 | >Toxin: Mchl_3211 | 10062 | >Antitoxin: Mchl_3210 |
| 4519 | >Toxin: Mnod_6053 | 10063 | >Antitoxin: Mnod_6052 |
| 4520 | >Toxin: Avi_1887 | 10064 | >Antitoxin: Avi_1886 |
| 4521 | >Toxin: Rleg_2116 | 10065 | >Antitoxin: Rleg_2117 |
| 4522 | >Toxin: Tfu_2015 | 10066 | >Antitoxin: Tfu_2014 |
| 4523 | >Toxin: Franccl3_1639 | 10067 | >Antitoxin: Franccl3_1640 |
| 4524 | >Toxin: Mmcs_2406 | 10068 | >Antitoxin: Mmcs_2407 |
| 4525 | >Toxin: Rxyl_2003 | 10069 | >Antitoxin: Rxyl_2002 |
| 4526 | >Toxin: Arth_2089 | 10070 | >Antitoxin: Arth_2090 |
| 4527 | >Toxin: Noca_2532 | 10071 | >Antitoxin: Noca_2533 |
| 4528 | >Toxin: Mkms_2452 | 10072 | >Antitoxin: Mkms_2453 |
| 4529 | >Toxin: Mvan_2705 | 10073 | >Antitoxin: Mvan_2706 |
| 4530 | >Toxin: Mjls_2446 | 10074 | >Antitoxin: Mjls_2447 |
| 4531 | >Toxin: Mflv_3708 | 10075 | >Antitoxin: Mflv_3707 |
| 4532 | >Toxin: Strop_3096 | 10076 | >Antitoxin: Strop_3095 |
| 4533 | >Toxin: Franean1_2065 | 10077 | >Antitoxin: Franean1_2066 |
| 4534 | >Toxin: Sare_3323 | 10078 | >Antitoxin: Sare_3322 |
| 4535 | >Toxin: BLD_0433 | 10079 | >Antitoxin: BLD_0434 |
| 4536 | >Toxin: Achl_1830 | 10080 | >Antitoxin: Achl_1831 |
| 4537 | >Toxin: Afer_0851 | 10081 | >Antitoxin: Afer_0852 |
| 4538 | >Toxin: Amir_5197 | 10082 | >Antitoxin: Amir_5196 |
| 4539 | >Toxin: Bcav_2169 | 10083 | >Antitoxin: Bcav_2168 |
| 4540 | >Toxin: Bfae_15220 | 10084 | >Antitoxin: Bfae_15230 |
| 4541 | >Toxin: Mlut_11370 | 10085 | >Antitoxin: Mlut_11380 |
| 4542 | >Toxin: Ksed_13130 | 10086 | >Antitoxin: Ksed_13140 |
| 4543 | >Toxin: Caci_5606 | 10087 | >Antitoxin: Caci_5605 |
| 4544 | >Toxin: Svir_15890 | 10088 | >Antitoxin: Svir_15900 |
| 4545 | >Toxin: Jden_1258 | 10089 | >Antitoxin: Jden_1259 |
| 4546 | >Toxin: Apar_0922 | 10090 | >Antitoxin: Apar_0921 |
| 4547 | >Toxin: Namu_2802 | 10091 | >Antitoxin: Namu_2803 |
| 4548 | >Toxin: BRA0605 | 10092 | >Antitoxin: BRA0606 |
| 4549 | >Toxin: Nwi_1713 | 10093 | >Antitoxin: Nwi_1714 |
| 4550 | >Toxin: RPB_2418 | 10094 | >Antitoxin: RPB_2417 |
| 4551 | >Toxin: RPC_2238 | 10095 | >Antitoxin: RPC_2237 |
| 4552 | >Toxin: RPD_3034 | 10096 | >Antitoxin: RPD_3035 |
| 4553 | >Toxin: Nham_2438 | 10097 | >Antitoxin: Nham_2439 |
| 4554 | >Toxin: Meso_1353 | 10098 | >Antitoxin: Meso_1352 |
| 4555 | >Toxin: BBta_4734 | 10099 | >Antitoxin: BBta_4735 |
| 4556 | >Toxin: BOV_A0570 | 10100 | >Antitoxin: BOV_A0571 |
| 4557 | >Toxin: Smed_0931 | 10101 | >Antitoxin: Smed_0930 |
| 4558 | >Toxin: Oant_3672 | 10102 | >Antitoxin: Oant_3673 |
| 4559 | >Toxin: Plav_2830 | 10103 | >Antitoxin: Plav_2829 |
| 4560 | >Toxin: Xaut_3864 | 10104 | >Antitoxin: Xaut_3863 |
| 4561 | >Toxin: Mext_2380 | 10105 | >Antitoxin: Mext_2381 |
| 4562 | >Toxin: Mrad2831_3572 | 10106 | >Antitoxin: Mrad2831_3573 |
| 4563 | >Toxin: Mpop_2337 | 10107 | >Antitoxin: Mpop_2338 |
| 4564 | >Toxin: Rpal_3536 | 10108 | >Antitoxin: Rpal_3537 |
| 4565 | >Toxin: M446_6672 | 10109 | >Antitoxin: M446_6673 |
| 4566 | >Toxin: Rleg2_1294 | 10110 | >Antitoxin: Rleg2_1293 |
| 4567 | >Toxin: Mchl_2657 | 10111 | >Antitoxin: Mchl_2658 |
| 4568 | >Toxin: Mnod_7411 | 10112 | >Antitoxin: Mnod_7412 |
| 4569 | >Toxin: Avi_1755 | 10113 | >Antitoxin: Avi_1754 |
| 4570 | >Toxin: Rleg_1386 | 10114 | >Antitoxin: Rleg_1385 |
| 4571 | >Toxin: Tery_4376 | 10115 | >Antitoxin: Tery_4375 |
| 4572 | >Toxin: Dtur_0871 | 10116 | >Antitoxin: Dtur_0872 |
| 4573 | >Toxin: Cyan7425_2516 | 10117 | >Antitoxin: Cyan7425_2517 |
| 4574 | >Toxin: Elen_2553 | 10118 | >Antitoxin: Elen_2552 |
| 4575 | >Toxin: Ccur_05120 | 10119 | >Antitoxin: Ccur_05130 |
| 4576 | >Toxin: Shel_07820 | 10120 | >Antitoxin: Shel_07830 |

TABLE 3-continued

| SEQ ID NO: | Toxin polypeptide sequences designation | SEQ ID NO: | Antitoxin polypeptide sequences designation |
|---|---|---|---|
| 4577 | >Toxin: Apar_0459 | 10121 | >Antitoxin: Apar_0460 |
| 4578 | >Toxin: Moth_1329 | 10122 | >Antitoxin: Moth_1330 |
| 4579 | >Toxin: Swol_1344 | 10123 | >Antitoxin: Swol_1345 |
| 4580 | >Toxin: Cthe_0714 | 10124 | >Antitoxin: Cthe_0713 |
| 4581 | >Toxin: Dred_1154 | 10125 | >Antitoxin: Dred_1153 |
| 4582 | >Toxin: Daud_1178 | 10126 | >Antitoxin: Daud_1179 |
| 4583 | >Toxin: Nther_1638 | 10127 | >Antitoxin: Nther_1639 |
| 4584 | >Toxin: Emin_0546 | 10128 | >Antitoxin: Emin_0545 |
| 4585 | >Toxin: Dhaf_3385 | 10129 | >Antitoxin: Dhaf_3386 |
| 4586 | >Toxin: GWCH70_2169 | 10130 | >Antitoxin: GWCH70_2170 |
| 4587 | >Toxin: Apre_1019 | 10131 | >Antitoxin: Apre_1020 |
| 4588 | >Toxin: Dtox_2102 | 10132 | >Antitoxin: Dtox_2101 |
| 4589 | >Toxin: Aaci_1703 | 10133 | >Antitoxin: Aaci_1704 |
| 4590 | >Toxin: Dde_1453 | 10134 | >Antitoxin: Dde_1452 |
| 4591 | >Toxin: Sfum_2116 | 10135 | >Antitoxin: Sfum_2117 |
| 4592 | >Toxin: Dvul_1964 | 10136 | >Antitoxin: Dvul_1965 |
| 4593 | >Toxin: Anae109_2310 | 10137 | >Antitoxin: Anae109_2309 |
| 4594 | >Toxin: Dole_1983 | 10138 | >Antitoxin: Dole_1982 |
| 4595 | >Toxin: DvMF_0908 | 10139 | >Antitoxin: DvMF_0909 |
| 4596 | >Toxin: Ddes_0761 | 10140 | >Antitoxin: Ddes_0760 |
| 4597 | >Toxin: Dbac_0507 | 10141 | >Antitoxin: Dbac_0508 |
| 4598 | >Toxin: Dret_2197 | 10142 | >Antitoxin: Dret_2196 |
| 4599 | >Toxin: RSp1366 | 10143 | >Antitoxin: RS02091 |
| 4600 | >Toxin: Rfer_3196 | 10144 | >Antitoxin: Rfer_3197 |
| 4601 | >Toxin: Rmet_4919 | 10145 | >Antitoxin: Rmet_4918 |
| 4602 | >Toxin: Ajs_1142 | 10146 | >Antitoxin: Ajs_1141 |
| 4603 | >Toxin: Rpic_4057 | 10147 | >Antitoxin: Rpic_4058 |
| 4604 | >Toxin: Dtpsy_1063 | 10148 | >Antitoxin: Dtpsy_1062 |
| 4605 | >Toxin: Rpic12D_4169 | 10149 | >Antitoxin: Rpic12D_4170 |
| 4606 | >Toxin: Nham_4673 | 10150 | >Antitoxin: Nham_4674 |
| 4607 | >Toxin: Smed_5395 | 10151 | >Antitoxin: Smed_5394 |
| 4608 | >Toxin: Mrad2831_6101 | 10152 | >Antitoxin: Mrad2831_6102 |
| 4609 | >Toxin: Mchl_5573 | 10153 | >Antitoxin: Mchl_5574 |
| 4610 | >Toxin: Avi_8129 | 10154 | >Antitoxin: Avi_8130 |
| 4611 | >Toxin: Avi_9187 | 10155 | >Antitoxin: Avi_9188 |
| 4612 | >Toxin: Rleg_5516 | 10156 | >Antitoxin: Rleg_5515 |
| 4613 | >Toxin: Bpro_4159 | 10157 | >Antitoxin: Bpro_4158 |
| 4614 | >Toxin: Aave_4353 | 10158 | >Antitoxin: Aave_4352 |
| 4615 | >Toxin: Ajs_3761 | 10159 | >Antitoxin: Ajs_3760 |
| 4616 | >Toxin: Pnap_0473 | 10160 | >Antitoxin: Pnap_0474 |
| 4617 | >Toxin: Mpe_A3358 | 10161 | >Antitoxin: Mpe_A3357 |
| 4618 | >Toxin: Daci_5972 | 10162 | >Antitoxin: Daci_5971 |
| 4619 | >Toxin: Dtpsy_3042 | 10163 | >Antitoxin: Dtpsy_3041 |
| 4620 | >Toxin: Vapar_4721 | 10164 | >Antitoxin: Vapar_4720 |
| 4621 | >Toxin: Nwi_1134 | 10165 | >Antitoxin: Nwi_1135 |
| 4622 | >Toxin: RPB_3775 | 10166 | >Antitoxin: RPB_3774 |
| 4623 | >Toxin: Jann_4196 | 10167 | >Antitoxin: Jann_4195 |
| 4624 | >Toxin: RPD_1695 | 10168 | >Antitoxin: RPD_1696 |
| 4625 | >Toxin: Nham_1394 | 10169 | >Antitoxin: Nham_1395 |
| 4626 | >Toxin: TM1040_2963 | 10170 | >Antitoxin: TM1040_2962 |
| 4627 | >Toxin: Rru_A2824 | 10171 | >Antitoxin: Rru_A2823 |
| 4628 | >Toxin: RSP_1329 | 10172 | >Antitoxin: RSP_1328 |
| 4629 | >Toxin: Pden_2112 | 10173 | >Antitoxin: Pden_2113 |
| 4630 | >Toxin: Rsph17029_2990 | 10174 | >Antitoxin: Rsph17029_2989 |
| 4631 | >Toxin: Rsph17025_2602 | 10175 | >Antitoxin: Rsph17025_2603 |
| 4632 | >Toxin: Acry_2132 | 10176 | >Antitoxin: Acry_2131 |
| 4633 | >Toxin: BBta_5495 | 10177 | >Antitoxin: BBta_5494 |
| 4634 | >Toxin: Plav_2572 | 10178 | >Antitoxin: Plav_2573 |
| 4635 | >Toxin: Dshi_3249 | 10179 | >Antitoxin: Dshi_3250 |
| 4636 | >Toxin: Rpal_4409 | 10180 | >Antitoxin: Rpal_4408 |
| 4637 | >Toxin: Gdia_3440 | 10181 | >Antitoxin: Gdia_3441 |
| 4638 | >Toxin: Mnod_5536 | 10182 | >Antitoxin: Mnod_5535 |
| 4639 | >Toxin: Moth_0849 | 10183 | >Antitoxin: Moth_0848 |
| 4640 | >Toxin: Swol_0832 | 10184 | >Antitoxin: Swol_0831 |
| 4641 | >Toxin: Cthe_0444 | 10185 | >Antitoxin: Cthe_0443 |
| 4642 | >Toxin: Dred_0683 | 10186 | >Antitoxin: Dred_0682 |
| 4643 | >Toxin: Haur_3503 | 10187 | >Antitoxin: Haur_3504 |
| 4644 | >Toxin: Teth514_2004 | 10188 | >Antitoxin: Teth514_2005 |
| 4645 | >Toxin: Ccel_2065 | 10189 | >Antitoxin: Ccel_2066 |
| 4646 | >Toxin: GWCH70_1027 | 10190 | >Antitoxin: GWCH70_1026 |
| 4647 | >Toxin: Dtox_1063 | 10191 | >Antitoxin: Dtox_1062 |
| 4648 | >Toxin: Aaci_1287 | 10192 | >Antitoxin: Aaci_1286 |
| 4649 | >Toxin: Teth514_1606 | 10193 | >Antitoxin: Teth514_1605 |
| 4650 | >Toxin: SYO3AOP1_1148 | 10194 | >Antitoxin: SYO3AOP1_1147 |
| 4651 | >Toxin: Dtur_1158 | 10195 | >Antitoxin: Dtur_1157 |
| 4652 | >Toxin: Athe_1327 | 10196 | >Antitoxin: Athe_1326 |
| 4653 | >Toxin: Afer_1349 | 10197 | >Antitoxin: Afer_1350 |

TABLE 3-continued

| | Toxin polypeptide sequences | | Antitoxin polypeptide sequences |
|---|---|---|---|
| SEQ ID NO: | designation | SEQ ID NO: | designation |
| 4654 | >Toxin: Elen__1335 | 10198 | >Antitoxin: Elen__1334 |
| 4655 | >Toxin: Ccur__06870 | 10199 | >Antitoxin: Ccur__06860 |
| 4656 | >Toxin: Shel__09680 | 10200 | >Antitoxin: Shel__09670 |
| 4657 | >Toxin: Pcar__1442 | 10201 | >Antitoxin: Pcar__1443 |
| 4658 | >Toxin: Dde__2432 | 10202 | >Antitoxin: Dde__2433 |
| 4659 | >Toxin: Moth__2390 | 10203 | >Antitoxin: Moth__2389 |
| 4660 | >Toxin: Swol 2392 | 10204 | >Antitoxin: Swol__2391 |
| 4661 | >Toxin: Dvul__1854 | 10205 | >Antitoxin: Dvul__1855 |
| 4662 | >Toxin: Dred__3162 | 10206 | >Antitoxin: Dred__3161 |
| 4663 | >Toxin: Dole__2082 | 10207 | >Antitoxin: Dole__2081 |
| 4664 | >Toxin: DvMF__3097 | 10208 | >Antitoxin: DvMF__3096 |
| 4665 | >Toxin: Ddes__1617 | 10209 | >Antitoxin: Ddes__1618 |
| 4666 | >Toxin: Dbac__0064 | 10210 | >Antitoxin: Dbac__0063 |
| 4667 | >Toxin: Dtox__4177 | 10211 | >Antitoxin: Dtox__4176 |
| 4668 | >Toxin: Dret__1418 | 10212 | >Antitoxin: Dret__1419 |
| 4669 | >Toxin: RSc2583 | 10213 | >Antitoxin: RSc2582 |
| 4670 | >Toxin: Saro__0317 | 10214 | >Antitoxin: Saro__0316 |
| 4671 | >Toxin: RPC__3540 | 10215 | >Antitoxin: RPC__3539 |
| 4672 | >Toxin: RPC__3900 | 10216 | >Antitoxin: RPC__3899 |
| 4673 | >Toxin: Rmet__1342 | 10217 | >Antitoxin: Rmet__1343 |
| 4674 | >Toxin: Rmet__1551 | 10218 | >Antitoxin: Rmet__1552 |
| 4675 | >Toxin: Sala__2613 | 10219 | >Antitoxin: Sala__2612 |
| 4676 | >Toxin: Rru__A0807 | 10220 | >Antitoxin: Rru__A0806 |
| 4677 | >Toxin: Meso__0508 | 10221 | >Antitoxin: Meso__0507 |
| 4678 | >Toxin: Meso__2323 | 10222 | >Antitoxin: Meso__2322 |
| 4679 | >Toxin: Meso__3852 | 10223 | >Antitoxin: Meso__3853 |
| 4680 | >Toxin: Bamb__2005 | 10224 | >Antitoxin: Bamb__2006 |
| 4681 | >Toxin: Shewana3__1283 | 10225 | >Antitoxin: Shewana3__1284 |
| 4682 | >Toxin: Pden__1483 | 10226 | >Antitoxin: Pden__1482 |
| 4683 | >Toxin: Pden__3195 | 10227 | >Antitoxin: Pden__3196 |
| 4684 | >Toxin: Aave__0727 | 10228 | >Antitoxin: Aave__0728 |
| 4685 | >Toxin: Ajs__2910 | 10229 | >Antitoxin: Ajs__2909 |
| 4686 | >Toxin: Pnap__4196 | 10230 | >Antitoxin: Pnap__4197 |
| 4687 | >Toxin: BBta__1501 | 10231 | >Antitoxin: BBta__1502 |
| 4688 | >Toxin: BBta__7441 | 10232 | >Antitoxin: BBta__7442 |
| 4689 | >Toxin: BBta__7742 | 10233 | >Antitoxin: BBta__7743 |
| 4690 | >Toxin: Swit__3692 | 10234 | >Antitoxin: Swit__3693 |
| 4691 | >Toxin: PSPA7__3705 | 10235 | >Antitoxin: PSPA7__3704 |
| 4692 | >Toxin: Oant__3213 | 10236 | >Antitoxin: Oant__3214 |
| 4693 | >Toxin: Plav__3542 | 10237 | >Antitoxin: Plav__3543 |
| 4694 | >Toxin: Xaut__0596 | 10238 | >Antitoxin: Xaut__0597 |
| 4695 | >Toxin: Xaut__0748 | 10239 | >Antitoxin: Xaut__0747 |
| 4696 | >Toxin: Xaut__2879 | 10240 | >Antitoxin: Xaut__2880 |
| 4697 | >Toxin: Xaut__3003 | 10241 | >Antitoxin: Xaut__3002 |
| 4698 | >Toxin: Xaut__3999 | 10242 | >Antitoxin: Xaut__3998 |
| 4699 | >Toxin: Daci__0437 | 10243 | >Antitoxin: Daci__0436 |
| 4700 | >Toxin: Daci__2698 | 10244 | >Antitoxin: Daci__2697 |
| 4701 | >Toxin: Bmul__2351 | 10245 | >Antitoxin: Bmul__2352 |
| 4702 | >Toxin: Caul__2028 | 10246 | >Antitoxin: Caul__2029 |
| 4703 | >Toxin: Caul__3828 | 10247 | >Antitoxin: Caul__3829 |
| 4704 | >Toxin: Mpop__3087 | 10248 | >Antitoxin: Mpop__3088 |
| 4705 | >Toxin: Rpic__2646 | 10249 | >Antitoxin: Rpic__2647 |
| 4706 | >Toxin: Paes__2347 | 10250 | >Antitoxin: Paes__2348 |
| 4707 | >Toxin: Gdia__1012 | 10251 | >Antitoxin: Gdia__1011 |
| 4708 | >Toxin: Gdia__2825 | 10252 | >Antitoxin: Gdia__2826 |
| 4709 | >Toxin: Tgr7__1896 | 10253 | >Antitoxin: Tgr7__1897 |
| 4710 | >Toxin: Avi__9659 | 10254 | >Antitoxin: Avi__9658 |
| 4711 | >Toxin: Dtpsy__3505 | 10255 | >Antitoxin: Dtpsy__3504 |
| 4712 | >Toxin: Avin__35710 | 10256 | >Antitoxin: Avin__35700 |
| 4713 | >Toxin: GM21__2350 | 10257 | >Antitoxin: GM21__2349 |
| 4714 | >Toxin: BCE__A0182 | 10258 | >Antitoxin: BCE__A0183 |
| 4715 | >Toxin: GBAA__3860 | 10259 | >Antitoxin: GBAA__3861 |
| 4716 | >Toxin: BAS3576 | 10260 | >Antitoxin: BAS3577 |
| 4717 | >Toxin: BT9727__3476 | 10261 | >Antitoxin: BT9727__3477 |
| 4718 | >Toxin: BCZK3488 | 10262 | >Antitoxin: BCZK3489 |
| 4719 | >Toxin: Tfu__0951 | 10263 | >Antitoxin: Tfu__0952 |
| 4720 | >Toxin: Nmul__A2277 | 10264 | >Antitoxin: Nmul__42278 |
| 4721 | >Toxin: Adeh__3496 | 10265 | >Antitoxin: Adeh__3495 |
| 4722 | >Toxin: Rxyl__0131 | 10266 | >Antitoxin: Rxyl__0132 |
| 4723 | >Toxin: Mlg__0323 | 10267 | >Antitoxin: Mlg__0324 |
| 4724 | >Toxin: Mlg__0325 | 10268 | >Antitoxin: Mlg__0324 |
| 4725 | >Toxin: Arth__4098 | 10269 | >Antitoxin: Arth__4097 |
| 4726 | >Toxin: Acel__1651 | 10270 | >Antitoxin: Acel__1650 |
| 4727 | >Toxin: Mvan__3669 | 10271 | >Antitoxin: Mvan__3668 |
| 4728 | >Toxin: Dred__2140 | 10272 | >Antitoxin: Dred__2141 |
| 4729 | >Toxin: Strop__0446 | 10273 | >Antitoxin: Strop__0445 |
| 4730 | >Toxin: Krad__4588 | 10274 | >Antitoxin: Krad__4587 |

TABLE 3-continued

| SEQ ID NO: | Toxin polypeptide sequences designation | SEQ ID NO: | Antitoxin polypeptide sequences designation |
|---|---|---|---|
| 4731 | >Toxin: Bcer98_0518 | 10275 | >Antitoxin: Bcer98_0517 |
| 4732 | >Toxin: Sare_0534 | 10276 | >Antitoxin: Sare_0533 |
| 4733 | >Toxin: BcerKBAB4_3497 | 10277 | >Antitoxin: BcerKBAB4_3498 |
| 4734 | >Toxin: AnaeK_3584 | 10278 | >Antitoxin: AnaeK_3583 |
| 4735 | >Toxin: BCAH187_A3780 | 10279 | >Antitoxin: BCAH187_A3781 |
| 4736 | >Toxin: BCB4264_A3830 | 10280 | >Antitoxin: BCB4264_A3831 |
| 4737 | >Toxin: BCG9842_B1471 | 10281 | >Antitoxin: BCG9842_B1470 |
| 4738 | >Toxin: BCAH820_3742 | 10282 | >Antitoxin: BCAH820_3743 |
| 4739 | >Toxin: BCAH820_B0280 | 10283 | >Antitoxin: BCAH820_B0279 |
| 4740 | >Toxin: Achl_3872 | 10284 | >Antitoxin: Achl_3871 |
| 4741 | >Toxin: A2cp1_3653 | 10285 | >Antitoxin: A2cp1_3652 |
| 4742 | >Toxin: Bcav_4020 | 10286 | >Antitoxin: Bcav_4021 |
| 4743 | >Toxin: Bcav_4022 | 10287 | >Antitoxin: Bcav_4021 |
| 4744 | >Toxin: GWCH70_1801 | 10288 | >Antitoxin: GWCH70_1802 |
| 4745 | >Toxin: Mlut_21360 | 10289 | >Antitoxin: Mlut_21350 |
| 4746 | >Toxin: Ksed_10590 | 10290 | >Antitoxin: Ksed_10580 |
| 4747 | >Toxin: Elen_1553 | 10291 | >Antitoxin: Elen_1552 |
| 4748 | >Toxin: Cagg_3412 | 10292 | >Antitoxin: Cagg_3411 |
| 4749 | >Toxin: Ccur_11220 | 10293 | >Antitoxin: Ccur_11230 |
| 4750 | >Toxin: Svir_36750 | 10294 | >Antitoxin: Svir_36760 |
| 4751 | >Toxin: Apre_0987 | 10295 | >Antitoxin: Apre_0988 |
| 4752 | >Toxin: Jden_2500 | 10296 | >Antitoxin: Jden_2499 |
| 4753 | >Toxin: Shel_01260 | 10297 | >Antitoxin: Shel_01250 |
| 4754 | >Toxin: Apar_0439 | 10298 | >Antitoxin: Apar_0438 |
| 4755 | >Toxin: Dtox_2078 | 10299 | >Antitoxin: Dtox_2077 |
| 4756 | >Toxin: Aaci_1113 | 10300 | >Antitoxin: Aaci_1112 |
| 4757 | >Toxin: Aaci_2657 | 10301 | >Antitoxin: Aaci_2658 |
| 4758 | >Toxin: Moth_0866 | 10302 | >Antitoxin: Moth_0865 |
| 4759 | >Toxin: Swol_0964 | 10303 | >Antitoxin: Swol_0963 |
| 4760 | >Toxin: Teth514_1858 | 10304 | >Antitoxin: Teth514_1859 |
| 4761 | >Toxin: Daud_1351 | 10305 | >Antitoxin: Daud_1352 |
| 4762 | >Toxin: Nther_1322 | 10306 | >Antitoxin: Nther_1321 |
| 4763 | >Toxin: Dhaf_4024 | 10307 | >Antitoxin: Dhaf_4025 |
| 4764 | >Toxin: Hore_09300 | 10308 | >Antitoxin: Hore_09290 |
| 4765 | >Toxin: Ccel_1852 | 10309 | >Antitoxin: Ccel_1853 |
| 4766 | >Toxin: Athe_1363 | 10310 | >Antitoxin: Athe_1362 |
| 4767 | >Toxin: Dtox_1126 | 10311 | >Antitoxin: Dtox_1125 |
| 4768 | >Toxin: Aaci_1300 | 10312 | >Antitoxin: Aaci_1299 |
| 4769 | >Toxin: Francci3_0449 | 10313 | >Antitoxin: Francci3_0448 |
| 4770 | >Toxin: Mmcs_4529 | 10314 | >Antitoxin: Mmcs_4528 |
| 4771 | >Toxin: Noca_4230 | 10315 | >Antitoxin: Noca_4231 |
| 4772 | >Toxin: Mkms_4616 | 10316 | >Antitoxin: Mkms_4615 |
| 4773 | >Toxin: Mvan_5101 | 10317 | >Antitoxin: Mvan_5100 |
| 4774 | >Toxin: Mjls_4912 | 10318 | >Antitoxin: Mjls_4911 |
| 4775 | >Toxin: Mflv_1646 | 10319 | >Antitoxin: Mflv_1647 |
| 4776 | >Toxin: Franean1_6169 | 10320 | >Antitoxin: Franean1_6170 |
| 4777 | >Toxin: Amir_6828 | 10321 | >Antitoxin: Amir_6827 |
| 4778 | >Toxin: Svir_37710 | 10322 | >Antitoxin: Svir_37700 |
| 4779 | >Toxin: Cthe_0333 | 10323 | >Antitoxin: Cthe_0334 |
| 4780 | >Toxin: Tpet_1428 | 10324 | >Antitoxin: Tpet_1429 |
| 4781 | >Toxin: Cphy_3800 | 10325 | >Antitoxin: Cphy_3799 |
| 4782 | >Toxin: Teth514_2147 | 10326 | >Antitoxin: Teth514_2146 |
| 4783 | >Toxin: TRQ2_1474 | 10327 | >Antitoxin: TRQ2_1475 |
| 4784 | >Toxin: Nther_0091 | 10328 | >Antitoxin: Nther_0092 |
| 4785 | >Toxin: Dtur_0910 | 10329 | >Antitoxin: Dtur_0911 |
| 4786 | >Toxin: Athe_1290 | 10330 | >Antitoxin: Athe_1291 |
| 4787 | >Toxin: Dtox_0180 | 10331 | >Antitoxin: Dtox_0179 |
| 4788 | >Toxin: BRA0158 | 10332 | >Antitoxin: BRA0159 |
| 4789 | >Toxin: RPC_1101 | 10333 | >Antitoxin: RPC_1102 |
| 4790 | >Toxin: Meso_0291 | 10334 | >Antitoxin: Meso_0290 |
| 4791 | >Toxin: BARBAKC583_1137 | 10335 | >Antitoxin: BARBAKC583_1136 |
| 4792 | >Toxin: BOV_A0142 | 10336 | >Antitoxin: BOV_A0143 |
| 4793 | >Toxin: Smed_0262 | 10337 | >Antitoxin: Smed_0263 |
| 4794 | >Toxin: Oant_4205 | 10338 | >Antitoxin: Oant_4204 |
| 4795 | >Toxin: Mext_0625 | 10339 | >Antitoxin: Mext_0626 |
| 4796 | >Toxin: Mrad2831_1685 | 10340 | >Antitoxin: Mrad2831_1684 |
| 4797 | >Toxin: Bind_3649 | 10341 | >Antitoxin: Bind_3648 |
| 4798 | >Toxin: Mpop_0603 | 10342 | >Antitoxin: Mpop_0604 |
| 4799 | >Toxin: Rleg2_0324 | 10343 | >Antitoxin: Rleg2_0325 |
| 4800 | >Toxin: Msil_0031 | 10344 | >Antitoxin: Msil_0032 |
| 4801 | >Toxin: Mchl_0636 | 10345 | >Antitoxin: Mchl_0637 |
| 4802 | >Toxin: Avi_0744 | 10346 | >Antitoxin: Avi_0745 |
| 4803 | >Toxin: Rleg_0356 | 10347 | >Antitoxin: Rleg_0357 |
| 4804 | >Toxin: Rfer_0565 | 10348 | >Antitoxin: Rfer_0566 |
| 4805 | >Toxin: Aave_4380 | 10349 | >Antitoxin: Aave_4379 |
| 4806 | >Toxin: Ajs_3792 | 10350 | >Antitoxin: Ajs_3791 |
| 4807 | >Toxin: Veis_2178 | 10351 | >Antitoxin: Veis_2177 |

TABLE 3-continued

| SEQ ID NO: | Toxin polypeptide sequences designation | SEQ ID NO: | Antitoxin polypeptide sequences designation |
|---|---|---|---|
| 4808 | >Toxin: Mpe_A0583 | 10352 | >Antitoxin: Mpe_A0584 |
| 4809 | >Toxin: Daci_0653 | 10353 | >Antitoxin: Daci_0654 |
| 4810 | >Toxin: Lcho_1597 | 10354 | >Antitoxin: Lcho_1598 |
| 4811 | >Toxin: Dtpsy_3066 | 10355 | >Antitoxin: Dtpsy_3065 |
| 4812 | >Toxin: BMAA0399 | 10356 | >Antitoxin: BMAA0400 |
| 4813 | >Toxin: BURPS1710b_A1204 | 10357 | >Antitoxin: BURPS1710b_A1203 |
| 4814 | >Toxin: Bcep18194_B1592 | 10358 | >Antitoxin: Bcep18194_B1591 |
| 4815 | >Toxin: BTH_II0254 | 10359 | >Antitoxin: BTH_II0255 |
| 4816 | >Toxin: Jann_3035 | 10360 | >Antitoxin: Jann_3036 |
| 4817 | >Toxin: Sde_1522 | 10361 | >Antitoxin: Sde_1521 |
| 4818 | >Toxin: RSP_3487 | 10362 | >Antitoxin: RSP_3488 |
| 4819 | >Toxin: Sfri_2373 | 10363 | >Antitoxin: Sfri_2372 |
| 4820 | >Toxin: PA14_00910 | 10364 | >Antitoxin: PA14_00900 |
| 4821 | >Toxin: Pden_2453 | 10365 | >Antitoxin: Pden_2454 |
| 4822 | >Toxin: Aave_1473 | 10366 | >Antitoxin: Aave_1474 |
| 4823 | >Toxin: BMASAVP1_1593 | 10367 | >Antitoxin: BMASAVP1_1594 |
| 4824 | >Toxin: Rsph17029_3131 | 10368 | >Antitoxin: Rsph17029_3132 |
| 4825 | >Toxin: BMA10247_A0448 | 10369 | >Antitoxin: BMA10247_A0450 |
| 4826 | >Toxin: BURPS668_A2965 | 10370 | >Antitoxin: BURPS668_A2963 |
| 4827 | >Toxin: BURPS1106A_A2840 | 10371 | >Antitoxin: BURPS1106A_A2838 |
| 4828 | >Toxin: Pmen_2316 | 10372 | >Antitoxin: Pmen_2315 |
| 4829 | >Toxin: Acry_2088 | 10373 | >Antitoxin: Acry_2087 |
| 4830 | >Toxin: PSPA7_0148 | 10374 | >Antitoxin: PSPA7_0147 |
| 4831 | >Toxin: Spro_3000 | 10375 | >Antitoxin: Spro_3001 |
| 4832 | >Toxin: Daci_3846 | 10376 | >Antitoxin: Daci_3847 |
| 4833 | >Toxin: Lcho_4057 | 10377 | >Antitoxin: Lcho_4058 |
| 4834 | >Toxin: PXO_00250 | 10378 | >Antitoxin: PXO_00249 |
| 4835 | >Toxin: Msil_2352 | 10379 | >Antitoxin: Msil_2351 |
| 4836 | >Toxin: Mnod_3048 | 10380 | >Antitoxin: Mnod_3049 |
| 4837 | >Toxin: Avi_6041 | 10381 | >Antitoxin: Avi_6040 |
| 4838 | >Toxin: Avin_26710 | 10382 | >Antitoxin: Avin_26700 |
| 4839 | >Toxin: Vapar_0213 | 10383 | >Antitoxin: Vapar_0214 |
| 4840 | >Toxin: Vapar_0516 | 10384 | >Antitoxin: Vapar_0517 |
| 4841 | >Toxin: CPS_4227 | 10385 | >Antitoxin: CPS_4226 |
| 4842 | >Toxin: Reut_B5017 | 10386 | >Antitoxin: Reut_B5016 |
| 4843 | >Toxin: Tbd_0071 | 10387 | >Antitoxin: Tbd_0072 |
| 4844 | >Toxin: PA14_06670 | 10388 | >Antitoxin: PA14_06680 |
| 4845 | >Toxin: Pden_2494 | 10389 | >Antitoxin: Pden_2493 |
| 4846 | >Toxin: Ajs_1906 | 10390 | >Antitoxin: Ajs_1907 |
| 4847 | >Toxin: Maqu_3130 | 10391 | >Antitoxin: Maqu_3129 |
| 4848 | >Toxin: Memar_0876 | 10392 | >Antitoxin: Memar_0877 |
| 4849 | >Toxin: PSPA7_0612 | 10393 | >Antitoxin: PSPA7_0613 |
| 4850 | >Toxin: Mboo_0955 | 10394 | >Antitoxin: Mboo_0956 |
| 4851 | >Toxin: Dshi_3173 | 10395 | >Antitoxin: Dshi_3174 |
| 4852 | >Toxin: Lcho_1448 | 10396 | >Antitoxin: Lcho_1447 |
| 4853 | >Toxin: Tmz1t_2609 | 10397 | >Antitoxin: Tmz1t_2610 |
| 4854 | >Toxin: Dtpsy_1711 | 10398 | >Antitoxin: Dtpsy_1712 |
| 4855 | >Toxin: Mpal_2629 | 10399 | >Antitoxin: Mpal_2628 |
| 4856 | >Toxin: Jann_1701 | 10400 | >Antitoxin: Jann_1702 |
| 4857 | >Toxin: TM1040_1114 | 10401 | >Antitoxin: TM1040_1115 |
| 4858 | >Toxin: RSP_2955 | 10402 | >Antitoxin: RSP_2954 |
| 4859 | >Toxin: Pden_1882 | 10403 | >Antitoxin: Pden_1881 |
| 4860 | >Toxin: Rsph17029_1600 | 10404 | >Antitoxin: Rsph17029_1599 |
| 4861 | >Toxin: Rsph17025_0890 | 10405 | >Antitoxin: Rsph17025_0891 |
| 4862 | >Toxin: Dshi_1737 | 10406 | >Antitoxin: Dshi_1736 |
| 4863 | >Toxin: Tfu_0674 | 10407 | >Antitoxin: Tfu_0675 |
| 4864 | >Toxin: Francci3_3583 | 10408 | >Antitoxin: Francci3_3582 |
| 4865 | >Toxin: Noca_3245 | 10409 | >Antitoxin: Noca_3244 |
| 4866 | >Toxin: Mvan_2207 | 10410 | >Antitoxin: Mvan_2208 |
| 4867 | >Toxin: Mflv_4135 | 10411 | >Antitoxin: Mflv_4134 |
| 4868 | >Toxin: Franean1_1159 | 10412 | >Antitoxin: Franean1_1160 |
| 4869 | >Toxin: Bcav_2509 | 10413 | >Antitoxin: Bcav_2508 |
| 4870 | >Toxin: Bfae_10100 | 10414 | >Antitoxin: Bfae_10110 |
| 4871 | >Toxin: Ksed_11170 | 10415 | >Antitoxin: Ksed_11180 |
| 4872 | >Toxin: Namu_3115 | 10416 | >Antitoxin: Namu_3114 |
| 4873 | >Toxin: SAG1651 | 10417 | >Antitoxin: SAG1652 |
| 4874 | >Toxin: LMOf2365_2675 | 10418 | >Antitoxin: LMOf2365_2676 |
| 4875 | >Toxin: SACOL0708 | 10419 | >Antitoxin: SACOL0709 |
| 4876 | >Toxin: SERP2344 | 10420 | >Antitoxin: SERP2343 |
| 4877 | >Toxin: MCAP_0235 | 10421 | >Antitoxin: MCAP_0236 |
| 4878 | >Toxin: Rxyl_1067 | 10422 | >Antitoxin: Rxyl_1068 |
| 4879 | >Toxin: SaurJH9_0674 | 10423 | >Antitoxin: SaurJH9_0675 |
| 4880 | >Toxin: SaurJH1_0689 | 10424 | >Antitoxin: SaurJH1_0690 |
| 4881 | >Toxin: Teth514_1026 | 10425 | >Antitoxin: Teth514_1027 |
| 4882 | >Toxin: Hlac_1459 | 10426 | >Antitoxin: Hlac_1460 |
| 4883 | >Toxin: Afer_0878 | 10427 | >Antitoxin: Afer_0879 |
| 4884 | >Toxin: Amir_6113 | 10428 | >Antitoxin: Amir_6112 |

TABLE 3-continued

| Toxin polypeptide sequences | | Antitoxin polypeptide sequences | |
|---|---|---|---|
| SEQ ID NO: | designation | SEQ ID NO: | designation |
| 4885 | >Toxin: GWCH70_1343 | 10429 | >Antitoxin: GWCH70_1344 |
| 4886 | >Toxin: Rleg_2433 | 10430 | >Antitoxin: Rleg_2434 |
| 4887 | >Toxin: Cagg_2004 | 10431 | >Antitoxin: Cagg_2005 |
| 4888 | >Toxin: Apre_1081 | 10432 | >Antitoxin: Apre_1082 |
| 4889 | >Toxin: Namu_1660 | 10433 | >Antitoxin: Namu_1661 |
| 4890 | >Toxin: RSc2444 | 10434 | >Antitoxin: RSc2443 |
| 4891 | >Toxin: Ajs_3450 | 10435 | >Antitoxin: Ajs_3449 |
| 4892 | >Toxin: Pnap_3339 | 10436 | >Antitoxin: Pnap_3338 |
| 4893 | >Toxin: Veis_1654 | 10437 | >Antitoxin: Veis_1653 |
| 4894 | >Toxin: Mpe_A2695 | 10438 | >Antitoxin: Mpe_A2694 |
| 4895 | >Toxin: Pnuc_1733 | 10439 | >Antitoxin: Pnuc_1732 |
| 4896 | >Toxin: Daci_1904 | 10440 | >Antitoxin: Daci_1905 |
| 4897 | >Toxin: Lcho_0695 | 10441 | >Antitoxin: Lcho_0694 |
| 4898 | >Toxin: Dtpsy_2777 | 10442 | >Antitoxin: Dtpsy_2776 |
| 4899 | >Toxin: Vapar_4033 | 10443 | >Antitoxin: Vapar_4032 |
| 4900 | >Toxin: Plut_1586 | 10444 | >Antitoxin: Plut_1587 |
| 4901 | >Toxin: Cag_0551 | 10445 | >Antitoxin: Cag_0550 |
| 4902 | >Toxin: CHU_2016 | 10446 | >Antitoxin: CHU_2017 |
| 4903 | >Toxin: Cpha266_0605 | 10447 | >Antitoxin: Cpha266_0604 |
| 4904 | >Toxin: Fjoh_0491 | 10448 | >Antitoxin: Fjoh_0492 |
| 4905 | >Toxin: Clim_1961 | 10449 | >Antitoxin: Clim_1962 |
| 4906 | >Toxin: Cphamn1_0635 | 10450 | >Antitoxin: Cphamn1_0634 |
| 4907 | >Toxin: Ppha_0731 | 10451 | >Antitoxin: Ppha_0730 |
| 4908 | >Toxin: Paes_0590 | 10452 | >Antitoxin: Paes_0589 |
| 4909 | >Toxin: Phep_4088 | 10453 | >Antitoxin: Phep_4089 |
| 4910 | >Toxin: Dfer_4057 | 10454 | >Antitoxin: Dfer_4056 |
| 4911 | >Toxin: Cpin_1428 | 10455 | >Antitoxin: Cpin_1427 |
| 4912 | >Toxin: TM1040_1251 | 10456 | >Antitoxin: TM1040_1250 |
| 4913 | >Toxin: Meso_0178 | 10457 | >Antitoxin: Meso_0179 |
| 4914 | >Toxin: RSP_1412 | 10458 | >Antitoxin: RSP_3802 |
| 4915 | >Toxin: Rsph17029_3482 | 10459 | >Antitoxin: Rsph17029_3481 |
| 4916 | >Toxin: Rsph17025_3687 | 10460 | >Antitoxin: Rsph17025_3686 |
| 4917 | >Toxin: VC0395_A2847 | 10461 | >Antitoxin: VC0395_A2846 |
| 4918 | >Toxin: VIBHAR_00792 | 10462 | >Antitoxin: VIBHAR_00791 |
| 4919 | >Toxin: VSAL_I0355 | 10463 | >Antitoxin: VSAL_I0354 |
| 4920 | >Toxin: Dbac_0032 | 10464 | >Antitoxin: Dbac_0031 |
| 4921 | >Toxin: BR1365 | 10465 | >Antitoxin: BR1366 |
| 4922 | >Toxin: Dde_1190 | 10466 | >Antitoxin: Dde_1191 |
| 4923 | >Toxin: RPC_1951 | 10467 | >Antitoxin: RPC_1950 |
| 4924 | >Toxin: RPC_1959 | 10468 | >Antitoxin: RPC_1960 |
| 4925 | >Toxin: Rru_A3500 | 10469 | >Antitoxin: Rru_A3499 |
| 4926 | >Toxin: RSP_3207 | 10470 | >Antitoxin: RSP_3208 |
| 4927 | >Toxin: Rsph17029_3947 | 10471 | >Antitoxin: Rsph17029_3948 |
| 4928 | >Toxin: Rsph17025_3436 | 10472 | >Antitoxin: Rsph17025_3435 |
| 4929 | >Toxin: BOV_1321 | 10473 | >Antitoxin: BOV_1322 |
| 4930 | >Toxin: Ssed_2093 | 10474 | >Antitoxin: Ssed_2094 |
| 4931 | >Toxin: Dole_2022 | 10475 | >Antitoxin: Dole_2021 |
| 4932 | >Toxin: Ddes_1471 | 10476 | >Antitoxin: Ddes_1472 |
| 4933 | >Toxin: Dbac_3138 | 10477 | >Antitoxin: Dbac_3137 |
| 4934 | >Toxin: Dret_0756 | 10478 | >Antitoxin: Dret_0757 |
| 4935 | >Toxin: Mbar_A3104 | 10479 | >Antitoxin: Mbar_A3103 |
| 4936 | >Toxin: Pcar_2991 | 10480 | >Antitoxin: Pcar_2992 |
| 4937 | >Toxin: Plut_1065 | 10481 | >Antitoxin: Plut_1066 |
| 4938 | >Toxin: Nmul_A1659 | 10482 | >Antitoxin: Nmul_A1658 |
| 4939 | >Toxin: Rfer_1163 | 10483 | >Antitoxin: Rfer_1164 |
| 4940 | >Toxin: Patl_2670 | 10484 | >Antitoxin: Patl_2671 |
| 4941 | >Toxin: Sfri_3051 | 10485 | >Antitoxin: Sfri_3052 |
| 4942 | >Toxin: Ping_0465 | 10486 | >Antitoxin: Ping_0466 |
| 4943 | >Toxin: Pnap_2334 | 10487 | >Antitoxin: Pnap_2333 |
| 4944 | >Toxin: Mmwyl1_1956 | 10488 | >Antitoxin: Mmwyl1_1957 |
| 4945 | >Toxin: Paes_0890 | 10489 | >Antitoxin: Paes_0891 |
| 4946 | >Toxin: Dbac_0950 | 10490 | >Antitoxin: Dbac_0949 |
| 4947 | >Toxin: Reut_B4434 | 10491 | >Antitoxin: Reut_B4433 |
| 4948 | >Toxin: Nham_4181 | 10492 | >Antitoxin: Nham_4182 |
| 4949 | >Toxin: Acid345_2997 | 10493 | >Antitoxin: Acid345_2998 |
| 4950 | >Toxin: M446_5818 | 10494 | >Antitoxin: M446_5819 |
| 4951 | >Toxin: Gdia_0829 | 10495 | >Antitoxin: Gdia_0830 |
| 4952 | >Toxin: Mnod_6887 | 10496 | >Antitoxin: Mnod_6888 |
| 4953 | >Toxin: Cagg_1523 | 10497 | >Antitoxin: Cagg_1524 |
| 4954 | >Toxin: Pcar_0845 | 10498 | >Antitoxin: Pcar_0846 |
| 4955 | >Toxin: Dde_2156 | 10499 | >Antitoxin: Dde_2155 |
| 4956 | >Toxin: Csal_1619 | 10500 | >Antitoxin: Csal_1618 |
| 4957 | >Toxin: CFF8240_0849 | 10501 | >Antitoxin: CFF8240_0848 |
| 4958 | >Toxin: Ping_3346 | 10502 | >Antitoxin: Ping_3345 |
| 4959 | >Toxin: Anae109_0871 | 10503 | >Antitoxin: Anae109_0872 |
| 4960 | >Toxin: Dole_1735 | 10504 | >Antitoxin: Dole_1736 |
| 4961 | >Toxin: AnaeK_1509 | 10505 | >Antitoxin: AnaeK_1510 |

TABLE 3-continued

| | Toxin polypeptide sequences | | Antitoxin polypeptide sequences |
|---|---|---|---|
| SEQ ID NO: | designation | SEQ ID NO: | designation |
| 4962 | >Toxin: A2cp1_1604 | 10506 | >Antitoxin: A2cp1_1605 |
| 4963 | >Toxin: Dret_1657 | 10507 | >Antitoxin: Dret_1656 |
| 4964 | >Toxin: Noc_2709 | 10508 | >Antitoxin: Noc_2708 |
| 4965 | >Toxin: RPC_1184 | 10509 | >Antitoxin: RPC_1183 |
| 4966 | >Toxin: Mvan_1183 | 10510 | >Antitoxin: Mvan_1182 |
| 4967 | >Toxin: Mflv_5149 | 10511 | >Antitoxin: Mflv_5150 |
| 4968 | >Toxin: Franean1_1484 | 10512 | >Antitoxin: Franean1_1485 |
| 4969 | >Toxin: M446_5114 | 10513 | >Antitoxin: M446_5113 |
| 4970 | >Toxin: Amir_5089 | 10514 | >Antitoxin: Amir_5088 |
| 4971 | >Toxin: Nwi_1704 | 10515 | >Antitoxin: Nwi_1703 |
| 4972 | >Toxin: RPB_2386 | 10516 | >Antitoxin: RPB_2387 |
| 4973 | >Toxin: RPC_3334 | 10517 | >Antitoxin: RPC_3333 |
| 4974 | >Toxin: RPD_3068 | 10518 | >Antitoxin: RPD_3067 |
| 4975 | >Toxin: Nham_2426 | 10519 | >Antitoxin: Nham_2425 |
| 4976 | >Toxin: BBta_4785 | 10520 | >Antitoxin: BBta_4784 |
| 4977 | >Toxin: Xaut_4457 | 10521 | >Antitoxin: Xaut_4456 |
| 4978 | >Toxin: Rpal_3566 | 10522 | >Antitoxin: Rpal_3565 |
| 4979 | >Toxin: Nwi_2202 | 10523 | >Antitoxin: Nwi_2201 |
| 4980 | >Toxin: RPB_3675 | 10524 | >Antitoxin: RPB_3674 |
| 4981 | >Toxin: RPC_1634 | 10525 | >Antitoxin: RPC_1635 |
| 4982 | >Toxin: RPD_1785 | 10526 | >Antitoxin: RPD_1786 |
| 4983 | >Toxin: Nham_2604 | 10527 | >Antitoxin: Nham_2603 |
| 4984 | >Toxin: Rxyl_0115 | 10528 | >Antitoxin: Rxyl_0116 |
| 4985 | >Toxin: Meso_1291 | 10529 | >Antitoxin: Meso_1292 |
| 4986 | >Toxin: Acry_0472 | 10530 | >Antitoxin: Acry_0473 |
| 4987 | >Toxin: BBta_5315 | 10531 | >Antitoxin: BBta_5314 |
| 4988 | >Toxin: Smed_1484 | 10532 | >Antitoxin: Smed_1483 |
| 4989 | >Toxin: Plav_2958 | 10533 | >Antitoxin: Plav_2957 |
| 4990 | >Toxin: Rpal_4323 | 10534 | >Antitoxin: Rpal_4322 |
| 4991 | >Toxin: M446_5446 | 10535 | >Antitoxin: M446_5447 |
| 4992 | >Toxin: Mnod_1753 | 10536 | >Antitoxin: Mnod_1754 |
| 4993 | >Toxin: BR0896 | 10537 | >Antitoxin: BR0897 |
| 4994 | >Toxin: BOV_0892 | 10538 | >Antitoxin: BOV_0893 |
| 4995 | >Toxin: Oant_2331 | 10539 | >Antitoxin: Oant_2330 |
| 4996 | >Toxin: CCV52592_1895 | 10540 | >Antitoxin: CCV52592_1894 |
| 4997 | >Toxin: Plav_2660 | 10541 | >Antitoxin: Plav_2659 |
| 4998 | >Toxin: CCC13826_1098 | 10542 | >Antitoxin: CCC13826_1097 |
| 4999 | >Toxin: Ssed_2356 | 10543 | >Antitoxin: Ssed_2355 |
| 5000 | >Toxin: Swoo_2229 | 10544 | >Antitoxin: Swoo_2230 |
| 5001 | >Toxin: M446_2238 | 10545 | >Antitoxin: M446_2239 |
| 5002 | >Toxin: Rleg2_1503 | 10546 | >Antitoxin: Rleg2_1504 |
| 5003 | >Toxin: Mnod_0371 | 10547 | >Antitoxin: Mnod_0370 |
| 5004 | >Toxin: Avi_2480 | 10548 | >Antitoxin: Avi_2479 |
| 5005 | >Toxin: Rleg_1701 | 10549 | >Antitoxin: Rleg_1702 |
| 5006 | >Toxin: DET0050 | 10550 | >Antitoxin: DET0051 |
| 5007 | >Toxin: Tfu_2070 | 10551 | >Antitoxin: Tfu_2069 |
| 5008 | >Toxin: Francci3_3214 | 10552 | >Antitoxin: Francci3_3213 |
| 5009 | >Toxin: Mmcs_2346 | 10553 | >Antitoxin: Mmcs_2347 |
| 5010 | >Toxin: Rxyl_1359 | 10554 | >Antitoxin: Rxyl_1360 |
| 5011 | >Toxin: Arth_2278 | 10555 | >Antitoxin: Arth_2277 |
| 5012 | >Toxin: Acel_1330 | 10556 | >Antitoxin: Acel_1329 |
| 5013 | >Toxin: Noca_2407 | 10557 | >Antitoxin: Noca_2408 |
| 5014 | >Toxin: Mkms_2393 | 10558 | >Antitoxin: Mkms_2394 |
| 5015 | >Toxin: Mvan_2640 | 10559 | >Antitoxin: Mvan_2641 |
| 5016 | >Toxin: Mjls_2387 | 10560 | >Antitoxin: Mjls_2388 |
| 5017 | >Toxin: Mflv_3763 | 10561 | >Antitoxin: Mflv_3762 |
| 5018 | >Toxin: Strop_1828 | 10562 | >Antitoxin: Strop_1829 |
| 5019 | >Toxin: DehaBAV1_0047 | 10563 | >Antitoxin: DehaBAV1_0048 |
| 5020 | >Toxin: TBFG_12576 | 10564 | >Antitoxin: TBFG_12575 |
| 5021 | >Toxin: Franean1_1694 | 10565 | >Antitoxin: Franean1_1695 |
| 5022 | >Toxin: Sare_1819 | 10566 | >Antitoxin: Sare_1820 |
| 5023 | >Toxin: BLD_0616 | 10567 | >Antitoxin: BLD_0615 |
| 5024 | >Toxin: MARTH_orf202 | 10568 | >Antitoxin: MARTH_orf203 |
| 5025 | >Toxin: UUR10_0378 | 10569 | >Antitoxin: UUR10_0379 |
| 5026 | >Toxin: Dtur_1023 | 10570 | >Antitoxin: Dtur_1024 |
| 5027 | >Toxin: Achl_2015 | 10571 | >Antitoxin: Achl_2014 |
| 5028 | >Toxin: Afer_0951 | 10572 | >Antitoxin: Afer_0952 |
| 5029 | >Toxin: Amir_5265 | 10573 | >Antitoxin: Amir_5264 |
| 5030 | >Toxin: Bcav_2014 | 10574 | >Antitoxin: Bcav_2015 |
| 5031 | >Toxin: Bfae_16360 | 10575 | >Antitoxin: Bfae_16350 |
| 5032 | >Toxin: Mlut_12720 | 10576 | >Antitoxin: Mlut_12710 |
| 5033 | >Toxin: Ksed_12510 | 10577 | >Antitoxin: Ksed_12520 |
| 5034 | >Toxin: Elen_2555 | 10578 | >Antitoxin: Elen_2554 |
| 5035 | >Toxin: Caci_2378 | 10579 | >Antitoxin: Caci_2379 |
| 5036 | >Toxin: Ccur_05100 | 10580 | >Antitoxin: Ccur_05110 |
| 5037 | >Toxin: Svir_15270 | 10581 | >Antitoxin: Svir_15280 |
| 5038 | >Toxin: Jden_1351 | 10582 | >Antitoxin: Jden_1350 |

TABLE 3-continued

| | Toxin polypeptide sequences | | Antitoxin polypeptide sequences |
|---|---|---|---|
| SEQ ID NO: | designation | SEQ ID NO: | designation |
| 5039 | >Toxin: Shel_07800 | 10583 | >Antitoxin: Shel_07810 |
| 5040 | >Toxin: Apar_0457 | 10584 | >Antitoxin: Apar_0458 |
| 5041 | >Toxin: Namu_3297 | 10585 | >Antitoxin: Namu_3296 |
| 5042 | >Toxin: BR0669 | 10586 | >Antitoxin: BR0670 |
| 5043 | >Toxin: Meso_0960 | 10587 | >Antitoxin: Meso_0961 |
| 5044 | >Toxin: Smed_0707 | 10588 | >Antitoxin: Smed_0708 |
| 5045 | >Toxin: Oant_2617 | 10589 | >Antitoxin: Oant_2616 |
| 5046 | >Toxin: Rleg2_1014 | 10590 | >Antitoxin: Rleg2_1015 |
| 5047 | >Toxin: Avi_1463 | 10591 | >Antitoxin: Avi_1464 |
| 5048 | >Toxin: Rleg_1166 | 10592 | >Antitoxin: Rleg_1167 |
| 5049 | >Toxin: Reut_B5756 | 10593 | >Antitoxin: Reut_B5755 |
| 5050 | >Toxin: Bcep18194_C6667 | 10594 | >Antitoxin: Bcep18194_C6668 |
| 5051 | >Toxin: Bcep18194_C7628 | 10595 | >Antitoxin: Bcep18194_C7629 |
| 5052 | >Toxin: Rmet_3558 | 10596 | >Antitoxin: Rmet_3557 |
| 5053 | >Toxin: Daci_1984 | 10597 | >Antitoxin: Daci_1983 |
| 5054 | >Toxin: Bmul_6053 | 10598 | >Antitoxin: Bmul_6054 |
| 5055 | >Toxin: Bphyt_4360 | 10599 | >Antitoxin: Bphyt_4361 |
| 5056 | >Toxin: Gdia_0758 | 10600 | >Antitoxin: Gdia_0759 |
| 5057 | >Toxin: Rfer_1402 | 10601 | >Antitoxin: Rfer_1401 |
| 5058 | >Toxin: Bpro_1690 | 10602 | >Antitoxin: Bpro_1689 |
| 5059 | >Toxin: Aave_1884 | 10603 | >Antitoxin: Aave_1883 |
| 5060 | >Toxin: Ajs_3355 | 10604 | >Antitoxin: Ajs_3356 |
| 5061 | >Toxin: Pnap_1461 | 10605 | >Antitoxin: Pnap_1460 |
| 5062 | >Toxin: Veis_3939 | 10606 | >Antitoxin: Veis_3938 |
| 5063 | >Toxin: Mpe_A1104 | 10607 | >Antitoxin: Mpe_A1103 |
| 5064 | >Toxin: Daci_5345 | 10608 | >Antitoxin: Daci_5346 |
| 5065 | >Toxin: Lcho_0681 | 10609 | >Antitoxin: Lcho_0680 |
| 5066 | >Toxin: Dtpsy_2703 | 10610 | >Antitoxin: Dtpsy_2704 |
| 5067 | >Toxin: Vapar_1473 | 10611 | >Antitoxin: Vapar_1472 |
| 5068 | >Toxin: DET0199 | 10612 | >Antitoxin: DET0198 |
| 5069 | >Toxin: Mbar_A2432 | 10613 | >Antitoxin: Mbar_A2431 |
| 5070 | >Toxin: Dde_2738 | 10614 | >Antitoxin: Dde_2739 |
| 5071 | >Toxin: Mhun_0927 | 10615 | >Antitoxin: Mhun_0928 |
| 5072 | >Toxin: Mthe_0907 | 10616 | >Antitoxin: Mthe_0908 |
| 5073 | >Toxin: Sfum_0349 | 10617 | >Antitoxin: Sfum_0348 |
| 5074 | >Toxin: Dvul_2100 | 10618 | >Antitoxin: Dvul_2101 |
| 5075 | >Toxin: Memar_2454 | 10619 | >Antitoxin: Memar_2455 |
| 5076 | >Toxin: DehaBAV1_0154 | 10620 | >Antitoxin: DehaBAV1_0155 |
| 5077 | >Toxin: Mboo_0831 | 10621 | >Antitoxin: Mboo_0832 |
| 5078 | >Toxin: Dole_2967 | 10622 | >Antitoxin: Dole_2968 |
| 5079 | >Toxin: DvMF_2934 | 10623 | >Antitoxin: DvMF_2933 |
| 5080 | >Toxin: Dbac_0077 | 10624 | >Antitoxin: Dbac_0078 |
| 5081 | >Toxin: Mpal_0502 | 10625 | >Antitoxin: Mpal_0501 |
| 5082 | >Toxin: Dret_1407 | 10626 | >Antitoxin: Dret_1406 |
| 5083 | >Toxin: Mbar_A0388 | 10627 | >Antitoxin: Mbar_A0387 |
| 5084 | >Toxin: Mhun_1181 | 10628 | >Antitoxin: Mhun_1182 |
| 5085 | >Toxin: Mbur_1241 | 10629 | >Antitoxin: Mbur_1242 |
| 5086 | >Toxin: Mthe_1611 | 10630 | >Antitoxin: Mthe_1610 |
| 5087 | >Toxin: Mlab_1220 | 10631 | >Antitoxin: Mlab_1221 |
| 5088 | >Toxin: Memar_0285 | 10632 | >Antitoxin: Memar_0286 |
| 5089 | >Toxin: MmarC7_0296 | 10633 | >Antitoxin: MmarC7_0297 |
| 5090 | >Toxin: Mboo_2347 | 10634 | >Antitoxin: Mboo_2346 |
| 5091 | >Toxin: Hlac_0279 | 10635 | >Antitoxin: Hlac_0280 |
| 5092 | >Toxin: Huta_1435 | 10636 | >Antitoxin: Huta_1436 |
| 5093 | >Toxin: Mpal_2679 | 10637 | >Antitoxin: Mpal_2678 |
| 5094 | >Toxin: Hmuk_1279 | 10638 | >Antitoxin: Hmuk_1280 |
| 5095 | >Toxin: Jann_1095 | 10639 | >Antitoxin: Jann_1094 |
| 5096 | >Toxin: TM1040_1726 | 10640 | >Antitoxin: TM1040_1727 |
| 5097 | >Toxin: RSP_0387 | 10641 | >Antitoxin: RSP_0386 |
| 5098 | >Toxin: Rsph17029_2041 | 10642 | >Antitoxin: Rsph17029_2040 |
| 5099 | >Toxin: Rsph17025_0849 | 10643 | >Antitoxin: Rsph17025_0850 |
| 5100 | >Toxin: Dshi_0770 | 10644 | >Antitoxin: Dshi_0769 |
| 5101 | >Toxin: Dd1591_2975 | 10645 | >Antitoxin: Dd1591_2974 |
| 5102 | >Toxin: RPB_3184 | 10646 | >Antitoxin: RPB_3183 |
| 5103 | >Toxin: Saro_0334 | 10647 | >Antitoxin: Saro_0335 |
| 5104 | >Toxin: Jann_2923 | 10648 | >Antitoxin: Jann_2924 |
| 5105 | >Toxin: RPC_1882 | 10649 | >Antitoxin: RPC_1883 |
| 5106 | >Toxin: RPD_2314 | 10650 | >Antitoxin: RPD_2315 |
| 5107 | >Toxin: TM1040_2218 | 10651 | >Antitoxin: TM1040_2217 |
| 5108 | >Toxin: RSP_2821 | 10652 | >Antitoxin: RSP_2822 |
| 5109 | >Toxin: Pden_2540 | 10653 | >Antitoxin: Pden_2539 |
| 5110 | >Toxin: Rsph17029_1475 | 10654 | >Antitoxin: Rsph17029_1474 |
| 5111 | >Toxin: Rsph17025_1525 | 10655 | >Antitoxin: Rsph17025_1524 |
| 5112 | >Toxin: Daci_5844 | 10656 | >Antitoxin: Daci_5845 |
| 5113 | >Toxin: Rpal_2374 | 10657 | >Antitoxin: Rpal_2375 |
| 5114 | >Toxin: Mchl_5685 | 10658 | >Antitoxin: Mchl_5686 |
| 5115 | >Toxin: Rru_A0999 | 10659 | >Antitoxin: Rru_A0998 |

TABLE 3-continued

| Toxin polypeptide sequences | | Antitoxin polypeptide sequences | |
|---|---|---|---|
| SEQ ID NO: | designation | SEQ ID NO: | designation |
| 5116 | >Toxin: RSP_0542 | 10660 | >Antitoxin: RSP_0543 |
| 5117 | >Toxin: Rsph17029_2193 | 10661 | >Antitoxin: Rsph17029_2194 |
| 5118 | >Toxin: Rsph17025_1245 | 10662 | >Antitoxin: Rsph17025_1244 |
| 5119 | >Toxin: BBta_5905 | 10663 | >Antitoxin: BBta_5906 |
| 5120 | >Toxin: Xaut_0110 | 10664 | >Antitoxin: Xaut_0109 |
| 5121 | >Toxin: M446_3597 | 10665 | >Antitoxin: M446_3598 |
| 5122 | >Toxin: Gdia_1571 | 10666 | >Antitoxin: Gdia_1572 |
| 5123 | >Toxin: Mnod_4011 | 10667 | >Antitoxin: Mnod_4010 |
| 5124 | >Toxin: MCA0079 | 10668 | >Antitoxin: MCA0080 |
| 5125 | >Toxin: BTH_II1184 | 10669 | >Antitoxin: BTH_II1185 |
| 5126 | >Toxin: BBta_1297 | 10670 | >Antitoxin: BBta_1298 |
| 5127 | >Toxin: Mext_4520 | 10671 | >Antitoxin: Mext_4521 |
| 5128 | >Toxin: Mrad2831_3340 | 10672 | >Antitoxin: Mrad2831_3341 |
| 5129 | >Toxin: Mpop_5032 | 10673 | >Antitoxin: Mpop_5033 |
| 5130 | >Toxin: Mchl_4980 | 10674 | >Antitoxin: Mchl_4981 |
| 5131 | >Toxin: BRA0156 | 10675 | >Antitoxin: BRA0155 |
| 5132 | >Toxin: RPC_1099 | 10676 | >Antitoxin: RPC_1098 |
| 5133 | >Toxin: Meso_0293 | 10677 | >Antitoxin: Meso_0294 |
| 5134 | >Toxin: BARBAKC583_1139 | 10678 | >Antitoxin: BARBAKC583_1140 |
| 5135 | >Toxin: Smed_0260 | 10679 | >Antitoxin: Smed_0259 |
| 5136 | >Toxin: Oant_4207 | 10680 | >Antitoxin: Oant_4208 |
| 5137 | >Toxin: Mext_0623 | 10681 | >Antitoxin: Mext_0622 |
| 5138 | >Toxin: Mrad2831_1687 | 10682 | >Antitoxin: Mrad2831_1688 |
| 5139 | >Toxin: Bind_3651 | 10683 | >Antitoxin: Bind_3652 |
| 5140 | >Toxin: Mpop_0601 | 10684 | >Antitoxin: Mpop_0600 |
| 5141 | >Toxin: M446_3678 | 10685 | >Antitoxin: M446_3677 |
| 5142 | >Toxin: Rleg2_0322 | 10686 | >Antitoxin: Rleg2_0321 |
| 5143 | >Toxin: Msil_0029 | 10687 | >Antitoxin: Msil_0028 |
| 5144 | >Toxin: Mchl_0634 | 10688 | >Antitoxin: Mchl_0633 |
| 5145 | >Toxin: Avi_0742 | 10689 | >Antitoxin: Avi_0741 |
| 5146 | >Toxin: Rleg_0354 | 10690 | >Antitoxin: Rleg_0353 |
| 5147 | >Toxin: Nwi_0763 | 10691 | >Antitoxin: Nwi_0764 |
| 5148 | >Toxin: RPB_4586 | 10692 | >Antitoxin: RPB_4585 |
| 5149 | >Toxin: RPC_4789 | 10693 | >Antitoxin: RPC_4790 |
| 5150 | >Toxin: RPD_0816 | 10694 | >Antitoxin: RPD_0817 |
| 5151 | >Toxin: Nham_3461 | 10695 | >Antitoxin: Nham_3460 |
| 5152 | >Toxin: Mmar10_2232 | 10696 | >Antitoxin: Mmar10_2231 |
| 5153 | >Toxin: BBta_0830 | 10697 | >Antitoxin: BBta_0831 |
| 5154 | >Toxin: Smed_0520 | 10698 | >Antitoxin: Smed_0521 |
| 5155 | >Toxin: Plav_0671 | 10699 | >Antitoxin: Plav_0672 |
| 5156 | >Toxin: Xaut_4646 | 10700 | >Antitoxin: Xaut_4645 |
| 5157 | >Toxin: Mext_3261 | 10701 | >Antitoxin: Mext_3260 |
| 5158 | >Toxin: Mrad2831_0031 | 10702 | >Antitoxin: Mrad2831_0030 |
| 5159 | >Toxin: Bind_0728 | 10703 | >Antitoxin: Bind_0727 |
| 5160 | >Toxin: Mpop_3457 | 10704 | >Antitoxin: Mpop_3456 |
| 5161 | >Toxin: Rpal_0901 | 10705 | >Antitoxin: Rpal_0902 |
| 5162 | >Toxin: M446_2347 | 10706 | >Antitoxin: M446_2346 |
| 5163 | >Toxin: Rleg2_0604 | 10707 | >Antitoxin: Rleg2_0605 |
| 5164 | >Toxin: Msil_1239 | 10708 | >Antitoxin: Msil_1240 |
| 5165 | >Toxin: Mchl_3585 | 10709 | >Antitoxin: Mchl_3584 |
| 5166 | >Toxin: Mnod_0262 | 10710 | >Antitoxin: Mnod_0263 |
| 5167 | >Toxin: Avi_1042 | 10711 | >Antitoxin: Avi_1043 |
| 5168 | >Toxin: Rleg_0644 | 10712 | >Antitoxin: Rleg_0645 |
| 5169 | >Toxin: WD1300 | 10713 | >Antitoxin: WD1299 |
| 5170 | >Toxin: Tfu_0350 | 10714 | >Antitoxin: Tfu_0349 |
| 5171 | >Toxin: ECH_0468 | 10715 | >Antitoxin: ECH_0469 |
| 5172 | >Toxin: Ssed_3664 | 10716 | >Antitoxin: Ssed_3665 |
| 5173 | >Toxin: Spea_3282 | 10717 | >Antitoxin: Spea_3283 |
| 5174 | >Toxin: Swoo_3951 | 10718 | >Antitoxin: Swoo_3952 |
| 5175 | >Toxin: Dret_0793 | 10719 | >Antitoxin: Dret_0792 |
| 5176 | >Toxin: RSc2370 | 10720 | >Antitoxin: RSc2369 |
| 5177 | >Toxin: Reut_A0685 | 10721 | >Antitoxin: Reut_A0686 |
| 5178 | >Toxin: Bpro_0940 | 10722 | >Antitoxin: Bpro_0941 |
| 5179 | >Toxin: Ajs_3461 | 10723 | >Antitoxin: Ajs_3460 |
| 5180 | >Toxin: Pnap_0837 | 10724 | >Antitoxin: Pnap_0838 |
| 5181 | >Toxin: Mpe_A1173 | 10725 | >Antitoxin: Mpe_A1174 |
| 5182 | >Toxin: Pnuc_1395 | 10726 | >Antitoxin: Pnuc_1394 |
| 5183 | >Toxin: Lcho_3725 | 10727 | >Antitoxin: Lcho_3724 |
| 5184 | >Toxin: Rpic_2583 | 10728 | >Antitoxin: Rpic_2582 |
| 5185 | >Toxin: Dtpsy_2788 | 10729 | >Antitoxin: Dtpsy_2787 |
| 5186 | >Toxin: Vapar_4059 | 10730 | >Antitoxin: Vapar_4058 |
| 5187 | >Toxin: Rpic12D_2179 | 10731 | >Antitoxin: Rpic12D_2178 |
| 5188 | >Toxin: Mbar_A3386 | 10732 | >Antitoxin: Mbar_A3387 |
| 5189 | >Toxin: Mhun_1603 | 10733 | >Antitoxin: Mhun_1602 |
| 5190 | >Toxin: Mbur_0221 | 10734 | >Antitoxin: Mbur_0220 |
| 5191 | >Toxin: Mthe_0333 | 10735 | >Antitoxin: Mthe_0332 |
| 5192 | >Toxin: Pisl_0588 | 10736 | >Antitoxin: Pisl_0587 |

TABLE 3-continued

| Toxin polypeptide sequences | | Antitoxin polypeptide sequences | |
|---|---|---|---|
| SEQ ID NO: | designation | SEQ ID NO: | designation |
| 5193 | >Toxin: Mlab_1499 | 10737 | >Antitoxin: Mlab_1498 |
| 5194 | >Toxin: Memar_0719 | 10738 | >Antitoxin: Memar_0720 |
| 5195 | >Toxin: MmarC5_0965 | 10739 | >Antitoxin: MmarC5_0964 |
| 5196 | >Toxin: Pars_1758 | 10740 | >Antitoxin: Pars_1757 |
| 5197 | >Toxin: Msed_0028 | 10741 | >Antitoxin: Msed_0027 |
| 5198 | >Toxin: Mevan_1555 | 10742 | >Antitoxin: Mevan_1554 |
| 5199 | >Toxin: Maeo_0079 | 10743 | >Antitoxin: Maeo_0080 |
| 5200 | >Toxin: MmarC7_1663 | 10744 | >Antitoxin: MmarC7_1664 |
| 5201 | >Toxin: Mboo_0688 | 10745 | >Antitoxin: Mboo_0689 |
| 5202 | >Toxin: MmarC6_0250 | 10746 | >Antitoxin: MmarC6_0249 |
| 5203 | >Toxin: Nmar_0227 | 10747 | >Antitoxin: Nmar_0226 |
| 5204 | >Toxin: Tneu_1579 | 10748 | >Antitoxin: Tneu_1578 |
| 5205 | >Toxin: Hlac_1844 | 10749 | >Antitoxin: Hlac_1843 |
| 5206 | >Toxin: Huta_0752 | 10750 | >Antitoxin: Huta_0751 |
| 5207 | >Toxin: Mpal_0525 | 10751 | >Antitoxin: Mpal_0524 |
| 5208 | >Toxin: Hmuk_2623 | 10752 | >Antitoxin: Hmuk_2622 |
| 5209 | >Toxin: BR1407 | 10753 | >Antitoxin: BR1406 |
| 5210 | >Toxin: Nwi_2355 | 10754 | >Antitoxin: Nwi_2354 |
| 5211 | >Toxin: RPB_2028 | 10755 | >Antitoxin: RPB_2029 |
| 5212 | >Toxin: RPC_3273 | 10756 | >Antitoxin: RPC_3272 |
| 5213 | >Toxin: RPD_3362 | 10757 | >Antitoxin: RPD_3361 |
| 5214 | >Toxin: Nham_2734 | 10758 | >Antitoxin: Nham_2733 |
| 5215 | >Toxin: RSP_2135 | 10759 | >Antitoxin: RSP_2137 |
| 5216 | >Toxin: Pden_1906 | 10760 | >Antitoxin: Pden_1907 |
| 5217 | >Toxin: Rsph17029_0810 | 10761 | >Antitoxin: Rsph17029_0811 |
| 5218 | >Toxin: Rsph17025_0719 | 10762 | >Antitoxin: Rsph17025_0720 |
| 5219 | >Toxin: BBta_6108 | 10763 | >Antitoxin: BBta_6107 |
| 5220 | >Toxin: BOV_1364 | 10764 | >Antitoxin: BOV_1363 |
| 5221 | >Toxin: Smed_2029 | 10765 | >Antitoxin: Smed_2028 |
| 5222 | >Toxin: Oant_1770 | 10766 | >Antitoxin: Oant_1771 |
| 5223 | >Toxin: Mext_2666 | 10767 | >Antitoxin: Mext_2665 |
| 5224 | >Toxin: Mrad2831_4519 | 10768 | >Antitoxin: Mrad2831_4520 |
| 5225 | >Toxin: Bind_0773 | 10769 | >Antitoxin: Bind_0772 |
| 5226 | >Toxin: Mpop_2788 | 10770 | >Antitoxin: Mpop_2787 |
| 5227 | >Toxin: Rpal_4016 | 10771 | >Antitoxin: Rpal_4015 |
| 5228 | >Toxin: M446_1097 | 10772 | >Antitoxin: M446_1096 |
| 5229 | >Toxin: Rleg2_2546 | 10773 | >Antitoxin: Rleg2_2545 |
| 5230 | >Toxin: Msil_0597 | 10774 | >Antitoxin: Msil_0598 |
| 5231 | >Toxin: Mchl_2893 | 10775 | >Antitoxin: Mchl_2892 |
| 5232 | >Toxin: Mnod_0693 | 10776 | >Antitoxin: Mnod_0694 |
| 5233 | >Toxin: Avi_2826 | 10777 | >Antitoxin: Avi_2825 |
| 5234 | >Toxin: Rleg_2805 | 10778 | >Antitoxin: Rleg_2804 |
| 5235 | >Toxin: RPC_4221 | 10779 | >Antitoxin: RPC_4220 |
| 5236 | >Toxin: Ppro_3346 | 10780 | >Antitoxin: Ppro_3347 |
| 5237 | >Toxin: P9515_14121 | 10781 | >Antitoxin: P9515_14111 |
| 5238 | >Toxin: Mlab_1426 | 10782 | >Antitoxin: Mlab_1425 |
| 5239 | >Toxin: Mext_0850 | 10783 | >Antitoxin: Mext_0849 |
| 5240 | >Toxin: Mpop_0774 | 10784 | >Antitoxin: Mpop_0773 |
| 5241 | >Toxin: PCC8801_3331 | 10785 | >Antitoxin: PCC8801_3332 |
| 5242 | >Toxin: Mchl_0809 | 10786 | >Antitoxin: Mchl_0808 |
| 5243 | >Toxin: Dbac_1869 | 10787 | >Antitoxin: Dbac_1870 |
| 5244 | >Toxin: Cyan8802_2786 | 10788 | >Antitoxin: Cyan8802_2785 |
| 5245 | >Toxin: Jann_2651 | 10789 | >Antitoxin: Jann_2652 |
| 5246 | >Toxin: TM1040_1731 | 10790 | >Antitoxin: TM1040_1732 |
| 5247 | >Toxin: RSP_0760 | 10791 | >Antitoxin: RSP_0761 |
| 5248 | >Toxin: Pden_0936 | 10792 | >Antitoxin: Pden_0937 |
| 5249 | >Toxin: Rsph17029_2419 | 10793 | >Antitoxin: Rsph17029_2420 |
| 5250 | >Toxin: Rsph17025_0415 | 10794 | >Antitoxin: Rsph17025_0414 |
| 5251 | >Toxin: Dshi_0765 | 10795 | >Antitoxin: Dshi_0764 |
| 5252 | >Toxin: BR0096 | 10796 | >Antitoxin: BR0097 |
| 5253 | >Toxin: Nwi_0320 | 10797 | >Antitoxin: Nwi_0319 |
| 5254 | >Toxin: RPC_0207 | 10798 | >Antitoxin: RPC_0208 |
| 5255 | >Toxin: RPD_0522 | 10799 | >Antitoxin: RPD_0521 |
| 5256 | >Toxin: Nham_0411 | 10800 | >Antitoxin: Nham_0412 |
| 5257 | >Toxin: Meso_3360 | 10801 | >Antitoxin: Meso_3361 |
| 5258 | >Toxin: BBta_0379 | 10802 | >Antitoxin: BBta_0378 |
| 5259 | >Toxin: BOV_0094 | 10803 | >Antitoxin: BOV_0095 |
| 5260 | >Toxin: Smed_3086 | 10804 | >Antitoxin: Smed_3087 |
| 5261 | >Toxin: Oant_0108 | 10805 | >Antitoxin: Oant_0109 |
| 5262 | >Toxin: Rpal_0202 | 10806 | >Antitoxin: Rpal_0203 |
| 5263 | >Toxin: Rleg2_3741 | 10807 | >Antitoxin: Rleg2_3742 |
| 5264 | >Toxin: Avi_4191 | 10808 | >Antitoxin: Avi_4192 |
| 5265 | >Toxin: Rleg_4064 | 10809 | >Antitoxin: Rleg_4065 |
| 5266 | >Toxin: PP_4158 | 10810 | >Antitoxin: PP_4157 |
| 5267 | >Toxin: PSPTO_2245 | 10811 | >Antitoxin: PSPTO_2246 |
| 5268 | >Toxin: GSU2483 | 10812 | >Antitoxin: GSU2484 |
| 5269 | >Toxin: Psyr_2050 | 10813 | >Antitoxin: Psyr_2051 |

TABLE 3-continued

| Toxin polypeptide sequences | | Antitoxin polypeptide sequences | |
|---|---|---|---|
| SEQ ID NO: | designation | SEQ ID NO: | designation |
| 5270 | >Toxin: Reut_A2290 | 10814 | >Antitoxin: Reut_A2289 |
| 5271 | >Toxin: RPB_4648 | 10815 | >Antitoxin: RPB_4649 |
| 5272 | >Toxin: Nham_2991 | 10816 | >Antitoxin: Nham_2990 |
| 5273 | >Toxin: Rmet_0041 | 10817 | >Antitoxin: Rmet_0042 |
| 5274 | >Toxin: PA14_43350 | 10818 | >Antitoxin: PA14_43340 |
| 5275 | >Toxin: Pnap_3601 | 10819 | >Antitoxin: Pnap_3600 |
| 5276 | >Toxin: Spro_1245 | 10820 | >Antitoxin: Spro_1244 |
| 5277 | >Toxin: PputGB1_3730 | 10821 | >Antitoxin: PputGB1_3729 |
| 5278 | >Toxin: Avin_24520 | 10822 | >Antitoxin: Avin_24530 |
| 5279 | >Toxin: Vapar_4991 | 10823 | >Antitoxin: Vapar_4990 |
| 5280 | >Toxin: Jann_3967 | 10824 | >Antitoxin: Jann_3968 |
| 5281 | >Toxin: RSP_3149 | 10825 | >Antitoxin: RSP_3148 |
| 5282 | >Toxin: Veis_2514 | 10826 | >Antitoxin: Veis_2513 |
| 5283 | >Toxin: Rsph17029_3886 | 10827 | >Antitoxin: Rsph17029_3885 |
| 5284 | >Toxin: Mrad2831_5988 | 10828 | >Antitoxin: Mrad2831_5987 |
| 5285 | >Toxin: Mnod_8672 | 10829 | >Antitoxin: Mnod_8671 |
| 5286 | >Toxin: Vapar_5617 | 10830 | >Antitoxin: Vapar_5616 |
| 5287 | >Toxin: MCA1644 | 10831 | >Antitoxin: MCA1645 |
| 5288 | >Toxin: Daro_2905 | 10832 | >Antitoxin: Daro_2904 |
| 5289 | >Toxin: Tbd_1531 | 10833 | >Antitoxin: Tbd_1530 |
| 5290 | >Toxin: Noc_2387 | 10834 | >Antitoxin: Noc_2386 |
| 5291 | >Toxin: Nmul_A2113 | 10835 | >Antitoxin: Nmul_A2112 |
| 5292 | >Toxin: Mfla_1880 | 10836 | >Antitoxin: Mfla_1879 |
| 5293 | >Toxin: Mlg_0717 | 10837 | >Antitoxin: Mlg_0718 |
| 5294 | >Toxin: PXO_00875 | 10838 | >Antitoxin: PXO_00874 |
| 5295 | >Toxin: Smal_2687 | 10839 | >Antitoxin: Smal_2688 |
| 5296 | >Toxin: Lferr_0814 | 10840 | >Antitoxin: Lferr_0815 |
| 5297 | >Toxin: Tmz1t_2263 | 10841 | >Antitoxin: Tmz1t_2262 |
| 5298 | >Toxin: AFE_0665 | 10842 | >Antitoxin: AFE_0666 |
| 5299 | >Toxin: PSPTO_5226 | 10843 | >Antitoxin: PSPTO_5225 |
| 5300 | >Toxin: Psyr_0318 | 10844 | >Antitoxin: Psyr_0319 |
| 5301 | >Toxin: Noc_2576 | 10845 | >Antitoxin: Noc_2577 |
| 5302 | >Toxin: Sde_3516 | 10846 | >Antitoxin: Sde_3515 |
| 5303 | >Toxin: Mlg_2539 | 10847 | >Antitoxin: Mlg_2540 |
| 5304 | >Toxin: PA14_69030 | 10848 | >Antitoxin: PA14_69020 |
| 5305 | >Toxin: Hhal_1182 | 10849 | >Antitoxin: Hhal_1183 |
| 5306 | >Toxin: Maqu_3434 | 10850 | >Antitoxin: Maqu_3433 |
| 5307 | >Toxin: Pmen_0322 | 10851 | >Antitoxin: Pmen_0323 |
| 5308 | >Toxin: Pput_5110 | 10852 | >Antitoxin: Pput_5109 |
| 5309 | >Toxin: PSPA7_5970 | 10853 | >Antitoxin: PSPA7_5969 |
| 5310 | >Toxin: COXBURSA331_A0127 | 10854 | >Antitoxin: COXBURSA331_A0126 |
| 5311 | >Toxin: PputGB1_5263 | 10855 | >Antitoxin: PputGB1_5262 |
| 5312 | >Toxin: PputW619_5028 | 10856 | >Antitoxin: PputW619_5027 |
| 5313 | >Toxin: Xfasm12_0963 | 10857 | >Antitoxin: Xfasm12_0964 |
| 5314 | >Toxin: XfasM23_0845 | 10858 | >Antitoxin: XfasM23_0846 |
| 5315 | >Toxin: PXO_02381 | 10859 | >Antitoxin: PXO_02380 |
| 5316 | >Toxin: Smal_3280 | 10860 | >Antitoxin: Smal_3279 |
| 5317 | >Toxin: Tgr7_2768 | 10861 | >Antitoxin: Tgr7_2767 |
| 5318 | >Toxin: Avin_47360 | 10862 | >Antitoxin: Avin_47350 |
| 5319 | >Toxin: SO_2677 | 10863 | >Antitoxin: SO_2676 |
| 5320 | >Toxin: MCA2934 | 10864 | >Antitoxin: MCA2935 |
| 5321 | >Toxin: Mfla_2702 | 10865 | >Antitoxin: Mfla_2703 |
| 5322 | >Toxin: Rsph17025_2105 | 10866 | >Antitoxin: Rsph17025_2106 |
| 5323 | >Toxin: VC0395_A0765 | 10867 | >Antitoxin: VC0395_A0766 |
| 5324 | >Toxin: Shew185_2087 | 10868 | >Antitoxin: Shew185_2086 |
| 5325 | >Toxin: Xaut_4504 | 10869 | >Antitoxin: Xaut_4505 |
| 5326 | >Toxin: Sbal195_2134 | 10870 | >Antitoxin: Sbal195_2133 |
| 5327 | >Toxin: Lcho_2251 | 10871 | >Antitoxin: Lcho_2252 |
| 5328 | >Toxin: Rpal_0669 | 10872 | >Antitoxin: Rpal_0668 |
| 5329 | >Toxin: Rpal_3387 | 10873 | >Antitoxin: Rpal_3386 |
| 5330 | >Toxin: Tgr7_1643 | 10874 | >Antitoxin: Tgr7_1644 |
| 5331 | >Toxin: Avi_3009 | 10875 | >Antitoxin: Avi_3010 |
| 5332 | >Toxin: BR0179 | 10876 | >Antitoxin: BR0180 |
| 5333 | >Toxin: RPB_1399 | 10877 | >Antitoxin: RPB_1400 |
| 5334 | >Toxin: Saro_2556 | 10878 | >Antitoxin: Saro_2557 |
| 5335 | >Toxin: Rru_A1933 | 10879 | >Antitoxin: Rru_A1932 |
| 5336 | >Toxin: Meso_3989 | 10880 | >Antitoxin: Meso_3990 |
| 5337 | >Toxin: BOV_0173 | 10881 | >Antitoxin: BOV_0174 |
| 5338 | >Toxin: Smed_1099 | 10882 | >Antitoxin: Smed_1100 |
| 5339 | >Toxin: Oant_0188 | 10883 | >Antitoxin: Oant_0189 |
| 5340 | >Toxin: Caul_3269 | 10884 | >Antitoxin: Caul_3268 |
| 5341 | >Toxin: Rpal_4696 | 10885 | >Antitoxin: Rpal_4695 |
| 5342 | >Toxin: Rleg2_1636 | 10886 | >Antitoxin: Rleg2_1637 |
| 5343 | >Toxin: Avi_2146 | 10887 | >Antitoxin: Avi_2147 |
| 5344 | >Toxin: Rleg_1823 | 10888 | >Antitoxin: Rleg_1824 |
| 5345 | >Toxin: Jann_0425 | 10889 | >Antitoxin: Jann_0424 |
| 5346 | >Toxin: RPC_0267 | 10890 | >Antitoxin: RPC_0266 |

TABLE 3-continued

| SEQ ID NO: | Toxin polypeptide sequences designation | SEQ ID NO: | Antitoxin polypeptide sequences designation |
|---|---|---|---|
| 5347 | >Toxin: RPD_0453 | 10891 | >Antitoxin: RPD_0454 |
| 5348 | >Toxin: TM1040_0057 | 10892 | >Antitoxin: TM1040_0056 |
| 5349 | >Toxin: RSP_1492 | 10893 | >Antitoxin: RSP_1491 |
| 5350 | >Toxin: Rsph17029_0142 | 10894 | >Antitoxin: Rsph17029_0141 |
| 5351 | >Toxin: Rsph17025_2897 | 10895 | >Antitoxin: Rsph17025_2896 |
| 5352 | >Toxin: Swit_3664 | 10896 | >Antitoxin: Swit_3665 |
| 5353 | >Toxin: Smed_3048 | 10897 | >Antitoxin: Smed_3047 |
| 5354 | >Toxin: Xaut_2211 | 10898 | >Antitoxin: Xaut_2212 |
| 5355 | >Toxin: Caul_4587 | 10899 | >Antitoxin: Caul_4588 |
| 5356 | >Toxin: Rpal_0271 | 10900 | >Antitoxin: Rpal_0270 |
| 5357 | >Toxin: Rleg2_3772 | 10901 | >Antitoxin: Rleg2_3773 |
| 5358 | >Toxin: Avi_4242 | 10902 | >Antitoxin: Avi_4243 |
| 5359 | >Toxin: Rleg_4096 | 10903 | >Antitoxin: Rleg_4097 |
| 5360 | >Toxin: Pcar_2797 | 10904 | >Antitoxin: Pcar_2798 |
| 5361 | >Toxin: Plut_0583 | 10905 | >Antitoxin: Plut_0584 |
| 5362 | >Toxin: Francci3_3111 | 10906 | >Antitoxin: Francci3_3112 |
| 5363 | >Toxin: Ppro_1965 | 10907 | >Antitoxin: Ppro_1966 |
| 5364 | >Toxin: Dvul_0285 | 10908 | >Antitoxin: Dvul_0284 |
| 5365 | >Toxin: Fnod_0467 | 10909 | >Antitoxin: Fnod_0466 |
| 5366 | >Toxin: Franean1_1807 | 10910 | >Antitoxin: Franean1_1806 |
| 5367 | >Toxin: Cmaq_0059 | 10911 | >Antitoxin: Cmaq_0058 |
| 5368 | >Toxin: Emin_1036 | 10912 | >Antitoxin: Emin_1037 |
| 5369 | >Toxin: DvMF_2367 | 10913 | >Antitoxin: DvMF_2366 |
| 5370 | >Toxin: Tbd_0578 | 10914 | >Antitoxin: Tbd_0579 |
| 5371 | >Toxin: Rfer_2118 | 10915 | >Antitoxin: Rfer_2117 |
| 5372 | >Toxin: Bpro_2410 | 10916 | >Antitoxin: Bpro_2409 |
| 5373 | >Toxin: Aave_3160 | 10917 | >Antitoxin: Aave_3161 |
| 5374 | >Toxin: Ajs_1923 | 10918 | >Antitoxin: Ajs_1922 |
| 5375 | >Toxin: Pnap_2167 | 10919 | >Antitoxin: Pnap_2168 |
| 5376 | >Toxin: Veis_4920 | 10920 | >Antitoxin: Veis_4921 |
| 5377 | >Toxin: Lcho_2593 | 10921 | >Antitoxin: Lcho_2594 |
| 5378 | >Toxin: Dtpsy_1727 | 10922 | >Antitoxin: Dtpsy_1726 |
| 5379 | >Toxin: Vapar_2732 | 10923 | >Antitoxin: Vapar_2731 |
| 5380 | >Toxin: Francci3_3069 | 10924 | >Antitoxin: Francci3_3068 |
| 5381 | >Toxin: Mmcs_5077 | 10925 | >Antitoxin: Mmcs_5078 |
| 5382 | >Toxin: Mkms_5165 | 10926 | >Antitoxin: Mkms_5166 |
| 5383 | >Toxin: Mjls_5456 | 10927 | >Antitoxin: Mjls_5457 |
| 5384 | >Toxin: Franean1_1843 | 10928 | >Antitoxin: Franean1_1844 |
| 5385 | >Toxin: Afer_0480 | 10929 | >Antitoxin: Afer_0481 |
| 5386 | >Toxin: Amir_3816 | 10930 | >Antitoxin: Amir_3815 |
| 5387 | >Toxin: Svir_26430 | 10931 | >Antitoxin: Svir_26440 |
| 5388 | >Toxin: Namu_2498 | 10932 | >Antitoxin: Namu_2499 |
| 5389 | >Toxin: Adeh_2402 | 10933 | >Antitoxin: Adeh_2401 |
| 5390 | >Toxin: Anae109_0244 | 10934 | >Antitoxin: Anae109_0245 |
| 5391 | >Toxin: CCC13826_1729 | 10935 | >Antitoxin: CCC13826_1728 |
| 5392 | >Toxin: Oter_1803 | 10936 | >Antitoxin: Oter_1804 |
| 5393 | >Toxin: SYO3AOP1_0447 | 10937 | >Antitoxin: SYO3AOP1_0448 |
| 5394 | >Toxin: AnaeK_1461 | 10938 | >Antitoxin: AnaeK_1462 |
| 5395 | >Toxin: Dhaf_0209 | 10939 | >Antitoxin: Dhaf_0210 |
| 5396 | >Toxin: A2cp1_1556 | 10940 | >Antitoxin: A2cp1_1557 |
| 5397 | >Toxin: Hlac_1165 | 10941 | >Antitoxin: Hlac_1164 |
| 5398 | >Toxin: Daro_3986 | 10942 | >Antitoxin: Daro_3985 |
| 5399 | >Toxin: Rmet_1293 | 10943 | >Antitoxin: Rmet_1292 |
| 5400 | >Toxin: RSP_0499 | 10944 | >Antitoxin: RSP_0500 |
| 5401 | >Toxin: Mlg_2026 | 10945 | >Antitoxin: Mlg_2025 |
| 5402 | >Toxin: Pden_3101 | 10946 | >Antitoxin: Pden_3102 |
| 5403 | >Toxin: Pnap_1971 | 10947 | >Antitoxin: Pnap_1970 |
| 5404 | >Toxin: Mpe_A2822 | 10948 | >Antitoxin: Mpe_A2821 |
| 5405 | >Toxin: Rsph17029_2150 | 10949 | >Antitoxin: Rsph17029_2151 |
| 5406 | >Toxin: Rsph17025_3372 | 10950 | >Antitoxin: Rsph17025_3371 |
| 5407 | >Toxin: Xaut_2176 | 10951 | >Antitoxin: Xaut_2177 |
| 5408 | >Toxin: Bind_1153 | 10952 | >Antitoxin: Bind_1154 |
| 5409 | >Toxin: Bphy_7262 | 10953 | >Antitoxin: Bphy_7261 |
| 5410 | >Toxin: SNSL254_A1648 | 10954 | >Antitoxin: SNSL254_A1647 |
| 5411 | >Toxin: SeHA_C1707 | 10955 | >Antitoxin: SeHA_C1706 |
| 5412 | >Toxin: SeSA_A1640 | 10956 | >Antitoxin: SeSA_A1639 |
| 5413 | >Toxin: SeAg_B1635 | 10957 | >Antitoxin: SeAg_B1636 |
| 5414 | >Toxin: SeD_A1800 | 10958 | >Antitoxin: SeD_A1801 |
| 5415 | >Toxin: Avin_50560 | 10959 | >Antitoxin: Avin_50550 |
| 5416 | >Toxin: MCA0236 | 10960 | >Antitoxin: MCA0237 |
| 5417 | >Toxin: Ava_3935 | 10961 | >Antitoxin: Ava_3936 |
| 5418 | >Toxin: Ava_4253 | 10962 | >Antitoxin: Ava_4254 |
| 5419 | >Toxin: Francci3_4482 | 10963 | >Antitoxin: Francci3_4481 |
| 5420 | >Toxin: RPB_0975 | 10964 | >Antitoxin: RPB_0976 |
| 5421 | >Toxin: RPC_4457 | 10965 | >Antitoxin: RPC_4456 |
| 5422 | >Toxin: Bxe_B1473 | 10966 | >Antitoxin: Bxe_B1474 |
| 5423 | >Toxin: RPD_1079 | 10967 | >Antitoxin: RPD_1080 |

TABLE 3-continued

| Toxin polypeptide sequences | | Antitoxin polypeptide sequences | |
|---|---|---|---|
| SEQ ID NO: | designation | SEQ ID NO: | designation |
| 5424 | >Toxin: Pnap_2322 | 10968 | >Antitoxin: Pnap_2321 |
| 5425 | >Toxin: BBta_5919 | 10969 | >Antitoxin: BBta_5918 |
| 5426 | >Toxin: Xaut_0094 | 10970 | >Antitoxin: Xaut_0095 |
| 5427 | >Toxin: Franean1_6875 | 10971 | >Antitoxin: Franean1_6874 |
| 5428 | >Toxin: Lcho_1352 | 10972 | >Antitoxin: Lcho_1353 |
| 5429 | >Toxin: Bind_0479 | 10973 | >Antitoxin: Bind_0480 |
| 5430 | >Toxin: Rpal_5095 | 10974 | >Antitoxin: Rpal_5094 |
| 5431 | >Toxin: Lferr_1232 | 10975 | >Antitoxin: Lferr_1231 |
| 5432 | >Toxin: M446_3540 | 10976 | >Antitoxin: M446_3541 |
| 5433 | >Toxin: Gdia_1564 | 10977 | >Antitoxin: Gdia_1563 |
| 5434 | >Toxin: Msil_3626 | 10978 | >Antitoxin: Msil_3625 |
| 5435 | >Toxin: PCC7424_2113 | 10979 | >Antitoxin: PCC7424_2112 |
| 5436 | >Toxin: PCC8801_1791 | 10980 | >Antitoxin: PCC8801_1792 |
| 5437 | >Toxin: AFE_1514 | 10981 | >Antitoxin: AFE_1513 |
| 5438 | >Toxin: Cyan7425_4799 | 10982 | >Antitoxin: Cyan7425_4800 |
| 5439 | >Toxin: Mnod_3990 | 10983 | >Antitoxin: Mnod_3989 |
| 5440 | >Toxin: Cyan8802_1819 | 10984 | >Antitoxin: Cyan8802_1820 |
| 5441 | >Toxin: BR0572 | 10985 | >Antitoxin: BR0571 |
| 5442 | >Toxin: RPC_1776 | 10986 | >Antitoxin: RPC_1775 |
| 5443 | >Toxin: Meso_0874 | 10987 | >Antitoxin: Meso_0873 |
| 5444 | >Toxin: Mmar10_0895 | 10988 | >Antitoxin: Mmar10_0894 |
| 5445 | >Toxin: BOV_0573 | 10989 | >Antitoxin: BOV_0572 |
| 5446 | >Toxin: Oant_2687 | 10990 | >Antitoxin: Oant_2688 |
| 5447 | >Toxin: Plav_0876 | 10991 | >Antitoxin: Plav_0875 |
| 5448 | >Toxin: Xaut_0072 | 10992 | >Antitoxin: Xaut_0073 |
| 5449 | >Toxin: Caul_1204 | 10993 | >Antitoxin: Caul_1203 |
| 5450 | >Toxin: Avi_1289 | 10994 | >Antitoxin: Avi_1287 |
| 5451 | >Toxin: Ent638_3494 | 10995 | >Antitoxin: Ent638_3495 |
| 5452 | >Toxin: EcHS_A0931 | 10996 | >Antitoxin: EcHS_A0930 |
| 5453 | >Toxin: Spro_0871 | 10997 | >Antitoxin: Spro_0872 |
| 5454 | >Toxin: EcolC_2770 | 10998 | >Antitoxin: EcolC_2771 |
| 5455 | >Toxin: SNSL254_A4372 | 10999 | >Antitoxin: SNSL254_A4371 |
| 5456 | >Toxin: SeAg_B2861 | 11000 | >Antitoxin: SeAg_B2862 |
| 5457 | >Toxin: SeD_A3043 | 11001 | >Antitoxin: SeD_A3044 |
| 5458 | >Toxin: PC1_3178 | 11002 | >Antitoxin: PC1_3177 |
| 5459 | >Toxin: Nwi_3022 | 11003 | >Antitoxin: Nwi_3023 |
| 5460 | >Toxin: Nham_3394 | 11004 | >Antitoxin: Nham_3395 |
| 5461 | >Toxin: Dgeo_2838 | 11005 | >Antitoxin: Dgeo_2837 |
| 5462 | >Toxin: Pnap_2692 | 11006 | >Antitoxin: Pnap_2691 |
| 5463 | >Toxin: Pnuc_1487 | 11007 | >Antitoxin: Pnuc_1486 |
| 5464 | >Toxin: Acry_1978 | 11008 | >Antitoxin: Acry_1979 |
| 5465 | >Toxin: Swit_0949 | 11009 | >Antitoxin: Swit_0948 |
| 5466 | >Toxin: Xaut_1455 | 11010 | >Antitoxin: Xaut_1454 |
| 5467 | >Toxin: Xaut_2672 | 11011 | >Antitoxin: Xaut_2671 |
| 5468 | >Toxin: Mrad2831_4215 | 11012 | >Antitoxin: Mrad2831_4216 |
| 5469 | >Toxin: Mrad2831_5267 | 11013 | >Antitoxin: Mrad2831_5266 |
| 5470 | >Toxin: BamMC406_4627 | 11014 | >Antitoxin: BamMC406_4628 |
| 5471 | >Toxin: SYO3AOP1_0084 | 11015 | >Antitoxin: SYO3AOP1_0083 |
| 5472 | >Toxin: M446_6453 | 11016 | >Antitoxin: M446_6452 |
| 5473 | >Toxin: Mchl_5388 | 11017 | >Antitoxin: Mchl_5387 |
| 5474 | >Toxin: Mnod_8369 | 11018 | >Antitoxin: Mnod_8370 |
| 5475 | >Toxin: Mnod_8664 | 11019 | >Antitoxin: Mnod_8663 |
| 5476 | >Toxin: Mnod_2704 | 11020 | >Antitoxin: Mnod_2703 |
| 5477 | >Toxin: BR1550 | 11021 | >Antitoxin: BR1549 |
| 5478 | >Toxin: Meso_2169 | 11022 | >Antitoxin: Meso_2170 |
| 5479 | >Toxin: BOV_1498 | 11023 | >Antitoxin: BOV_1497 |
| 5480 | >Toxin: Smed_1549 | 11024 | >Antitoxin: Smed_1548 |
| 5481 | >Toxin: Oant_1616 | 11025 | >Antitoxin: Oant_1617 |
| 5482 | >Toxin: Rleg2_2786 | 11026 | >Antitoxin: Rleg2_2785 |
| 5483 | >Toxin: Avi_3221 | 11027 | >Antitoxin: Avi_3220 |
| 5484 | >Toxin: Rleg_3050 | 11028 | >Antitoxin: Rleg_3049 |
| 5485 | >Toxin: Swol_0189 | 11029 | >Antitoxin: Swol_0190 |
| 5486 | >Toxin: Cthe_2247 | 11030 | >Antitoxin: Cthe_2246 |
| 5487 | >Toxin: Teth514_0448 | 11031 | >Antitoxin: Teth514_0449 |
| 5488 | >Toxin: Nther_2239 | 11032 | >Antitoxin: Nther_2238 |
| 5489 | >Toxin: Hore_17170 | 11033 | >Antitoxin: Hore_17160 |
| 5490 | >Toxin: Ccel_0091 | 11034 | >Antitoxin: Ccel_0092 |
| 5491 | >Toxin: Athe_1678 | 11035 | >Antitoxin: Athe_1677 |
| 5492 | >Toxin: GWCH70_3034 | 11036 | >Antitoxin: GWCH70_3033 |
| 5493 | >Toxin: Rru_A0101 | 11037 | >Antitoxin: Rru_A0100 |
| 5494 | >Toxin: Smed_3679 | 11038 | >Antitoxin: Smed_3678 |
| 5495 | >Toxin: Anae109_0022 | 11039 | >Antitoxin: Anae109_0023 |
| 5496 | >Toxin: Rleg2_2305 | 11040 | >Antitoxin: Rleg2_2306 |
| 5497 | >Toxin: PCC7424_1520 | 11041 | >Antitoxin: PCC7424_1519 |
| 5498 | >Toxin: PCC8801_3755 | 11042 | >Antitoxin: PCC8801_3756 |
| 5499 | >Toxin: Cyan7425_0809 | 11043 | >Antitoxin: Cyan7425_0808 |
| 5500 | >Toxin: Tgr7_1598 | 11044 | >Antitoxin: Tgr7_1597 |

TABLE 3-continued

| SEQ ID NO: | Toxin polypeptide sequences designation | SEQ ID NO: | Antitoxin polypeptide sequences designation |
|---|---|---|---|
| 5501 | >Toxin: Rleg__2644 | 11045 | >Antitoxin: Rleg__2645 |
| 5502 | >Toxin: Cyan8802__3804 | 11046 | >Antitoxin: Cyan8802__3805 |
| 5503 | >Toxin: Shewmr7__0736 | 11047 | >Antitoxin: Shewmr7__0735 |
| 5504 | >Toxin: Mmwyl1__0574 | 11048 | >Antitoxin: Mmwyl1__0575 |
| 5505 | >Toxin: YPK__0910 | 11049 | >Antitoxin: YPK__0909 |
| 5506 | >Toxin: SNSL254__A2922 | 11050 | >Antitoxin: SNSL254__A2923 |
| 5507 | >Toxin: SeHA__C3478 | 11051 | >Antitoxin: SeHA__C347 |
| 5508 | >Toxin: SeAg__B2787 | 11052 | >Antitoxin: SeAg__B2788 |
| 5509 | >Toxin: VSAL__I1041 | 11053 | >Antitoxin: VSAL__I1040 |
| 5510 | >Toxin: RPB__3182 | 11054 | >Antitoxin: RPB__3183 |
| 5511 | >Toxin: Saro__0336 | 11055 | >Antitoxin: Saro__0335 |
| 5512 | >Toxin: Jann__2925 | 11056 | >Antitoxin: Jann__2924 |
| 5513 | >Toxin: RPC__1884 | 11057 | >Antitoxin: RPC__1883 |
| 5514 | >Toxin: RPD__2316 | 11058 | >Antitoxin: RPD__2315 |
| 5515 | >Toxin: RSP__2823 | 11059 | >Antitoxin: RSP__2822 |
| 5516 | >Toxin: Pden__2538 | 11060 | >Antitoxin: Pden__2539 |
| 5517 | >Toxin: Rsph17029__1473 | 11061 | >Antitoxin: Rsph17029__1474 |
| 5518 | >Toxin: Rpal__2376 | 11062 | >Antitoxin: Rpal__2375 |
| 5519 | >Toxin: Mchl__5687 | 11063 | >Antitoxin: Mchl__5686 |
| 5520 | >Toxin: Francci3__3214 | 11064 | >Antitoxin: Francci3__3215 |
| 5521 | >Toxin: Arth__2278 | 11065 | >Antitoxin: Arth__2279 |
| 5522 | >Toxin: Acel__1330 | 11066 | >Antitoxin: Acel__1331 |
| 5523 | >Toxin: Noca__2407 | 11067 | >Antitoxin: Noca__2406 |
| 5524 | >Toxin: Strop__1828 | 11068 | >Antitoxin: Strop__1827 |
| 5525 | >Toxin: Franean1__1694 | 11069 | >Antitoxin: Franean1__1693 |
| 5526 | >Toxin: Sare__1819 | 11070 | >Antitoxin: Sare__1818 |
| 5527 | >Toxin: Achl__2015 | 11071 | >Antitoxin: Achl__2016 |
| 5528 | >Toxin: Amir__5265 | 11072 | >Antitoxin: Amir__5266 |
| 5529 | >Toxin: Bcav__2014 | 11073 | >Antitoxin: Bcav__2013 |
| 5530 | >Toxin: Caci__2378 | 11074 | >Antitoxin: Caci__2377 |
| 5531 | >Toxin: Svir__15270 | 11075 | >Antitoxin: Svir__15260 |
| 5532 | >Toxin: Jden__1351 | 11076 | >Antitoxin: Jden__1352 |
| 5533 | >Toxin: Namu__3297 | 11077 | >Antitoxin: Namu__3298 |
| 5534 | >Toxin: Reut__C6182 | 11078 | >Antitoxin: Reut__C6181 |
| 5535 | >Toxin: Reut__C6338 | 11079 | >Antitoxin: Reut__C6339 |
| 5536 | >Toxin: Bxe__A1728 | 11080 | >Antitoxin: Bxe__A1729 |
| 5537 | >Toxin: Bxe__A0064 | 11081 | >Antitoxin: Bxe__A0063 |
| 5538 | >Toxin: Bpro__0341 | 11082 | >Antitoxin: Bpro__0340 |
| 5539 | >Toxin: Nham__3807 | 11083 | >Antitoxin: Nham__3806 |
| 5540 | >Toxin: Bcen2424__6839 | 11084 | >Antitoxin: Bcen2424__6838 |
| 5541 | >Toxin: Smed__6339 | 11085 | >Antitoxin: Smed__6338 |
| 5542 | >Toxin: Xaut__4609 | 11086 | >Antitoxin: Xaut__4610 |
| 5543 | >Toxin: Bphy__7465 | 11087 | >Antitoxin: Bphy__7466 |
| 5544 | >Toxin: Bphyt__6578 | 11088 | >Antitoxin: Bphyt__6579 |

According to yet another aspect of the present invention there is provided an isolated bacterial population genetically modified to express a toxin and a cognate antitoxin thereof, the bacterial population being resistant to a lytic activity of a bacteriophage, wherein said toxin comprises an amino acid sequence at least 90% homologous to a sequence as set forth in SEQ ID NOs: 2773-3117, wherein when said toxin comprises said amino acid sequence at least 90% homologous to SEQ ID NO: 2773-2804, said antitoxin comprises an amino acid sequence at least 90% homologous to the sequence as set forth in SEQ ID NO:8317-8348, wherein when said toxin comprises said amino acid sequence at least 90% homologous to SEQ ID to NO: 2805-2871, said antitoxin comprises an amino acid sequence at least 90% homologous to the sequence as set forth in SEQ ID NO:8349-8415, wherein when said toxin comprises said amino acid sequence at least 90% homologous to SEQ ID NO: 2872-2935, said antitoxin comprises an amino acid sequence at least 90% homologous to the sequence as set forth in SEQ ID NO:8416-8479, wherein when said toxin comprises said amino acid sequence at least 90% homologous to SEQ ID NO: 2936-3030, said antitoxin comprises an amino acid sequence at least 90% homologous to the sequence as set forth in SEQ ID NO:8480-8574, wherein when said toxin comprises said amino acid sequence at least 90% homologous to SEQ ID NO: 3031-3078, said antitoxin comprises an amino acid sequence at least 90% homologous to the sequence as set forth in SEQ ID NO: 8575-8622, wherein when said toxin comprises said amino acid sequence at least 90% homologous to SEQ ID NO: 3079-3087, said antitoxin comprises an amino acid sequence at least 90% homologous to the sequence as set forth in SEQ ID NO:8623-8631, wherein when said toxin comprises said amino acid sequence at least 90% homologous to SEQ ID NO: 3088-3094, said antitoxin comprises an amino acid sequence at least 90% homologous to the sequence as set forth in SEQ ID NO:8632-8638, wherein when said toxin comprises said amino acid sequence at least 90% homologous to SEQ ID NO: 3095-3109, said antitoxin comprises an amino acid sequence at least 90% homologous to the sequence as set forth in SEQ ID NO:8639-8653, wherein when said toxin comprises said amino acid sequence at least 90% homologous to SEQ ID NO: 3110-3117, said antitoxin comprises an amino acid sequence at least 90% homologous to the sequence as set forth in SEQ ID NO:8654-8661.

Thus for example, the present inventors have found that when the toxin comprises an amino acid sequence as set forth in SEQ ID NOs: 3031-3078, the bacterial population in which the toxin antitoxin system is expressed is protected from the lytic activity of the T7Δ4.3Δ4.5Δ4.7 bacteriophage.

Further, when the toxin comprises an amino acid sequence as set forth in SEQ ID NO: 2805-2871, the bacterial population in which the toxin antitoxin system is expressed is protected from the lytic activity of the WT T7 strain.

Methods of expressing polypeptides in microbial populations are known in the art and further described herein below.

Regulatory sequences include those that direct constitutive expression of a nucleotide sequence as well as those that direct inducible expression of the nucleotide sequence only under certain conditions. A bacterial promoter is any DNA sequence capable of binding bacterial RNA polymerase and initiating the downstream (3') transcription of a coding sequence into mRNA. A promoter can have a transcription initiation region, which is usually placed proximal to the 5' end of the coding sequence. This transcription initiation region typically includes an RNA polymerase binding site and a transcription initiation site. A bacterial promoter can also have a second domain called an operator, which can overlap an adjacent RNA polymerase binding site at which RNA synthesis begins. The operator permits negative regulated (inducible) transcription, as a gene repressor protein can bind the operator and thereby inhibit transcription of a specific gene. Constitutive expression can occur in the absence of negative regulatory elements, such as the operator. In addition, positive regulation can be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) Annu. Rev. Genet. 18:173). Regulated expression can therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters can be constitutively active or inducible. A non-limiting example of a heterologous promoter is given in U.S. Pat. No. 6,242,194 to Kullen and Klaenhammer.

Sequences encoding metabolic pathway enzymes provide particularly useful promoter sequences. Examples include promoter sequences derived from sugar metabolizing enzymes, such as galactose, lactose (lac) (Chang et al. (1987) Nature 198:1056), and maltose. Additional examples include promoter sequences derived from biosynthetic enzymes such as tryptophan (trp) (Goeddel et al. (1980) Nucleic Acids Res. 8:4057; Yelverton et al. (1981) Nucleic Acids Res. 9:731; U.S. Pat. No. 4,738,921; EPO Publication Nos. 36,776 and 121,775). The beta-lactamase (bla) promoter system (Weissmann, (1981) "The Cloning of Interferon and Other Mistakes," in Interferon 3 (ed. I. Gresser); bacteriophage lambda PL (Shimatake et al. (1981) Nature 292:128); the arabinose-inducible araB promoter (U.S. Pat. No. 5,028,530); and T5 (U.S. Pat. No. 4,689,406) promoter systems also provide useful promoter sequences. See also Balbas (2001) Mol. Biotech. 19:251-267, where *E. coli* expression systems are discussed.

In addition, synthetic promoters that do not occur in nature also function as bacterial promoters. For example, transcription activation sequences of one bacterial or bacteriophage promoter can be joined with the operon sequences of another bacterial or bacteriophage promoter, creating a synthetic hybrid promoter (U.S. Pat. No. 4,551,433). For example, the tac (Amann et al. (1983) Gene 25:167; de Boer et al. (1983) Proc. Natl. Acad. Sci. 80:21) and trc (Brosius et al. (1985) J. Biol. Chem. 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-.beta.-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) J. Mol. Biol. 189:113; Tabor et al. (1985) Proc. Natl. Acad. Sci. 82:1074). In addition, a hybrid promoter can also be comprised of a bacteriophage promoter and an *E. coli* operator region (EPO Publication No. 267,851).

The vector can additionally contain a nucleotide sequence encoding the repressor (or inducer) for that promoter. For example, an inducible vector of the present invention can regulate transcription from the Lac operator (LacO) by expressing the nucleotide sequence encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., lambda CI857, rendering lambda pL thermo-inducible, or lambda CI+, rendering lambda pL chemo-inducible) can be employed.

In addition to a functioning promoter sequence, an efficient ribosome-binding site is also useful for the expression of the fusion construct. In prokaryotes, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) Nature 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in Biological Regulation and Development: Gene Expression (ed. R. F. Goldberger, Plenum Press, NY).

The bacterial protecting peptides can also be secreted from the cell by creating chimeric DNA molecules that encode a protein comprising a signal peptide sequence fragment that provides for secretion of the two-component regulatory polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth medium (Gram-positive bacteria) or into the periplasmic space, located between the inner and outer membrane of the cell (Gram-negative bacteria). Preferably there are processing sites, which can be cleaved either in vivo or in vitro, encoded between the signal peptide fragment and the protein of the invention.

DNA encoding suitable signal sequences can be derived from genes for secreted bacterial proteins, such as the *E. coli* outer membrane protein gene (ompA) (Masui et al. (1983) FEBS Lett. 151(1):159-164; Ghrayeb et al. (1984) EMBO J. 3:2437-2442) and the *E. coli* alkaline phosphatase signal sequence (phoA) (Oka et al. (1985) Proc. Natl. Acad. Sci.

82:7212). Other prokaryotic signals include, for example, the signal sequence from penicillinase, Ipp, or heat stable enterotoxin II leaders.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

Bacteria such as *Lactobacillus acidophilus* generally utilize the translation start codon ATG, which specifies the amino acid methionine (which is modified to N-formylmethionine in prokaryotic organisms). Bacteria also recognize alternative translation start codons, such as the codons GTG and TTG, which code for valine and leucine, respectively. However, when these alternative translation start codons are used as the initiation codon, these codons direct the incorporation of methionine rather than of the amino acid that they normally encode. *Lactobacillus acidophilus* NCFM recognizes these alternative translation start sites and incorporates methionine as the first amino acid.

It will be appreciated that for expressing toxin/antitoxin pairs in microbial populations the polynucleotide sequence encoding the toxin may be comprised in the same expression vector as that comprising the antitoxin or may be comprised on a separate expression vector from that of the antitoxin.

Exemplary microbial populations that may be protected from toxins and/or the lytic effect of bacteriophages according to this aspect of the present invention include those bacteria useful in dairy and fermentation processing. Thus, microorganisms in which the peptides described herein may be expressed are those that are useful in the manufacture of milk-derived products, such as cheeses, yogurt, fermented milk products, sour milks, and buttermilk. The microorganisms may be probiotic organisms.

According to one embodiment, the bacteria is a lactic acid bacteria.

As used herein the phrase "lactic acid bacteria" refers to a genus selected from the following: *Aerococcus, Carnobacterium, Enterococcus, Lactococcus, Lactobacillus, Leuconostoc, Oenococcus, Pediococcus, Streptococcus,* to *Melissococcus, Alloiococcus, Dolosigranulum, Lactosphaera, Tetragenococcus, Vagococcus,* and *Weissella* (Holzapfel et al. (2001) Am. J. Clin. Nutr. 73:365 S-373S; Bergey's Manual of Systematic Bacteriology, Vol. 2 (Williams and Wilkins, Baltimore (1986)) pp. 1075-1079).

The production of bacteria comprising the toxins and/or antitoxins of the present invention, the preparation of starter cultures of such bacteria, and methods of fermenting substrates, particularly food substrates such as milk, can be carried out in accordance with known techniques, including but not limited to those described in Mayra-Makinen and Bigret (1993) Lactic Acid Bacteria. Salminen and vonWright eds. Marcel Dekker, Inc. New York. 65-96; Sandine (1996) Dairy Starter Cultures Cogan and Accolas eds. VCH Publishers, New York. 191-206; Gilliland (1985) Bacterial Starter Cultures for Food. CRC Press, Boca Raton, Fla.

The term "fermenting" refers to the energy-yielding, metabolic breakdown of organic compounds by microorganisms that generally proceeds under anaerobic conditions and with the evolution of gas.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as to well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N.Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., to "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Materials and Methods

Coverage Analysis of Pairs of Genes:

Mapping of sequencing clones on 360 bacteria and 28 archaea for which raw clone sequencing data was available was performed as described in (Kimelman et al., 2012). Gene positions and annotations were downloaded as described (Kimelman et al., 2012). For each consecutive pair of genes in each genome, three numbers were recorded:

x=<number of clones fully spanning the first and not the second gene> y=<number of clones fully spanning the second gene but not the first gene> z=<number of clones fully spanning both genes>

A pair of genes conforming with {x=0; y>0; z>0} or {x>0; y=0; z>0} was declared as "following the TA cloning pattern". Pairs in which the putative toxin was identified as a 'hitchhiker' (Kimelman et al., 2012) were eliminated from further counts in order to avoid cases in which this clonability pattern was a byproduct of a nearby single, standalone toxic gene. Pairs residing in replicons lacking sufficient clone coverage were also ignored in further counts.

Aggregation of Pairs into Families:

Clustering of individual genes based on sequence homology was retrieved from IMG (worldwidewebimgdotjgidotdoedotgov/cgi-bin/w/maindotcgi) on November 2010 (based on the "IMG cluster" field). Cluster IDs were recorded for every consecutive pair of genes analyzed. Pairs containing a gene that lacked a cluster ID were discarded. All pairs having the same two cluster IDs (regardless of the order and the strand) were aggregated into a single "family of pairs". Families containing less than 7 pairs were ignored, to ensure statistical power in next steps of the analysis. This resulted in 21,417 families, containing at least 7 pairs of consecutive genes sharing to the same two cluster IDs, which were further analyzed. The following "TA cloning fraction" (F) parameters were calculated for each family:

F1=the fraction of family members that follow the TA cloning pattern {x=0; y>0; z>0}

F2=the fraction of family members that follow the TA cloning pattern {x>0; y=0; z>0}

Directionality of putative family (i.e., determining whether gene "x" is the putative toxin or the putative antitoxin) was determined using $F_{max}=\max\{F1,F2\}$, such that:

$F_{max}$=F1→x is the putative toxin $F_{max}$=F2→y is the putative toxin

For each family, the Genus names of all containing organisms were extracted. A "family diversity" (FD) measure was defined as the number of different genus names divided by the total number of family members (pairs). This measure was used to roughly assess the tendency of the family to undergo horizontal gene transfer (HGT) within a wide array of organisms, with higher FD corresponding to higher HGT tendency. For example, a 10-members family where all members are found in strains of *Escherichia coli* will receive a low FD of 0.1. Only families having FD>=0.5 were further analyzed, based on the empirical FD distribution among known families of TA systems (FIG. 9A=S3A).

A Statistical Framework to Detect TA Families:

Since a given pair of genes has the potential to follow the TA cloning pattern merely by chance (i.e., due to the random clone fragmentation) rather than reflecting a real toxin/antitoxin activity, clone distribution simulations were performed to assess statistical significance per family (FIG. 7=S1). For every pair of genes in each family, all clones covering its genome of origin were randomly distributed on the genome, shuffling clone positions but maintaining their number and sizes. Based on these random clone distributions, the x, y, and z values were measured for the gene pair, and a simulated "TA cloning fraction" ($F_{sim}$) was then calculated for the family. This procedure was repeated 1,000 times for each family, generating a distribution of $F_{sim\ (i)}$ (i=1..1000). The real $F_{max}$ of the family was then compared to the distribution of $F_{sim}$ values obtained from the simulations, generating an empirical p value for a family.

Since this procedure is computationally demanding to perform for >21000 families, only families where $F_{max}$>=0.3 (i.e., at least 30% of family members followed the TA cloning pattern) were thus analyzed. Families presenting p-value<=0.05 were considered as following the TA cloning pattern in a statistically significantly manner.

To identify families significantly localized to Defense Islands (DIs) (Makarova et al., 2011), a value of 'mean number of defense island genes in proximity' ($DI_{val}$) was calculated for each family based on a list of 132 COGs (DI genes) that were shown to be enriched in defense island regions (Makarova et al., 2011). For this, the average number of DI genes within a range of ±5 genes from each family member was calculated. Families having $DI_{val}>0.5$ were defined as DI associated (FIG. 2), based on the empirical $DI_{val}$ distribution among known families of TA systems (FIG. 9B). Families were further reviewed manually to remove transposon-containing families possibly associated with defense islands due to their transposition-related properties rather than being genuine TA systems.

Analysis of Known TA Systems within the Identified Set:

The locus tags of all genes from the 24 final families (FIG. 2) were checked against a previously compiled list of known TA systems (Makarova et al., 2009). For a given family, if at least one pair was found in the list of known TA systems, the family was declared as 'known'. Families that were not declared as 'known' were further similarly checked against a list of predicted TA genes downloaded from TADB (http://bioinfo-mmldotsjtudotedudotcn/TADB/) (Shao et al., 2011). Families in which at least one pair was found in this TADB list were declared as 'predicted'. Families found in neither list were declared as 'novel'.

Domain analysis of genes in the identified families was performed by searching their sequences against the Conserved Domain Database (CDD) (Marchler-Bauer et al., 2011) using rpsblast (ftp://ftpdotncbidotnihdotgov/blast/documents/rpsblastdothtml) with e-value threshold of 0.05.

For the Phylogenetic distribution analysis of families (FIG. 4), the IMG cluster ids (http://imgdotjgidotdoedotgov/cgi-bin/w/maindotcgi) of the toxin and to antitoxin for each family were used to retrieve all img adjacent pairs of genes that have the same two cluster ids. For each family, number and identity of organisms carrying members of the family were extracted (Tables 4 and 5, herein below; FIG. 4).

Experimental Evaluation of 'TA Cloning Pattern':

Toxin and antitoxin were amplified from their genomes of origin (in the case of sanaAT, psyrAT and sdenAT) or synthesized (GenScript) for the families pmenAT and rlegAT. The toxin was then directionally ligated into the pRSFDuet-1 vector (EMD Chemicals Inc.) and the antitoxin ligated into the pBAD/HisA plasmid (Invitrogen). Since transformation of the toxin gene alone resulted in mutations in the toxin due to toxicity, the two plasmids (carrying the toxin and antitoxin) were co-transformed into E. coli BL21(DE3)pLysS (Stratagene) in the presence of 0.3% arabinose to induce the antitoxin. The clones were verified by direct sequencing with primers on the pRSFduet-1 and pBAD/HisA vectors.

For the toxicity assay on plates, clones were cultured in LB medium with 100 µg/ml ampicillin, 50 µg/ml kanamycin, 34 µg/ml chloramphenicol and 0.3% arabinose overnight. The next day, a portion of each overnight culture was inoculated into fresh medium (10-fold dilution) and 10 µl were spotted on LB plates supplemented with 100 µg/ml ampicillin, 50 µg/ml kanamycin and 34 µg/ml chloramphenicol. Toxin, antitoxin or both were induced by 100 µM IPTG and 0.3% arabinose, respectively.

For the growth kinetics experiments 3 different colonies of each system were cultured in LB medium with 100 µg/ml ampicillin, 50 µg/ml kanamycin, 34 µg/ml chloramphenicol and 0.3% arabinose overnight. The next day cells were diluted 1:20 and measured for OD using 1 cm path cuvetts. Samples were equilibrated to the same OD and 5 µl of these samples were added to 175 µl LB medium supplemented with 100 µg/ml ampicillin, 50 µg/ml kanamycin, 34 µg/ml chloramphenicol in a 96-wells microplate. Cells were placed in Infinite M200 in a script employing a 60 cycles of ~5 min interval. Measurements were done using 486ex/516em bandwidth (Gain 95, 105 and 110) and OD at 600 nm overnight. For each of the colonies the following treatments were applied: No induction, induction of 100 µM IPTG and/or 0.3% arabinose after ~4 h, and induction of 100 µM IPTG after ~4 h and of 0.3% arabinose after another ~2.5 hours. The overnight growth replicate values were averaged and the measured OD values were plotted against time.

The viability assay (FIG. 3C) was performed as described by Pedersen et al (2002). Briefly, each strain was grown overnight at 37° C. in LB medium containing 100 µg/ml ampicillin, 50 µg/ml kanamycin, and 34 µg/ml chloramphenicol. In the next morning, cells were then diluted 1:1000 in the same medium as above and grown for 3 hours. At time zero cells were then washed once with LB, and then transcription of toxin was induced by 100 µM IPTG. At increasing time points after toxin induction (30, 60, 120, 180, 240 and 300 mins) cells were plated in several dilutions on LB-plates containing 100 µg/ml ampicillin, 50 µg/ml kanamycin, 34 µg/ml chloramphenicol and 0.3% arabinose. CFUs were determined in the next morning by colony counting.

Plaque Assays:

E. coli strains harboring the antitoxin only or the toxin-antitoxin of psyrAT, sanaAT, pmenAT, rlegAT, and sdenAT binary toxin-antitoxin systems were grown overnight in LB liquid medium supplemented with 35 µg/ml chloramphenicol, 100 µg/ml ampicillin and 0.3% L-arabinose with or without 50 µg/ml kanamycin, respectively. Overnight cultures were diluted 1:100 in fresh LB medium supplemented with inducers and antibiotics as above and aerated with shaking at 37° C. until reaching $O.D_{600}{\approx}0.5$. Cultures were then centrifuged for 10 min and re-suspended in LB to an $O.D_{600}$ of exactly 0.5. Volumes of 200 µl of culture and 10 µl of the indicated T7 phages were mixed in 3 ml of warm 0.8% agar LB supplemented with 35 µg/ml chloramphenicol, 100 µg/ml ampicillin and 0.3% L-arabinose or 35 µg/ml chloramphenicol, 100 µg/ml ampicillin, 50 µg/ml kanamycin, 0.3% L-arabinose, and 100 µM IPTG for the antitoxin only- or toxin-antitoxin-harboring cultures, respectively. The mixtures were immediately overlaid on LB plates supplemented with the above indicated inducers and antibiotics. Overlaid plates were incubated at 37° C. for 3 h and plaques were then counted. For a given TA pair, efficiency of plating (EOP) was calculated by dividing the number of plaque forming units (PFU) obtained for bacterial lawn expressing the toxin+antitoxin by the number of PFU obtained on the bacterial lawn expressing the antitoxin alone. For the rlegAT system, additional experiments were done with resuspension of cultures in LB to a higher $O.D_{600}$ of 2.5, to address the possibility that the observed smaller plaque sizes stemmed from lower lawn density resulting from partial toxicity of this system to E. coli when grown on plates.

Expression of Lon and 4.5 Proteins and Co-Immunoprecipitation Assay:

The 4.5 gene (3' His-tagged) and full-length Lon protease gene (5' Flag-tagged) were cloned into the $1^{st}$ and $2^{nd}$ expression cassettes, respectively, of the vector pRSFDuet-1 (EMD Chemicals, Inc.). DNA cloning was performed using the Restriction Free (RF) cloning procedure (Unger et al., 2010). Induction experiments were performed using E. coli BL21 (DE3) cells expressing only the Lon or the 4.5 proteins and cells expressing both Lon and 4.5 proteins. Induction was carried out at 37° C. for 3 hr by addition of 200 µM of IPTG. Cell pellets were lysed by sonication in a buffer containing 50 mM Tris-HCl, pH 7.4, 150 mM NaCl, 1 mM EDTA, 1% (v/v) Triton X-100, 1 mM phenylmethylsulfonyl fluoride (PMSF) and 1 μl/mL protease inhibitor cocktail (Set IV, EMD Chemicals, Inc.). Cell debris were removed by centrifugation at 4° C. for 15 minutes at 18,000 g. Clear supernatants were transferred to 1.5 ml tubes and incubated on a rotator shaker at 4° C. for 1 hr with 80 μl pre-washed anti-Flag M2-agarose beads (Sigma, #A2220). The beads were washed three times with the buffer described above and the Flag-tagged protein or protein complex were eluted using Flag-peptide (Sigma, #F3290) using the manufacturers' recommendations.

Example 1

Systematic Discovery of TA Families Based on Large-Scale Cloning Experiments 360 bacterial and 28 archaeal genomes that were sequenced using the clone-based Sanger approach, and for which the raw sequencing data was accessible and mapped to the assembled genome (Kimelman et al., 2012) were analyzed. For the sequencing of each genome, an average of 22,313 different randomly fragmented clones (typically sized between 3 kb-8 kb, thus typically spanning ~3 to ~8 genes) were inserted into $E.$ $coli.$ Cumulatively, the analyzed genomes span over 1.5 million genes to that were sequenced using over 8.5 million clones. The number of cloned DNA fragments that fully contain were recorded for each gene, and for each pair of consecutive genes.

To detect families of gene pairs in which one of the genes (putative toxin) is absent from clones unless the adjacent gene (putative antitoxin) is also present, the present inventors first searched for homologous gene pairs that repeatedly appear adjacent to each other in multiple genomes (at least 7 appearances) and aggregated them into families of pairs (Methods). To avoid the analysis of housekeeping genes that appear in conserved operons (e.g., ribosomal protein genes), the present inventors focused on families showing high tendency to undergo horizontal gene transfer (Methods). Each pair of genes (X and Y) in each family was considered as following the "TA cloning pattern" if the number of clones covering gene X (toxin) but not Y (antitoxin) was 0, the number of clones covering gene Y but not X was >0 and the number of clones covering both X and Y was >0 (FIGS. 1B-C).

Not all toxins are expected to manifest their toxicity when cloned in $E.$ $coli,$ because their expression depends on the ability of the $E.$ $coli$ host to recognize their native promoters and translate them using available tRNA pool (Sorek et al., 2007). Therefore, for a given toxin-antitoxin family of gene pairs, one may expect a significant fraction of pairs, but not necessarily all pairs, to follow the "TA cloning pattern" (FIG. 1C). To assign a statistical significance for a given family as possibly coding for a bona fide TA family, the present inventors performed, for each pair in each family, 1000 random simulations, where the clones used for sequencing of the relevant genome were randomly shuffled on the genome (Methods; FIG. 7). The results were then used to assign an empirical p-value per family, revealing families in which the fraction of pairs that follow the TA cloning pattern is significantly above the fraction expected by chance ($p<=0.05$). This yielded 188 candidate families (FIG. 2).

The identified families may include genes that follow the TA cloning pattern as a by-product of their functions, and not for reasons associated with classical TA systems. For example, a metabolic enzyme whose expression results in accumulation of toxic intermediates might be neutralized by an accompanying transcriptional repressor. This may be the case for the argininosuccinate synthase and the ArgR to repressor of the arginine regulon that obey the TA cloning patterns in 4 out of 12 homologous pairs. To identify TA systems more likely to play phage defense-related roles, the present inventors focused on those families that had high tendency to appear within bacterial "defense islands". It was recently shown that bacterial anti-phage immune systems such as restriction enzymes, CRISPR and Abi genes aggregate in such "defense island" loci in bacterial genomes (Makarova et al., 2011). Therefore, the present inventors selected those families in which the genomic neighborhood was enriched for defense genes (Methods). This analysis resulted in a set of 24 putative families of TA gene pairs, overall containing 400 pairs from 176 genomes (FIG. 2; Tables 4-5).

TABLE 4

Families of previously known and bioinformatically predicted toxin-antitoxin systems retrieved by the TA discovery algorithm

| | # pairs in family | Antitoxin superfamily | Toxin superfamily | COGs associated with antitoxin | COGs associated with toxin | P value for TA cloning pattern |
|---|---|---|---|---|---|---|
| 1 | 16 | RelB | RelE | COG3905 | COG3668 | $5.0 \times 10^{-3}$ |
| 2 | 25 | RelB | RelE | COG3077 | COG3041 | $3.0 \times 10^{-3}$ |
| 3 | 13 | RelB | RelE | n/a | n/a | $1.1 \times 10^{-2}$ |
| 4 | 33 | Xre | RelE | COG3620 | COG4679 | $2.5 \times 10^{-2}$ |
| 5 | 28 | Xre | RelE | n/a | COG2944 | $2.5 \times 10^{-2}$ |
| 6 | 32 | Xre | RelE | COG5499 | COG4680 | $7.0 \times 10^{-3}$ |
| 7 | 27 | Phd | RelE | COG2161 | COG2026 | $3.4 \times 10^{-2}$ |
| 8 | 9 | HicB | HicA | COG1598 | COG1724 | $9.0 \times 10^{-3}$ |
| 9 | 11 | HicB | HicA | n/a | COG1724 | $3.4 \times 10^{-2}$ |
| 10 | 12 | VapB | VapC | COG4456 | COG1487 | $4.0 \times 10^{-3}$ |
| 11 | 10 | HigA | HigB | COG3093 | COG3549 | $1.0 \times 10^{-3}$ |
| 12 | 22 | MosA | MosT | n/a | COG2253 | 0 |

TABLE 5

Novel families of toxin-antitoxin systems retrieved by the TA discovery algorithm

| # pairs in fam. | Antitoxin | Toxin | Antitoxin annotation | Toxin annotation | Domains associated with antitoxin | Domains associated with toxin | P value for TA cloning pattern |
|---|---|---|---|---|---|---|---|
| 11 | PsyrA SEQ ID NOs: 8416-8479 | PsyrT SEQ ID NOs: 2872-2935 | Nucleotide-binding protein | RecQ-family DNA helicase | COG0758 | COG0514 | 0 |

TABLE 5-continued

Novel families of toxin-antitoxin systems retrieved by the TA discovery algorithm

| # pairs in fam. | Antitoxin | Toxin | Antitoxin annotation | Toxin annotation | Domains associated with antitoxin | Domains associated with toxin | P value for TA cloning pattern |
|---|---|---|---|---|---|---|---|
| 10 | SanaA SEQ ID NO: 8575-8622 | SanaT SEQ ID NOs: 3031-3078 | S-adenosyl-homocysteine hydrolase | Hypothetical protein | n/a | DUF1814 | 0 |
| 10 | PmenA SEQ ID NO: 8480-8574 | PmenT SEQ ID NO: 2936-3030 | ADP-ribose binding domain protein | Hypothetical protein | COG2110 | n/a | 0 |
| 9 | SEQ ID NO: 8623-8631 | SEQ ID NOs: 3079-3087 | Hypothetical protein | Adenine specific DNA methylase | n/a | COG2189 | 0 |
| 7 | SEQ ID NO: 8632-8638 | SEQ ID NOs: 3088-3094 | T/G mismatch-specific endonuclease | Type II restriction endonuclease | COG3727 | PF09019 | 0 |
| 20 | RlegA SEQ ID NO: 8349-8415 | RlegT SEQ ID NOs: 2805-2871 | Predicted transcriptional regulator | Hypothetical protein | COG5340 | DUF1814 | 0 |
| 8 | SEQ ID NO: 8654-8661 | SEQ ID NOs: 3110-3117 | Hypothetical protein (associated with cas/cmr genes) | RAMP domain protein (Cmr6-like) | n/a | DUF324 | $2.9 \times 10^{-2}$ |
| 15 | SEQ ID NO: 8639-8653 | SEQ ID NO: 3095-3109 | Uncharacterized membrane protein | Membrane protein, TraG-like N-terminal domain | n/a | PF07916 | $2 \times 10^{-3}$ |
| 7 | SdenA SEQ ID NO: 8317-8348 | SdenT SEQ ID NOs: 2773-2804 | Hypothetical protein | Hypothetical protein | n/a | DUF1814 | $3 \times 10^{-3}$ |

*TA system that is part of a larger operon putatively involved in bacterial defense (FIG. 8).

Of the 24 identified families, 12 families (50%) were already described as TA systems, either experimentally (12 "known" families) or by earlier bioinformatic predictions (3 "predicted" families (Shao et al., 2011)), providing strong validation to the present cloning-based approach for TA discovery (Table 4). Although a diverse set of known TA families is represented in the set retrieved by the present algorithm, to due to limitations of the present approach not all known families were represented. For example, in the family consisting of HipAB gene pairs, 6 out of 19 pairs were found to obey the TA cloning pattern, but since the toxin is relatively large and the antitoxin is a short gene, such a pattern has high probability to occur by chance in the random simulations, and hence this family did not pass the present statistical threshold (p=0.43) (see Discussion).

Example 2

Experimental Validation of Novel TA Families

The present analysis retrieved 8 putative novel families of TA systems (Table 5). Six of these families, which appeared as "stand-alone" toxin-antitoxin pairs (see below), were selected for further experimental characterization (Table 6, herein below). A representative pair was selected from each family and co-transformed into E. coli BL21 (DE3) on a compatible two-vector system, so that the putative toxin was under the control of an IPTG-induced promoter, and the antitoxin was under the control of an arabinose-induced promoter (FIG. 3A). E. coli bacteria carrying these two plasmids were plated on agar plates containing IPTG, arabinose, or both IPTG and arabinose. In all six tested pairs, induction of toxin expression inhibited bacterial growth, while co-induction of the toxin and antitoxin resulted in bacterial survival (FIG. 3A). These results validate the genome-wide approach for discovery of novel TA systems.

The 6 novel validated families were named based on the species from which the validated system was taken: pmenAT (P. mendocina); sanaAT (S. sp. ana-3); rlegAT (R. leguminosarum); psyrAT (P. syringae); sdenAT (S. denitrificans); and hhalTA (H. halophila). The toxins in these new systems were further tested in order to analyze whether they have a bacteriocidic (cell-killing) or bacteriostatic (growth-inhibiting) effect. For this, IPTG was used to induce toxin expression for different time intervals (ranging from 30 to 300 mins) The cells were then plated on agar plates containing arabinose to activate antitoxin expression (FIG. 3C). For the rlegTA system, colony forming units dropped by 5 orders of magnitude following 120 minutes of toxin induction, implying that the rleg toxin has a bactericidal effect on the cells. These results were also supported by the kinetic assays, where induction of antitoxin expression 2.5 hours after toxin induction did not result in cell regrowth for rlegTA (FIG. 3B). A milder effect was observed for the remaining TA systems, with sdenTA and hhalTA showing almost no reduction in colony forming units following toxin induction, suggestive of a bacteriostatic effect for these systems (FIG. 3C).

Previous analyses have shown that toxin-antitoxin systems can be modular, such that members of one toxin family may be associated with several different types of antitoxin, and

TABLE 6

Gene pairs selected for experimental verification in a dual-plasmid arabinose/IPTG expression induction system

| Family | Antitoxin locus tag | A size (aa) | Toxin Locus tag | T size (aa) | Organism | # clones that cover antitoxin | # clones that cover toxin | # clones that cover both | Reversible toxicity? |
|---|---|---|---|---|---|---|---|---|---|
| sdenAT | Sden_0299 | 174 | Sden_0300 | 295 | *Shewanella denitrificans* OS217 | 8 | 0 | 31 | Yes |
| psyrAT | Psyr_3805 | 455 | Psyr_3804 | 698 | *Pseudomonas syringae* pv. *syringae* B728a | 13 | 0 | 1 | Partial |
| sanaAT | Shewana3_4160 | 136 | Shewana3_4161 | 313 | *Shewanella* sp. ANA-3 | 5 | 0 | 29 | Yes |
| pmenAT | Pmen_0566 | 360 | Pmen_0565 | 217 | *Pseudomonas mendocina* ymp | 3 | 0 | 10 | Yes |
| rlegAT | Rleg_6340 | 205 | Rleg_6339 | 289 | *Rhizobium leguminosarum* bv. *trifolii* WSM1325 | 11 | 0 | 31 | No |
| hhalTA | Hhal_0686 | 96 | Hhal_0685 | 119 | *Halorhodospira halophila* SL1 | 2 | 0 | 23 | Yes |

Example 4

Characteristics of Novel TA Families

Most type II TA modules described to date share several typical characteristics: the antitoxin appears upstream of the toxin; both the toxin and antitoxin are small proteins (typically ~100aa); and the antitoxin contains a DNA binding domain (Makarova et al., 2009). Since the present approach does not rely on such attributes for TA modules discovery it has the potential to expand the premises of TA modules properties. Indeed, some of the new families that were experimentally validated deviate significantly from the previously described characteristics. For example, the sizes of many new toxins and antitoxins are significantly larger than 100 aa, with a maximum of 698 aa in the toxin of the psyrAT system; in two families the toxin is located upstream of the antitoxin (FIG. 4A); and several antitoxins do not contain a known DNA binding domain (although the possibility cannot be ruled out that some antitoxins code for yet uncharacterized such domains) (FIG. 4A).

Although in most of the known TA systems the toxin is a ribonuclease, diverse domains within the new toxins detected, including DNA helicase, phosphoribosyl-transferase and nucleotidyl-transferase suggest novel mechanisms of toxicity (FIG. 4A). Similarly, the presence of an ADP-ribose-binding, S-adenosyl-homocysteine hydrolase and nucleotide-binding domains in some of the antitoxins suggest that these antitoxins perform a more complex function than simply masking the activity of the toxin by protein-protein interactions (FIG. 4A; Table 5). Finally, in four of the novel families, it seems that the TA system is part of a larger operon that is co-horizontally transferred between genomes in the context of defense islands, suggesting their involvement in more complex defense mechanisms (Table 5; FIG. 8).

vice versa (Leplae et al., 2011; Makarova et al., 2009). Indeed, the toxins of three of the present new families carry the same domain, DUF1814, with a different antitoxin associated with this domain in each of the three families (Table 2; FIG. 4A). One of these families, rlegAT, where the DUF1814 toxin is accompanied by COG5340 as an antitoxin, was previously shown to be enriched in defense islands in bacterial genomes and was suggested as a new TA system based on its two-gene nature (Makarova et al., 2011). The DUF1814 domain was recently classified as a nucleotidyl-transferase domain based on structural information, but its specific substrates are yet unknown (Kuchta et al., 2009). Interestingly, the DUF1814 domain was also documented in AbiG, a two-gene system involved in abortive infection in *Lactococcus lactis* via an unknown mechanism (Makarova et al., 2011; O'Connor et to al., 1996), although there is no direct homology between the AbiG system and any of the genes in the new TA systems that were presently detected. Therefore, the results point to DUF1814 domain-containing proteins as a widespread superfamily of toxins that might be involved in anti-phage defense (see below).

Overall, members of the novel systems that were detected appeared in 21% of the genomes analyzed, and in the vast majority of cases (93%) they appeared in the chromosomal DNA rather than on plasmids. These results suggest that such systems have important roles in bacterial physiology/defense rather than functioning as plasmid addiction molecules. The distribution of most families is spread across multiple bacterial phyla including several important human pathogens (Tables 4 and 5; FIGS. 4B-C). For example, the psyrAT, sanaAT, and pmenAT systems are abundant in enteropathogenic and uropathogenic *E. coli* strains; the pmenAT system also exists in many *Mycobacterium tuberculosis* isolates; psyrAT exists in *Shigella* and *Pseudomonas aeruginosa* strains; and the rlegAT and sanaAT systems exist in several pathogenic *Legionella* species. In addition, many resident bacteria of the human gut carry one or more of these TA modules, including bacteria belonging to the *Bifidobacterium* and *Prevotella* genera (Tables 7-11, herein below, FIG. 4C). This underscores the novel toxin-antitoxin families as potentially contributing to persistence, phage defense and stress responses of clinically important bacteria.

TABLE 7 pmenAT Family

| Organism name | Toxin IMG Gene Object ID | Antitoxin IMG Gene Object ID |
|---|---|---|
| *Acidovorax avenae citrulli* AAC00-1 | 639821371 | 639821372 |
| *Actinosynnema mirum* 101, DSM 43827 | 645948092 | 645948093 |
| *Aliivibrio salmonicida* LFI1238 | 643378769 | 643378768 |
| *Alkalilimnicola ehrlichei* MLHE-1 | 638125243 | 638125244 |
| *Arthrospira maxima* CS-328 | 643172840 | 643172839 |
| *Arthrospira maxima* CS-328 | 643172852 | 643172851 |
| *Arthrospira platensis* NIES-39 | 650387585 | 650387586 |
| *Arthrospira platensis* Paraca | 646128269 | 646128268 |
| *Arthrospira* sp. PCC 8005 | 648389866 | 648389867 |
| *Arthrospira* sp. PCC 8005 | 648389879 | 648389880 |
| *Aurantimonas manganoxydans* SI85-9A1 | 639105350 | 639105351 |
| *Bacillus thuringiensis* IBL200 | 644713531 | 644713532 |
| *Beggiatoa* sp. PS | 641099098 | 641099099 |
| *Brachyspira hyodysenteriae* WA1, ATCC 49526 | 643738127 | 643738126 |
| *Candidatus Accumulibacter phosphatis* Type IIA UW-1 | 645012050 | 645012051 |
| *Cyanothece* sp. PCC 7822 | 648189618 | 648189617 |
| *Dermacoccus* sp. Ellin185 | 650227082 | 650227083 |
| *Desulfonatronospira thiodismutans* ASO3-1 | 644404121 | 644404120 |
| *Desulfovibrio* sp. 3_1_syn3 | 648927836 | 648927837 |
| *Dickeya zeae* Ech1591 | 644851325 | 644851326 |
| *Edwardsiella ictaluri* 93-146 | 644783480 | 644783479 |
| *Edwardsiella tarda* EIB202 | 646417146 | 646417147 |
| *Edwardsiella tarda* FL6-60 | 648267250 | 648267249 |
| *Enhydrobacter aerosaccus* SK60 | 646169120 | 646169121 |
| *Escherichia coli* O127:H6 E2348/69 (EPEC) | 643442443 | 643442442 |
| *Escherichia* sp. 4_1_40B | 645350401 | 645350402 |
| *Eubacterium saburreum* DSM 3986 | 650308116 | 650308115 |
| *Geobacter lovleyi* SZ | 642677613 | 642677612 |
| *Gloeobacter violaceus* PCC 7421 | 637460780 | 637460781 |
| *Gluconacetobacter diazotrophicus* PAl 5, DSM 5601 | 641334933 | 641334934 |
| *Klebsiella pneumoniae* 342 | 643367815 | 643367814 |
| *Leptotrichia goodfellowii* F0264 | 647211994 | 647211995 |
| *Lyngbya* sp. CCY 8106 | 640014016 | 640014017 |
| *Marinobacter* sp. ELB17 | 640635553 | 640635552 |
| *Methylobacter tundripaludum* SV96 | 648842442 | 648842443 |
| *Micromonospora aurantiaca* ATCC 27029 | 648134607 | 648134606 |
| *Mycobacterium bovis* AF2122/97 | 637137397 | 637137398 |
| *Mycobacterium bovis* BCG Pasteur 1173P2 | 639828992 | 639828993 |
| *Mycobacterium bovis* BCG Tokyo 172 | 643732879 | 643732880 |
| *Mycobacterium tuberculosis* 02_1987 | 643025701 | 643025702 |
| *Mycobacterium tuberculosis* 210 | 647208652 | 647208653 |
| *Mycobacterium tuberculosis* 94_M4241A | 643021508 | 643021509 |
| *Mycobacterium tuberculosis* 98-R604 INH-RIF-EM | 645190033 | 645190034 |
| *Mycobacterium tuberculosis* C | 638728678 | 638728679 |
| *Mycobacterium tuberculosis* CDC1551 | 637094328 | 637094329 |
| *Mycobacterium tuberculosis* CPHL_A | 646012704 | 646012705 |
| *Mycobacterium tuberculosis* EAS054 | 643034220 | 643034221 |
| *Mycobacterium tuberculosis* F11 (ExPEC) | 640604798 | 640604799 |
| *Mycobacterium tuberculosis* GM 1503 | 643047494 | 643047495 |
| *Mycobacterium tuberculosis* H37Ra | 640600718 | 640600719 |
| *Mycobacterium tuberculosis* H37Rv (lab strain) | 637025228 | 637025229 |
| *Mycobacterium tuberculosis* Haarlem | 641785646 | 641785647 |
| *Mycobacterium tuberculosis* K85 | 646016919 | 646016920 |
| *Mycobacterium tuberculosis* KZN 1435 (MDR) | 644877737 | 644877738 |
| *Mycobacterium tuberculosis* KZN 4207 | 647084598 | 647084599 |
| *Mycobacterium tuberculosis* KZN 4207 (DS) | 645118109 | 645118108 |

TABLE 7-continued pmenAT Family

| Organism name | Toxin IMG Gene Object ID | Antitoxin IMG Gene Object ID |
|---|---|---|
| *Mycobacterium tuberculosis* KZN R506 | 648334260 | 648334261 |
| *Mycobacterium tuberculosis* KZN V2475 | 647088790 | 647088791 |
| *Mycobacterium tuberculosis* SUMu001 | 648445593 | 648445594 |
| *Mycobacterium tuberculosis* SUMu002 | 648446131 | 648446132 |
| *Mycobacterium tuberculosis* SUMu003 | 648449945 | 648449946 |
| *Mycobacterium tuberculosis* SUMu004 | 648454358 | 648454359 |
| *Mycobacterium tuberculosis* SUMu005 | 648458950 | 648458951 |
| *Mycobacterium tuberculosis* SUMu006 | 648463059 | 648463060 |
| *Mycobacterium tuberculosis* SUMu007 | 648467445 | 648467446 |
| *Mycobacterium tuberculosis* SUMu008 | 648471678 | 648471679 |
| *Mycobacterium tuberculosis* SUMu009 | 648479444 | 648479445 |
| *Mycobacterium tuberculosis* SUMu010 | 648483724 | 648483725 |
| *Mycobacterium tuberculosis* SUMu011 | 648487988 | 648487989 |
| *Mycobacterium tuberculosis* SUMu012 | 648488272 | 648488273 |
| *Mycobacterium tuberculosis* T17 | 643047830 | 643047831 |
| *Mycobacterium tuberculosis* T85 | 643038464 | 643038465 |
| *Mycobacterium tuberculosis* T92 | 643026422 | 643026423 |
| *Nitrosococcus halophilus* Nc4 | 646693941 | 646693942 |
| *Nitrosomonas europaea* ATCC 19718 | 637427715 | 637427716 |
| *Oscillatoria* sp. PCC 6506 | 648860075 | 648860076 |
| *Parvibaculum lavamentivorans* DS-1 | 640878511 | 640878512 |
| *Pectobacterium carotovorum carotovorum* PC1 | 644864144 | 644864143 |
| *Pedobacter* sp. BAL39 | 641137361 | 641137360 |
| *Prevotella timonensis* CRIS 5C-B1 | 647314799 | 647314798 |
| *Providencia rustigianii* DSM 4541 | 643141873 | 643141874 |
| *Pseudomonas entomophila* L48 | 637999408 | 637999409 |
| *Pseudomonas mendocina* ymp | 640501778 | 640501779 |
| *Rhodopseudomonas palustris* TIE-1 | 642711985 | 642711984 |
| *Roseiflexus* sp. RS-1 | 640593922 | 640593923 |
| *Roseovarius nubinhibens* ISM | 638835723 | 638835722 |
| *Ruminococcus flavefaciens* FD-1 | 646114893 | 646114892 |
| *Shewanella putrefaciens* CN-32 | 640500731 | 640500732 |
| *Stigmatella aurantiaca* DW4/3-1 | 649685957 | 649685958 |
| *Synechocystis* sp. PCC 6803 | 637472042 | 637472041 |
| *Syntrophothermus lipocalidus* DSM 12680 | 646854986 | 646854985 |
| *Thauera* sp. MZ1T | 643700535 | 643700534 |
| *Thermus aquaticus* Y51MC23 | 645188421 | 645188422 |
| *Thiobacillus denitrificans* ATCC 25259 | 637710175 | 637710174 |
| *Zymomonas mobilis* subsp. *mobilis* ZM4 ZM4 plasmid pZZM405 | 648935037 | 648935036 |

TABLE 8 psyrAT Family

| Organism name | Toxin IMG Gene Object ID | Antitoxin IMG Gene Object ID |
|---|---|---|
| *Acinetobacter johnsonii* SH046 | 646301838 | 646301837 |
| *Arthrospira platensis* NIES-39 | 650383509 | 650383508 |
| *Chlorobium phaeobacteroides* DSM 266 | 639765722 | 639765723 |
| *Cyanothece* sp. PCC 8801 | 643474605 | 643474606 |
| *Dehalogenimonas lykanthroporepellens* BL-DC-9 | 648069289 | 648069288 |
| *Desulfitobacterium hafniense* DCB-2 | 643560590 | 643560591 |
| *Desulfitobacterium hafniense* Y51 | 637910440 | 637910441 |
| *Desulfotalea psychrophila* LSv54 | 637527656 | 637527657 |
| *Desulfotomaculum acetoxidans* 5575, DSM 771 | 645033659 | 645033660 |
| *Escherichia coli* 83972 | 644299713 | 644299712 |
| *Escherichia coli* ABU 83972 | 648235458 | 648235457 |
| *Escherichia coli* B088 | 647955723 | 647955722 |
| *Escherichia coli* B185 | 647960289 | 647960288 |
| *Escherichia coli* E22 (EPEC) | 638663931 | 638663932 |
| *Escherichia coli* IAI39 | 643513743 | 643513742 |
| *Escherichia coli* M605 | 648348440 | 648348439 |
| *Escherichia coli* M718 | 648353998 | 648353997 |

TABLE 8-continued psyrAT Family

| Organism name | Toxin IMG Gene Object ID | Antitoxin IMG Gene Object ID |
|---|---|---|
| Escherichia coli MS 185-1 | 648599204 | 648599205 |
| Escherichia coli MS 200-1 | 648586960 | 648586959 |
| Escherichia coli MS 21-1 | 648564766 | 648564767 |
| Escherichia coli MS 45-1 | 648550266 | 648550267 |
| Escherichia coli MS 69-1 | 648553056 | 648553055 |
| Escherichia coli O103:H2 str. 12009 | 646343586 | 646343585 |
| Escherichia coli O111:NM B171 (EPEC2) | 638674448 | 638674447 |
| Escherichia coli O139:H28 F11 (ETEC) | 638660743 | 638660744 |
| Escherichia coli O150:H5 SE15 | 646872639 | 646872638 |
| Escherichia coli O157:H7 EC4042 | 642258307 | 642258308 |
| Escherichia coli O157:H7 EC4045 | 642254369 | 642254368 |
| Escherichia coli O157:H7 EC4076 | 642284244 | 642284243 |
| Escherichia coli O157:H7 EC4113 | 642276965 | 642276966 |
| Escherichia coli O157:H7 EC4196 | 642270878 | 642270879 |
| Escherichia coli O157:H7 EC4206 | 642245550 | 642245551 |
| Escherichia coli O157:H7 EC4401 | 642289554 | 642289553 |
| Escherichia coli O157:H7 EC4486 | 642295954 | 642295953 |
| Escherichia coli O157:H7 EC4501 | 642302598 | 642302597 |
| Escherichia coli O157:H7 EC508 | 642315404 | 642315403 |
| Escherichia coli O157:H7 EC869 | 642309592 | 642309591 |
| Escherichia coli O157:H7 EDL933 (EHEC) | 637066109 | 637066108 |
| Escherichia coli O157:H7 TW14588 | 643013921 | 643013922 |
| Escherichia coli O6:K15:H31 536 (UPEC) | 638064677 | 638064676 |
| Escherichia coli O6:K2:H1 CFT073 (UPEC) | 637358068 | 637358067 |
| Escherichia coli SECEC SMS-3-5 | 641618544 | 641618543 |
| Kingella denitrificans ATCC 33394 | 650370405 | 650370406 |
| Lyngbya sp. CCY 8106 | 640016567 | 640016566 |
| Maribacter sp. HTCC2170 | 648162921 | 648162922 |
| Marinobacter aquaeolei VT8 | 639810511 | 639810512 |
| Microcoleus chthonoplastes PCC 7420 | 647568262 | 647568263 |
| Nitrococcus mobilis Nb-231 | 639000572 | 639000573 |
| Nitrosomonas europaea ATCC 19718 | 637428828 | 637428829 |
| Nostoc sp. PCC 7120 | 637233840 | 637233841 |
| Oscillochloris trichoides DG6 | 650114297 | 650114298 |
| Pelodictyon phaeoclathratiforme BU-1 | 642727669 | 642727668 |
| Photorhabdus luminescens laumondii TTO1 | 637466171 | 637466172 |
| Polaromonas naphthalenivorans CJ2 | 639835976 | 639835975 |
| Providencia stuartii ATCC 25827 | 642341526 | 642341525 |
| Pseudomonas aeruginosa 39016 | 650201418 | 650201417 |
| Pseudomonas syringae pv. syringae B728a | 637654162 | 637654163 |
| Roseiflexus castenholzii HLO8, DSM 13941 | 640894598 | 640894597 |
| Shewanella baltica OS155 | 640121625 | 640121624 |
| Shigella dysenteriae 1617 | 650108289 | 650108288 |
| Shigella dysenteriae Sd197 | 640435823 | 640435822 |
| Sinorhizobium meliloti AK83, DSM 23913 | 648746639 | 648746638 |
| Teredinibacter turnerae T7901 | 644918750 | 644918749 |
| Trichodesmium erythraeum IMS101 | 638106714 | 638106713 |
| Vibrio furnissii CIP 102972 | 647177818 | 647177819 |

TABLE 9 rlegAT Family

| Organism name | Toxin IMG Gene Object ID | Antitoxin IMG Gene Object ID |
|---|---|---|
| Acidovorax delafieldii 2AN | 645555203 | 645555202 |
| Acidovorax sp. JS42 | 639838035 | 639838036 |
| Agreia sp. PHSC20C1 | 638988138 | 638988137 |
| Agrobacterium sp. H13-3 | 649987843 | 649987844 |
| Asticcacaulis excentricus CB 48 | 649817025 | 649817026 |
| Bradyrhizobium japonicum USDA 110 | 637369489 | 637369490 |
| Brevibacterium mcbrellneri ATCC 49030 | 647495830 | 647495829 |
| Candidatus Accumulibacter phosphatis Type IIA UW-1 | 645008063 | 645008062 |
| Candidatus Protochlamydia amoebophila UWE25 | 637502933 | 637502934 |
| Chlorobium limicola DSM 245 | 642669528 | 642669529 |
| Chlorobium phaeobacteroides DSM 266 | 639765252 | 639765251 |
| Chlorobium phaeovibrioides DSM 265 | 640453070 | 640453069 |
| Conexibacter woesei DSM 14684 | 646506209 | 646506208 |
| Corynebacterium glutamicum R | 640460410 | 640460411 |
| Delftia acidovorans SPH-1 | 641295145 | 641295146 |
| Desulfococcus oleovorans Hxd3 | 641265756 | 641265755 |
| Desulfomicrobium baculatum X, DSM 4028 | 645000532 | 645000533 |
| Eggerthella lenta VPI 0255, DSM 2243 | 645026066 | 645026065 |
| Eggerthella sp. 1_3_56FAA | 650045752 | 650045751 |
| Ensifer medicae WSM419 | 640743222 | 640743221 |
| Ensifer medicae WSM419 | 640777216 | 640777215 |
| Ensifer medicae WSM419 | 640743222 | 640743221 |
| Gemmata obscuriglobus UQM 2246 | 642225335 | 642225336 |
| Gloeobacter violaceus PCC 7421 | 637460064 | 637460063 |
| Gordonia bronchialis DSM 43247 | 646396290 | 646396289 |
| Gordonibacter pamelaeae 7-10-1-bT, DSM 19378 | 650562241 | 650562242 |
| Intrasporangium calvum 7KIP, DSM 43043 | 649830949 | 649830948 |
| Legionella longbeachae NSW150 | 648036627 | 648036628 |
| Legionella longbeachae NSW150 | 648038896 | 648038897 |
| Lentisphaera araneosa HTCC2155 | 641129191 | 641129192 |
| Lentisphaera araneosa HTCC2155 | 641132412 | 641132413 |
| Mariprofundus ferrooxydans PV-1 | 639879700 | 639879701 |
| Methylobacterium extorquens AM1 | 644816407 | 644816408 |
| Mobiluncus mulieris ATCC 35239 | 648832456 | 648832455 |
| Mobiluncus mulieris ATCC 35243 | 644432065 | 644432064 |
| Mobiluncus mulieris FB024-16 | 648839977 | 648839978 |
| Mycobacterium leprae Br4923 | 643606676 | 643606675 |
| Mycobacterium leprae TN | 637073074 | 637073073 |
| Mycobacterium marinum M, ATCC BAA-535 | 641718837 | 641718836 |
| Nakamurella multipartita Y-104, DSM 44233 | 645043556 | 645043555 |
| Nitrosococcus halophilus Nc4 | 646694275 | 646694276 |
| Olsenella uli VPI, DSM 7084 | 648106565 | 648106566 |
| Opitutaceae sp. TAV2 | 641180308 | 641180309 |
| Pelodictyon luteolum DSM 273 | 637768549 | 637768548 |
| Pelodictyon phaeoclathratiforme BU-1 | 642727042 | 642727041 |
| Phenylobacterium zucineum HLK1 | 642757721 | 642757722 |
| Polaromonas naphthalenivorans CJ2 | 639826420 | 639826421 |
| Polaromonas sp. JS666 | 639328971 | 639328972 |
| Polaromonas sp. JS666 | 639328971 | 639328972 |
| Propionibacterium freudenreichii shermanii CIRM-BIA1 | 649639912 | 649639911 |
| Raphidiopsis brookii D9 | 647110477 | 647110476 |
| Rhizobium leguminosarum bv. trifolii WSM1325 | 644828134 | 644828135 |
| Rhizobium leguminosarum bv. trifolii WSM1325 | 644828341 | 644828342 |
| Rhizobium leguminosarum bv. viciae 3841 | 639650816 | 639650815 |
| Rhizobium rhizogenes K84 | 643644497 | 643644496 |
| Rhizobium sp. NGR234 (ANU265) | 643821930 | 643821929 |
| Rhodomicrobium vannielii ATCC 17100 | 649745264 | 649745263 |
| Rhodopseudomonas palustris DX-1 | 649838192 | 649838193 |
| Rhodopseudomonas palustris DX-1 | 649839250 | 649839249 |
| Slackia heliotrinireducens RHS 1, DSM 20476 | 644987249 | 644987248 |
| Synechococcus sp. RS9917 | 638961153 | 638961154 |
| Syntrophobacter fumaroxidans MPOB | 639702820 | 639702821 |
| Variovorax paradoxus S110 | 644796233 | 644796232 |
| Verrucomicrobiales sp. DG1235 | 647600269 | 647600268 |
| Xanthomonas oryzae pv oryzae MAFF 311018 | 637850518 | 637850519 |
| Xanthomonas oryzae pv oryzicola BLS256 | 641737990 | 641737989 |
| Xanthomonas oryzae pv. oryzae KACC10331 | 637633303 | 637633304 |
| Xanthomonas oryzae pv. oryzae PXO99A | 642640643 | 642640644 |
| Xylanimonas cellulosilytica DSM 15894 | 646444306 | 646444305 |

TABLE 10 sdenAT Family

| Organism name | Toxin IMG Gene Object ID | Antitoxin IMG Gene Object ID |
|---|---|---|
| Acidithiobacillus ferrooxidans ATCC 53993 | 642789179 | 642789178 |
| Ammonifex degensii KC4 | 646360172 | 646360173 |
| Bifidobacterium longum DJO10A | 642679488 | 642679489 |
| Bifidobacterium longum longum ATCC 55813 | 644347132 | 644347131 |
| Bifidobacterium longum longum CCUG 52486 | 643912156 | 643912157 |
| Bifidobacterium longum longum CCUG 52486 | 643912885 | 643912886 |
| Bifidobacterium longum longum F8 | 650528372 | 650528373 |
| Bifidobacterium longum NCC2705 | 637327456 | 637327457 |
| Bifidobacterium sp. 12_1_47BFAA | 650054808 | 650054809 |
| Burkholderia rhizoxinica HKI 454 | 649762359 | 649762358 |
| Cellvibrio japonicus Ueda 107 | 642704960 | 642704959 |
| delta proteobacterium sp. MLMS-1 | 639152971 | 639152970 |
| delta proteobacterium sp. MLMS-1 | 639153350 | 639153349 |
| delta proteobacterium sp. MLMS-1 | 639155398 | 639155397 |
| delta proteobacterium sp. MLMS-1 | 639158034 | 639158033 |
| Desulfurivibrio alkaliphilus AHT2 | 646845548 | 646845547 |
| Eggerthella lenta VPI 0255, DSM 2243 | 645023812 | 645023813 |
| Helicobacter canadensis MIT 98-5491, ATCC 700968 | 643921049 | 643921048 |
| Helicobacter canadensis MIT 98-5491, ATCC 700968 | 647542139 | 647542138 |
| Marinobacter sp. ELB17 | 640637051 | 640637050 |
| Marinomonas sp. MWYL1 | 640805575 | 640805574 |
| Pantoea sp. At-9b | 649850365 | 649850364 |
| Parascardovia denticolens DSM 10105 | 650283875 | 650283876 |
| Pectobacterium wasabiae WPP 163 | 646378766 | 646378765 |
| Photorhabdus luminescens laumondii TTO1 | 637462283 | 637462284 |
| Photorhabdus luminescens laumondii TTO1 | 637465673 | 637465672 |
| Proteus mirabilis ATCC 29906 | 644443817 | 644443818 |
| Proteus mirabilis HI4320 | 642578705 | 642578706 |
| Proteus mirabilis HI4320 | 642578886 | 642578885 |
| Providencia rustigianii DSM 4541 | 643143270 | 643143271 |
| Shewanella denitrificans OS217 | 637954281 | 637954280 |
| Verminephrobacter eiseniae EF01-2 | 639850605 | 639850606 |
| Xenorhabdus nematophila ATCC 19061 | 649646151 | 649646150 |

TABLE 11 sanaAT Family

| Organism name | Toxin IMG Gene Object ID | Antitoxin IMG Gene Object ID |
|---|---|---|
| Acidovorax delafieldii 2AN | 645555430 | 645555431 |
| Acidovorax sp. JS42 | 639838656 | 639838657 |
| Burkholderia pseudomallei 1106a | 640135680 | 640135679 |
| Burkholderia pseudomallei 14 | 641944057 | 641944056 |
| Burkholderia pseudomallei 9 | 641966075 | 641966074 |
| Burkholderia pseudomallei B7210 | 641976418 | 641976417 |
| Burkholderia pseudomallei Pakistan 9 | 644419997 | 644419996 |
| Chlorobium limicola DSM 245 | 642667845 | 642667846 |
| delta proteobacterium sp. MLMS-1 | 639154553 | 639154552 |
| Desulfatibacillum alkenivorans AK-01 | 643534322 | 643534323 |
| Escherichia coli 83972 | 644303823 | 644303822 |
| Escherichia coli ABU 83972 | 648234949 | 648234948 |
| Escherichia coli FVEC1302 | 648901279 | 648901278 |
| Escherichia coli FVEC1412 | 647965363 | 647965362 |
| Escherichia coli H591 | 648379532 | 648379531 |
| Escherichia coli MS 119-7 | 648651653 | 648651652 |
| Escherichia coli MS 198-1 | 648524147 | 648524146 |
| Escherichia coli MS 45-1 | 648547640 | 648547641 |
| Escherichia coli MS 69-1 | 648552519 | 648552520 |
| Escherichia coli MS 69-1 | 648554605 | 648554604 |
| Escherichia coli O17:K52:H18 UMN026 | 644760974 | 644760973 |
| Escherichia coli O6:K2:H1 CFT073 (UPEC) | 637357531 | 637357530 |
| Escherichia coli W | 648733316 | 648733317 |
| Escherichia coli W, ATCC 9739 | 650430781 | 650430780 |
| Escherichia sp. 1_1_43 | 646267384 | 646267383 |
| Legionella drancourtii LLAP12 | 645590921 | 645590922 |
| Legionella pneumophila Corby | 640570188 | 640570189 |
| Legionella pneumophila Lens | 637581974 | 637581973 |
| Legionella pneumophila Paris | 637581109 | 637581110 |
| Methylovorus glucosetrophus SIP3-4 | 644899678 | 644899679 |
| Pelodictyon luteolum DSM 273 | 637768759 | 637768758 |
| Pelodictyon phaeoclathratiforme BU-1 | 642728170 | 642728169 |
| Photobacterium sp. SKA34 | 639052391 | 639052392 |
| Photorhabdus asymbiotica asymbiotica ATCC 43949 | 644890382 | 644890383 |
| Photorhabdus luminescens laumondii TTO1 | 637465992 | 637465993 |
| Pseudoalteromonas haloplanktis TAC125 | 637736049 | 637736048 |
| Rhodocista centenaria SW | 643414024 | 643414025 |
| Shewanella baltica OS155 | 640110446 | 640110445 |
| Shewanella sp. ANA-3 | 639720519 | 639720518 |
| Synechocystis sp. PCC 6803 | 637471904 | 637471903 |
| Verminephrobacter eiseniae EF01-2 | 639851447 | 639851446 |
| Vibrio harveyi BB120, ATCC BAA-1116 | 640911279 | 640911280 |
| Vibrio tapetis CECT4600; CIP104856; B1090 plasmid pVT1 | 642914607 | 642914606 |
| Vibrio vulnificus CMCP6 | 637363648 | 637363647 |
| Vibrio vulnificus M06-24/O | 649922394 | 649922393 |
| Vibrionales sp. SWAT-3 | 641059142 | 641059141 |
| Yersinia aldovae ATCC 35236 | 645336728 | 645336729 |
| Yersinia enterocolitica enterocolitica 8081 | 640077595 | 640077596 |

Example 5

Novel TA Systems Provide Phage Resistance

The present inventors next set out to explore whether any of the TA systems detected can provide defense against phage. For this, efficiency of plating assays of T7 phage on E. coli hosts were performed (FIG. 5A). Since these new TA systems to are widespread in E. coli strains (but are not found in the lab strains E. coli K-12 and E. coli BL21), it was hypothesized that a successful coliphage, such as T7, might hold anti-defense mechanisms that mitigate the defense conferred by the TA systems. The present inventors therefore tested, in addition to the wild-type (WT) T7 phage, 12 additional T7 mutants lacking genes that are not-essential for infection of E. coli K-12 (Table 12). Each of these T7 mutants was used to infect E. coli BL21 or K-12 expressing the five verified new TA systems, as well as control clones expressing only the antitoxin of each system (FIG. 5A). One of the tested systems, sanaAT, was found to provide E. coli with resistance against T7Δ4.3Δ4.5Δ4.7, reducing sensitivity to this phage strain by almost 3 orders of magnitude (FIG. 5B). A second system, rlegAT, resulted in opaque plaques with plaque diameters reduced more than fourfold for the WT T7 strain (diameters of 0.47 mm±0.06 for E. coli expressing both the toxin and the antitoxin, as compared to 1.77 mm±0.03 for bacteria expressing the antitoxin only).

TABLE 12

| | Genes deleted |
|---|---|
| WT T7 | none |
| T7Δ0.3 | 0.3 |
| T7Δ0.7Δ1.7 | 0.7, 1.7 |
| T7 LG3 | 1.1, 1.2, 1.3 |
| T7Δ1.2 | 1.2 |
| T7Δ1.2Δ1.7 | 1.2, 1.7 |
| T7Δ1.7 | 1.7 |
| T7Δ2.8 | 2.8 |
| T7Δ3.8 | 3.8 |
| T7 HS33 | 4.3, 4.5, 4.7 |
| T7Δ4.5 | 4.5 |
| T7Δ5.3-5.9 | 5.3-5.9 |
| T7Δ5.9 | 5.9 |

Figure 5C:
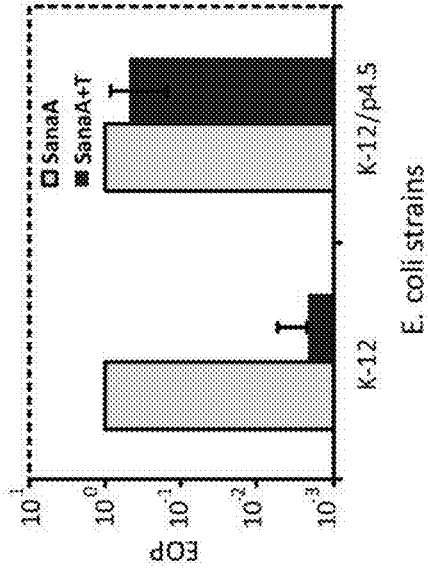

Since the sanaAT system provides resistance to a T7 phage lacking 3 non-essential genes (genes 4.3, 4.5 and 4.7) but not to the WT T7 phage, it was hypothesized that one of these genes codes for an anti-defense mechanism that overcomes the abortive infection imposed by the TA system. Complementation assays in E. coli K-12 expressing gene 4.5 from a plasmid marked this gene as encoding the anti-Abi mechanism (FIG. 5C). The 4.5 gene codes for a peptide (85aa) with no functional annotation.

The present inventors asked whether the defense provided by the sanaTA system against the phage is Lon-dependent. The Lon protease is one of the major proteolytic machineries in the bacterial cell (Gottesman, 2003), and was implicated in degradation ("destabilization") of many types of antitoxins in E. coli, thus enabling toxin activity (Christensen et al., 2001; Van Melderen et al., 1996; Wang et al., 2011). Indeed, T7 mutant growth on E. coli containing the sanaTA system was restored by two orders of magnitude when the E. coli also lacked ion (FIG. 5D), suggesting that the sanaTA protection from T7 phage depends on Lon activity.

Figure 5E:
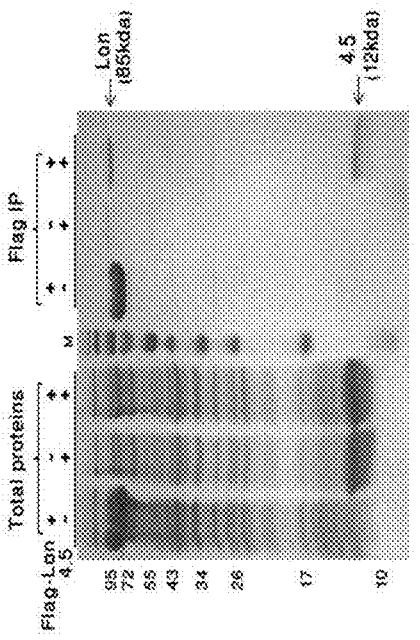
Figure 5D:
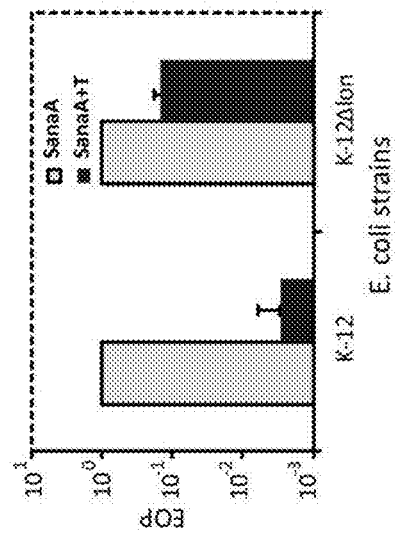
Figure 5F:
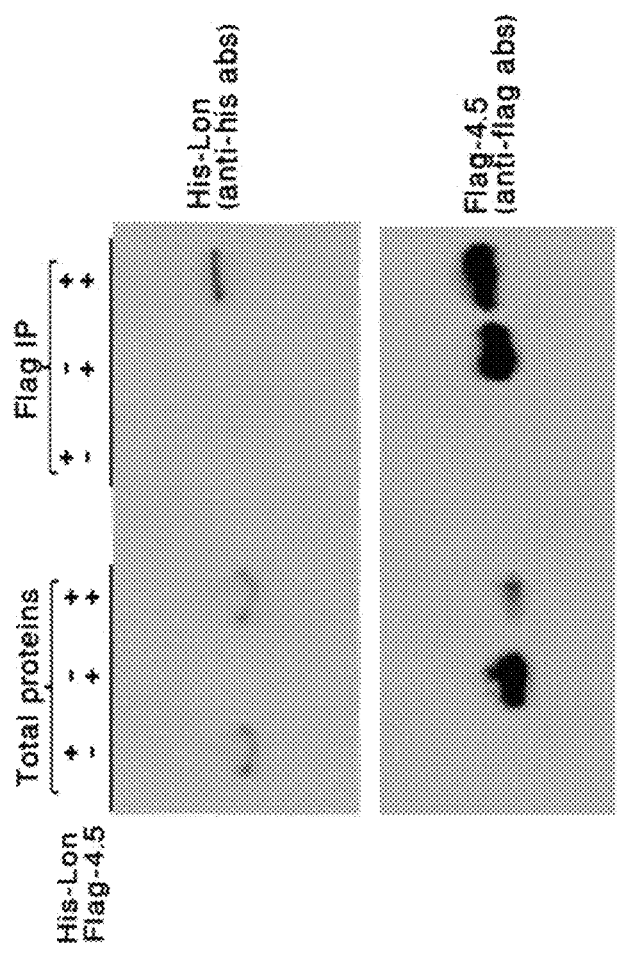

It was hypothesized that the phage gene product (Gp) 4.5 interacts with Lon to prevent antitoxin degradation and thus hinders the sanaTA abortive infection activity. To test this hypothesis we co-expressed Lon (Flag-tagged) and Gp4.5 within E. coli. Indeed, we found that Lon and Gp4.5 co-immuno-precipitate, indicating that 4.5 tightly binds Lon (FIG. 5E). A reciprocal co-immuno-precipitation assay, where pull-down was performed on flag-tagged Gp4.5 protein, produced similar co-immuno-precipitation patterns (FIG. 5F). Overall, these results suggest that the T7 Gp4.5 neutralizes TA-system-mediated abortive infection by inhibiting the Lon protease activity, thus preventing antitoxin degradation and toxin activation.

Example 6

Phage Anti-Abi Gene Inhibits Persistence-Mediated Resistance to Antibiotics

Toxin-antitoxin systems were shown to mediate bacterial resistance to antibiotics through promotion of persister cells (Maisonneuve et al., 2011; Rotem et al., 2010). Persisters are non-growing bacterial cells found in a dormant state and are thus resistant to many antibiotics and other stress conditions (Smith and Romesberg, 2007). Such persisters are stochastically found in bacterial populations as a small fraction of the population. It was recently shown that persistence in E. coli depends on resident type II TA systems as well as on the Lon protease. Indeed, deletion of Lon in E. coli was shown to mitigate TA-system-mediated persistence and resulted in higher sensitivity to antibiotics (Maisonneuve et al., 2011).

The present discovery of a T7-encoded peptide that generally alleviates TA systems activity via inhibition of the Lon protease raised the hypothesis that this peptide can also inhibit persister formation. To test this hypothesis persistence was measured as the fraction of surviving E. coli cells following 5 hr exposure to antibiotics (ampicillin) Bacteria expressing the 4.5 gene were 5-fold more sensitive to ampicillin as compared to WT bacteria (manifested in 5-fold less persister cells for ampicillin) (FIG. 6). These results suggest possible utility of phage-derived peptides as a means to tackle bacterial persistence.

To search for additional phage genes that may function as Lon inhibitors, the present inventors looked for all phage genomes for genes showing homology to the N-terminus of Lon, roughly where the 4.5 aligns (FIG. 5D). 6 such genes were found (including gene 4.5) in a diverse set of phages.

It may be predicted that these phage proteins inhibit Lon protease and can thus function as inhibitors of persistence.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES

Aizenman, E., Engelberg-Kulka, H., and Glaser, G. (1996). An Escherichia coli chromosomal "addiction module" regulated by guanosine [corrected] 3',5'-bispyrophosphate: a model for programmed bacterial cell death. Proc Natl Acad Sci USA 93, 6059-6063.

Amitai, S., Kolodkin-Gal, I., Hananya-Meltabashi, M., Sacher, A., and Engelberg-Kulka, H. (2009). Escherichia coli MazF leads to the simultaneous selective synthesis of both "death proteins" and "survival proteins". PLoS Genet. 5, e1000390.

Aoki, S. K., Diner, E. J., de Roodenbeke, C. T., Burgess, B. R., Poole, S. J., Braaten, B. A., Jones, A. M., Webb, J. S., Hayes, C. S., Cotter, P. A., et al. (2010). A widespread family of polymorphic contact-dependent toxin delivery systems in bacteria. Nature 468, 439-442.

Bernard, P., and Couturier, M. (1992). Cell killing by the F plasmid CcdB protein involves poisoning of DNA-topoisomerase II complexes. J Mol Biol 226, 735-745.

Cherny, I., and Gazit, E. (2004). The YefM antitoxin defines a family of natively unfolded proteins: implications as a novel antibacterial target. J Biol Chem 279, 8252-8261.

Chopin, M. C., Chopin, A., and Bidnenko, E. (2005). Phage abortive infection in lactococci: variations on a theme. Curr Opin Microbiol 8, 473-479.

Christensen, S. K., Maenhaut-Michel, G., Mine, N., Gottesman, S., Gerdes, K., and Van Melderen, L. (2004). Overproduction of the Lon protease triggers inhibition of translation in Escherichia coli: involvement of the yefM-yoeB toxin-antitoxin system. Mol Microbiol 51, 1705-1717.

Christensen, S. K., Mikkelsen, M., Pedersen, K., and Gerdes, K. (2001). RelE, a global inhibitor of translation, is activated during nutritional stress. Proc Natl Acad Sci USA 98, 14328-14333.

Christensen, S. K., Pedersen, K., Hansen, F. G., and Gerdes, K. (2003). Toxin-antitoxin loci as stress-response-elements: ChpAK/MazF and ChpBK cleave translated RNAs and are counteracted by tmRNA. J Mol Biol 332, 809-819.

Daines, D. A., Wu, M. H., and Yuan, S. Y. (2007). VapC-1 of nontypeable Haemophilus influenzae is a ribonuclease. J Bacteriol 189, 5041-5048.

Deveau, H., Garneau, J. E., and Moineau, S. (2010). CRISPR/Cas system and its role in phage-bacteria interactions. Annu Rev Microbiol 64, 475-493.

Duman, R. E., and Lowe, J. (2010). Crystal structures of Bacillus subtilis Lon protease. J Mol Biol 401, 653-670.

Engelberg-Kulka, H., Reches, M., Narasimhan, S., Schoulaker-Schwarz, R., Klemes, Y., Aizenman, E., and Glaser, G. (1998). rexB of bacteriophage lambda is an anti-cell death gene. Proc Natl Acad Sci USA 95, 15481-15486.

Fico, S., and Mahillon, J. (2006). TasA-tasB, a new putative toxin-antitoxin (TA) system from Bacillus thuringiensis pGI1 plasmid is a widely distributed composite mazE-doc TA system. BMC Genomics 7, 259.

Fineran, P. C., Blower, T. R., Foulds, I. J., Humphreys, D. P., Lilley, K. S., and Salmond, G. P. (2009). The phage abortive infection system, ToxIN, functions as a protein-RNA toxin-antitoxin pair. Proc Natl Acad Sci USA 106, 894-899.

Fozo, E. M., Makarova, K. S., Shabalina, S. A., Yutin, N., Koonin, E. V., and Storz, G. Abundance of type I toxin-antitoxin systems in bacteria: searches for new candidates and discovery of novel families. Nucleic Acids Res 38, 3743-3759.

Goldberg, A. L., Moerschell, R. P., Chung, C. H., and Maurizi, M. R. (1994). ATP-dependent protease La (lon) from Escherichia coli. Methods Enzymol 244, 350-375.

Gomez, J. E., and McKinney, J. D. (2004). M. tuberculosis persistence, latency, and drug tolerance. Tuberculosis (Edinb) 84, 29-44.

Gottesman, S. (2003). Proteolysis in bacterial regulatory circuits. Annu Rev Cell Dev Biol 19, 565-587.

Goulard, C., Langrand, S., Carniel, E., and Chauvaux, S. The Yersinia pestis chromosome encodes active addiction toxins. J Bacteriol 192, 3669-3677.

Guglielmini, J., Szpirer, C., and Milinkovitch, M. C. (2008). Automated discovery and phylogenetic analysis of new toxin-antitoxin systems. BMC Microbiol 8, 104.

Hayes, F., and Van Melderen, L. (2011). Toxins-antitoxins: diversity, evolution and function. Crit Rev Biochem Mol Biol 46, 386-408.

Hazan, R., and Engelberg-Kulka, H. (2004). Escherichia coli mazEF-mediated cell death as a defense mechanism that inhibits the spread of phage P1. Mol Genet Genomics 272, 227-234.

Hazan, R., Sat, B., and Engelberg-Kulka, H. (2004). Escherichia coli mazEF-mediated cell death is triggered by various stressful conditions. J Bacteriol 186, 3663-3669.

Hood, R. D., Singh, P., Hsu, F., Guvener, T., Carl, M. A., Trinidad, R. R., Silverman, J. M., Ohlson, B. B., Hicks, K. G., Plemel, R. L., et al. (2010). A type VI secretion system of Pseudomonas aeruginosa targets a toxin to bacteria. Cell Host Microbe 7, 25-37.

Horvath, P., and Barrangou, R. (2010). CRISPR/Cas, the immune system of bacteria and archaea. Science 327, 167-170.

Hurley, J. M., and Woychik, N. A. (2009). Bacterial toxin HigB associates with ribosomes and mediates translation-dependent mRNA cleavage at A-rich sites. J Biol Chem 284, 18605-18613.

Jiang, Y., Pogliano, J., Helinski, D. R., and Konieczny, I. (2002). ParE toxin encoded by the broad-host-range plasmid RK2 is an inhibitor of Escherichia coli gyrase. Mol Microbiol 44, 971-979.

Jorgensen, M. G., Pandey, D. P., Jaskolska, M., and Gerdes, K. (2009). HicA of Escherichia coli defines a novel family of translation-independent mRNA interferases in bacteria and archaea. J Bacteriol 191, 1191-1199.

Kim, Y., Wang, X., Ma, Q., Zhang, X. S., and Wood, T. K. (2009). Toxin-antitoxin systems in Escherichia coli influence biofilm formation through YjgK (TabA) and fimbriae. J Bacteriol 191, 1258-1267.

Kimelman, A., Levy, A., Sberro, H., Kidron, S., Amitai, G., Yoder-Himes, D., Zhu, Y., Wurtzel, O., Rubin, E. M., and Sorek, R. (2012). A vast collection of microbial genes that are toxic to bacteria. Genome Research In press.

King, G., and Murray, N. E. (1994). Restriction enzymes in cells, not eppendorfs. Trends Microbiol 2, 465-469.

Koga, M., Otsuka, Y., Lemire, S., and Yonesaki, T. (2011). Escherichia coli rnlA and rnlB compose a novel toxin-antitoxin system. Genetics 187, 123-130.

Kuchta, K., Knizewski, L., Wyrwicz, L. S., Rychlewski, L., and Ginalski, K. (2009). Comprehensive classification of nucleotidyltransferase fold proteins: identification of novel families and their representatives in human. Nucleic Acids Res 37, 7701-7714.

Labrie, S. J., Samson, J. E., and Moineau, S. (2010). Bacteriophage resistance mechanisms. Nat Rev Microbiol 8, 317-327.

Lehnherr, H., and Yarmolinsky, M. B. (1995). Addiction protein Phd of plasmid prophage P1 is a substrate of the ClpXP serine protease of Escherichia coli. Proc Natl Acad Sci USA 92, 3274-3277.

Leplae, R., Geeraerts, D., Hallez, R., Guglielmini, J., Dreze, P., and Van Melderen, L. (2011). Diversity of bacterial type II toxin-antitoxin systems: a comprehensive search and functional analysis of novel families. Nucleic Acids Res 39, 5513-5525.

Liu, M., Zhang, Y., Inouye, M., and Woychik, N. A. (2008). Bacterial addiction module toxin Doc inhibits translation elongation through its association with the 30S ribosomal subunit. Proc Natl Acad Sci USA 105, 5885-5890.

Maisonneuve, E., Shakespeare, L. J., Jorgensen, M. G., and Gerdes, K. (2011). Bacterial persistence by RNA endonucleases. Proc Natl Acad Sci USA 108, 13206-13211.

Makarova, K. S., Wolf, Y. I., and Koonin, E. V. (2009). Comprehensive comparative-genomic analysis of type 2 toxin-antitoxin systems and related mobile stress response systems in prokaryotes. Biol Direct 4, 19.

Makarova, K. S., Wolf, Y. I., Snir, S., and Koonin, E. V. (2011). Defense islands in bacterial and archaeal genomes and prediction of novel defense systems. J Bacteriol 193, 6039-6056.

Marchler-Bauer, A., Lu, S., Anderson, J. B., Chitsaz, F., Derbyshire, M. K., DeWeese-Scott, C., Fong, J. H., Geer, L. Y., Geer, R. C., Gonzales, N. R., et al. (2011). CDD: a Conserved Domain Database for the functional annotation of proteins. Nucleic Acids Res 39, D225-229.

Masuda, H., Tan, Q., Awano, N., Yamaguchi, Y., and Inouye, M. (2012). A novel membrane-bound toxin for cell division, CptA (YgfX), inhibits polymerization of cytoskeleton proteins, FtsZ and MreB, in *Escherichia coli*. FEMS Microbiol Lett 328, 174-181.

Neubauer, C., Gao, Y. G., Andersen, K. R., Dunham, C. M., Kelley, A. C., Hentschel, J., Gerdes, K., Ramakrishnan, V., and Brodersen, D. E. (2009). The structural basis for mRNA recognition and cleavage by the ribosome-dependent endonuclease RelE. Cell 139, 1084-1095.

O'Connor, L., Coffey, A., Daly, C., and Fitzgerald, G. F. (1996). AbiG, a genotypically novel abortive infection mechanism encoded by plasmid pCI750 of *Lactococcus lactis* subsp. *cremoris* UC653. Appl Environ Microbiol 62, 3075-3082.

Otsuka, Y., and Yonesaki, T. (2012). Dmd of bacteriophage T4 functions as an antitoxin against *Escherichia coli* LsoA and RnlA toxins. Mol Microbiol 83, 669-681.

Pandey, D. P., and Gerdes, K. (2005). Toxin-antitoxin loci are highly abundant in free-living but lost from host-associated prokaryotes. Nucleic Acids Res 33, 966-976.

Pecota, D. C., and Wood, T. K. (1996). Exclusion of T4 phage by the hok/sok killer locus from plasmid R1. J Bacteriol 178, 2044-2050.

Poole, S. J., Diner, E. J., Aoki, S. K., Braaten, B. A., t'Kint de Roodenbeke, C., Low, D. A., and Hayes, C. S. (2011). Identification of functional toxin/immunity genes linked to contact-dependent growth inhibition (CDI) and rearrangement hotspot (Rhs) systems. PLoS Genet. 7, e1002217.

Roberts, R. C., Strom, A. R., and Helinski, D. R. (1994). The parDE operon of the broad-host-range plasmid RK2 specifies growth inhibition associated with plasmid loss. J Mol Biol 237, 35-51.

Rotem, E., Loinger, A., Ronin, I., Levin-Reisman, I., Gabay, C., Shoresh, N., Biham, O., and Balaban, N. Q. (2010). Regulation of phenotypic variability by a threshold-based mechanism underlies bacterial persistence. Proc Natl Acad Sci USA 107, 12541-12546.

Schumacher, M. A., Piro, K. M., Xu, W., Hansen, S., Lewis, K., and Brennan, R. G. (2009). Molecular mechanisms of HipA-mediated multidrug tolerance and its neutralization by HipB. Science 323, 396-401.

Shao, Y., Harrison, E. M., Bi, D., Tai, C., He, X., Ou, H. Y., Rajakumar, K., and Deng, Z. (2011). TADB: a web-based resource for Type 2 toxin-antitoxin loci in bacteria and archaea. Nucleic Acids Res 39, D606-611.

Skorupski, K., Tomaschewski, J., Ruger, W., and Simon, L. D. (1988). A bacteriophage T4 gene which functions to inhibit *Escherichia coli* Lon protease. J Bacteriol 170, 3016-3024.

Smith, P. A., and Romesberg, F. E. (2007). Combating bacteria and drug resistance by inhibiting mechanisms of persistence and adaptation. Nat Chem Biol 3, 549-556.

Sorek, R., Kunin, V., and Hugenholtz, P. (2008). CRISPR—a widespread system that provides acquired resistance against phages in bacteria and archaea. Nat Rev Microbiol 6, 181-186.

Sorek, R., Zhu, Y., Creevey, C. J., Francino, M. P., Bork, P., and Rubin, E. M. (2007). Genome-wide experimental determination of barriers to horizontal gene transfer. Science 318, 1449-1452.

Stahlberg, H., Kutejova, E., Suda, K., Wolpensinger, B., Lustig, A., Schatz, G., Engel, A., and Suzuki, C. K. (1999). Mitochondrial Lon of *Saccharomyces cerevisiae* is a ring-shaped protease with seven flexible subunits. Proc Natl Acad Sci USA 96, 6787-6790.

Stern, A., and Sorek, R. (2011). The phage-host arms race: shaping the evolution of microbes. Bioessays 33, 43-51.

Tan, Q., Awano, N., and Inouye, M. (2010). YeeV is an *Escherichia coli* toxin that inhibits cell division by targeting the cytoskeleton proteins, FtsZ and MreB. Mol Microbiol 79, 109-118.

Tuchscherr, L., Medina, E., Hussain, M., Volker, W., Heitmann, V., Niemann, S., Holzinger, D., Roth, J., Proctor, R. A., Becker, K., et al. (2011). *Staphylococcus aureus* phenotype switching: an effective bacterial strategy to escape host immune response and establish a chronic infection. EMBO Mol Med 3, 129-141.

Unger, T., Jacobovitch, Y., Dantes, A., Bernheim, R., and Peleg, Y. (2010). Applications of the Restriction Free (RF) cloning procedure for molecular manipulations and protein expression. J Struct Biol 172, 34-44.

van der Oost, J., Jore, M. M., Westra, E. R., Lundgren, M., and Brouns, S. J. (2009). CRISPR-based adaptive and heritable immunity in prokaryotes. Trends Biochem Sci 34, 401-407.

Van Melderen, L., and Saavedra De Bast, M. (2009). Bacterial toxin-antitoxin systems: more than selfish entities? PLoS Genet. 5, e1000437.

Van Melderen, L., Thi, M. H., Lecchi, P., Gottesman, S., Couturier, M., and Maurizi, M. R. (1996). ATP-dependent degradation of CcdA by Lon protease. Effects of secondary structure and heterologous subunit interactions. J Biol Chem 271, 27730-27738.

Wang, X., Kim, Y., Hong, S. H., Ma, Q., Brown, B. L., Pu, M., Tarone, A. M., Benedik, M. J., Peti, W., Page, R., et al. (2011). Antitoxin MqsA helps mediate the bacterial general stress response. Nat Chem Biol 7, 359-366.

Wozniak, R. A., and Waldor, M. K. (2009). A toxin-antitoxin system promotes the maintenance of an integrative conjugative element. PLoS Genet. 5, e1000439.

Zhang, X. Z., Yan, X., Cui, Z. L., Hong, Q., and Li, S. P. (2006). mazF, a novel counter-selectable marker for unmarked chromosomal manipulation in *Bacillus subtilis*. Nucleic Acids Res 34, e71.

SEQUENCE LISTING (11088 sequences)

SEQ ID NO: 1 - DNA, 969 bp, Acidithiobacillus ferrooxidans ATCC 53993
atgaataaagaagattttgcgcaatatgtagatgtggccatgcggggtgacgggctgggttttttgcgtcctgtggtggagaaggaattgctgcactatgagatttttagcgcattggacgaagaggggctgttaaaggatctggtgtttcaggggggaacctctctgcgtctatgttatggctctgagcgattcagtgaagaccttgactttgcgggtggaaagaatttttccgcccggagtatggccgccgtcaaaggctgcattgtcgggaagattggcaagcgctttgacctggatatcacggtccgggagcccagggatgctccatttgatgggacagtgcgggtagataaatggatggtcacgatccagaccagtccggatcgtccggacgtaccacggcaaaagatcaaactggaaattgccaacgtaccggcctattccagggatattcttccattgcggattaactattccgttctggaggggcgtagtcaacctttggtggcggtcgagtccagggatgagattctggcggacaagctgattgcacttcctgcttccatttccagaatgattggccaggagatggagttgaccccatcgcggatcaggcatcgggatatttgggatatcgcgtggttatctggtcagggagcgcagttggatacccaactggtcagaaggaaaatctcggattatggattggatgaattcccccagtttttggatcgcgccattgctgcgattcccgtgattgctggtggagaggggttccgtgcgcagatggcgcgattcctgccgcaaacacaacatgacagggtgtttggcaaggaggggtatgagaaatatttcgagaatacggtcagcggattgctatccagtctgcggaaggatctggaatttgatctcaaaaaagtccagcaggtgctgccagggaagaaaaaacgtgggccgaagttataa

SEQ ID NO: 2 - DNA, 867 bp, Ammonifex degensii KC4
atgcagtgggaggaaataacccgcaaggcctatactctgggaacaacccctgagttcgtttttcgcgaagagactcaaaaggccgtcctgtccttcttgagcaggaaaagtttcttccgcgaaggggtgttccaaggaggaactgcgctacgccttttctacggcgccccccgcttctcagaggacctagacttcgttttcgtagcgaaaaactcgggcacctggcagaacaccgggcgtttacttcagggactagaggcctacctcctgggtgtcttccctttcccactggaggtaacggcgaaaaagcagaaggagagcgagaccctgaagaggttttccctccgggccacaggtggccctctgagcaggaaagtggtggtgaacatcgagtttgctaacgtgccgtcgtacatgcaccgagtagcccacctggagtttccccccttcaacccgatgatccgggtggaggccccggaggaaatcctggccgacaaggtagtggcctgcgccctgagagcgtacatcaagggccgggacctgtgggacatccgctatctgactctcgagaaggggctgatccttcccgttaaactcgtcgcccagaaagcacgggactacggaagcaccgcccgagaactggcagagaaactcaagaaagcggcggaaaaagtgagagaagaggggagagaaagtattctcaacgagatgccacgcttcctggcaaaacacgaagcggaactgctccccgcacaagcgtccgaggccgcaattggagtggcttccctcttggaagaagccgcaaagaaggtggcgttccatgcggatgacggagtggtaccgccttttccaggagaacagctttaa

SEQ ID NO: 3 - DNA, 147 bp, Bifidobacterium longum DJO10A
atgactggaactgacgaaccgttcaagtacaaagccatggcagcacagatcgtttccgccgaaggcatgggcaatctgcttcccgtggtcgagaaggaacttctgcattatcgaatctgtttgttcatccgatcctcgcggtgctaa

SEQ ID NO: 4 - DNA, 957 bp, Bifidobacterium longum longum ATCC 55813
atgatgactggagctgacggcacctatgactacaaggctatggcggccgggatcgtcttggccgggggcgagggcatgggcaatctgcttcccgtggtcgagaaggaacttctgcattatcgaatcctggatgccatgatgcgcgagggtttcttctcctcgctggtgttccagggcggcacgagtctgcgcctgtgccacgggtccccaaggtacagcgaggaccttgattttgccggcggcacctcgttcgacatggacacccttaaagggcttggctcctgcatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgattcccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagctcgcggaattgaaatcatctgattacggcgaagaaggactttgggcagaccgtgctgatcgcgtggcgggggtcgccgatgtgatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggttcccggattccctattttcggtgcgtcgaacgactccagtccaacccgctga

SEQ ID NO: 5 - DNA, 957 bp, Bifidobacterium longum longum F8
atgatgactggagctgacggcacctatgactacaaggctatggcggccgggatcgtcttggccgggggcgagggcatgggcaatctgcttcccgtggtcgagaaggaacttctgcattatcgaatcctggatgccatgatgcgcgagggtttcttctcctcgctggtgttccagggcggcacgagtctgcgcctgtgccacgggtccccgaggtacagcgaggaccttgattttgccggcggcacctcgttcgacatggacacccttaaagggcttggctcctgcatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgattcccgcgtacgagccgcagcatcgtcccgccttggtcaactatccgatgttcccggccttgtcgggtcagatcatcctcgatgcggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagcttgcggaattgaaatcatctgattacggcgaagaaggactttgggcagaccgtgctgatcgcgcggcgggggtcgccgatgtgatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggttcccggattccctattttcggtgcgtcgaacgactccagtccaacccgctga

SEQ ID NO: 6 - DNA, 954 bp, Bifidobacterium longum
atgactggagctgacggcacctatgactacaaggctatggcggccgggatcgtcttggccgggggcgagggcatgggcaatctgcttcccgtggtcgagaaggaacttctgcattatcgaatcctggatgccatgatgcgcgagggtttcttctcctcgctggtgttccagggcggcacgagtctgcgcctgtgccacgggtccccaaggtacagcgaggaccttgattttgccggcggcacctcgttcgacatggacacccttaaagggcttggctcctgcatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgattcccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagcttgcggaattgaaatcatctgattacggcgaagaaggactttgggcagaccgtgctgatcgcgtggcgggggtcgccgatgtgatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggttcccggattccctattttcggtgcgtcgaacgactccagtccaacccgctga

SEQ ID NO: 7 - DNA, 519 bp, Bifidobacterium sp. 12 1 47BFAA
gtggcatcgattcccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagcttgcggaattgaaatcatctgattacggcgaagaaggactttgggcagaccgtgctgatcgcgtggcgggggtcgccgatgtgatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggttcccggattccctattttcggtgcgtcgaacgactccagtccaacccgctga

SEQ ID NO: 8 - DNA, 921 bp, Cellvibrio japonicus Ueda107
atgaagatcactgaagacgattttacccaactggtcaataaagccatgcaggacaataatgtcacgcatatgcgccctgttattgaaaaggaactgctgcactacgacattttgttttgcctggaagacagcgggcttctggataatctggtgtttcagggcggcacctcgcttcgcttgtgtcgagggggaaaccgtttcagtgaagatctggacttcgccggcggcaaagatttttcatcaggtatgctcagtaaaatgaaaaattgccttcaggattatttggggaaaaggtacggccttgaagtcctgattaaagaaccttcaaccttaaaagaaagtgcggaatacgccgaactgaacattgataaatggcaaatctcaataatcaccgcaccggatcgaaaagaggtgccaaggcaacgcatcaaaatcgaagttgccaatgttcctgcttataccaaagaagctgtaccgctcaaggttaactacgattttttgccggacggctatgaagacaccctgatctttactgaaaccctggatgaagtcatggccgacaaattggtttctctgcccgccacacaaagatatgtgcgctatcgcgatatttgggatttatcatggctaaaacaacaaggtgccgttgtgcagccggagctggtccagcgaaaaattaccgattaccgtctgacagattaccccgaccggcttgagttgatgatcaataaaattcccgacatagttgcaagcactgattttaaaaatgaaatgaaacgtttcctcccgacggatgtttatgaccgcaccttggggaaggaaaaatttgaaggttttttggttaataccgttacgggtttgtttaaggagcttaaaaaagcattatctgggcagcaggttgaacctgagttcagattgtga

SEQ ID NO: 9 - DNA, 891 bp, delta proteobacterium sp. MLMS-1
atgaatctgattgaacaactggccaccgaagccctccgcaaccacccggaactttctctgctgcggtcggcggtggagaaggagctgctgcaccacgatatcctgcgcctgctgaacgacgccggtctgctcgccggcctcacctttatcggcggcacctgcctgcgggcctgctacggcgccgaacggctcagcgaggacctcgacttcagcggcggccacgacttccgccgggagggcatggccggcctgaaagcggccctggaaaccggcctgcacgccaagtacggccttgaggtagaggtaaaggagccggtgcgcgagacgggcaacaccgatacctggaagatccgtatcatcacccgccccgcccgccgcgccatgccggcccagcggattaatatcgatatctgcgcggtaccgagccatgatcgccgaccaatgatgctgcgcaaccattacggcgtggaaatgggcacctccggcctgatcctccaggccgagagccgcgaggagattctggcggacaagctgctggccctggccttgcgccccaaccgggtcaagaaccgcgacctctgggatatcgcctggctcaagcgccacaatatcaacctgtccgccgccctgttgtcccgcaagatcgccgaccgccgtctggtcccggaagatttttttaaacgcctggagcggcggcagcaaatgctggccgacggccccgaaccccgccgggactttatccacgaaatgacccgcttcctggcggtcgccaccgtcgagcaaaccgtggccagggaagagttctggccctacctgctcgacaccatcgccgaccaatgccaacaggcgcgcaccctgctggacagttatccctacagaaagagccggtaa

SEQ ID NO: 10 - DNA, 891 bp, delta proteobacterium sp. MLMS-1
atgaatctgattgaacaactggccaccgaagccctccgcaaccacccggaactttctgtactgcggtcggcggtggagaaggagctgctgcaccacgatatcctgcgcctgctgaacgacgccggcctgctcgccggcctcacctttatcggcggcacctgcctgcgggcctgctacggcgctgaacggctcagcgaggacctcgacttcagcggcggccacgacttccgccgggagagcatggccggcctgaaagcggccctggaaaccggcctgcacgccaagtacggccttgaggtagaggtaaaggagccggtgcgcgagacgggcaacaccgatacctggaagatccgtatcatcacccgccccgcccgccgggccatgccggaccagcggatcaatatcgatatctgcgcggtaccgagccatgaccaccggccgatgatgctgcgcaaccattacggcgtggatatgggcacctccggcctgatcctccaggccgagagccgcgaggaaattctggcggacaagctgctcgccctggccctgcgccccaaccgggtcaagaaccgcgacctctgggatattgcctggctcaagcgccacaatatcaccctgtccgccgccctgttgtctcgcaagatcgccgaccgccgcctggctccggaagattttcttaaaagcctggagcggcggcagcaacagctctccgacggccccgaaccccgccgggactttatccacgaaatgagccgcttcctggcggtcgccaccgtcgagcaaaccgtggccagggaggagttctggctctacctgctcgacattatcgccgaccaatgccaacaggcgcgcaccctgctggacagttatccctacagaaagagccggtaa

SEQ ID NO: 11 - DNA, 879 bp, delta proteobacterium sp. MLMS-1
atgactgaatcggcaaattttgcggcactggtggataaggccatgacattttccggacaggggcatatgcggccggtgattgaaaaggagttgctgcattacgacattctgttcattctcgacaaagaaggcttgcttgatctcttgactttccagggggggacatccctgcgtctgtgctatggcgctacacgcttcagcgaggatctcgattttgtcggcggccggaattttgatcgccgtcagctggtatcgatgagggattgccttgagcattatatcggtaagcgctacgggtttgaggttatcgtcaaagagccccgcgaattgcgcaatgagccagaatatgaagggttgaacgtagagagatggcaaatcgcggtggtcacggctcccggtcagaggcacttgccccggcagcgtatcaagatcgaagtggtcaatgttccggcctattcgcgtattccacgcagcctgcaaacccattacgattttctgccggacggttacggcgatacactggtcttgactgaaaccctggcagagatcatggccgataaactggtttctctagtgaatagccggcgttacgtgcgccaccgggatatctgggatttgcgctggctgaagcagaatggcgcggtaatcaaccacgattgggtaaagaacaagatcattgactaccgcatcgccgattatgagcttaagttggaaagcctttggcaggaattgccggttatcgtccatggcgatgcattcaagtctgagatggcccgttttctgccgtatgaggttcaggagagaaccttcaggaagggcaaattttgtgatttcctggtcggtgaaatccgggaaatgctggacaatgtccgtagttaa

SEQ ID NO: 12 - DNA, 879 bp, delta proteobacterium sp. MLMS-1
atgactgaatcggcaaattttgcggcactggtggataaggccatgacattttccggacaggggcatatgcggccggtgattgaaaaggagttgctgcattacgatattctgttcattctcgacaaagaaggcttgcttgatctcttgactttccagggggggacatccctgcgtctgtgctatggcgctacacgcttcagcgaggatctcgattttgtcggcggccggaattttgatcgccgtcagctggtatcgatgagggattgccttgagcattatatcggtaagcgctacgggtttgaggttatcgtcaaagagccccgcgaattgcgcaatgagccagaatatgaagggttgaacgtagagagatggcaaatcgcggtggtcacggctcccggtcagaggcacttgccccggcagcgtatcaagatcgaagtggtcaatgttccggcctattcgcgtattccacgcagcctgcaaacccattacgattttctgccggacggttacggcgatacactggtcttgactgaaaccctggcagagatcatggccgataaactggtttctctagtgaatagccggcgttacgtgcgccaccgggatatctgggatttgcgctggctgaagcagaatggagcggtaatcaaccacgattgggtaaagaacaagatcattgactaccgcatcgccgattatgagcttaagttggaaagcctttggcaggaattgccggttatcgtccatggcgatgcattcaagtctgagatggcccgttttctgccgtatgaggttcaggagagaaccttcaggaagggcaaattttgtgatttcctggtcggtgaaatccgggaaatgctcgacaatgtccgtagttaa

SEQ ID NO: 13 - DNA, 906 bp, Desulfurivibrio alkaliphilus AHT2 uid49487
gtgaatctgcttgaacaactggcgggggaagccctccgccaccgtccggaactctctttgctgcggccggcggtggaaaaggaactgctgcaccacgatatcctgcgcctgcttaatgaagccggtctgctctccggcctgacctttatcggcggcacctgcctgcgggcctgctacggtgccgaacgcctcagcgaagacctcgacttcagcggcggccacgacttccgccgggaaagcatggccggcctgaaagcagccctggaaaacggcctaggtgccaagtacggccttgaggtggaggtaaaagagccggtgcgcgaggcgggcaacaccgatacctggaagatccgcatcatcactcgcccggcccgccggaacctgccggcccagcggatcaatatcgatatctgcgcggtgccgagccacgaccgccgaccgctgatgctgcgcaaccattacggggtggaaatgggcacctccggcctgatcctccaggccgaaagtcgcgaggaaattctggtggacaaactgctggccctggccctgcgccccaaccgggtcaagaaccgcgacctgtgggatatcgtgtggctcaagcgccacaatatcaacttgtccgccgccctgctcgcccgcaagatcgccgaccgccgtctggccccagaagattttcttaactacctggagcagcggcagcaactgctggccggcggccccgatccccgccgggactttatccacgaaatgacccgcttcctggcggccgccaccgtcgagcaaaccgtggccagggaagatttctggtcctatctgctcgactccatcgccgacgaatgccgacaggcacgcaccctgctggaaaacttaccccaagccgataatggcgtcccccgcgactcttga

SEQ ID NO: 14 - DNA, 987 bp, Eggerthella lenta DSM 2243
atgttgattgaccttgaagaggttgccagcgatatcgccagcaaggtcgatggcgtccggctcacgcccgtcattgaaaaggaaatcatccattacgagattatccggtcactcgggaggaacggcctgcttcgagatatcacctttcaaggcgggacctcgctgcgtctctgctatggatcgcaacgatatagcgaagacctcgattttgtcgccggcgacagcttcgattcgctccccttggatgatttttccaagactttgcgctccgatttgctgaaatcctacgataccgaggttagcgtcagggaacccaaggtcgtcaatgatttcgatggcgtcgggatgcgtagatggacggtttccgtaaataccaacatcgcgcgccccgatttgccgaaacagcgaatcaagctcgagatcgcgtctgtgccagcacatacatccacgattcgacgtgtcgcggtcaattatcccgaacttgccggaatgtatgacgacctcacgatccggtgccagacactcgaggaaatcttggccgacaagctcatctcgttctccgccaccgattcgcatatcaggcatcgcgacctctgggacattccctggatcgtccgtgcacaggagatcgatttccctgccgtagccgcatttgtcgcggcaaagcacgatgactaccgctgtcccgcctcccttgccagcatgatcgccaccgggacgcaacgtgcacgcgtctgctatgtcgacgggtcatttaccggacagatgcagcgtttcctatctcccgctgtcttgaaccgcacgcacgatttcgataatcactgcgatgccctcaatacaatcgtcgaaaagtgcttcgaccgcgtcgccgcctccctcggcatctcagatgaggtcgagcattccagacgcaaactcgcaatcgagatatcttcgggatcgatttcggccgccgccctaccgaaaaggactttagacctttcttaa

SEQ ID NO: 15 - DNA, 879 bp, Helicobacter canadensis MIT 98-5491, ATCC 700968
atgagtgatttagaaaatatcgcagattcttatgcttttgaactaggaaacacaaaagacgcagtgattaaggaaattttgcattatgatattttgcaatctttgagtcaatcagatatagccaatgatatagtatttcaaggcggaacttctttgaggctttgttatggtaataatagacattcagaagatttagattttgcattaaaagatgaaaaagttgattttgatgaagctttgcttaaagagtttgaaaagatttttgttagcacaataagaaataaatataatttagaagcagaattatcatattccaaagaaaatgaagattttgtaaaaaaatggactgcaaaagtgtttttgccaatttctcataggaaagcaaaaattaatatagaaatttgtgatgttccaagctatgataataaagtgatgaatgtcatcaatcactactctttgaaaaataatgatgatttgataattagagttaaaagcttggaagaaatattagccgataaaatcttagctttagggtgcagaaaatatatcaaatatagagatatttgggacattaagtggattttagacaaaaatacttcaattaatcttgaatggattaataataaaatatgcgattatcacgcttctaattttcctataaaacttgctcaaaaattagaagaactccaagaaaataaagaagcacacaataatggcttcattaatgagatgagtaggtttgtgaaacctgttttgtttgaaaaatacaagaagcttgattttttcgcagaaacaattgatgaagttttagaaaatggagagaatgttttagaattgctaaaagagcaagaatatacaaaatatctgcgaaaaagttaa

SEQ ID NO: 16 - DNA, 909 bp, Marinobacter sp. ELB17
atgacgctatttgacacattggttagcgaggccatcaggaaccagcgtgagctaattgcgctgcgccctgttgtcatcaaagaaatattacatcacgatattctgcgcgagttaagccatgcagatcttctcaaaaaactgaccttcataggcggaacctgcctccgcgcctgttatggttctagcaggctaagcgaggatctggattttacgggcggagctggtttcaacaaggatgagctggataagctgaaggtcacgctggaagtgcggttaactgagaaatacgaactgccgatctctgtaacagaacccaaagctgagaagcagggaaatgtagatacttggaaactccaagtaaacacacaacctgagcgtccagatatgccagctcaaagaattcacttagacatttgcgcggtacccagctaccagatcaccccacggacgcttcagaaccactacgggatcaatcttggtacagaatcattaataattaaggcccagacgcgcgaggaaatctttgcagacaagctgctcgcatttgctatgcggccaggacgaatcaagtatcgagacgtatgggacattggctggctagcccaaaatggcattgagcctgcacttgaccttctcaacgccaagctggcggatcacggggaactggaagatgactttctgattcggtcggacgaacggttagggcaactggtaaacgatgaacagcaacacagagattttgtttttgaaatgacgcgatttatccctcctgatcgcctagaccaaacacttaggcaggaagggttctggacgtacctctccaacacggtcatagagaaggtgcgccaggcacaaaatcgggttgagagtgacgccactcatgacacaggcccttcattcttgatgtag

SEQ ID NO: 17 - DNA, 891 bp, Marinomonas MWYL1
atgctcaaagaagtcataaagcaaattgttaacaccaatgctgagtatgcagggataacacctgttatagaaaaagaaatattgcaccatgatattatggcggtcatggtaaaacagggggttatgcaatcactaacttttattggcggcacatcacttcgcttatgccacaacagctctcgattatctgaggatttagattttaatggagggcatgactttaaacctgatgattttgatggtttggaagtcgagattcaaaagtacatacaaaaaaaatatgaaacagaagtctgggtaaataagccaaacaaagataaacaaggagacacatcttcttggaaaattagtatcgaaaaagaagctaaccgccctgacctaccacgtcaaaaaatgcatatagacatttgtgcgatcccttctttcgacattgagagaagaccattgatcaatcattacgatgtcgtcgttccaacagaagggcttttgatcccagtacagtcgttagaagaaaccttggcagataaattcattgccctagcataccgttccagacgtattaaacctcgtgatgtttgggatattctttggatcaagcaaagaggtattgacgtatccatagagctgatctacaaaaaacttgcggcaagagaaaaaacaaaagctcacttcatagagtcgcttacccttcaggtcgaaaaattactgaacaaagaagaggtaaaagctgactttaacaatgaaatgagccgtttcattccaagccaaattaaacagcgaacaattgataatccagaatattggcaatacgtgcaacttgaaattaaaagcatgacagacccgatactcaaacctgatttacagacaaagaaatttgatatgggcttttaa

SEQ ID NO: 18 - DNA, 918 bp, Pantoea sp. At-9b
gtgaatcagaaagttaattttgccgtactggtcagtcaggcgatggagtccgctgagcttgaaggtctacggagcgtggtggaaaaagaacttttgcactacgacattctctactgcctggataatgccggtttattacaggatctgactttccagggagggacctcattaaggctctgttatggtggtaaccgattcagtgaggatctggattttgcgggtggaactgagttttccggttcacatctcaagaacatgaaaacctgcattgaagattatctgggaacgcgttacggattagaggtcagcgtaaaagagccaaatgagttacggcgggagccgggctatgaggatattcgtattgataaatggcaggtatccgtcaccacctcccctgaaaggcgtgatatgccaaagcagcgtatcaagattgagattgcaaatattcccgcctacacgagagtgccgatgggactatcacgtaactatacggttctacctgatggctatgctgacacgcttgtgatgtgtgaaacgcttgatgaagtgatgagtgacaaactcatttccctggtcgccacaacaaaatatgtccgctatcgcgatatctgggatctgccgtggttactccagcagaacgcggcctatgatattgaactgattcgcaggaaaattcaggactatcggatcccaaactacagggaacttttaaagcttcgcctggagagcattgaccagacggtcagcgatggacggtttgaagcagaaatgcggcgttttttaccgcagacagtttttgacagaacgctggggcgtgctgaatttaccggttatctaagtaacaggctcaaaactctgttaagttccttacaaaaggagctggaaggggagggaagagggaatccatttctgatgtga

SEQ ID NO: 19 - DNA, 285 bp, Parascardovia denticolens DSM 10105
gtggacgtctcccatgcggtgggattacggagtttgaaagaagaggatcaccgggagcgatcggtttaccgggatcagtatccgcttgttttcgaccgcatccatcacgccttatccgacagtaccgccttcaccacggagatgagccgcttcctgccctccgccgttcgggaaagaaccatggccgcggagtatgggtccaagccatggaatccacccgcaccaacattttcagcgcattcccaccagacaatacgcttgtggattaagtatccaatacgataa

SEQ ID NO: 20 - DNA, 918 bp, Pectobacterium wasabiae WPP163
atgaatcagaaagttaactttgccgaattggtcagcaaagtggtggaatcagccgagcttgaaggcttgcgcaatgtggtggagaaggagcttttgcactacgacatcctctactgtttggataatgcgggcttgctggagcagcttacttttcagggagggacatcgttaaggctgtgccatggcgcaaaccgcttcagtgaagatttggatttcgccggcggtgttgcgttttctggcgcagaccttaagaacatgaaagcctgtattgaagattatctagggaatcggtacggccttgaagtcaacgtgaaagagccaaatgaattgcggaatgaacccggttatgaggaagttcgcatcgacaaatggcaggtatccgtgaccactgcaccggaaaaacgcgatatgccaaggcaacggatcaaaattgagatcgccaatatcccggcttatacccgaacgccgatgacgctaaaacgtaactatgaggttttacctgatggttattccgatacgctggtcatgtgtgaaacgctgaatgaagtgatgtgcgacaaactggtttcgcttgtcgccactaccaaatatatccgctatcgtgacgtatgggacttgccgtggctgatccaacaaaacgcgacttatgatatcgatctgattcgtaagaaaatacaggattaccgcatctctaattatgatgatctactggcacagcgcatacagagcattgatcaggttgtgggggatggccgttttagcgctgaaatgcggcgattcctgccacaagcagtatttgatagaacgttagggcgtgaggcttttagccactatttaagcggcgaactaaaagcactcttaagtgcgttacagcaagcgttaaaaggagagggcgggaaagcgccgttcgtcatgtaa

SEQ ID NO: 21 - DNA, 921 bp, Photorhabdus luminescens
atgtctagccacgttaactttaacgccattgttgatgaagtcattgaacaagacagactggcaaacctgaggccagttgtagaaaaagaactgttgcattatgacatcctgttttgtctttctaaggacggtttactcaaggagattacctttcagggtggtacatcgctaaggctctgctacggctctaaccgatttagcgaagatctggattttgctggtgggcgtggtttctgttccgctgatttgagtagaatcaaagagtgtatcgagaaatacctgggtgtacgatatgggcttgaggtcacggtaaaggaaccgaatgaactacgaaacaaaccggagtatgcagaagtaaaagtggataaatggcaaatatccgtcactactgcgcctgaacgtaaagacctgccaaaacagcgcataaaaatagaaatcgccaatattcctgcctatacaaacaccccccgttcattgataagaaattattcagtgttacccgacggatatgctgatctccttgtgtctgtcgaaaccctgcctgaaatcatggccgataagctgatagcattccctgctactacatctcaaattcgataccgcgatatgtgggatttattatggttaagtcagcaaaatacgacaccagacatagaactcattaaaagaaaagtatcagattatcagcttgataactttgaggaattgcttcaagccagaatcgactcgattgaaattattgttgcttctggtcactttcacaacgagatgagacgatttatacccgcacctatatacgacagaagtgtaggacaagaagcattttccacctatttaacgacgagcctaaaggagttgttaaccactgtgaagaaaagcctgtattcttcaggagacaactccattccattcaagttataa

SEQ ID NO: 22 - DNA, 921 bp, Photorhabdus luminescens
atggtcaataaagcaaatttcgcccaacttatagagttagcaatgcaggtaccaggacgttcccatatgcgaccggttattgagaaggaactgttgcattacgatattctttattgccttgatactaatggattacttgatcaactcactttccaaggaggaacctctctgcgcttgtgtcacggagctccacgttttagcgaagatctggacttttccggtggtgttaactttaatcgtaatcaattacaagccatgaaaaaatgtttggaacattacattggcaaacgttacggttttgaagtttcagttaaagaaccagccgatttaagaaacgagcctgaatatgctggccttaatatagataagtggcaggtctcaattgtcaccgcgcctgagcgcaaagatctccccaaacagagaatcaaaattgaaattgccaatatcccttcttattcacaggaaccgaaggcattaatgaccaactacaattttctacctgatggctacgccgatacgctggtattaaccaaatcattggatgaagtcatggcggataaactggtttctctggtcaatacacaacactatgtacggcaccgagatatctgggatttacgctggttaaaacagaaaggagctaccctgcgtatggattgggttaataacaagattatagattatcggattagtggctattcagacaaattagccaatattctgacacgcttgcctgcaattattaaaggtgatgctttccgtaacgaaatgcagcgctttatcccacaggatgtccaggaacgcactctgcacaaagaaaaattctttacatttttaactaccgaaatcgctgatatgctacaacgggtacaaaactcactaaacagttgctcaacatccgagaatgaattcaatatgtag

SEQ ID NO: 23 - DNA, 930 bp, Proteus mirabilis ATCC 29906
atgtctgattttgtcaattttaatgagctagttgacagcattgtcatcgaaaaggattacggcgcgaacaggcctgtcgtggaaaaagaattgctacattatgacattctttatgctctttccgccacagggcttttaaagcacatcacatttcagggcggtacatcgcttaggctttgctatggatcaaacagatttagtgaagatctggactttgctggtggtcgtgacttctgttcagcgcaactgcttgagattaaagcgtgtattgagaaatatgttggtgaacgatatggcttggaggttgtggttaaagagccaaaagagctaagaaaagaacctgattatgcagatgtaaaagtcgataagtggcaaatatcagtgactaccaatccaggaaaaaaagacctaccaaagcagaagatcaaagtggaaatagccaacattcctgcatacaccaacacccttcgaacgcttgttaaaaactatgagcagcttcctagtggctattctgacctgattattagagtggaagagctcacggaggtcatggctgataaattggtttcattcccagcaacaacctcacgtattcggtatagagatatgtgggatttggtgtggttgcaccagaaaggggttaaaccagacgctgaactggtaatgaaaaaggttgccgattataagctcaatgagcattttgaggaatggttgcaagcaagaattgagtctttgcctgcattggttgcgagtgaaaagtttaagggagagatgaagcgattcttacctgtgtctgtcgtagatagaactctccttcacccagattttcttgaatttttacaaattactcttcatgaactgctagtcactatccaaacagatatttatggaagtaaagatccgaagccagtaaaaaaatttgaaatgtag

SEQ ID NO: 24 - DNA, 930 bp, Proteus mirabilis; identical to SEQ ID NO: 23

SEQ ID NO: 25 - DNA, 921 bp, Proteus mirabilis
atgaaaattgatcaagaaaatttcgcgctattggtgaataaagcaatgcaggtcggaaatgtatctcacatgcgttccgtgatagagaaagaactcttacactacgatattttatttgcgctagaaaaaggtggacttctaaacaaactgacttttcaaggtggcacttcattacgtctttgttatggtggtaatcgtttcagcgaagatctggattttgctggcgggaaggattttagctcagcaatgttggcagatatgaaacattgtatagaaaaatacattggcgaacgatacgggctagaagtaacagtaaaagaaccaaaagatctaaagcaagatcctaaatattctgaattgagcattgataagtggcaaatagcagtagtgacttctcctgagagaaaagatctaccaaaacaaaaaatcaaagtagaagtggcaaacattccagcctatacaagagagccccaacctctgcaaataaactatgattttttgcctgatggatacagtgatatgctaattttgacagaaagtttggatgaaatcatggcggataaaatcatttctttgccagccactacaaggtatgtccgccaccgagatatatgggatttagcttggttacagcaacaaggcgcgacactcaatatggacttagttaaaaataaggtatcagattataaacttgagcacttcaacaaaatgttggaaaactttctcgaacgacttcctagtattgtatctagtgaagcattcattgcagaaatgaaacgtttcttaccaacagatgtatttgatagaaccctcgctcaggataagtttcaagtttacctgcaaaatactttggcgaaactatttaaaactgtgagtaacgaattactaggcaaggtcactaatagtgaatttagaatgtaa

SEQ ID NO: 26 - DNA, 888 bp, Shewanella denitrificans OS217
atgttgaagcagcaaattcgtcaaatcgtccaagcaaaccctgactatgcagcagtgacacctgttatagaaaaagagatcttgcatcatgacattatggatgtgctgatcaaacagggtgttatgcagcgattgacctttattggtggcacctcattacgtatgtgctacaacagcagcagactgtcggaagaccttgattttaacggcggtcatgatttcaaaccctcggagtttgatgggttggagtccgaaatccaaacctatattcagaacaagtatgaaacagaagtttgggtcaacaaaccttccggcgagcagcagggggatacagtttcttggaaaattagtattataaaagaggctaatcgacctgatttgcctcggcaaaaaatgcatattgacgtctgtgctattccgtcattcgatatcgaaaagcgcccgttactcaatcattacgacatcgttgtaccgacagaagggatcttggttccggtacagtctttacaagaaacactggctgataagctgatcgcgttagcgtatcgcgcaaggcgcataaagcctcgtgatatatgggatattgtttggatcaagcaacgcggcattaacttatcaaagacactggttgaaaaaaaactcgtcgccagacagaagcaaaccgaagattttcgtcaagcactgtctgtacagttgggcaaactgatgacagaagatgaagtacgtaacgacttcaacatggaaatgagccgctttatccctaagcaaattaaagagagaaccctagataatcctgaatactgggcgtatgttcaggctgaggtaaatgccatcgcgtctgaattacttaatgacggaacagcaaaaaatccatttgatatgggttag

SEQ ID NO: 27 - DNA, 1014 bp, Verminephrobacter eiseniae EF01-2
atgaaccggcaagatttcaacgccatggtcgagttggccatgcgcgacgaccagttgtcggccatgcgcccggtggtggaaaaggagttgctgcaccacgagatcttccaagcccttgatgacgccggcctgctcaagcacttggtcttccagggcggcacctcgcttcggctctgccgtggctcggaccgattcagcgaggacctcgacttcgccggtggccgcgatttcacggctgacaagatgcaaggcatcgaggagtgcatcgagaagcacattgggctgcgtttcggcctgaacgtgacggtcaaggagcccaaggaacccaaagggcgcgcggtcggcaggtcaggcgtcgcactggacaggtggtggatctcgatcgagaccgctccggaaaacgccgccatgccccgccagaaaatcaaactcgaaatcgccaacatccccgcctaccaggtcgaactcgtcccgctgcgccagaactacgagtttctcggcggcatgaaggaaatcctggtcaacgtcgaatcggtctccgaaattttggccgacaagatcgtggccttccccacctcgctcgtggacaaccagggcgcgccactgcccccgacagccgcgaagatccgctaccgcgacctctgggacatcgcctggctgctcaaaaagcgcgccgagctcgacccccgcatggtcgccagcaagatcagggactacggcatccccaacttccccgaactgctcgaccgggccatcgagatgattccggcggtggtcaaaagcgcggcgttccaggaccaaatgcgcaggttcatcgatgcgggcaccgtcaagaggacgctcggcgacgagcgttacctggactacctggcctcgacggtcggtggacagttccaggaggccaaggcccatctccagcacgcagcggcgctggaggccgcaaaggccgtcgccgcgccgggccagggatccacacccaagaaatctgcgtcccctgcatcctctgcggattga

SEQ ID NO: 28 - DNA, 921 bp, Xenorhabdus nematophila ATCC 19061 uid49133
atgcctgataaaaccgattttaatattcttgtcgatgaaatcgttacgcagaacgggtttaccgacatcaggcctgtagttgagaaagagctcctacactatgacattttgcattgcctcgctaaaaatggcttgctgaaaaagcttacctttcaaggaggcacgtcactcaggctctgctatagttccaaccgattcagtgaagatttggactttgcagggggtcgtgacttttgttcggcagatctggggaggattaaagagagcgtcgaaaactatctgggcgcacgttacggtcttgaggttaccgtaaaggaacctaatgaactcaggaaagagccagagtatgccaatgtgaaaatcgataaatggcaaatttctgtcacaacagccccagagcgtaaggacttgccaaagcagcgcatcaaaattgagatcgctaacatcccggcctatacaaagaatccgcgcccattaacgcgcaactaccctgtgttgcctgatggctactccgaaactatcgtgttggtagaagagttaacagaaatcatggcggataaactggtttcattccctgcgacaacgaaacatattcgttatcgtgacatgtgggatttggtctggctgaaacaacagggagttgaacccgacaccgatctgatcaagcgcaagctatcggattattgtttaactgattttggcgaacagcttcaggcacgattggactcgattgaaaaccttattgcgtcaggcacctttcaggaagaaatgaagcggtttattcctgcaccagtttacaacaggactatcgggcagacagacttcatgcgttacctcgaaaccaccctgaaagcattacttactacagtgcaaaaagagttgtactcaccagcaaccaaccccgttcctttcaagatgtaa

SEQ ID NO: 29 - DNA, 981 bp, Bifidobacterium longum longum CCUG 52486
atggatgggagtgacatggcgttcgactacaaggcggtcgcggcgggcatcgcgcgttcggaaggcatgggtgccctgcttcccgtggtggagaaggaactgctgcattaccggatactttccgccatgcaggacggcggcttcttcggcccgatcgtgttccaaggaggcacgagcctgcgtctgtgccacgggtccccccgttacagcgaggacctcgacttcgccggcggcacgggtttcggcgtcgatgaccttcgggggttgggcgaatgcgtcaggtcctccctcgccggcatgtccccggacgtgcaggtgaaggttcgcgaaccggtccgggacgagggcctggtgaggagatggcgcatatccatccgcacggcggcgcaacgtcgtgatctgccgagccagtcgatcaagctggaggtcgcatcggtgccggcgcatgagccgcagacgaggccggtcagggtcaattatccctccgtgtcggcgatcgccggggacatcatcctggcggtggaaagccccaccgagatactcgcggacaagcttctgtcgtttgcatgctcctcccatatccgccgtcgtgacctgtgggacatgtgctggctgtcgtccagggccgacgtggatgcgtcccgggcgttccggatggccacgctcaaggctggggaatacggggaggtcggagaatgggaggcgcgcgcaggccggctgcgtgagatcccgtcggtgttgtcttcggacgcctttctggacgagatgcgaaggttcctgccggcccgaatgctcgtcgccaccgtcgaatccctctcctggcgcgagtacgcctcgcaggcggtcaccgggctgtatgatccctccgggcccgcatgggcgtcgccgtatggctcgccgggtttcgggcggccgatgcctgagcccgaccagtcttccgccgttcccatgtggcgtgacgggggtcccgctctttcctga

SEQ ID NO: 30 - DNA, 954 bp, Bifidobacterium longum longum CCUG 52486; identical to SEQ ID NO: 6

SEQ ID NO: 31 - DNA, 879 bp, Helicobacter canadensis MIT 98-5491, ATCC 700968; identical to SEQ ID NO: 15

SEQ ID NO: 32 - DNA, 891 bp, Providencia rustigianii DSM 4541
atgttaaaacaacagattagacaaataatccaagtaaatccagactatgcagcgatcacgccagtaatagaaaaagaaattttacatcatgacattatggatgtattaatcagacaaggtgctatgcaacggctcacctttattggcggaacatctcttcggatgtgctacaacagttcacgtttatcagaagacttggactttaatggtggacatgatttcaaacccactgaatttgacggtttagaatttgagatacaaaagtatattcagaataaatatgaaaccgacgtttgggtaaataagccatcagaggaaaaacagggggatacagtgtcatggaaaatcagcattgtgaaagaggctaatcgccctgatttaccaaggcaaaaaatgcatattgatgtatgtgctatcccttcatttgatattgaaaaacgccctttactgaatcactacgatattgttgtaccgacagaggggatcttagttccagttcaatcactgcaagaaacgcttgcagataagctgattgctttagcctatcgagcaagacgaataaaacctcgtgatatatgggatattgtttggataaaacaacgtggtattagcctatcaaaaacgctcgtcgaaaagaaattgattgcgagaaataaggaaatagacgattttcatcacgccattgcgatacagcttaataaattgatgcaagaagatgacctacgcaatgattttaatgctgaaatgagtcgttttattcctaaacaaattaaagagagaacagttgataaccctgaatattgggcttatgttcagattgaagtaaacgatattgtcactgaattactaaataatattaagccaaagaatccattcgatatggggttgtga

SEQ ID NO: 33 - DNA, 903 bp, Acidovorax delafieldii 2AN
atgaccagcaacctctccgcgtcgattctggcccgactactgaccctcgccaagcaacgtggcgacgactacaacctgctgctcaaccgcttcggcatggagcgcctgctgacccgcgtcagcctgtcaccgcatgctgaccgcttcctgctcaagggcgccctgctctttgcactctggtacgacaccccgcaccggccgacaaaggacgcagacttgctcggcttcggccccgacgatgaggcgaacctgatcgccaccttccgcgaaatcgccgccatggacctgggcgatggcattttgtttgatgccgactccgtgaaggccgacgccattcgcgaggacaacacctacggcggaacgcgcatcacgctggtggcacgcatcggttccgcacgctgcgcgctgcaggtcgatgtgggcttcggggacgcagtgacgccgaggccacagacggtggcttatcccaccttgctaggcgacttccctgcccccacgctgcgggtctatcccgtctacaccgtgatcgccgagaagtaccaggccatggtcatgctggggcaagcgaacagccgcatgaaggatttcttcgacctggcggtaatcgcacggcgcacggaactggacggcgccacgctggcggcagccattgccgccacctttgcccgacgccagaccgccctacccaccgagcggcccttggcactgaccaagcagttcagcgaagacgccactaagctgcgccaatggcaggccttcctgaacaagaaccgtatcgaagccgcgagcctgggtgacaccgtggcgctgctggacgacctgctgtggccgccaacggaggttgccgccgctggcggtcaggctacggccatatggcacccagagactttgcgctgggtctag

SEQ ID NO: 34 - DNA, 903 bp, Acidovorax sp. JS42
atgaccggcaacctatccgcgtcgatcctggcccgactgctgaccctcgccaaacagcgcggcgacgactacaacctgctgctgaaccgctacggcatggagcgcctgctggcccgcgtcagcacgtccccgcatgctgaccgctttctgctcaagggcgccctgctctttgcgctgtggtacgacaccccgcaccgcccgacgcgggacgctgacttgctgggctttggccctgacgacgaggcgaacctgatcgccactttccgcgacatcgccgccatggacctgggcgacggcatcgtgtttgaccccgaatccgtgaaggccgacgccattcgcgaggacaacacctacggcggcacccgcatcacgctggtggcacgcatcggttccgcacgctgcgcccttcagatcgacgtgggcttcggcgatgccgtcacgccggggccacagacggtggcttacccgactctgctgggtgacttcccagcccccacgctgcgggtctatccggtctacaccgtgatcgcagagaaataccaggccatggtgatgctggggcaagcgaacagccgcatgaaggacttcttcgacctggcggtgatcgcacggcgcacggaactggacggtgccacactggcagcagccattgccgccacctttgcccgacgccagaccgccctgcccaccgggcggcccttggcactgacccagcagttcagcgaagacgccgcaaagctgcgtcagtggcaggccttcctgaacaagaaccgcatcgaagccgcgagcctgggtgagaccgtcgcactgctggacgacctgctgtggccaccgacgcaggtcgccaccgccagcagtcaggcaacggccacttggcgccctgaagccctgcgctgggtctaa

SEQ ID NO: 35 - DNA, 873 bp, Agreia sp. PHSC20C1
atgactcctgagcagaccttcagtgcattgcaacggattgcccgacaagagggccgcgctgtgcaggagcttctcaccctgtatgtgttggaacggttcctggcacgcctggttgagtccccctacgcggactcgttcgtgctcaagggcggagtccttcttgcgggctacggtctccgccggccgacacgggatgttgatatgcaagcaatcgacttcgtgctcgacgaggagcactgcgggaaggtggtcgcagcggtagcaactgcggaggcagacgatggcgtcgccttcgacgcgatcccgacacgcatcgaacagatccgtgacgaagaggagtattcgggactgcgggtgcatgtccgggcgcagctccaccggtcgcccatcgccctcaagctcgacatcagcaccggcgatccaatctcaccgcacgcgcaactcgtgacaatgccacgcatcctcggtggtgagttcacggtgatgggtcatccgcccgagacggtcattgcggagaaggcagtcacgattcttcaacgtggtgccaccagcacgcgctggcgcgactacatggacttgcgatcactcgccctcagccggagcttcagcgcggcaaccttgggcaaggcgatcgaggaagtcgcgaagcaccggacggtcgaactctccgccccttcgggatcgctcaacggacacgacgaagttgcacagcagaagtgggctgcgtggcgcaagaaaaccgatgttgaagacatcacgctgcctgtcctcgaggatcagctcaccgaagtgtgcggattcttggatccgattttcaccgacgaagtcgaacctgcggcggcgtgggatccaacttcgaaaacatggcattga

SEQ ID NO: 36 - DNA, 876 bp, Asticcacaulis excentricus CB 48
atggataagctcaaagcgaacagggcggcctcagtaaaagacaagctcctaaggctcgcaaaagcccaggggcagccattcgacgtgatgctggtcagatacggcctggagcgacttctttatcgcctttcgatctcaagatatcggaaccgattcatcctgaagggcggcctgcttgtaactctttgggtggatgacgctatgcgcgtcaccagagacgtggatctgcttggccagggcgaggataatcaagacctcttaaagggaacattctctgagatattgtcgattgaagttgacgacggcctgatatttgactctgcgaacttaatcgccgaggcgatccgcgaggatattaaatacggtggcacccgccttaagaccttagcgttccttgagaggacacgcatttcgatcactatcgacattggttttggagatgcggttacgccagcgcccatggatatcgacttccccaacctgctggataacgaagtatcaaacgtcagagcttatcctcccacaacggttatcgccgaaaaattccaggccatggtcaacctcggcctaatcaacggccgaatgaaggactattacgatctttgggccattccgcagagcctgagcatcgatcagaatgcactggacgcagcaattgaagctacgttcagccgccgcggcacagccgtaccaactgagacgcctcctggcctttcagacgcaatgtacacatctcccgataagcttcgccaatgggatgcctatgcacgttccattgcgtttgatggcccgcctttccgggagatcgtccagacgatttgggaactggtgggctccgcttgctcacgcatcaatgccaacgccattcgcaactaa

SEQ ID NO: 37 - DNA, 1125 bp, Bradyrhizobium japonicum
atgtcgacgttcctatcacggatccggcgaggacaattgtcgattgctttcgctaccgaaccaagatcggccttgacgtcgcgatggaggggctgcgcgaaggcctccgccgtcgccgatgcaagccggatcaactctggcattacgctcgcaaggcgcgggtctggtcggtcatgcgtccctacgtcgaagcaatggtgtccgatggcgcgtgagcctcgcaacatcggcgcatcagtgcgagcgcggctcctcgatcgggcacgtgccgagcgatcggacttccagattctcctgacgcgatatgcgctcgagcgtctgctctaccggctaagcgcgtcgccgcaccgcgaccgcttcatcctcaaaggtgcgatgctcttcgtgacctggatagccgatccgtttcggcctacgcgcgatctggatctgcttggccacggcgaccgcgacaccgaagccattgccgaaaccttccgggccatttgtgcgcagccggtcgtcgatgacggtgtgacgtttgatgtcgcagcgctgatggcgaccccgattcgtgaggagctggaatatggtggcgtgcgggtccgcacaacggcaactatcgccggggcgcgtattccgatccaggtcgacatcggtttcggcgacgccattacacccgcggcggtcgagatcgactatcccaccctgctggacgccccaacgccgcaccttcgcgcatatccggtcgaaacagtggtagctgagaaattcgcagcgctcgtgacgctcggcgtggccaacagtcggctcaaggatttctatgatctctgggtaatctcccgaacattcgagcttcgccgggccgctcttgccgaggcaattcagcggaccttcgagcgacgcggaacggtcctcccatccgttgtcccggtcggtctgaccgatgaattcgcggaaacatgggccgcccagtggcgcgccttcctggagcgcgatcggatggcagccgcaccggatgcttttgccgttaccgtcgccgatctccgcctcttcttgatgcccctggtcgtcggattgaaagaagaacgaatttggccgccgagcgggccatggtcgccgggagcagcaatcgatgaggcatag

SEQ ID NO: 38 - DNA, 729 bp, Brevibacterium mcbrellneri ATCC 49030
gtgactccggcgccgaaccgtaacacccgcgccggtcaggtgtataacgacttgcgcaacatcgcccgcgcccaccgtcgcgatccggcagagtacttcaccctgtacgccctcgaaggattcctcgtccgcctggttgcttcaaaggtttcgaacgacttcgttctcaaaggcggcgtgctcatgactgcgttcgccgtgcgccgacccacccgagacatcgacctcgccgccaccgggttccccaacgacatcctcgacgttgaggctcgtgtccgggagatcatcgttcaacaacccgatgacggcttggtcttcgaactcggctctgtctccggtgagtcgatccttgatgacgcggtctataccggcgtccgtgtcaaactcaacgttcgtctggccaccgcacgtattgctttgcacgttgacgttaactttggcgatccgatctggcccgcaccggtcgagcaggaactgccatgcttacttggtggaacgctccgcttgcgcgggtaccccgaccacatggtgttcgccgagaagatcgtcaccgctctcgaccgcggcgaggtgaacacccgctggcgcgacttcgtcgacattgcttggattgtcggcacacgccgaacccgtgctggaccgcagagcaacgggcacgacctgggatccgcggtcgcggtcctgggaaagcctccggtagcgcttctccaggcggatctgagtggctga

SEQ ID NO: 39 - DNA, 924 bp, Candidatus Accumulibacter phosphatis clade IIA UW 1
gtgagcgttcggaacatcggagctgccatccgtaacaggctgctcaataaggctcgtgccgagaacctggactacaatctgctgctgaccagatatgcactggagcgcatgctctaccgcctgagcatctcggaacaacgcgaccagctcgtgctcaagggagcattgctgttcgatctgtggttcgatgtgccacaccgacccacccatgacgccgatttactcggttttgggccggccgagattccacacatcgagcaggtcttccggagtatgtgcagcattgaggtcgaggacggcatcgtgttccagcccgactcggtgaaggccacagagatccgcaaggaggccagctactctggcctccgggtcacgctggtggggatgttggacagcgcccgctgcccggtgcagatcgatatcggttttggtgatgccgtcgtgcccggcccagatgaggtccactatccggtcatcctcagcgagatggccgggccacaactccgggcctatccccgctacaccgtagtggcggaaaagctggaggcgctgacctcacttggaatgctcaatagccggatgaaggatttcttcgatctgtgggtactggccaggcattctgacttcgatggcccgatcttgtcgcgggcggttgcggccacgttcgagcgtcggcgcactcctatcccccatggggcgccgatcggcttgagcgacgagttcatcaatgacgcccagaagaacaagcagtggcaggccttcctgcgcaagaacgcgctagatccaatgccgctggcgaaggtgattgccgatctgcgggagtttctactgccggtgttggcgtcagtcgaggcgagtggcagccacgatatggcctggtggtgccgagaaggatggcggcaactgaccgagcacggcacctga

SEQ ID NO: 40 - DNA, 870 bp, Parachlamydia sp UWE25
ttgtacgacatgacaacagacttagaaaaatcatttaaagctaaacttagaactattgcaaaagaaaaaaatcgagatcctgcagatctttggcaatctctgacattagaacgcttccttgtccgcttagctaggtcgaaatatcgcgatcaatttgtattgaaaggcggcatcctcctgtctagatacctagagattggaagagaaacaaccgatttggattttttagctaaaaaaatcagcaatcaagttttgtctttgcgggttgtttttgaagaaattgcggagattgatatcaatgatggattcatctttaaagaagttaaggctagcgaattaacccatcctcacatggggtatccaggcgttgaaatttctataatggcttattttgggcgtactcgatttaaggtcgcaatagatattggctttggagatattgttgaacctattgaatataaaattagactcacaaattactcaaagggtgatctttttgaagacagcgtcgaattggcttgctatccgaaagaattcatctttgctgaaaagttagagactatcatacatcggggatctttcaatagtcgtatgaaggactttcacgacatttactccatgatattgtcatcagcacttctctcatttaagagtttagagaatgtcattcggattgtattcaaacatcgagaaacagagttacttttaccaatttcttttcaagaggatgaaattatccgtatgcaaagtttttggagtgagtatttaaagagtttacgcgaagagaatgttgaaggtcttccgtcattgttttcggatctcgtaacaaaaattaaccagtggcttaaattgaacaccaagttcatctaa

SEQ ID NO: 41 - DNA, 921 bp, Chlorobium limicola DSM 245
gtgagtgcaaaagcgatcaagaatatcggagcttcggtcaggcaacggctcttgaacaaggcacgacaggatcacaggccttttcaggagctgctgcagtactatgccatggagcgctttctctatcgtctgtcggtttcctcattcgcagatcgcttcattctcaagggagcattgctgcttcgtgtctggcaagctcccttggcaagacctactatggatatcgatatgctgggcagaaccgcaaacgccccggagaagatcacgaccattatccatcaggttttggcagtcgaagagcaggaagatgggatcattttcgatcctgactcaatcactgtcgagccgataactgaagatgcggactatgagggattgcgcgtgagatttcgtggacattgcgatgctgcccgtctgaccatccagcttgatattggatttggagacaaggttttcccggagcctctacaggaatcgttaccatcattgctgaattttcctccggcggagatgtactgttacagcagggaaagcatgattgccgaaaagtttgaggtgatggccaagcttgggatactcaacagcaggctgaaagacttctatgatatctggatgctgtcacgccagtacaactttgaaggcggcaggcttgccgaagccatcaagcagacgtttgagcaacgggggacaatacttgttcaacctcaggagattatttccctgaagtttatcgatgaaaagcaggtgcaatggactgctttcaggaagcgtatcggacttgaatttttgcctgaggacttcaatcagatcgtgcagcagttggaactatttctaaccccaattgtcaaagccttgatcgaaaaagagagctatggagatagctggattgctccggatacatggcagagaaatcagcgatag

SEQ ID NO: 42 - DNA, 939 bp, Chlorobium phaeobacteroides DSM 266
gtgagcgcaaaagagatcaaaaatatcggagcctcggtcaggcaaaggctgttgaacaaggcgcgacaggaaaacaggccttttcaggagctgttgcaatactatgccatggagcgctttctctatcgtctgtcggtttcttcattcgcagatcgtttcattctcaagggggcattgttgctcagggtctggcatgctcccctggcaagaccgacaatggatatcgatatgctcggcaaaacaggaaacgccccggagagtatcacgacgattatcagtcaggttttagccgttgaaaaacaaggagacgggatcgttttcgatccggaatcaatcaccgttgagccgataacggaagatgcggactatgaaggattgcgcatacgatttcgcggtgatctcgatgccgcccgactgactattcagcttgatattggatttggagacaaggtctacccggatcctgtaaaggaatcgttaccatcattgctgaatttccctcaggctgaactctactgttacagcagggaaagcatgattgccgaaaagtttgaggtgatggccaagcttgggattctcaacagcaggatgaaggacttctatgatatctggatgctctcacgccagtatgatttcgaaggtgtcagtctcgcagaagccatcaggcagacgtttgcgcaacggggaacaacgctcgtccagatgaaagaaatcttttccggagagtttattgatgagaagcaggtgcaatggaatgccttcagaaaacgtattggtcttgaatacctgccggcctcgtttgctgatgtggtacagcaggtgcaggtatttctatctccagctgtggaagcgctcagggcaaatcgactttttcaggacaattggattgctcaggattcatggcggagtagtcatgaaaaaccagaggtgggagcataa

SEQ ID NO: 43 - DNA, 663 bp, Prosthecochloris vibrioformis DSM 265
atgaaaaagaagccagtgaaagacacaagtgcctcggttcgggcacgactgttgaatcttgccaggtcgacaggaagagattttcaggaattgacagttcgatacactgtggaacggttcctttcaagattggctgagagtgagcaccgtgagcgattcattctcaaaggtgctatgctgtatataccatggaagcttgataacaagcggacaacaatggacctggacctgctgggattcggcagtcctgatatggaaaatctgaagaccgtatttcaggagatctgcggtaccgcaatcgaagatgatggactcgttttcaataaggacactgtaaccgttaccgggatccgtgaagcgtcagtttatgacggtgttcggattattgtgcgtgtgaatcttggggcaatgccaatacggctgcaggtggatgtaggctttggagatcaaattgtaccagcacctcaatcagcagagtttccggcacttctcgccgaacacggtccaatcattcgctcttactctcctgaaatggtaatagctgaaaagttcaatgccatgatcgttttgggaatggcgaacagtcggatgaaggattacttcgatatttggatgttaagccgaaatttcacaatcgaagcggatgtactccctagatgttaa

SEQ ID NO: 44 - DNA, 912 bp, Conexibacter woesei DSM 14684 uid43467
ttgaccgcgcagccgcctgtcgaccaggccgccgcagcggccttcaaggcactgcgggtcaaagcccgagccgagcaccggggcaacacccagccgctgctggtcgtctacgccgtcgagtccttcttgcgccgcctggcgatctccgactacgcggatcgcatggtcctcaagggcgggatgctgatggccgccaacagcatccgccgcatgaccagagatgccgacctctcgacccacggcctgcccaacgacgagcggcgggttcacgaagcggtcacacgcatctgcgcgctggagcccgacccacacgacggcgtcgtgatcgacccgtcctcgatccggaccgaggtcatgcgcgaaggggacgagtatcagagcgtccgctgcaagcagctcgccatcctcggccgagcgaggatccccttcgcactggacttctccttcggcgacccgggccaatcgaccgtgatcgacctggagtcggccatcgaccgccccgccgttcggctcgctgcctacccgctcacgctcaacctcgccgagaagatcgtcaccgccatgcaacggcgcgagtccagcacccgcgaccgcgacttcgccgacctctgggtcaccagccgccgacaccgcctcgacgcaaccgagcttcgccagcacatcctcgccgtcgcctcccaccgccagcagccagtgatcccgatggccgaggcactggcgcacatgcccgaccgccaacagccctacgccgcgatggtcgcgcgaatgtcgtaccagtcgccaccgccgcagcgctggagcgacctcatcgttggcgtcatcggacttgtcgacccgctcctggccgccaccagcgaaagcctctcccactggaatcccgcgacccttagctggaccaccgcgacgagatga

SEQ ID NO: 45 - DNA, 918 bp, Corynebacterium glutamicum R
atgagcaagaaaagccaagaaccacgcaactatagaaccggccgagcctcggcaaccgcaggtgcaggaattttctccaccattaacaaagctgatcgagttgccttttatgaccgaagcatcgtcttatcacgcatcttcgcaaacgaccccaactcgtgggtcctcaaaggaggcaccgccctaatatggcgagacacgacagcacgatccacccgcgacatcgaccttttcaacagcgcagccgaggacatcaacgaagcactgcacgctttacgcaactccttagagactatctctactgcaccaagcgatgttcacttagtcattgacagcgcaaaaatcgacgtcagcgcacaaggaaaccgtcaacaagcagctcttcaggttcgcctccagtccgcatccggcatgcccctgagcaacactccggtaaaaattgatctagtagttggatgccacgtaactggggaagtcgatgcacacccaacagatggactagaaaaagttcttcaatcccacgttccccacatccgtctgtacccaattgtggaccacctcgccgataaagtagctgccaccatgcaaagctacccctccagcgatggggatagtcccagtagtcgtgttcacgacctcattgatatcgcccatatcgctgtgacagaagaaattaacggtacccaactgctcgtagctatcgaatcagaacggattcaacgcggcttgccgccatacgagcagggattccaatgtcccccacattgggcagagttataccgcaagcgaaaaggaagcaaagggtcagctccccagtcctttgatgaagctgttgatatcgctaaacgtcttatcgactccgccatttttgggaaatctttaggcatgacctggaaagacgggtcgtggcatgcataa

SEQ ID NO: 46 - DNA, 846 bp, Delftia acidovorans SPH-1
atgagccgcgatatcgcagcctcgatccgtgcacgtttgaagcaatgcgcggacgcccgcaggcaggacttcaacctcacgctcacccactatggcctggagcgcctgctgtaccgcctgtccatctcgccccatgcggacagctatctgctcaagggcgcactgctgttcgccatctggtacgagcagccgcacaggccgacccgcgacgccgatctgctgggctttggcctggacgacgttgactcggcggtgagcgctttccgcgagatctgcgggattgccgtggacgacggcattgccttcgatgccgcgtcggtgcgtggaaccaccatccgcaaggaagccggctatggcgaagtacggattgacctgcgcgccacgctggacggtgcacgcatcacgctgcaggtggacataggcttcggcgatgccgtgacaccatcgccacaagccatccgctaccccgtgctgctcgacggcctgcccgcaccgcaactgcgcagctaccccaagtacaccgtggtggccgaaaaactccacgcgatatgcctgctgggcatggccaatacccggatgaaggactacttcgatctctgggtgttgatgaccgaaggcacgctggaccctgccgaactgcggcgcgccatgaaagcgaccttcgagcgccgccaactcgcgctgcccgcgggcctgcctgccggattgagcgatggtttcagcagcgatgcggccaagcaggcgcagtgggccgccttcctgaagaagaaccggcttgaagcgctggagctggcccctgtcgtggcaaggctgcgagaggaattccagcaatgcggcatcttctga

SEQ ID NO: 47 - DNA, 918 bp, Candidatus Desulfococcus oleovorans Hxd3
ttgaccaaaaaacaggtgaaaaatatctcagcatccatacggcaaaagctgctcaacaaatccagaactgatgcccgtccttttcaagaactggttcagtattatgccatggagcggtttctgtatcgcctggcacagtcccggcacgccaaccggtttattctgaaaggggcgctgatgcttcggatctggcaagccccggaaactcgttcaacgatggacattgatctgcttggcaaaacagataacaatgtgtcagcgctcatttccaatataaccgagatactctctgttgatgttgatcccgacggcctctctttctttcctgaaaacataatgggcgagcatattactgaggacgcggaatataagggagtaaggatctgctttccggcaaagctggatacgatgaagctaaatatgcagattgatataggcttcggcgatattatccatcccgcgcctgaaagatcagaaatacccaccatactggagtgcccggcacctcaattattgtgttacagccgtgaaagctcgatcgctgaaaaatttgaagccatgttgaaacgtagagagttgaacagccggatgaaggacttctgtgacatctggctcctttcccgctattttgattttgatgggaaaattgtgtcagaagccattaggttgacgcttgaacaacgcgggacagaacttccaggcaacataaatatagtcgccttttcgcacgagttcatcatagcgaaacaagtccaatggaacgcttttatgaaaaaactcagacaggatcatgttcctgctgagttcgaaaccatcgtcatgcaagtgaaaggatttatcagcccgataatctcggctttgattgcacgaaagacaccaccttcaaaatggactgcacctggtccatgggccttctga

SEQ ID NO: 48 - DNA, 903 bp, Desulfomicrobium baculatum DSM 4028
gtgacatccggcaagaacatctcggcatccgtcaggcaacgcctcttgaaccgtgcccaccacgacgacaggcctttcaatgagctcctgcaatactatgccatggagcgctttctgtaccgcctctcccgctctgcccatgcggaccgctttgtcctcaaaggggcgttaatgctcagggtctggcgatccccccaattcaggccgaccatggatatcgacatgcttggcaggacaaaccgcgaggaaacgctcattctccgtcaaatccgggatatcatgatgatggatgtaggcatggacggactttcgttcgacccagattcgctccggaccgagcgcatcaccgaggacgccgagtatgaaggaatcagagtgcgatttctcgggaccctgggcacggcacgcatcaacatgcaaattgacatcggcttcggcgatatcgtccatcccggccccgagatggcggaaatgcccacaatgctcgatttcccggccccgcgacttctttgctacagccgagaaagcgccattgccgaaaaatttgaagccatggtgtctctgggcgccctgaatagccgaatgaaggacttctacgacatctggctcctatcgcgtcaatttgactttaacggaaaggatttggtcgaggccgtcagattgacgttcaaacagagaggaactgtcttgcctgaacaaattgaagctttccgccgagactttgctgaagttaaacagacccagtgggcggctttccgcaagaggctgcagcaggaacatgtccctgtttcgtttcaggaggtcacgacggcgcttggaatattcctcggaccgatcgcaacgtcgatttcagaagagtcaaaaattccagaagcatgggctgcctcgggtccatggtcctga

SEQ ID NO: 49 - DNA, 960 bp, Eggerthella lenta DSM 2243
atgatggtgtgcaagaccccggcagctctggaaatggctataaaggccgcggccaaggcttctcccctcgaaaccggcagagccgtttccggcttctacttccacaggctcttatgtcgcgtgttcagcaagcctgactcccctttcatgctcaaaggcggccagagcatgctggcgcgcaccatggacgcgcgcgccacccgggatatcgacctgctttcggaggaggcagacctcgacgccgcgctcgccgagctcagagccctcgcagaagccgatctcggcgatttcgtggtcttcgagttcgtaggagccgtgccgatcaaggtcgaggacgagtaccgatcggggctcaaggtcgccttcgtgcccttgcttggaggaaagcggctgcaggaggtctcgatagatttggtggccgaccgcgttgcctgcggagagcctgagatagtgacgccggccgacaggatcgacgttgcaggcgttccgatgttcgactaccgcgtgtatccccttgcgaactccctcgccgacaagctctgcgccatggtcgagacgcacgacggcaaaccttcgtctcgcataaaggatctcgtcgacgttgcgatctacgcaactaccgtcgatatcgatggcggcgaactctgcaggcgggtgcgcagcgaggcgggcgcacgcggaatagtgctccctgacaggttctcggtgccggatgaatggaagcagctgtacgagggcgctttcaagaagctggttagccgtaccggtctttcttccgagctctccgacatcgcggcggccgaagcacttgccgcaagtttgttcgatcctgttttggctcgaaaggctggcgatctgcattgggatcacgagagtctgagttgggaaggccttgtcctcgagcatggcgaggatggacgccgcacctccgagcttctccgactattgcacgattgctga

SEQ ID NO: 50 - DNA, 960 bp, Eggerthella sp. 1 3 56FAA; identical to SEQ ID NO: 49

SEQ ID NO: 51 - DNA, 644 bp, Sinorhizobium medicae WSM419
atgccgcgtgagcctcgcagcatcggcgcatcagtgcgagcgcggctcctcgatcgggcacgtgtcgagcgatcggatttccaaattctcctgacgcggtatgcgctcgagcgtctgctctacaggctaagcgcgtcgccgcaccgcgaccgcttcatctcaaaggtgcaatgcttttcgtaacctgggtcggcgacccattccggcctacccgcgatctggacctgcttggccacggcgacagcggtgccgaagccatcgctgacacgttccgcgccatttgtgtgcaacccgtcgccgatgacggggtgacgtttgatgcggccgcgctgatcgcggccgcgatccgcgaggagatcgaatatggcggcgtgcgggtccgcacgaccgcaacgatcgccggagcgcgtattccaattcaggtcgacatcggtttcggcgatgccgttacgcccgcggccgtcgagatcgactatcccactctgctggacgccccaactccgcaccttcgcgcatatccggtcgaaacggttgttgctgagaaattcgaagcgctcgtaacgctcggtgtggccaatagccggctcaagcagctgcaccagatgctttcgccgttaccgttgccgatctccgcctcttcttga

SEQ ID NO: 52 - DNA, 870 bp, Sinorhizobium medicae WSM419
atggctaaggagatcagaaatgttggtgcctcggtgcgcgcccgcctgctgcaactcgccaaggcaagcgggcaaagcttcgatgtggttctgacgcgttttgcccttgagcggttactgttccggctcagccggtcaccccatgccggtcgtttcgtgctgaagggcgccatgctgatgatgagctggttcgacgatccgcaccgcggaacgcgcgacctcgaccttctgggctttggtaatcccgagccggacccgatgctggcgacctttcgggaaatcctggcgcaagaggttgatgatggcgtcatgttcgatgccgacaccctgcgggtggatcgcatccgtgaggagctggaatatggtgggctccggctacgggcggtcgcttcgatcagcggcgcccggatcaacctgacgatcgacatcggcttcggcgatgcgctagagcccggggcggagatgttggactatccttcaatgctggatttcccggcgccacgactccgggcctatgcgcgggagacagtcatcgccgagaagttccaggcgatggtcatgctcgggcgtgtgaacagccggatgaaggacttctatgacatctggattctcagcaggtcttttgatttcgatgatgacaggctggcgcgcgcaatcgccgccaccttcgagcgccgcgaaacgccgatccctgaagacctaccggatgctttgacggatgcttttgctaaggacgagcaaaagcaacggcaatggcgcgcttttgtcgaaggcgttgcgcacaatccgggggatctgacgaatgtcatcgcggagattgcttcgttcctgatgccgcacgctattgcagccgcgaagctgggaaaataa

SEQ ID NO: 53 - DNA, 644 bp, Sinorhizobium medicae WSM419; identical to SEQ ID NO: 51

SEQ ID NO: 54 - DNA, 774 bp, Gemmata obscuriglobus UQM 2246
gtgcagctgaagttcgtaatcgagcgactgctcgcacggctcttcgcgggtgaaaatccgccgtggctgctcaagggcggattcgcgatggacctgcggtttcgaccgcgagcgcgaacgacaaaggacgtggacctatcggtctcgctcatcactggtgggggcgacgcacggtccgccgggctgcgagatcggctgcaagaggcgctcgacgtcgacctcggcgattatttgacttttcgcctcggaacccccaagcgcgagctcacaaacgcgcccggcggtggagcgcaatttccctgcgaagcggtactggttggcaagacgtacgccgcgtttcacatcgatgtgggcgttggggacgcgctcatcggtacccccgagcggctcgtcggagaggacctgctcgagttcgtgggcgtgccaccggcagcggtgctcgcgattcccaaaccgcagcaatttgccgagaaggtccacgcctacacgtttccgtgggtcgggcggctcaacagccgcacgaaagacttggtcgacctggtgctcctcatcgaacgcggagcgcccgctgtggccgaaattcgtgcggcactcgtgaccacgttcaccacacgcagtacccacccgttgccagccgcactcgctcctcctccgccttcgtggaaagaggatttcgttgggatggcggctcaagccggaatctcgaccaccgattacctcgaggcgttcacgttgctcgagaggttttggtcaacgaacgcgcttgcgggttaa

SEQ ID NO: 55 - DNA, 204 bp, Gloeobacter violaceus
atgaaggacatggccgcctccgtgcgcgaccgcctgtacgcggagcaccggcgtcggggagaggagtttcagtttcttgtgacgcgctacgccctggagcgagtgctttaccggcttggccgctcccggcacgtcgagagcttcgtcctcaaaggagcgatgctctttgccatctgggccgacgaaccgcaccgggccacctag

SEQ ID NO: 56 - DNA, 1032 bp, Gordonia bronchialis DSM 43247
atggcctatgcgtcggaggatgcgtttcgcgccgggttgaaagctcgactggtgcgcgaagcccgcgacagcagattcagccgtgacgaactggcacgcgccttcaccctgcacctgttcaccgcccgactgttccggtcgtctgatgccaagcactggatactcaccggcggtaccgcactacagttccgggcaccccagcaagctcgcccgaccgctgacgcggacctcgccacccgcctcgacgccgaacacatgcaggagtcattgcagcgtgccgcccgacccggccccggagacttcgggcacttcgacatccgcatctcccccaccgacaaccctggactgttcgctggacacatccgatacatcgttgccggacaacgcttctcagacgcttccctcgacctcgccacgcaccgcgagatgctgttcgcagccgaggaaaccgtccctgagccagccttgcgggtcgacgaactcgatcccatgcccgtgatcaggatgcaggccgtggccgaagccatcgccgataaggttgcagctctctacgagctccacggaccccaagggcaaactccctcgacccgcgtacacgatctcgtcgacctggcgatccttaccggcacccaacgtgtcgatgccgcgcagttgcacacggcactgcgttatcaggaacaacgccgcgccatcacgatccccgtcccgctggtgctccccagtccgagctggcaacgggactatccggaccgcgctgcccacagcggagtgccgcgcgagctcggtaccgccgagcgcgcactggcctacaccaacaccctcatcgagccggtcttgtccggacgagtgacatcgggacaatgggaccccggcacaggggcatgggcgccgccgacccgatcgatcgccgatctgctcgctgacacccgtagcccgcaacgggctcacacacccacgccaccggccaccacaagccctacaccccaaccatattcaaccgaccgggcgcgcgacactgagcgtggattgtga

SEQ ID NO: 57 - DNA, 891 bp, Gordonibacter pamelaeae 7-10-1-bT, DSM 19378
atgatggcgtacgcaacccccacagccctcgaaatggcggtcaaggccgccgcgaaggcatcatcgcttgacaccgggagagccgtctcgggtttctacttccatcgattcctgtgccgcatattcagcaggcaggacacgccttttgtgctgaagggaggccagagcatgcttgcacgtactgcggatgcacgagccacccgagacatcgacctgctttctgagaaagcggatatcgacgaagcgctcgccgaactcaagcatcttgcagccatcgacctcgaggacttcgtaaccttcgaatttgtcggatacaagccgatcaaggccgaagacgactaccgagcaggactcaacgtcacctttacacccttgcttggaggaaaacggctgcaggatatctccatcgacctcgtgttcgatcagatcgcgtacggcaaatccgaggttgtcgagccagccgacagaatcgacgtaccggatatcccgacgttcggctatcgcatctaccccgccacgtgctcccttgccgacaaactctgcgccatggtcgaaatgcatggcgacaggccctcctcgcgcgtcaaagaccttgtagacgttgcggtttacgccgtgaccaccgacttcgacggcggagagctttgcaggcgggcgcgcatcgaggcgaccgtgcggggaataaagcttcccgagaagtacgcggcgcccatggagtggaaacggctttaccgcggcaccttcaggaagcttgttcggcaaaccggtctgcccccggaatacgccgagatcgagacggcagaagcacttgcggcaagcctgctcgacccggtcttgtcgcaagaggccgacgggcggcgctggtaccacgaaaatctgggctgggagtaa

SEQ ID NO: 58 - DNA, 852 bp, Intrasporangium calvum 7KIP, DSM 43043
atggcggcgaatggcgctcaggtccttcgacagctgcaacggcaggcgctggcctcaaggcagaccggtgccacggtcacgaccggcgagttggtgacccgtcatgcgttggagtcgttcctggaccggcttcagaggactccgcacgggatggacttcgtgctgaagggcggcatcctgttggctggctacggagttcgccggccaaccaaggacgtggactgccaggctcgctccgcgtccgtaaccgctgcgcacatcgaaagagtcgtaagggatgtcgcgaccgtcgaggccgctgacggcctcgagatcgacttgggcagcctagatgtccagaccatccgggaagcggctgactaccccggccttcggatgcgggcgctcggcacggttggcacagcgcgggtggtcgtggcctgggacatctcgacgggggaccccgtcgtccccctgccgaagatggtgtccatcccccgagtcctgggtgagccgatcgagatgctcgggtatgcgcccgagacgtcggttgcggagaagggcgtcacgattctcgagcgtggcatcacgagcacgcgctggcgcgactacgtcgacatcgtgcaactcgccaaacacggtatcgaccgtagcgtgttgttggactcggcccgggctgtcgcgcggttccgccaagtcattcttcgtcccgtcgcggactcggttgccggctacggtgcggcatcccagccaaagtgggcggcatggcgacgtaaggaaggcctcgaggacgtgtgcgagccgaatctggacgaccagttgcttgaggtcatcgccgtcttggaccccgtgttctcctcggggtcggagtag

SEQ ID NO: 59 - DNA, 906 bp, Legionella longbeachae NSW150 uid46099
atgaaatcgcccaaaaatagtgccgcatcaatccgacagcgtttattaaatcattcgaaaacctaccaaaaaccatttaatgagattcttcaatattatgcaatggagcgatttctttatcgtctatcactatcccagcacaaaaataagttcatcttaaaaggtgcattaatgctaagagtatggaacgctccagagtccagaccgactatggatattgatatgctgggaaaaacaagtaacgatgaaataaatattgttcaacagatgaaagaaatactatcagttaatgttccagaagacggcctcgcctttgacgcaaccacaatgcaggcagaacggattaaagaagatgctgactatcatgggataagaatactctttaaaggcaatctcgatacagcaaaaattcatatgcaaatcgatattggctttggtgatgttgtctatcctgttcctaaaaaatcacttatgccaacaatcctggatcttccagcaccagaattgttgacttacagcagagaaactgccattgcagaaaaatttgaggcgataattaagctaggtagcctcaatagtagaatgaaagacttttatgatatttggatgttatccagacaattcgattttaatggtaaggaactttcagaagcaatacgcctgacatttgaaaaccgtaacactgtattatcagatgacattgaggcattttcaaatcaatttatacaattaaaacaaactcaatggctagcctttaccaaacggctcaagcaagagtatgtaccgattcaattccaagaaattattagtaaaattcaggcttttctttatccactggtattaacattctctcaacaaaatccaatgccacaaaaatggtgtagtattacatgtcaatggtcataa

SEQ ID NO: 60 - DNA, 852 bp, Legionella longbeachae NSW150 uid46099
atgacaaaaaatactggtgagtctgtacgctcacgtttgaagaatatagctattaaagaaggttctgattttaatgcggtattgactcgttatggtctagagcgtttgttatatcgaattggagaatcagaatattctaaacagtttttgttgaaaggtgccttattatttaacttatggtatgacatgcctcatcgcccaactaaagatattgatttattggggtttggtgataatgatctagcgtatgttaaacaaacgttcagtaaaatttgcagaatctctacagatgatggaataagtttcctgtctgaatcagtgacggttgacactatcaaaaaagatgggggttatactggagcaagagttgagttatttggggaattggcgaaagcaaagattaaaatacaaattgatataggttatggtgatgcagttacccctgggccaatagatgcccattatcccgtgcttcttagtgatcttcctgcccctaaaatctggacttatccaatttatacggtaattgcagaaaagctgcacgcaattgcattattgggcatggcgaatagtcgattaaaagactacttggatctttatgtattattaagtaatgaacagatagataaccaagtcttggctaaagctatacaggctacatttaatcgtcgaggtatggatcttcctgaagcgctgcctgttggcctgaccgatgagtttgctaacgatccaagcagggaatcaatgtggaaagcctttttgagaaaaaatgaactagagcagaaaccattaactgaagttattgctgtgatcagaaatttgattcaagtgccatattctttggcaaagtaa

SEQ ID NO: 61 - DNA, 192 bp, Lentisphaera araneosa HTCC2155
atgagcaaagctgcatccgttcaacaacttctacgtaatcaagctaaagctcaaggtattaatcctaatatccttcaggttcgttattccttagaacgttttctttatcgattgggtttaagtgaacacaaagatcgattcactttaaaaggtgcgatgctctttatcttgtggagtgataaatctttttga

SEQ ID NO: 62 - DNA, 840 bp, Lentisphaera araneosa HTCC2155
atgagtaaggccgcatcagttcaacagcttttacgcaatcaagctaaggctcaggggatcaacccaaacatccttcaggtccgttattccttagaacgctttctttatcgacttggtttaagtgagcataaaaatcgaatcactttaaaaggagctatgctttttatcttgtggagtgataaatcttttcgaccaaccaaagatgctgatttcctgatcacaggagatatttctcctaacaatattcaacaagttatcatcgacatttgtagtaccaaagtagagcaaggtgatgctatggaatacgatgctgaaagtatcaaaattatccccattaaagaaagccaagagtatcaagggcttcgagtaactctcaagtctaaacttggacatatacctatacctatgcagcttgatatgggaacgggcgacatcgtaacaccccctgcgacagaagccgacttcaaagtccttatagatactcttccagctcctagacttaaggtatataatcgtgaaactgtaatagctgagaaactacaagctatggttttattggacttggcgaatagtagaatgaaggacttctacgatgtctggatcatctgtacccaatttggttttgatgaagagatacttaaagaggctattgtatctacttttaagcgacgtggcacagactatccttctgaaggcattagttcactcactgaatacttctacgatgacccttctattaaaattcgatggaaagcttttactaaaaagttaaagcttgaccttagtttagaacaagtatgtattgatatcaaggggtacttggaggctattcttaagtga

SEQ ID NO: 63 - DNA, 885 bp, Mariprofundus ferrooxydans PV-1
atgagcggcaaaggcacaaatacggcagcctcaattcggcaacgactgctgaatatctcgcgtgagcagaaggtcaatttcaaccgtattctgaccgactatggcttacagcgactactgtatcgattgtccgtctcccggtatcgggatgaattcgttctgaaaggtgcgatgcttttctcgtactggagtggtgatgcattcagggctacgaaagacgctgatttcctcaagtccggagaagcatcgatggattacctcagagaagtgtttaccaatctatgcaatcagtctgtagaaccggatgacgggctgatatttgatcctgcgtccgtgagcgcagaagagatcagagaagaagatgcctatggtggcattcggatcacgatgacagcaaagctatcaggtgcccgtatctcgattcaggcggacataggtatcggcgacgtgattacgccagcggcacaggaaatcgagtatccggttcttctcgacatgccagcaccaaagctgaaagcctatccggtcgagaccgtcatcgcggagaagtttgaggccatggttcacctggggtttgccaatagcaggatgaaagatttctatgacatttgggcattatcgaagttcatgaaaccggattgcgacacgctggccatggcgatagccaatacattcaggaggcgtggcactgcgcttccatcagatacgccggtcgctctgaccggtgagttttcaagggatgatatgaagcagaagcaatgggctgcatttataagacgtgccgctgttggaaacagtgcaaaagcgacgctacatgaaacagtcgaagaaatcaggcctatgttgatgagtatggtggacattgcgagaaatggtaatggatga

SEQ ID NO: 64 - DNA, 942 bp, Methylobacterium extorquens AM1
atgtcgcccctcgcagcaagccgccgctcccttctgcagaaccaagccaacaagctcggcatcagcaacgagctggtgatgcgtcgctacgtgttcgaacggttcctggaccgcctcgccagctcggcccatcggggcgagctggtcctcaagggggcgatggcactcatcgccgtgacccaatccttcggcagacccacgaaggacatggacatgctcggtctgaatccgctttccatggaggacgccctcgagctaatccggcacgtggcctcgatcgcgcccgggcaggacgatgccgtcgaattcattccttcaagcttcaaggcgtccgtcatcaacgaggagaccgacgagcccggcacccgcatcatgggcgaagcccggatcggaaccgcccgcattccgatcaagatcgagatctcgcacggtcaggctatgacgccgggagcggtgctcatggactatccgaccgtcctcggcggcatggatgctccgaaggtgctcgtctacagcaaggagacgatgctcgccgagaaattcgaggcgatcgtcagcctcggcacccacatctcacgcttcaaggacttctacgacgtccggcagcttgcccgcaggttggccttcgacggcgaggtggcggcccaagccttcctcaacaccttcggcaatcgcggcacggacatcccggaaggggagctggcggcgttcgaccccgccttcgtgtcgggggcaggtcagcgtggatggtcttcgttccttcgcaagcaggtcatcagggacgcggcgacgttcggcgaggtggtcgacgagatccggccgttcgtcctggaggtggcggccatggcgcgcggcgaggccccgatccgcaactggacgcccggagaagggtggtcttcgccggaggaggtctacgcgccggcgccggggccgcgcccctga

SEQ ID NO: 65 - DNA, 840 bp, Mobiluncus mulieris ATCC 35239
atggatattctgggtttattgcgccagcgagcgcgggaggtcacgaggcgagacgggattcaaccccctacgcaagagatttatgttcactatgtgttggaaggatttttggctcggctagcggcttcgccctatcgtgaggacttcgtgctgaaaggtggcttgctgcttggggtctatacgggacgtaggtttaccaaggatattgattctaacgcggtgtctgccacagtggatgcggcagagctgcgcaccatcgccacaagtatcgcccggattgatattggtgacggggtggttttcaacccggaacgtttgactactcgcgagattcgtgagaccgatgattatccagggatacgcctgaaaatgcccgcccggattagttcttgggaaggcgtgtttgcatgggatgtttccacgggtgacccgatagttcctaatccgcaatggataactatttcgcatgaaccgggggagtctttgcaggtgttgtcctatccgcctgaagcgattatggctgagaaagtggtgacaattctggagcgaagcattacttcaacccgctggaaggattacgtggatattcttgatttatatcgtgccggactagatgagtcagctctagtcgcggcgctgaaagcggtggctcgtcatcggggagtggagctccgtccgattgctgggctcatggatggatacggggatgtgtatcaaaatcggtgggcgacatggcggaaaaaagaaaatctggaagggaaaaccgaggctaatctagatagtcagctagcaaaaatggctaccatactcgacccgatgctcgtttcggcagttgagtag

SEQ ID NO: 66 - DNA, 840 bp, Mobiluncus mulieris ATCC 35243
atggatattctgggtttattgtgccagcgagcgcgggaggtcgcgaggcgagacgggattcaaccccctacgcaagagatttatgttcactatgtgttggaaggatttttggctcggctagcggcttcgccctatcgtgaggacttcgtgctgaaaggtggcttgctgcttggggtctatacgggacgtaggtttaccaaggatattgattctaatgcggtgtctgccacagtggatgcggcagagctgcgcaccatcgccacaagtatcgcccggattgatattggtgacggggtggttttcgacccggaacgtttgactactcgcgagattcgtgagaccgatgattatccagggatacgcctgaaaatgcccgcccggattagttcttgggaaggcgtgtttgcatgggatgtttccacgggtgacccgatagttcctaatccgcaatggataactatttcgcatgaaccgggggagtctttgcaggtgttgtcctatccgcctgaagcgattatggctgagaaagtggtgacaattctggagcgaagcattacttcaacccgctggaaggattacgtggatattcttgatttatatcgtgccggactagatgagtcatctctagtcgcggcgctgaaagcggtggctcgtcatcggggagtggagctccgtccgattgctgggctcatggatggatacggggatgtgtatcaaaatcggtgggcgacatggcggaaaaaagaaaatctggaagggaaaaccgaggctaatctagatagtcagctagcaaaaatggctaccatactcgacccgatgctcgtttcggcagttgagtag

SEQ ID NO: 67 - DNA, 840 bp, Mobiluncus mulieris FB024-16; identical to SEQ ID NO: 65

SEQ ID NO: 68 - DNA, 360 bp, Mycobacterium leprae Br4923
gtgcagccagcccggtacgtaaccacttcggtacttaaaggcggtgtgctgttggccgcctccggtaattgccacccaacccgggacatcgatctgtccggtatcgacgtcaacaacgacgccgccacagttcttaacctggttcgccccgtcttcacaagtcgtcttcctgatgatgacgtcctgatataccaagctgattcggctactgccgaggtgaccagcaaagaggataactactccggtgtgcaagttaccgccaccacaacactggccagtgcacgcctgacctttcatgttgatgtcagcgttgggtaccccatctaccccccggtgcccaccattcgcaaaccaagttga

SEQ ID NO: 69 - DNA, 360 bp, Mycobacterium leprae; identical to SEQ ID NO: 68

SEQ ID NO: 70 - DNA, 852 bp, Mycobacterium marinum M
atgagtgccggcgatgcggtgtttcgccggatccagtccctcgcccggtccgcagcggcaaaggacgggaccggcgcaccgacgcaggagtacttgatccggcatactctcgaatcgttcctggatcggcttgcccgcagctcccatgcaggcgacttcgtcctcaaaggcggagttctgctggccgcctacggggtgcgtcgcccaaccaaggacgccgacgccaacgccgtccacgccgacgttaccgccgagcatctcgcccacgtggtccgtgacatcgccgtcatcgacgtcgaagacggggtggtgttcgacctcgaaacgatcaacgtgcggcagatccgcgatcaggccgactacccgggtcttcgtgtacgggtcgccgtgtcgatcggaccgtggaagggcgcggtggcatgggatgtgtccaccggagatccgatcgtgccgccgccccggcagatgaccatcgaccggatcctcggcgacccaatcaccctgcttggttacgcgcccgagaccgccatcgccgagaagggtgtcaccattctcgaacgcggaatcacgagtacccgctggcgtgactacgtcgacatcgtccagctcgcccgccgaggcatcgaccccgaagaactcctccgctcggcacgggccgtcgcccgccaccgcggcgtcaccctcgaacccgtcgcaccgcacctcgtcggctacggtgcagtcgcacaagcgagatgggccgcatggcgccgcaaggaacacctcgagtccgtctgcgaagaaaacctcgacgatcaaatcgctctggttacctcgagtctcgattacgtctttgcccacggtctcgaatag

SEQ ID NO: 71 - DNA, 852 bp, Nakamurella multipartita DSM 44233
gtggacggccgcatcgccgccgagtacttcaggctgtacgcgttggaggggctcctgctgcggctctcgcactccgtccaccgcgaccggttcgtgctcaaaggcggcgtgttgctggccgcctaccagctccgccggcctaccacggacatcgacttcgcggccctggccacctccaacgaccttgaggaaatccggcagaccgtcatcgagatcgcccggactccgctcccgcccgacctcgacgacggtcttgtcttcgacctgggcgcggtcaccgcaagagtgatccgcgaccaggatcaatacagcggcgtacgtgtacgactgggcgcccggctggtcactgcctgggaactgttccacgtggacgtcaacgtcggcgatcccatctggccggcccccgccgacgtcgaactaccccggttgctcgaccagccggcaatcccgctgcgcgggtatccgatggagatggtcctcgccgagaaggtcgtcaccgcgctacaactgggcatagccagcacccggtggcgggactacggcgacatctaccagctgaccggccgatacgacttcaactcagggctggtccgagatgccgtcgccgccgtcgccgcctatcgcgagatcgaactcacggccttgaccgacgagctggcgggctacgccgaactggcccagaccaaatggttcgcgtggcgatcccggcaggacctgatcgatcggctaccggcctccttcacccaggttcttaccgcggtcgccggcttcgccgacccggtgctcagcccgaccgacgacgtcgggtcagcccgatggagcccgcagacccgatcctgggtcgacgtctga

SEQ ID NO: 72 - DNA, 936 bp, Nitrosococcus halophilus Nc4 uid46803
gtgacccagcatcgcggccccaatcttgccacctcgattcgccagcgcctgctcaacgaggcgcgtgagacggatcgtccattcaacgaagtgctccagtactttgccatggagcgctttctttatcggctgtcgaagtcggatcatgcggacaagttcgtcctcaagggggcattgatgtttaccgtctggcaggcgccggtcatgcgtcccaccctggatatcgacctactcgggatcaccgacaacgacgtcgaggctatcgttgcggtcatgagagatatctgccgccaagacgtcgagaccgacgggctggctttcgatgtggccggggtcgagggggagcgcatcgtcgaggacgcggactacgccggcgttcgcgtgcggtttcggggaacgctgggaacggcccgcatcaccatgcaactggacatcggcttcggtgatgtcgttgtgccgaaacccgaagcggcggactatcccacgatcctggaccttcccgcccctcgtctgaggggctacagccgcgagagtgccgtcgccgagaagttcgaggcgatggtcaagttgggcgtggtcaacagccgtgtgaaggacttcttcgacatctggctgctgtcccggcggttcgacttcgatggccggacaatggcccaggccctgaccgagaccttcgtcacccgggacacaacgatcccagccgagcctgtcgccttgaccggcgacttcggcaacgacgccggccggcaagaccaatggcgggggttcattcgcaggagccggttgcagaacgtaccaagcagcttcgctgaaatcgtcgaagctgtcgccgttttcctcggcccagtcacgaaggcgcttgctgccggggagcgtttccaaggctcgtggaaggcgccagggccctggcgtggtcattatgccggcaacacgtaa

SEQ ID NO: 73 - DNA, 888 bp, Olsenella uli VPI, DSM 7084
atgtacaaaagcgccgctgctctggaaatggcggtcaaggccgctgctttatcatctcccctcaacacgagcagggccatctcctccttctatttccaccggttcctctgccgcgtgttcgccggcggtaacgatgcgtttgtcctcaaaggcggccagtcgatgctcgcccgcacgatcgatgcgagggcgacgcgcgacatcgacctgctggcgacaaggggcgacctcgacgaagcgctccgaagcctcatcggactggcgcaggagaatatggatgacttcgtcactttcgagttcgccggatcgaggcccatcaaggccgaagacgaacaccgcagcggcctctccgtgaggttcatccccatcatcggctcaaagcgcatgcagcagattgcgatcgacctcgtcatcgaagaaattcccctcgaggacacagagctcattgcacccgtggacagaatcgacattgaggggctgcagacttgcgactatctcgtctaccccgtggagaatgcattggcagacaagctttgcgccttggctgaaaagcacggcggaagagtatcctcgcgagtgaaagacctggtcgacattgcaatctacgcgacgacgtgctccatcaatggagataagttgcagaaatgcgtgcatcgcgaagcagccgtccgaagggtagccctgccgaaatccttcgccattcccgaaggctgggatgaatcccatgaggggcggttcgagaagatgtgcttgcagacgggattagctgattcgttttggagcattgacgcgtcggctaagctcgcccgcagacttttcgaccccgctcttgccggtttggcaaatgacatgacgtggagtccgcaaaagacagcttgggaggagtaa

SEQ ID NO: 74 - DNA, 939 bp, Chlorobium luteolum DSM 273
gtgagcgcaaatgctatcaaaaatatcggagcctcggtcaggcaaagactgttgaacaaggcgcggcaggaaaacaggccttttcaggagctgttgcaatactatgccattgagcgctttctctaccgtctgtcggtttcctcattcgcagatcgtttcattctcaagggggcattgttgctcagggtctggcaagctcccctggcaagaccgacaatggatattgatatgctcggcaaaacaggaaacgccccggagagtatcatgaccattatccatcaggttttagccgttgaaaaacaaggagacgggatcgttttcgatccggaatcaatcaccgttgagccgataacggaagatgcggactatgaaggattgcgcatacgatttcgcggtgatctcgatgccgcccgactgactatccagcttgatattggatttggagacaaggtctaccctgatccagtacaggaatcgttaccatcattgctgaatttccctcaggctgagatgtactgttacagcagggaaagcatgattgccgaaaagtttgaggtgatggccaagcttggcatcctcaacagcaggatgaaagacttctatgatatctggatgctctcacgccagtatgatttcgaaggtgccagtctcgcagaagccatcaggcagacgtttgcgcaacggggaacaacgctcgtccagatgaaagaaatcttttccggagagttcattgaggagaagcaggtgcaatggaatgccttcagaaaacgtattggtcttgaatacctgccggcctcgtttgctgatgtagtgcagcaggtgcaggtatttctatctccagctgtggaagcactcagggcaaagcgattttttcaggacaattggattgctccggattcatggcggagtaatcatgaaaaaccagaggtgagagcataa

SEQ ID NO: 75 - DNA, 939 bp, Pelodictyon phaeoclathratiforme BU 1
gtgagtacaaaagcgatcaaaaatatcggagcctcggtcaggcaaaggctgttgaacaaggcgcgacaggaaaacaggccttttcaggagctgttgcaatactatgccatggagcgctttctctatcgtctgtcgatttcctcattcgcagatcgtttcattctcaagggggcattgttgctcagggtctggcatgctcccttggcaagaccgacaatggatatcgatatgctcggcagaacaggaaacgcccctgagagtatcacgaccattatccgtcaggttttagccgttgaaaaacaaggagacgggatcgttttcgatccggaatcaatcaccgttgagccgataacggaagatgcggactatgaaggattgcgcatacgatttcgcggtgatctcgatgccgcccgactgactatccagcttgatattggatttggagacaaggtctaccctgatccagtacaggaatcgttaccatcattgctgaatttccctcaggctgagatgtactgttacagcagagaaagcatgattgccgaaaagtttgaggttatggccaagcttgggattctcaacagcaggatgaaagacttctatgatatctggatgctctcacgccagtatgatttcgaaggtgccagtctcgcagaagccatcaggcagacgtttgcgcaacggggaacaacgctcgtccagatgaaaaaaatctttttcggagagttcattgaggagaagcaggtgcaatggaatgccttcagaaaacgtattggtcttgaatacctgccagcttcgtttgctgatgtggtgcagcaggtgcaggtatttctatctccagctgtggaagcgctcagggcaaagcgattttttcaggacaattggattgctccgaattcatggcggagtaatcatgaaaaaccagaggtgagagcttaa

SEQ ID NO: 76 - DNA, 972 bp, Phenylobacterium zucineum HLK1
ttggcggttcgcggagatcgaccgggtccaaaccgtgatgcgcccctacctcgaggcgctcacgtgaatgacaagcccaaggacatggccgtctcggctcgcgcccggctgaccaaccgggcccgcgagcggaaggagaacgcccagctcctgatgacccgctacgtcatcgagcggctcctgtggcgcctcagcgtctcgccctaccggcagctcttcgtgctcaaaggcgccatgctcttcagcctctgggcgcccacgccataccgcgccactggggacctggacctcctgggtttcggcaacaacgaccccgatcaggtcgcgggtctgttccgagagttgatggtgatcccaggggacgacgggatcgtcttcaaaccggacaccatcgtggcggcggccgcgcgcgccgaggacgagtacagcggggttcgcctcgacttccaggccgaactcgccggcgctcggctcccgatccatgtggacatcggtttcggcgacgccatcacgccgggcgcacaggacatcgagtatccgtccctgctcgatctgccgccgccaaagctccgcgcctacccgccggagacggtggtggcggagaagttccaggcgatgaccgcgcttggaatggtcaactcgcgcatgaaggacttcttcgatctctgggccatcgccaacaccttcgccttcgagggggcggtcctggcccaggctatcgccgcgacgttcgcacgccgagagacgccgctgccgaaagagccaccgctcgccctcaccgctggcttcgcggaagccaagcaggcccagtggaccgcctttctgaagcggacggagatttcgctggcgcccgagcccttccccgagattcaggcccagatcgttgaactcgtgatggcgccgacgctccgcatcgcggatggcgagaccttcgcgggccgttggccgccgggtggcgtctggaccacgtga

SEQ ID NO: 77 - DNA, 882 bp, Polaromonas naphthalenivorans CJ2
atgacccatgacattgccgcttccgtgcgcgcacgcctgctcaacctggccaaggccgaaggttctgagttcaaccaggtgctggttcgctacacgctcgagcgcctgctgtaccgcctgagccagtccgcgcacgccgaccgctttgtgctcaagggcgcgttgctgttcacgctgtggtacgacatggcgcaccgcccgacccgggacgccgacctgctgggctttggcccaagcgacctggcctctatcgaccagatgtttcgcgacatcgctggcgttgccgtcgaggatggcatcgtctttgagccggccagcgtcaaggtcgaggacatccgcaaggaatccggttacggcggcgcgcgggtgctgatcacgggcgagctggcaaaggcacgctgccgggcccaagtggacatcggctttggcgacgcggtcacgccagggccggtgcaggcggtgtttcccgtgttgctggcagattttcccgcaccacagctcagaacctacccggtgtacacagtcattgccgaaaagctccacgctatcgcgctgctgggcatgaccaacacccggttgaaggactacctggatttgtcggtcctgctggagcgagaggcgctggacccgacgatcttggcgacagcgatcgctgccacgttcatgcgccggggcatggcggtgccggcgcaactgcccatcgggctgagcgatgagtttgccaacgatgcgacgcgccaggcgctgtggcgtgcctttctcaagaagaacgcgctgaccatcacgccgctgccggacacggtatcggctctgcacgcttaccttcatccggtgatcagacaagctgcgctgcagcaaatggatttgtcgaagacactttaa

SEQ ID NO: 78 - DNA, 339 bp, Polaromonas JS666
ttggccaagctcgacagcgcgcgcatcgcgctgcaggtggacatcggatttggcgatgccgtaacgccggcgccggaagcgatcagctaccgggtattgctgaacgacctgcccgctccacagctgcgcgcttacccgaaatacacggtggtggccaaaaagttccacgccgtgtgcctgctgggcatgaccaacacccgcatgaaggactacttcgacctgtgggtgctgttgggcgaaaacacacttgatccatgggagctgcgccgcgccatcgagaccactttcgaacgccgaaagatggccataacctcgcattgcatgggccgtccaaggtga

SEQ ID NO: 79 - DNA, 957 bp, Propionibacterium freudenreichii shermanii CIRM BIA1 uid49535
atgaagggccaagggccctacgtcgactggttcggcgtcgagagtgccatccagcaagcggcccgtcggcaggccgcggaccaccccggtgccagcgtcggtcagtatcttgaccacattcgcagggaccgcttcctctcccgcgtattcgccgatcctgaatcaggctggctcctcaaaggcggcaccgcgatgctggcccgcgtacccacggggcgccatacccgtgacgttgacctgtcaaccacacgagcaaccctcgatgaagccgtggaagacctcgcgcaccgggtcgcggtcgacatgggggaccatctgcggttccagttggagtcggagcgtcccggtctggccgtcacccagcccggcgtcctcgtcgccaggttgtcattcgcctgcatcacggacacggggaagcgattcgacaatgtcgcggtcgaccttgccgtggggccgcccccggtcggacatattgaacacacccggccggcggacagtccggaccttccccgactgatctccccgccctacgccatgtttccgctgaccgaccagcttgccgagaaggtcagcaccatgatgacgccccggcccgacgggcggcccaacagccgcgccaaggacctcgtcgacgtcgatatcatcgccgccacccaatacgtcgacctgcgcgagttgcgtcttgccctggccgtgcagcagcaacgcgccaacacggacctgggacgccacctccgggtgcctccccattgggagccccgctaccagtcattggccacgggaacctccgctgccgcggtcgcgccgacctttgcggatgccgtcgaccttgctgcaaggttcatcaaccccgccctggacgccgtccgcactgtcaggacgacgtggggaccagaggccatggaatggacggtcgggacgggaagccccgcagcaggcccgcatcgtggggtgtga

SEQ ID NO: 80 - DNA, 294 bp, Raphidiopsis brookii D9
atgagtgcgaaaaacctcaaaaatatctctgcttctgtccgtcaacgtcttctaaacagggcgaaagatgaacagcggccatttagcgagctacttcagtactatgcgatggaacgcttcctgtaccgaatgtcgcaatctcctcatgctgacaggttcattctcaagggggcgctgatgctcagagcatggcactcgaccgaattccgtttaaatgtgaaaaatgtcgaaaactctttagtgaagatttggattttgtgggcaagaacatatactagagctgttgggaaataa

SEQ ID NO: 81 - DNA, 870 bp, Rhizobium leguminosarum bv  trifolii WSM1325
atggctaaggaaatcagaaacgtcggcgcctcggtgcgagcccgcctgttgcacctcgccaaggcaagcgggcaaagctttgatctggtcctgacgcgtttcgctcttgaacggttattgttccggctcagtcagtcgccccacgccaatcgcttcgttctaaaaggggcgatgttgataatgagttggttcgacgacccgcaccgaggcacgcgcgacctcgatcttttgggtttcggtgatccgagtccggacccgatgcttgagacatttttggaaattctggcgcaagaggccgacgatggcgtcacgttcgatcccgatacgctgcatgtggatcgcattcgcgaggcactggactatggtgggctcaggctgcgggtgatcgctacgatcagtggagcccggatcaacctgacgatcgacatcgggtttggcgatgcgcttgagccgggagtggagatcctggattatccttccatgctcgattttccgatgccgcggctccgggcctatgcgcgggaaacggtcattgccgagaagtttcaggccatggtgatgctggggcgagtagacagccgcatgaaggatttctacgacatttggatcctcagcaggtctttcgacttcagcgatgatcggctggcgcgtgcaatcgccgctacctttaagcgccgcgagacatcgatccccaccaacctacctgacgccctaacggacgcctttggcaaggaccagcaaaagcagcggcaatggcgcgctttcattgaaggcgttgcacacaatcctggcgatctgacagacgtcatcgcggagattgccgcattcctgatgccgcacgcggttgcagctgcgaggctggaccaatga

SEQ ID NO: 82 - DNA, 846 bp, Rhizobium leguminosarum bv  trifolii WSM1325
atggcgcgtgaactcaagaaaaacgtaggggcatcggtgcgcgcccggctgctggatcggtctcgcgcagagcgtacggactttcagatcctactgacgcgctacgcgctcgaaagactcctgtaccggctgagcctatcggagcatcgcgaccgctttatcctgaagggcgcgatgctgttcgtaacctggatcgccgacccgtttcggccgacgcgggacctcgatctgctgggctacggcgaaaacagcccgaaggccatcgccgaaactttccatgccatttgcacgcagccggtggacgctgatggcgtagtcttcgacgtggatgcactcgcagccgcgccgatccgtgaggaagtcgaatatggcggcgttcgtgtccgtaccactgccaccatcggaggcgcgcgcattcccattcaggtggacataggtttcggtgacgccgtcacgcctggaccggtcgacatagaatatccgtcgctgctcgatgcgccggtgccgcgcctgcgggcctatccggtcgggaccgtggtcgccgagaaattcgaggcgctggtatcgctcggcatggcaaatagccgcctgaaggatttctatgatctctggctgattgccgagacgttcgagttggagcggtccaccctcgctgaggcggtgcgccagacctttgcgagacgagggacgggtattccgacggaggggccaacgggtctcagcgaagcctatgctgaggtctggatcggcaatggcgggcgttccttggtcgcgaacggatggcggccgcaccacccgccttgggcacggtggtcactgatctcggacgcttcctattgccgctga

SEQ ID NO: 83 - DNA, 1062 bp, Rhizobium leguminosarum bv viciae 3841
ttgcgatggaggggctgcgcgaggggctccgccggcgcaagaccacaagcgacgacctctggacatatgcgaaagaggccaggatctggtcgatcatgcgaccctatgtcgaagcgacggtggccgatggcgcgtgagctcaagaaaaacgtaggggcatcggtgcgcgcccggctgctggatcggtctcgcgcagagcgtacggactttcagatcctactgacgcgctacgcgctcgaaagactcctgtaccggctgagcctatcggagcatcgcgaccgctttatcctgaagggcgcgatgctgttcgtaacctgggtcgccgacccgtttcggccgacgcgggacctcgatctgctgggctacggcgaaaacagcccgaaggccatcgccgaaactttccatgccatttgcacgcagccggtcgacgctgatggcgtggtcttcgacgtggatgcactcgaagccgcgccgatccgtgaggaagtcgaatatggcggcgttcgtgttcgtaccactgccaccatcggaggcgcgcgcattcccattcaggtggacataggtttcggtgacgccgtcacgcctggaccggtcgacatagaatatccgtcgctactcgatgcgccggtgccgcgcctgcgagcctatccggtcgcgaccgtggtcgccgagaaattcgaggcgctggtaacgctcggcatggcaaatagccgcctgaaggatttctatgatctctggctgattgccgagacgttcgagctggagcggtccaccctcgctgaggcggtgcgccagacctttgcgagacgagggacgggtattccgatggagaggccaacgggtctcagcgaagcctatgctgaggcctgggatcggcaatggcgggcgttccttggtcgcgaacggatggcggccgcaccacccgccttgggcacggtggtcgctgatctcgggcgcttcctattgccgctgacccagcctgtggaaggggaatggcgctggaagccttatgagggctggattcagctgcaagtaaagcagcttggatatccaaagcgctga

SEQ ID NO: 84 - DNA, 606 bp, Agrobacterium radiobacter K84
atggctaaagagatcaagaacatcggcgcctcggtgcgcgcacgtctgctgcaactcgccaaggcaagtggccagagcttcgacctggttctgacccgcttcgccctcgagcggctgctcttccggctcagccggtcaagccatgccgaccgtttcgtgctgaagggcgccatgttgatgatgagttggttcgacgacccacaccgcggcacgcgcgaccttgatctgctgggtttcggtgatccgagcgcggagctaatgctggcgacgtttcgggagatcctggcgcaggacgccagcgatggcgtcgagttcgacgctgacgcacttcgcgtcgaccgcattcgcgaagagctggaatatggcgggctgaggctgaggacgacagcttcgatcagcggcgcccggatcagcctgacgatcgacatcggctttggcgatgcgctggagcctggcaccgaggaactggactatccttcgatgctggactttcccatgccccggctgcggggctacgcccgggagactgtcattgccgagaaattccaggcgatggtggcgctggggcgtgccaacactcggatgaaagatttctacgacatctag

SEQ ID NO: 85 - DNA, 714 bp, Sinorhizobium fredii NGR234
atggctaaggaaatcagaaatgttggcgcctcggtgcgggcccgccccctgcaactctccaaggcaagcgggcaaagctttgatctggttctgacgcgttttgccctcgagcggttgctgttccggctcagccagtcaccccatgccggtcgcttcgtgctgaagggcgctatgctgatgatgagctggttcgaggatccgcaccgcggcacgcgcgatctcgaccttctgggctttggcagtcccgaaccggacctgatgctgggcacatttcgggaaatcctggcgcagcaggttgacgatggtgtcatgttcgatgccgacaccctgagggtggatcgcatccgtgaggagcttgaatatggtgggctccggctacgggcggtcgcttcgatcagcggcgcccggatcaacctgacgatcgacattggctttggcgatgcgcttgagcccggggcggagatgctggactatccttctatgctggatttcccggcgccacgacttcgggcctatgcgcgggagacggtcatcgcagagaagttccaggcgatggtcatgcttgggcgtgtgaacagccggatgaaggacttttacgacatctggattctcagcaggtcctttgatttcgatgatgacaggctggcgcgcgcaatcaccgccaccttcgagcgccgcgaaacgccgatcccggaagacctaccggatgcttga

SEQ ID NO: 86 - DNA, 876 bp, Rhodomicrobium vannielii ATCC 17100
atgcctaacattgctgcctctgttcgcgctcgccttcgtaacgtcgcggccacgcgcaatgaacccgtcgaattgctgttgacgcggtatgtgttggagcgccttctctaccggctcagcaccaccgaacatcgcaagcgcttcgtcctaaaaggcgcaatgctgatgaggatgtggttcgacatgccatttcggccaacgcgcgacttggatcttcttggctttggtgatccagatccagaagcgatgctcgctattttcagaggcatatgctcgattcagcttgatgatggcgtcgaattcgacgctgagggtttacgcatccaccgcatccgcgaggacaacgagtatgggggtctgcggctcaaaacaatcgcgacgcttgcaggagcgcggattgccgttaccatcgacgtcggttttggtgatgccgtcgaacctgaaatcaccgatgtcgaactgcctgtgctactcgacctgccgcctccacgtctttacgcctatccgcgagaaacggtgatcgccgaaaagtttcaggcgatggtcaatctcggccgcgccaacagccgcatgaaggacttttatgatatttggcagctttcaattgcttacgactttcatggcgaaagcctgccgcgagccatcgctgcaacatttgcacggcgcaacacgccagttccttcggaaagccccgacgcgttgacggcggcgttcgccgaggaccttgtcaaacaacaacaatggaactcgtttttgcaggacatcgacgcgccgtttgtgcctctcgcagaaatccttgcagctttgaactcttttcttatgcctcatgcggaagccgctcggacgatagcggcttcaaaggggctgccttcctaa

SEQ ID NO: 87 - DNA, 873 bp, Rhodopseudomonas palustris DX-1
atggctagggagatcaggaatatcggcgcctcggtgcgcgcgcggctcctcaacctctccaaggcgaagggacagagcttcgatctggtgctcacgcgcttcgcgctggagcgccttctgttccggctcagccagtcacctcatgccgaccgcttcgtgttgaaaggcgcgatgctgatgatgagctggttcgacgatccgcaccgcgggacgcgcgatctcgatctgctgggtttcggagacccgagcgaagccgcgatgctggcgacattccgggacatcctcgctcaggacgccgaagacggcgtcgtgttcgatccggacacgctgcgtgtcgatcgcattcgcgaggagctcgactatggcggtctccggctgcgtgccatcgcctcggtcggcggcgcccggattaatctgacaatcgatatcggctttggcgatgcgctggagcctggagcggaagtcgtcgactatccggcgatgctcgacctgcccgcgccgaggctgcgcgcctatgcgcgggagacagtgatcgccgagaagttccaggcgatggtggcgttgggccaggccaacagccggatgaaggacttctacgacatctggattcttagccggtcgttcagcttcgatgatgacagacttgcaaaggcgatcgcagcgactttcgatcggcgcaagacagcgataccgaccgagcggcccgatgcgctgacgccggcattcgcggcggacgaacagaaacagaagcaatggcgtgcctttgttgaggatgttgcggttgatccaggacctcttgcgctggttattgaggaactcacaggcttcctgatgccacaggccagtcgagccaacgaattcgggcgatattag

SEQ ID NO: 88 - DNA, 867 bp, Rhodopseudomonas palustris DX-1
atggctaggccgccggtcaggaatgtcgccgcgtcggcgcgggatcgcctcgccaatctcgctcgcgagcgcaagcaaccgttcgagctgttgctgacgcgctatgtgctcgagcggctgcttttccgtttgagccagactcctcacggctctcgctttgtcctcaagggcgcaatgctgctgacaacatggctggaggcggcattccggccaacgcgcgatcttgatctgctcgggtatggcgatccagacccggacgcgatgctgggcgtattcacggacgtttgcgccatcgacttcgacgacggcgttgtcttcgacgttgctgcactcgagatcgaccaaatccgcgaagaacttgagtatggtggccttcgcatcaagaccaatgcgacggtcggcggagcccgagtgcgggttgtcgtcgacatcggctttggagatgcggttgaaccgcaagcggcagaagtcgatttgccggtgctgctcgatcagccgtctccccgcatccggacttatccgcccgagaccgtgatcgccgagaagtttcaggcgatggtcgcgcttggcagggcaaacagtcggatgaaagacttctatgatatttgggttctttcgcgtgactatcagtttgaaggcgaaagccttgcgcgtgccattgcagcgaccttcgcgcgccgacggacagagattccaacagagctgccggatgcgctgacaaaggcattcgccgaagatgccgcgaaaatcaagcagtggaaggcgttcatggagaatatcgaagtcgatgttgtgccgctggcggatgttgtcgcagatttggcggcgttcttgatgccgcgagcggcgcaggcgcgtggcgtgtaa

SEQ ID NO: 89 - DNA, 909 bp, Slackia heliotrinireducens DSM 20476
atggggtattcgtctccgaaagccttggagatggctgtgaaggacgcggccaaggcttcccctctcgacactaatcgcgccatcgcgggcttctacttccacaggctgctctacagggtcttcagcgagcccgggaccccgttcgtcctcaaaggcggacaggggatgctcgctaggaccgccgacgcacgcgccacgcgcgacatcgatcttgcgacggacagtatggacgtagacgccgcggtggacgagctcgagcgcctcgccgccaaggatgcagacgacttcgtcaccttcgaattgagaggcgtggccccgatcaaaggagaggacgcgtaccgcgacggctacaccgtggtcttcgacgcgttcatcggcccgaagagggtccagcgcgtctccgtcgacctggtggcggactcgatcgcaatcggcgaacccgactatatggctcccgccgacagaatcgacgtccggggaatccccgtgtgtgactaccccgtctacccgtcggcgcgggccgtcgcggacaaggtctgcggcattgtcgagcgccacgcgggccggccgtcttcccgcgtgaaggacctcatggacatcgcggcctacgcgctcaccgatgacttcgatgcagaaactctaggggccgcgctgaagcgcgaagcctccgcaaggcggctctcgctcggtagcgaattctcactgcccgcggaatggggagacgctcacgaggcgcagtactcgaagcttgcggtccaggcaaggatgtcccaggacatgtcaacgctctccggtgcgctatcaatctccagggcactactggatcccgtcctctcaggatcggcaacgggatcgtggagccatatcgcgcgcgcgtgggtggagagcatcgtacgggacgcactataa

SEQ ID NO: 90 - DNA, 837 bp, Synechococcus sp. RS9917
gtgaaggccaacagggccgcctccatccgccagcggttgctgaaccggtcccggcaggagcaggagaccttcgatgcggtgctgaaccgtttcggcagggagcggctgctgtatcggatcgggatctcggagtactgcgaccggttcctgctcaagggggcaatgctcttcgccctttggtacgacatgccgcaccggcccacgcgggacatggacctgctgggcttcgggccgggagagctgttcgtgctggagcgggtcttccgggagatcgcccagcagcgggtggatgacggcctggccttctccgagaccgtcacggcagcagagatccgcaatgaggccaactacgccggtgccagggtcacgttgctggccaccctggagcaggcccgcattcccctgcaggtcgacatcggcttcggagatccggtgacgcctgaggctgagcagatcgactacccggtgctgctggaagacctgccccctccgcgtctgggggcctatcccgtgtacacggtgatcgccgagaagctgcaggcgatcgtcagcctcggcatggtcaacagccgcctgaaggactacttcgacctgcaggttctgctggtgcgagaggagctcgatgcgcaggtgctggcggaagccgtgcggcgcacctttgccgtgcgctccacaccgttgccgcagcaggttcccctggggctgagcagtgagtttggcgaggatccggataagcaggcccagtggcgggccttcctgcagcgcaacgagcttgccgaaataccactgcctgcggtggtgtcgcagatccgggacggtgactgccagcaaagatga

SEQ ID NO: 91 - DNA, 933 bp, Syntrophobacter fumaroxidans MPOB
gtgacccaaaaccggcttcgaaatgttggggcgtccgtccgtcagcgtctcctcaacctttcaaagaaaaagtccgaaccctttgatctcgtgctgacacgctacgccctggaaagactattgtacagaatagggcgctctgaatggcgaagcagatttctgctcaagggtgccatgctgtacaccctctggttcgatgcgtcctaccgcccgaccagggacatggttcttcttggcttcggtccaggccaaatcgctcacctggaagggacttttcgtgccttgtgcgaagtcgccgtcgaggacgacgggctaacttttctgaaggagaacgttcgcggttcagagatccgaggtgagagcgagtaccggggagtacggatgcaagtgaccgcgatcctttcaggtgccgtcatccccctccaaattgacgtagcttttggtgacgtggttcttcctggtccggaggaagttcgctatccaacgattctggaccttccggcgcctgaagtcctcgcctacccaaggtacaccgttgtctccgagaaatttcaggccatggtgatgctcggcattgccaatagtcgcatgaaggatttctatgatattcgggaactggcacggcggttcgaattcgatggcttgctgctcagccgggcgatacgggctacgttcgaacagcgcaggaccgttctgccggcggagatcccgctggctttgacggaatctttctcccatgacagggtcaagatgacccaatggggcgcattcatccgtaagaatcgtctcatggaggagaaggtatccttgcaggaggtggcggtttttctgacgggttttctaatgcctcccgttcgtgccgcccaacagggagaagcattcgagatgatttggaccgctccgggcccttgggaaccgcgcaatccgacctga

SEQ ID NO: 92 - DNA, 693 bp, Variovorax paradoxus S110
atgagccgcaatctcgcagcgtccgtccgcgcccgcttgaagcagcgagccgatgccacgagacaggacttcaacctgacgctcacccgctacgggctggagcggctgttgtaccggctctcggtgtcgccgcatgcagccaactacctgctcaagggtgcgctgctgttttcgctgtggtacgaccagccgcatcggccgacgcgcgacgcagatctgctgggctttggtccggatgacgtcgacaccgcggtatcggctttccgcgagatctgccagatcgaagtggacgacggcatcgcgttcgacgcagcctcggtcaggggctcggtgatccgcaaggaggcgggctacggcggcgtacggatcgacttgcttgcgaagttggacggcgcgcgcctcgcgctgcaagtggatatcggctttggcgatgcggtcacgccggcacccgaaccggtgagctacccggtgctgctcgaagacctgtccgcgccgcaactgcgcgcctatccgaaatacacggtggtcgccgagaagtttcatgcggtgtgcctgctgggcatggccaatacccgcatgaaggactacttcgatctctgggtgctgctcaccgagggtgcgctggaagccgccgaactgcgccgcgcgatcgcgctgttgcgcggcgaattccagaagctcggaactgcctga

SEQ ID NO: 93 - DNA, 867 bp, Verrucomicrobiales sp. DG1235
atgaccaaaagcaatcttgcagcctccgttcgccaacgcctcctaaacaagtctaaagagaatagggaggccttcgatttcgtcctgtctcgctacgcaattgagcgattcctctatcgcctaagcctcagccagcactcgaacaccttcgtactgaaaggagccattctattctatttctggaaccatgaaatgcaccgcccgacccgcgatatcgactttctcggttctggcacagcagactgcgaaatactcgaacgaatcataacggagatagtaaccacgcccgcatgcgaagacggacttaccttcaacacctccaccatcaaggcggcgccaatacgcgaagaagcgttttatgacggcatcagagcaaaactgatcgcaaagctcggtaccgttagaatcccgatgcaaatcgatataggattcggcgacgccgttacacccgctccggaaacgaaacacattcaaagtctgatcaccgagctacccggaccggaagtcaacgcctacccgatgtattcagtaatagcggaaaagctcgaagccatggtcgtgcttggagagcaaaacagccgcatgaaggatttcttcgatatccattttctccttacgaaagaagaactcaacgccaactccatacgagaagccgtagtcgctaccttcaaacgcagacgaaccgacttgccgctaaccactccgccttcgctcttagtcgaattcgccgttctcaaacaaatgcaatggaaagcgtttttaagaagaaacaatctcgaatcaaccaacgaagacttctcaaagatacttgaggaaatcagagaacatttgccgataaactggatttctttgggcaaggagagctaa

SEQ ID NO: 94 - DNA, 924 bp, Xanthomonas oryzae MAFF 311018
atgaacgaacctgacaagagcaggcgcactgttgccgcgtcggttcgcgcccggctgctcaacaaggcccgcgccgaaagactcgacttcaacctgctgctgacccgctacgcgctggagcgcgtcctttaccgcctgagcgtttcggagcagcagggtcaattcttgctcaaaggtgcgctgctgttcgacatctggttcgacataccgcatcgcccgacgcacgatgccgacctgctgggcttcggctccaccgagatcccacatctggaagacctgttccgcagaatcagtcaaatcgccagcgatgacggcatcgtgtttcaggccgacagcgtgaaggccgccgaaatccgcaaggaggccaactacgcgggcgtccgtgtgacgatgatcggcctgctcgatggcgcgcgctgcacggtgcagatcgacatcggtttcggcgacgccgtgacgcccggcccggacaacgtgcagtacccagtcatcctcgacggcatgccgcagccgcaactgcgggtctatccccgctacaccgtggtcgccgaaaagctggaagcgatggtcaagctcggcatcctcaacagccggatgaaggactacttcgacctctgggttctcgccggacattccgacttcgacggtgcggtgctggccacggccattcgcgccacgttcgagtgcaggggtacggccatcccacccggcgcgccgctgggcctcaccgatgagttcggcctggacgagcagaagacaaagcagtggcaggcgttcctgcgcaagaacaccttggagccgatgccgctgaccacggtgatcgaagcgctgcgcgaattcgtgctgcccgtgctggccgcgctcgcggcaggcgaaggtttcgaccgccagtggcgcgcgggcgcgggatgggatgcggcctga

SEQ ID NO: 95 - DNA, 852 bp, Xanthomonas oryzae pv oryzicola BLS256
atgagcaacgtcgccgcttccgtgcgcgcccgcctgcggggcgtcgccaaggcgcagggcgtggatttcaatcaggtgctggtgcgcttcgcgctggagcgcatcctttaccgcctgagccagtccgagcacgcggatcgtttcctgctcaagggcgcgctgctgttcacgctctggtatgacatgccgcaccgggccacgcgcgacgccgacctgctgggcttcggcgcgagcgatctggagtccgtggcccagaccttccgcgacatcgccagcgtcgccgtggacgacggcatcgtgttcgacccggcctcggtcgtcgcagaagaaattcgcaaggacgccggatacgccggggcgcgcatcctcatcggcggcgagctggccaaggcgcggtgcaggacgcagatcgacgttggcttcggcgatgcggtcacaccggctccggtgcactcggtctatccggtgttgctggaagatctgcctgcgcctcgcctgcgcacctatcccgtctacaccgtcatcgcggaaaagctccacgccatcgcgcttctgggtatgaccaacagtcggatgaaggattacctcgacctgtcggtgctgctggaacgtgaatccctggacatcgatctgctggcgcaagcggtgaaggccactttcgagcgacgcggcatggccgtggccgctgctctgccgatcggcatgaccgacgagttcgcgcacgacacgtctcggcaggcgctgtggcaggcattcctcaagaagaacgaactcgcccccgaacccctggctgccatcgtggttcgactgcgggcggccttggaaccagcgttgcaccgggctgctcgatga

SEQ ID NO: 96 - DNA, 924 bp, Xanthomonas oryzae KACC10331; identical to SEQ ID NO: 94

SEQ ID NO: 97 - DNA, 924 bp, Xanthomonas oryzae PXO99A; identical to SEQ ID NO: 94

SEQ ID NO: 98 - DNA, 864 bp, Xylanimonas cellulosilytica DSM 15894
gtgagccccaacccgacgcgcgacacccccgcgggccgggcgtacaacgacctccgcaacctcgccaagtcgcacagacgcgacccggcggagtatctcgcgctgtacgcgctcgaatgcttcctcgcgcgtcttgcggcatccgacctcagcggcgacttcgtgctcaagggcggggtactgctcgccgcgttcgccgcacggcacccgacgcgtgacatcgatctggcagccatgggcttccccaatgacatcgcggaggtcgagcgccgagtccgcacgatcattgccgtcgatgcccaagacggtctccacttcgctgccgactcgatcagcagcgacgtcatccgcgacgaggccgactacaccggcgtgcgcgtccacctggtcgcaacgttggcgaaagcgcggatccccgtccacgtcgatgtgaacttcggcgacccgatctggccggcaccacaggagacagctctgcccaggatccttggaggcgaggtctggttgctgggctatccggcccacatggtcctcgcggagaagatcgtgaccgccatcgaccgaggagtcgcgaacacacggtggcgcgacttcgtcgacatcgccacgatcagccgaacccagaccttcgccgggcacgagctcgcagccgcgatccgcacggttgcccggcatcggcaggttgagatccggctcctcgccgaggaactcgccggtatgggcgatatcgctcagtcccggtggagtgcatggcggcgaaagcagcgcctcgtcgatggcactcccgaggcgtttcaagtgttgctcgacgacgtcatcgcattcgccgaccctgtgctgaacgcggccgacgaggaactgtag

SEQ ID NO: 99 - DNA, 873 bp, Opitutaceae sp. TAV2
atgagcgcgccgaaaaacattgcggcgtcggtgaaagcccgcctgcaaaacgcggccagccgacgcggtgaggatttcaaccttctgctcatgcgctatggcatcgaacgcctgctctttcgcctgagccaatccgcccacgccgaccgcttcctactcaagggggcgatgctgtttgttgtttgggacgaaaaaacccatcgccccacgcgtgaccttgatctcctcgggtttggtccctcggaaaaggaggatctgcaaaaaatctttcaggcggtggtgagcacgccggtggtggacgacggcctcgtcttcgatcccgcgtcggtgcgggccgaggaaatcagggaagacaacgcctatggcggcgttcgcatccggctgatgggcaagcttggaacggcggaagtcccggtccagattgatgtcggcgccggggacgtggtcacgcccgcgccggagacggcggcgtttccaacgctgctggatttcccggcgccgaaaatccgcacatatccggtttacaccgtcgtggccgaaaaattcgaggcgatgacgacgcttggcccggcgaacacgcgcatgaaggacttccacgacgtgtggtttctggcccggcgcttcaacctcgatgtcgcgatcctccggcaggcgatcaaggcaacgttcgcccgccggaaaacctcgctgccacaatttcccgaacccctcaccgaatcgcttgcgaatgatccggccaaacaagcccaatggacggcgtttattcggcgcaacggcctcagcggcgttccgggtcaattcagcgaagtggtggccgcattgcgaacattcatcgcgcctgtgctgcgtccttccggtcgcttgccgcagtga

SEQ ID NO: 100 - DNA, 2076 bp, Acinetobacter johnsonii SH046
atgaattataatgcaacacgctcattagaattattacaaacaggttcccaaaatcctcatgcagaattccgtgagggccaagaagctgcaattcaacatttagtagagtctacacaaagattattagttatccaaaaaacaggttggggtaaaagttttgtctattttattgctacgaagttattgagagaagctggtaaaggtcctgttatcttagtttcccctcttctctcactaatgcgaaaccaaatagaagctgcaacaagaatgggggttaaagcattttcaattacgcacgaaaatgatagtcaatcggacgagatccaaagcctaatggcacaagatcaagtcgatattcttataatatctcctgagagactaagtaatttagattttaaagaaaaaatcttaaataaatattctgcatatttttcaatgatagtgattgatgaggcgcactgtatttctgattggggccatgactttagacctgattatcgacttatagaacgtattttaaaaaatttaccacaaaacctacgtgttctagcaactactgctacagcaaacaagcgtgtaatggatgaccttgctgctattttagggcctaatataacggtacatgcaggtgatctaaatcgttcttcattgacattacaaactattgaacttcccacccatgccgaaaagttggcttggctaatagaaaatatacctaagctccaaggctctggaattatttacaccttaacaataagagatgcacaactagtaactcagtggcttacagaacatgatattcatgccgaggtatataattcaaaaatagaaggtagcaaggagtcattagaaaatgctttaattaataataaattaaaggttttagttgctactgtagctttaggtatgggctttgataagcctgatttagcatttgtaattcattatcaaatgcctagttcaatagttgcttactatcagcaagttggtcgtgcaggccgtgcaatagactctgcgtatggaattctattagctggaaatgaagatgatgaaatcagtaattggtttatagatagcgcatttccaacaagcattgaaatacacaatgtacttctagccttagaaaaggctcctattgggttaactgtacccaaaatgttaacccaaattaatatgagcagctctagaatcgaaaaaactttgaaagctctttctcttgaatacccgccactagtagctaaaatagggacacaatggcgccgcacacctattccttatcatgattcagtactgcaacgagctgaacgtttaacaactttgaggagagctgaactagaacaaatgcatgaatatgtcaaacttccttttggaagccatatgcattttctaattagagcacttgatggagatactcaatccattcaaccaccctctctaccacctctaccaataaatgtagatccagaatctatcaatatggcaaataattttttacatcggacaggggtacctataaaagttcgtcacaagtggccagatttgataggtatgccacaatacaatttaaagggtaggattcatgattcagaaaaagcgcaagaaggtctcgctttatgtctatggggagatgctggatgggctaagttagttaaaaaaggaagatacgaagatttttcttttgatgatgtattagttcatgagtgtgtaaaaatgtacaaaacttggaacttagattcatcgcctacatgggttacttgtgtaccttcattgaacaatccaactttagtaccaaattttgctcaacgtttagcaaaggaattaaatttaccatttgtccctatactaattaaaactgcgcatagaggtcagcaaaaatctatggcaaacttaactcaacaagctcttaacattgacggcagtttagcaatatcagataagccctcaaatggaccagttcttttagtggacgatattgtgaattcaggttggacctttactgtagctgcttggcttttacgtagtaacggaagcgggcctgttatacctttcgctttagcaacaacgggatataaataa

SEQ ID NO: 101 - DNA, 1395 bp, Arthrospira platensis NIES-39
ttggttgctcgaatatttaccccaacttcctggcagtggaattatttatacattgacggtcagagacgcgcggaaactaaccaattttttaaaaaaaaaggcattaaatccgccgcttatgatggtcaacttgacaatgaattgcgacaaaaattagaaaatgatttattggctaaccaactaaaagtcttagtggcaaccacagctttaggtatgggttttgataaaccggatttaggctttgttattcattatcaaagacctggttcagttgtccattattatcaacaagtcggtcgagccggacgtgctgtagatgaagcctatggtattttattaagtggaaaagaagatgaggaaatcactaattactttatcaaaaatgcctttccttcctcacataatatccaacaaattcttgaggcgctgctgactaaaaatgaattatcagtgcctgaaattgaacaaagtgtcaatatcggtcgtggtcaaattgagaaggtgttaaaattcctgtctttagaatcttctcccccggtagttaaacgcaagtcaaaatggtatgctaccccggcagcattacgttatcaactgaatagtcataaaattgatgaaattactcgtattcgagaggaagaacaggcggaaatgcgagactatatgaacagtcaagaatgcttgatgcaattcttacaatgttccctcgatgaccccaacccagcaccctgtggaaagtgtgcggtttgtttaaatcgacccttactcaaaactacctgtaaccaggagttagtcaaggaagctattgaatatttaaaacgcacctatcaaacgattgaacctcgccgacaatttcccaaaaatgccttacttgaatataattttaatggcaagattagtcaccaattacaagcagaagcgggacgcagtttgtgttgttggggtgatccgggttggggggaacaggtacaacaaggaaaatatcaaaataatcactttgatgataaattggtagaggctatggtggagatgattaacaaatggcaaccgcaacctttccctacatgggtaacttgtgttccttccctaactcgtccccatttggtgccaaattttgctgaaagagtagccgttagattaaatttacgcttccttccagttgtggaaaaaatccgtgaaacaccaccccaaaaaaagatgagcaatagctatcaacaagcccataatttagatggtgcttttcggattaattatcaggaagttcaaccagggtctgtatttttaattgatgatatggtagactcccgttggactgtaactataattactgcactgttgcgacagtcgggaagtggtcgggtttttcctgtggctttgacattaaattcttttaggtaa

SEQ ID NO: 102 - DNA, 2076 bp, Chlorobium phaeobacteroides DSM 266
atgatatataaatcggcaagggcattggagcttctgaggatcgcttcctgtaatcccgatgcaatgttccgtgagagccaggaggaagcaattcgatacattgttgaaggccgagggcggttgcttgttgtccagaagactggctggggtaagagttttgtctattttattgcgacacgcttgcttcgtgaaggaggaagtgggccagccctcttgatttcaccactgcttgccttgatgcgaaaccagattgaggctgcggaacgaatgggggtgcgtgctgctaccatcaactcagataatccggatgactgggctgaggtggaactgagcatcgcccgtaatgcgattgatattctgatcatttcacctgaacggcttgcgaatgaacgtttcagtgccaatgttctggctcgaattgcttcgcagatttcgatattggttattgatgaagcacactgtatttctgactggggtcacgactttcggccttactatcgattgctggagcggattgtcaaaagcttgccatcaaatctgagacttcttgcgaccacggcgacggcaaacaatcgcgttatggaggatctttccgaagtgcttgggccgtatttggaggtattacgcggtgatttgaatcgtccatcgctcaccttgcaaaccatattgttacctgatcaagcccagcgccttgcctggctttcagaacagcttgcggctcttcaaggccatggaattatctataccctcaccgttcgtgatgcaaacacggttgcagcctggctgaaaagtcgcggtttcagtgttgaagcttatacgggtgaaaccggtgatcgtcgacctgagtttgagcaggcactgctccataataaggttaaagcgcttgttgcaacctctgcgcttggaatgggcttcgataaaccggatctggcatttgtgattcactatcagatgccgggatcggttgttgcctactatcagcaggtagggcgtgccgggcgtgctcttgaatcagcatatggcatcttgctgagtggcagggaagagacggatatcacggactggttcatcaggagtgcctttccgaccaggcatgaggttaatgaggtcattaatgcgcttgaaaatgagcttgcagggctctcggtacccgaacttctggcgaaagtgaatctgagtaaaggacgtattgagaagactattgcattactttcgctggaatcacccgcccctgtcgcaaagcaagggagcaagtggcaattgacagcagccacacttggtgagggattttgggctcgtgcggatcgacttaccgcgttacgtcgtgatgatcaacgtcaaatgcaggaatatcttgcattgccctttgctgaacacatgggttttcttattcaggcgcttgatggcgatccaaataccgttagctttccgttattgcctccgttgccgatacttgctgatgcggctcttgttctggaagcggtcgcttttttgcgccgcaccagtttgcccattgaaccaagacttcagtggccggggggcggtatgccacaatatcaggtaaaaggaaaaatacctgtaaatttgcaggccgggcacggtaaaaccctctcggtttggggtgatgccggatggggcgaactcgtcagacaaggaaaatatcttgacaactgttattctgacaggttggttactgcttgtgttgagatgattcaaaaatggaatccggaaccagcaccggcatgggtgacgtgtgttccatcattgcgtcaccccgatctcgttccggattttgcgcagcgactggcagatgcgctgcatctgccattccaaaaagtgtttgtcaagagagaagagaggcccgaacagaaaacgatggcaaacagtacccaacaggcacggaatattgatggttcacttgcggtcaatggacaaacagtcccggaaagcccggttcttctggttgatgatgtggtggattctcgctggacattgacggtgtcagcctggcttttgagaaaatacggaagcggcgtggtttggcctatggcgcttgctcaaacaggatacgattaa

SEQ ID NO: 103 - DNA, 2094 bp, Cyanothece PCC 8801
atgacaagtcaactttatgacaaggctttacgatacctccgccatgctttaaataaccctaaagctaactttcgagacggacaatgggaagctatttcaaatttagtaaacaatcactctcgtttgttagtcgttcaacggacaggatggggtaaaagtttagtctattttatcgcaactaggctattacgggatcaaggagccggaaccagtttattaatttcacctttactagctttaatgcgtaaccaaattgcgaccgcacaacgaattaatgttaatgcagacaccatcaattctagtaatactgaggaatggaatagagttcaagaacaattattggcaggaaatattgatattttattaatttctcctgaaaaacttgctaatgatcaatttagagagaatattttgattaccattgcttctcgtattagtttattcgtcgtagatgaggcgcactgtatttctgattggggacatgactttagaccagattatcgtcgaattgcccgtattttacaagctttacccgctaatattcctgttttagccactacagcaaccgcaaataatcgagtagttaatgatattaaggcgcaattgggagacagcttacaaattagtcgaggaaacttaaccagacaaagcttaaagctacaaaacctctattttcctagtcctgctgcacgcttagcttggttagcacaatatattcctactttaccgagttctggtatcgtctataccctaacagtaagggacgctcaaagggtggccaactggttaaaacagcaaggaattgatgcagaagcttattatggagcgttagagaaaaaaatcagggaacctttggaagatcaactattaaacaatgaaattaaggtattagtagcaacaacggcgttagggatgggatttgacaaacccgatttaggttttgtgatacactatcagcgtcctggttctgttgttcactattatcagcaagtaggacgtgccggacgtgcagtagatcaagcttatggaattcttttaagtggggatgaagacgaagaaattagcaaatattttatcgaaaatgcttttccacctgaagttcacaaccaagaagttttaaatgctctagaatcggctcaaaatggcttatctgtacgagaattagagcaaaaattaaatctatcaaggggacaaatcgataaggtattaaagttactgtccttggaatctcctgcacttgtaagcaagcaagagtcaaaatggtatgcaacagccgtcaattatcaacccaatcgacaaaaaattaaacaattaaccgatattcgttacgaagaacaagatcaaatgcgggattatatgaagagtgacagttgtttgatgcagtttttagcctctgcattagatgatgaaaacccgacagtttgtggaaaatgtgccgtttgtttaggtaaatctttactgcctgtcacctattcccctaatttagttgatcaagcagtaatgtttctcaaacgcagtgatcacatcatcgaaccgaggaaacaatggccattaaaaggtgcattttcagtgtatcagttttcaggtaacattaaaccagaattaacagcagaaaatggtagagcattatgtttatggggagatgctggatggggacaattagtcaaacaaggaaaatatgaaactaatcattttgatgatcacttggtagaagcaatggcagaaatgattcaacgttggaaacctgaacctaaacccacttggataacttgtattccttctctaaatcgtccccatttagtgcctaattttagtcaaagattggctaatcatttacaaatactttttattccagtggttacaaaaatcaagaaaaatccaccacaaaaaaacatgagcaatagttatcaacaagctcacaatttagatggagtatttagcatcgatagggaaaaagtaatgccagattctgtctttttagtcgatgattttgttgattctcgttggacattaaccgtcgtttctgcactgttacgtcaaactggaagtggtcaagtttttcccacaactttagcgttaaattctttatcttaa

SEQ ID NO: 104 - DNA, 2073 bp, Dehalogenimonas lykanthroporepellens BL DC 9 uid48131
atggctgtatattcacgtgcccgggcgctggaactgctgagagtaggctgtggcaaacctaacgctaagttcagagaaggccaggaagaagctatacgccatattgtcgagggcaagggccgattgttggtagttcagaaaacaggctggggtaagagttttgtatacttcatagcagtcaagctcctgcgagaacaaggccatggcccggctctattgatctcccccttgctgtcactgatgaggaatcagattcaagccgctgagaaaatgggggtaaaggcggtaaaaatagattcaaccaatgaggctaactggactgatatcgaggaatctatcaagaataatgaaattgatattctgctgatctctccggaaagactggaaaacaaacgcttcaacgataaggttttatcaaagatttctgataaaatttctttaattgtcatcgatgaggcacattgtatctccgactgggggcatgatttcaggccgcagtaccggctcatcgaaagaataatcaaacgattaccacgtaacctgagaatgctggctaccaccgccacggccaataaccgggttatggacgatttgaaacagatactggggccacatctgatggtatcaagaggtgaattaaccaggtactcactggttctacaaacgataatcatgcccaaccaggcggaacgcctggcatggctggccgagtatgttccgttgttagagggaaacggtattatttatactctgacagtcagagacgcgtatcgagtagcgaactggctgaagtccagaggattgaatgtagaagcttataccagcgaatccgaaaatagagagaaactagagctggctttattgaataacaacttaaaagccttggtatcaacggtagctttgggtatgggatacgataaacccgacttggcctttgtcatccattaccagacgccgggctcggtagtcgcctactatcaacaagttggtcgggcgggacgagcgttaaaggccgcacacggtatattgttcagcggcgaagaagatacggatataacggattattttatcgacagcgctttcccttcacaggcagaggttagcgcgatactaaacgctttgttggaagagccaagcggtttaacaattgatgagttgactcagacagcaaacattggttacgggcgtataaaacaagccctgcagcttttatctctggagtctccggcccctgttgttaaagacggctataaatggcaactgaccgccgccaagataaatccagaattttgggaaagaataaccaggctgaccgaattacgtaaaacggaacaacgacaaatgcaggattatgtcagactgaaccacgaccacatggaattcctggtgcatgctctggatggagacatcaaccaaatatataaaccaagagccccgaaactctcagaagaaacagacccaaatctggtcaaagacgccgtcaggtttttacagcgcacggaacaagtcattgaaccacgcttgaaatggccggtaggctatcttccgatttacggtttgaaaggatatattccgacagaattccgtaacaagccgggcaaagcgttgtgtgtctggggagacgctggttgggggcaaatggtacgtaaaggtaaatatacagattcacattatccagatgaactggtaacggcctgcgtacaattataccggaaatggaacccgcaaccggccccggcctgggttacctgtattccttcaaccaggcatcctaacctggttcccgaattcgccgccagattggcgagggagttgaaactaccttttgtccaagtattgaagaaaagagaccaacgtccagaacagaaaacgatggctaacagttattaccaggcgctgaatctggatggctctctggaaatcaaggctgatataataccgaatgggccagtacttctggtggacgatatggttgattcaagatggactttgacgattgccggatggctattgacaacaaaaggcagtggaccggtgtggccgatggcgctgtcagtaacaagtggaaagtaa

SEQ ID NO: 105 - DNA, 2088 bp, Desulfitobacterium hafniense DCB 2
atgcaggctcaggcattaagtcttctaagaaaaatgattggcagggatgcggagtttcatcaaggacagtgggaagctatcgaatcagttcttcggggaaaaaagacactgcttgttcagcgaaccggatggggaaagagtgttgtctattttattggtgccaaattattaagggaaagaggtttgggtccaactataatcgtcagtccattactatccttaatgagaaatcaaatcgagaatgcagttaagatcggaatctccgctgaaaccattaatagcgataatacggatgaatggacagagattgaagagaagctgaaaagaaaggcggtcgatattcttcttttatctccggaaagattaggcaacaaggattttacggaacgtgtccttccttcaatagaaggagggatcggcatgcttgttgtggacgaggcccattgtatttcggattggggccatgatttcagaccggattatcgaaggatagttagaatcattaaacaattgccgcccaatgttcctttgatagcaacaactgccacggccaaccaaagagttgttgatgatattaaagctcagctgggggatgagttaaatagtattagggggccattgaccagggaatctcttcagttgcaggtgatcaaattagctgaccaggcagaaaggttagcgtggttgcatgaaaatataaacaagatggaagggtcgggaattatctactgtttaaccgttgcggactgcaataaggttgcgaaatggctgcgcggcaagggaatcaatgctttggaatatcatgccgacttgtcaaaagatgctaaagaaaaaagaaaattgagagaggaacgggaacggaaattactgaataatgaagtcaaggcactggtcgccacagtagccttgggtatgggcttcgataaacccgatctgggttttgttattcactaccaacgtcctggatctatcgttcggtattatcaggaaatcggacgggcggggagagctttggataaagcttatgcgattttgctgaatggtgctgaagatgatgagatagaagagtactttattcaatctgcttttcctacgccaaaagaaatgaatgcggttgtgaatgctatagagaaggcttcattaggaatgaccaaaaacaaaatcctcaaagaattaaatatgtcctacggaagggtagaaaagtgtttgaaaacattagaaatcgaaggaataatttataaagaaaagagcagttattttcgatctccggtcagctggctgccggattcaacgaaaagcagtgcaatcactaaactccgaataaatgaactggaagatatgagaaagttcgtcgatacggaagactgctacatgcgttacatttccgccaagcttgatgatccttatttaaaaaactgtggtaaatgccgtaactgcctggatactcaatttttcagtgaagtcgtctctcgggataatgtattggaggcaattcagtttttaaaaggagagtatctggatattgagcccagaaagcaatggcctgctggaattaaagctgaagcaactaaaaaaatacctgaagaagagcaaaactttactggaaaggcactatgttcatatggcgatgcaggatggggaagggtagttgccgaagataaataccgcaatgagtattttagtgatgaactggttgatgcttctttggccttattaaaaaacacattgttaaaagaagacttgggatgggtaacatcagtgccatcgcttcgcagacctttactcgttaaagattttgccatgagacttgctgaaaaaataggcttaccctacattgatgcaataagaaagactgaagacacaccatatcaaaagaaaatggaaaacagctatcaacagtgcagcaatgccctgcatggtttttcagttattgagagggtccccgagtctcctgtccttttggtggatgatatcatcgactctggttggactttaacggtttgtgggatattattaaggggagagagatctggaccggtatatccatttgccttagcaaaggcgtcagggttagaaggtggggaataa

SEQ ID NO: 106 - DNA, 2139 bp, Desulfitobacterium hafniense Y51
ttgatgagatctgttactcacatccgaaaagcaaataaggggggaataaatatgcaggctcaggcattaagtcttctaagaaaaatgattggcagggatgcggagtttcatcaaggacagtgggaagctatcgaatcagttcttcggggaaaaaagacactgcttgttcagcgaaccggatggggaaagagtgttgtctattttattggtgccaaattattaagggaaagaggtttgggtccaactataatcgtcagtccattactatccttaatgagaaatcaaatcgagaatgcagttaagatcggaatctccgctgaaaccattaatagcgataatacggatgaatggacagagattgaagagaagctgaaaagaaaggcggtcgatattcttcttttatctccggaaagattaggcaacaaggattttacggaacgtgtccttccttcaatagaaggagggatcggcatgcttgttgtggacgaggcccattgtatttcggattggggccatgatttcagaccggattatcgaaggatagttagaatcattaaacaattgccgcccaatgttcctttgatagcaacaactgccacggccaaccaaagagttgttgatgatattaaagctcagctgggggatgagttaaatagtattagggggccattgaccagggaatctcttcagttgcaggtgatcaaattagctgaccaggcagaaaggttagcgtggttgcatgaaaatataaacaagatggaagggtcgggaattatctactgtttaaccgttgcggactgcaataaggttgcgaaatggctgcgcggcaagggaatcaatgctttggaatatcatgccgacttgtcaaaagatgctaaagaaaaaagaaaattgagagaggaacgggaacggaaattactgaataatgaagtcaaggcactggtcgccacagtagccttgggtatgggcttcgataaacccgatctgggttttgttattcactaccaacgtcctggatctatcgttcggtattatcaggaaatcggacgggcggggagagctttggataaagcttatgcgattttgctgaatggtgctgaagatgatgagatagaagagtactttattcaatctgcttttcctacgccaaaagaaatgaatgcggttgtgaatgctatagagaaggcttcattaggaatgaccaaaaacaaaatcctcaaagaattaaatatgtcctacggaagggtagaaaagtgtttgaaaacattagaaatcgaaggaataatttataaagaaaagagcagttattttcgatctccggtcagctggctgccggattcaacgaaaagcagtgcaatcactaaactccgaataaatgaactggaagatatgagaaagttcgtcgatacggaagactgctacatgcgttacatttccgccaagcttgatgatccttatttaaaaaactgtggtaaatgccgtaactgcctggatactcaatttttcagtgaagtcgtctctcgggataatgtattggaggcaattcagtttttaaaaggagagtatctggatattgagcccagaaagcaatggcctgctggaattaaagctgaagcaactaaaaaaatacctgaagaagagcaaaactttactggaaaggcactatgttcatatggcgatgcaggatggggaagggtagttgccgaagataaataccgcaatgagtattttagtgatgaactggttgatgcttctttggccttattaaaaaacacattgttaaaagaagacttgggatgggtaacatcagtgccatcgcttcgcagacctttactcgttaaagattttgccatgagacttgctgaaaaaataggcttaccctacattgatgcaataagaaagactgaagacacaccatatcaaaagaaaatggaaaacagctatcaacagtgcagcaatgccctgcatggtttttcagttattgagagggtccccgagtctcctgtccttttggtggatgatatcatcgactctggttggactttaacggtttgtgggatattattaaggggagagagatctggaccggtatatccatttgccttagcaaaggcgtcagggttagaaggtggggaataa

SEQ ID NO: 107 - DNA, 2085 bp, Desulfotalea psychrophila LSv54
ttgaggtgcaaaatgaaagaaagagcaatagggtacctgcgaaatgcccttaataaaccagaagcaaattttcgtgatgggcaatgggaaagtattgagcagttgctgaataacaaacgggttttagtcgttcagcgaacaggttggggaaaaagcatggtatactttcttgcaactaagcttttgcgtgagcagggggctggtccgaccctattgatatcaccacttttatcgctaatgcgtaaccaagttgaggcggctacacgaattggtgttagagcaaaaacaattaacagtaccaataatgaggaatgggacaccgttcaaacagaactggaagccaatcaagttgatgtactgcttatctcacctgagaagttaggtaatgatgattttcgacagaatatcttatcaactatggctgataaggtaggattgtttgttgtggatgaggcacattgtatttctgattgggggcatgatttcagacccaagtacagacaaattgtacgggtgctccaagctttaccatcaaatatccctgttcttgcaacaacagcgactgctaataatagggttgtagatgacgttaaatcgcaattgggtgatgacattgaactcataagaggttcacttgttcgtcaaagccttagacttcagaatataacaatgccaagctctgctgcgagattggcttggcttgcccagaccattcctaaacttcctgctagcggcatcgtctacactttgacaaaaagggatgctgatagagtcactgagtggcttcaactagttaatatagatgctaaagcttactacaatggtgttcctaacagagaggatcttgaacaacagttatttcataatgaagtaaaagtactggtcgcaacagttgcactggggatgggctttgataagcctgatttagggtttgttatccattttcaaagacctagttctgttgttcattattatcagcaagttggtcgtgcagggcgggctgttgaagaggcatatggcattttattgagtggaacagaagacgatcagattacggacttctttatccgtagtgcttttcctccacaaaaacatatatcggaagtaattagggtgcttgatgaatcaaatgacggtctatcttcttactctatggaaaaagttttgaatcttcggactaaacaaattatgaacaccatagactatcttgctgctgagtcacccgcaccagttgtaaaagttgggacaaagtggaatgcgactgccacagcttcaacgtatagaattaaccaagaaaacatagatgcaatcactgccattcgtcgccaagaacagcagcaaatgcatgagtacatgcaacatactggttgcttaatggcatttctgcaagatgcactggatgatccagcacctcaaaattgtggaaaatgccaaaactgcgcaccagagttacggctcgatgaaagctacgataatgacttggccaataaggcgggcctttttttgcgccggagttatcaacccgttaaagcaaaaaaaaaatggccaccccacaacccgttaccaacctacaatttttctggcatgatacgagagaatttaatagcatctgagggtcgtgcgttaagtctctggcgtgatgccggatggggcgaattgatttataaagggaaatatgaggataatcatttttctgatgtcttggtgacagcttgtgtggaaatgttgcgagaatgggcacccgaggaggcacccaaatgggttacttgtataccatctatcaaccatcctgatttggtaccaaatttcgcaaaacgtctggctagggcgttagagataccgttcgtagattgcgttgtaaaagtacaaaataatcaacaacaaaaaactatggaaaacagctttcaacaagcaagaaatttggatggtgtttttaaggttaatctcgaatctagagcatatagcccatgcttgcttattgatgacatggttgattctggttggactttcactgttgcggctgccctattacgacaagttggttgcaccgcagtttatcctttagctctagcgctgaattcttaa

SEQ ID NO: 108 - DNA, 2271 bp, Desulfotomaculum acetoxidans DSM 771
atgaaccgtcgattattataccgctggctggccagcggggtattgtggctgctgcttttaattgtagtcgtgatctctatccgaagtgtaaatatagtcaacagtactttagctttatttgtcacccatagaggaaaatttttgttaccggcgaaatatttatattattggaaattgacctgcttgggggacaaatctatgagagaacgagcagtgagactgttgaaagctatgctgggtgctggagtagttttcagggaaggccagtgggaagcaatagaatcaattattaataggaaacgcacattggttgtccagcgcacaggttgggggaagagtattgtttattttatcgcaacaaaattattgagagatcagggtgcaggcccaacaattttgattagtccattgctttccttaatgcggaatcaaatagaaaatgctgctcgtatcggtattagagccgaatcaataaacagccaaaacgaagaagactgggagcatgtgaaaagtactttggtacggggtgaatgtgatgtgctacttgtttcgccggagcgcctggccaatttttattttttagatcaagttttgcccttaattagtagcggaattggtatttttgtggttgatgaagctcactgtatttctgactgggggcatgattttcgtccagattaccggagaattgtccggattgtcaataatttgccatcgaatgttcctgtaattgctactaccgctacagctaatgatcgtgtagttaatgatattaaagaacaacttgggcaaaatcttagcatatttagaggtccattaaaaagggattctttgagattacaaaccatacgattggcagatcagtccgaaagattagcctggcttgtcgcaaatattccgaagatgaacggttccggaataatttactgtttaacggttgctgattgcgatagagtagccagatggctgcaagagaaaggaattaacgctcttgagtaccatggaaaattgggaaacgatctgcgaaaagaaagagagcagaaacttcttgataatgaaattaaagctcttgtagcgacggttgcattaggtatgggatttgataagcccgatttgggttttgttgtccactaccagcgacccggttcaatagttgcatattaccagcaaattggccgtgcaggtcgggcgcttgacaatgcttatgctattcttttgaatggccgtgaagatgatgagattcaagactattttataaatactgcatttcccggtgcagatgaaatggatcgtgtagttcgggttttgaacagttcacaaaggggattaaaagcttctgagataatgcttttattaaatatttctcaaatcaggcttgagaaatgtttaaaaatgttacaaattgatgaggctatttctaagaatggcacagtttacagtagaaccttaaacccgtggcagcctgatattgccagaagtgagcaagtaacggcacagagaaagcatgaactgcgcagaatgcaggattatgttaataccgatatgtgccttatgaaatttgtatctttagaattaggtgatccgtatgccggtaattgcgggcggtgtaaaaactgttgtggggaaggatttttctctgagcaggtaggtatagaaaatattttggaagcgactcagtttttgcgtgggaatttcctggtgattgagccaagaaaacaatggccgcctgggggagtcggcgatatgaagggaaaaatatctggtgagcatcgtaaccaggaagggtattcactttgtatgtatggtgatgcaggttgggggcgtttggtcagggaggataaatatgagcaaggttattttcgtgatgagcttgtttttgcagctgttgacctcataaagaatcaatggaacccttacccgttcccggtctgggtaactgcagttccttcgctgcgtcaccctaaccttgtacctgattttgccaagaaagtggctgaaaagcttggaattccgtttaatccggttttggttaaggtaaaaagtactcctcagcaaaaaactatgaaaaacagttttcttcaagctgataatgtaatagattgctttgaaattcagttcggttgccctgaaggcccggttttgctaatagatgacatggtagattcccgttggacatttactgtttgtgggatgttgttgagtaagagtggcagcgggcttgtatacccgttcgccattgccaatactgctggcggaggtgacatagaataa

SEQ ID NO: 109 - DNA, 2100 bp, Escherichia coli 83972
atgatggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcacggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttattacagcggcgtgacttgtgaaggtgcggaagattctaatactgccagggagtatctggagcaggcactgctggcaaataaaatcaaagtgctggtcgcgacgacggcattaggtatgggatttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaagagtgcaaaatgcaatttctgcgccgcgcactcgatgagccaagtgccgaacgttgtggtaaatgtagcagttgtcttcagcatccgctgttgtcgcccgacattgatagcggcttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcccaggagaaaaaaacggggcgcttcagtgatgagctggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 110 - DNA, 2097 bp, Escherichia coli ABU 83972
atggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcacggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttattacagcggcgtgacttgtgaaggtgcggaagattctaatactgccagggagtatctggagcaggcactgctggcaaataaaatcaaagtgctggtcgcgacgacggcattaggtatgggatttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaagagtgcaaaatgcaatttctgcgccgcgcactcgatgagccaagtgccgaacgttgtggtaaatgtagcagttgtcttcagcatccgctgttgtcgcccgacattgatagcggcttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcccaggagaaaaaaacggggcgcttcagtgatgagctggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 111 - DNA, 2088 bp, Escherichia coli B088
atggaaaagcacgcagctgaattgcttttacagcggatgttaggaaataccaccgctactttcagggaagggcaatgggaagccatagacgcggtggtgaaccaacgacgaaaactgctggttgtccaacgcactggctgggggaaaagtgccgtgtacttcatcgccagtaaaatcttccgcgatcgcggtgctggcccgacaattatcatctctcctttgcttgccctgatgcgtaaccaggttgccgccgctgaacggttaggtattacggctgaaacgttgaattctacaaacagggaagaatggcagcgtattagcgataagttgctgcaaggtgaggtcgattgcttgctggtttccccggaacgtttggcaaaccaagactttatcgaaacggttttatatcctatagccgatcgtattggcttgcttgtggtcgacgaggcgcactgcatctctgattggggccacgattttcgcccggattaccgacgtatattagatattttgcgccaactgcctgcgaataccccagttctgggtacaaccgcgacagcgaataaccgtgtcgttgaggatatccgtcagcaattgggtgacattgtgattcagcgtggaacgctggctcgcgaaagtttggcgcttgatgccttagtcttaggtgaacagtcatcccgtctggcatggttagcaacggttatccctcagttttccaaatcgggaattgtttataccctgactactcgcgatgccgaccttgtcgccgagtggttaaggacaaatggtatcagtgcatttgcttactacagcggcgtgacttgtgaaggcgcggaagattctaatactgccagggaatatctggagcaggcgttgctggcaaataaaattaaagttctggtcgcgacgacggcgctgggaatgggctttgacaaaccggatttggggtttgttattcattaccagatgccggggtctattgtcggttactaccaacaggtagggcgtgccgggcgtgctatagattccgctgttggcatattgctttgtggtggtgaagaccgcgctattcataaattcttccgtgaaagcgcctttcctgcggaggcgcaaattcatgaaatactcaacgtacttagcgagaatgacggtcttaccctacgaggcattgaacaacggacgaatctccgttatgggcaaatagaaaaagcactgaaattattggtagctgaaaatccatcgcctgtggtgtataccgagaaattatggcgcagaactatcgtcagtttctctcctgaccatgaacgaattaaccatttgatgaatcagagaaaaaatgagctggcagatgttgaaagctatatcacgaccaaggagtgcaaaatgcaatttctgcgccgcgcactcgatgagccaagtgccgaacgttgtggtaaatgtagcagttgtcttcagcatccgttgttgtcgcccgatattgatagcggcttactccatgcggcaaatttatttattaaacacgctgacctgccattaaatctcaataaacaggtagcatctggagcttttacgcaatacggatttaaagggaacttgcctgcgggtttacaaggatctacggggcgagtcctttctcgttggggagattccggatggggaaagcaggtagcacaggagaaaaaaacggggcgattcagtgatgagctggtggaggcatgtgcggaaatggttcgccaacgctggaatccgcatcctgaaccaacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgcaggcaggttgcccgacggtttatcctcttgcccttgcttctacctcggtaa

SEQ ID NO: 112 - DNA, 2097 bp, Escherichia coli B185
atggaaaagcacgcagctgaattgcttttacagcggatgttaggaaataccaccgctactttcagggaagggcaatgggaagccatagacgcggtggtgaaccaacggcgaaaactgctggttgtccaacgcactggctgggggaaaagtgctgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtgcggtcgattgcttgctggtttccccggaacgtttggcaaaccaggactttatcgaaacggttttatatcctatagccgatcgtattggcttgcttgtggtcgacgaggcgcactgcatctctgattggggccacgattttcgcccggattaccgacgtatattagatattttgcgccaactacctgcgaatacccctgttctgggtacaaccgcgacagcgaataaccgtgtcgttgaggatatccgtcagcaattgggtgacattgtgattcagcgtggaacgctggctcgcgaaagtttggcgcttgatgccttagtcttaggtgaacagtcatcccgtctggcatggttagcaacggttatccctcagttttccaaatcgggaattgtttataccctgactactcgcgatgccgaacttgtcgccgagtggttaaggaaaaatggtatcagtgcatttgcttactacagcggcgtgacttgtgaaggcgcggaagattctaatactgccagggaatatctggagcaggcgttgctggcaaataaaattaaagtgctggttgcgacaacggcgctgggaatgggctttgacaaaccggatttggggtttgttattcattaccagatgccaggttcgatagttggttactaccaacaggtggggcgtgccggtcgcggtatcgattctgctgttggcatactgctttgcggcagtgaagaccgtgctattcataaattcttccgtgaaagcgcctttcctgcggaggcgcaaattcatgaattactcaacgtacttagcgtgaatgacggtcttaccttacgaggcattgaacaacggacgaatctccgttatgggcaaatagaaaaagcactgaaattattggtagctgaaaatccatcgcctgtggtgtataccgagaaattatggcgcagaacaattgtcagtttttctcctgaccatgaacgaattaaccatttgatgaatcagagaaaaagtgagctggcagacgttgaaagctatatcacgaccaaggagtgcaaaatgcaatttctgcgccgcgcactcgatgagccaggtgccgaacattgtggtaaatgtagcagttgtcttcagcatccgttgttgtcgcccgacattgatagcggcttactccatgcggcaaacttatttattaaacacgctgacctgtcattaaatctcaataaacaggtggcagctggggcttttacgcaatacggatttaaagggaacttgcctgcgagtttacaaggatctacggggcgaatcctttctcgttggggagattccgggtggggaaagcaggtagcacaggagaaaaaaacggggcgattcagtgatgaactggtggaggcatgtgcggaaatggttcgccaacgctggaatccgcatcctgaaccaacctgggtatgctgcgttccttcattaaagcacctcgacctggttcctgattttgcccggcgactggcggcgaaacttggcttaccttttattgatgccattgaaaaagtcgtggacaatccaccgcagaaaatgcagcaaaaccgtttccaccagtgtcaaaatctcgacggggcgtttgtgattacccctcctttgatgcctggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 113 - DNA, 2097 bp, Escherichia coli IAI39
atggaaaagcacggagctgaattgcttttacagcggatgttaggaaataccaccgctactttcagggaagggcaatgggaagccatagatgcagtggttaatcagcggcgaaaactgctggttgtacagcgcaccggctgggggaaaagtgccgtgtacttcatcgccagtaaaatcttccgagatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtgaggtcgattgcttgctggtttccccggaacgtttggcaaaccaggactttatcgaaacggttttatatcctatagccgatcgtattggcttgcttgtggtcgacgaggcgcactgcatctctgattggggccacgattttcgcccggattaccgacgtatattagatattttgcgccaactgcctgcgaatacccctgttctgggtacaaccgcgacagcgaataaccgtgttgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttactacagcggcgtgacttgtgaaggcgcggaagattctaatactgccagggaatatctggagcaggcactgctggcaaataaaatcaaagtgctggtcgcgacgacggcattaggtatggggtttgataaatctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagcggaaaatccatcgcctgtggtgtataccgagaaattatggcgcagaactatcgtcagtttttctcctgatcatgaacgaattaaccatttgatgaatcagagaaaaagtgaactggcagacgttgaaagctatatcacgaccaaggagtgcaaaatgcaatttctgcgccgtgcactcgatgagccaagtgccgaacgttgtggtaaatgtagcagttgtcttcagcatccgttattgtcgcccgacattgatagcggcttactccatgcggcaaatttatttattaaacacgctgacctgccgttaaatctcaataaacaggtggcagctggggcttttacgcaatacggatttaaagggaacttgcctgcgggtttacaaggatctacggggcgaatcctttctcgttggggagattccgggtggggaaagcaggtagcacaggagaaaaaaacggggcgcttaagtgatgagctggtagaagcatgtgcggaaatggtttgccaacgctggaatccgcatcctgaaccaacctgggtatgcagcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgacaggcaggttgcccgacggtttatcctcttgcccttgcttctacctcggtaaaaaattga

SEQ ID NO: 114 - DNA, 2100 bp, Escherichia coli MS 185-1; identical to SEQ ID NO: 109

SEQ ID NO: 115 - DNA, 2100 bp, Escherichia coli MS 200-1
atgatggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgactggttaaggaaaaatggtatcagtgcatttgcttattacagcggcgtgacttgtggaggtgcggaagattctaatactgccagggagtatctggagcaggcactgctggcaaataaaatcaaagtgctggtcgcgacgacggcattaggtatgggatttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaagagtgcaaaatgcaatttctgcgccgcgcactcgatgagccaagtgccgaacgttgtggtaaatgtagcagttgtcttcagcatccgctgttgtcgcccgacattgatagcggcttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcccaggagaaaaaaacggggcgcttcagtgatgagctggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgatgatatcgtggattctgcatggacgctgacagttctgacagcactgttacgccaggcaggttgcccgacggtttatcctcttgcccttgcttctacctcggtaaaaaattga

SEQ ID NO: 116 - DNA, 2097 bp, Escherichia coli MS 21-1
atggaaaagcacggagctgaattgcttttacagcggatgttaggaaataccaccgctactttcagggaagggcaatgggaagccatagatgcagtggttaatcagcggcgaaaactgctggttgtacagcgcaccggctgggggaaaagtgccgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtgaggtcgattgcttgctggtttccccggaacgtttggcaaaccaggactttatcgaaacggttttatatcctatagccgatcgtattggcttgcttgtggtcgacgaggcgcactgcatctctgattggggccacgattttcgcccggattaccgacgtatattagatattttgcgccaactgcctgcgaatacccctgttctgggtacaaccgcgacagcgaataaccgtgttgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttactacagcggcgtgacttgtgaaggcgcggaagattctaatactgccagggaatatctggagcaggcactgctggcaaataaaatcaaagtgctggtcgcgacgacggcattaggtatggggtttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagcggaaaatccatcgcctgtggtgtataccgagaaattatggtgcagaactatcgtcagtttttctcctgatcatgaacgaattaaccatttgatgaatcagagaaaaagtgaactggcagacgttgaaagctatatcacgaccaaggagtgcaaaatgcaatttctgcgccgtgcactcgatgagccaagtgccgaacgttgtggtaaatgtagcagttgtcttcagcatccgttattgtcgcccgacattgatagcggcttactccatgcggcaaatttatttattaaacacgctgacctgccgttaaatctcaataaacaggtggcagctggggcttttacgcaatacggatttaaagggaacttgcctgcgggtttacaaggatctacggggcgaatcctttctcgttggggagattccgggtggggaaagcaggtagcacaggagaaaaaaacggggcgcttaagtgatgagctggtagaagcatgtgcggaaatggttcgccaacgctggaatccgcatcctgaaccaacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgatgatatcgtggattctgcatggacgctgacagttctgacagcactgttacgccaggcaggttgcccgacggtttatcctcttgcccttgcttctacctcggtaaaaaattga

SEQ ID NO: 117 - DNA, 2100 bp, Escherichia coli MS 45-1; identical to SEQ ID NO: 109

SEQ ID NO: 118 - DNA, 2100 bp, Escherichia coli MS 69-1
atgatggagaaacacggagctgaattgcttttacagcggatgttaggaaataccaccgctactttcagggaagggcaatgggaagccatagatgcagtggttaatcagcggcgaaaactgctggttgtacagcgcaccggctgggggaaaagtgccgtgtacttcatcgccagtaaaatcttccgagatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtgaggtcgattgcttgctggtttccccggaacgtttggcaaaccaggactttatcgaaacggttttgtatcctatagccgatcgtattggcttgcttgttgtcgacgaggcgcactgcatctctgattggggccacgattttcgcccggattaccgacgtatattagatattttgcgccaactgcctgcgaatacccctgttctgggtacaaccgcgacagcgaataaccgtgttgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttactacagcggcgtgacttgtgaaggcgcggaagattctaatactgccagggaatatctggagcaggcactgctggcaaataaaatcaaagtgctggtcgcgacgacggcattaggtatggggtttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagcggaaaatccatcgcctgtggtgtataccgagaaattatggcgcagaactatcgtcagtttttctcctgatcatgaacgaattaaccatttgatgaatcagagaaaaagtgagctggcagacgttgaaagctatatcacgaccaaggagtgcaaaatgcaatttctgcgccgtgcactcgatgagccaagtgccgaacgttgtggtaaatgtagtagttgtcttcagcatccgttattgtcgcccgacattgatagcggcttactccatgcggcaaatttatttattaaacacgctgacctgccgttaaatctcaataaacaggtggcagctggggcttttacgcaatacggatttaaagggaacttgcctgcgggtttacaaggatctacggggcgaatcctttctcgttggggagattccgggtggggaaagcaggtagcacaggagaaaaaaacggggcgcttcagtgatgagctggtagaagcatgtgcggaaatggttcgccaacgctggaatccgcatcctgaaccaacctgggtatgctgcgttccttcattaagacacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 119 - DNA, 2097 bp, Escherichia coli O103 H2 12009
atggaaaagcacgcagctgaattgcttttacagcggatgttaggaaataccaccgctactttcagggaagggcaatgggaagccatagacgcggtggtgaaccaacgacgaaaactgctggttgtccaacgcactggctgggggaaaagtgccgtgtacttcatcgccagtaaaatcttccgcgatcgcggtgctggcccgacaattatcatctctcctttgcttgccctgatgcgtaaccaggttgccgccgctgaacggttaggtattacggctgaaacgttgaattctacaaacagggaagaatggcagcgtattagcgataagttgctgcaaggtgaggtcgattgcttgctggtttccccggaacgtttggcaaaccaagactttatcgaaacggttttatatcctatagccgatcgtattggcttgcttgtggtcgacgaggcgcactgcatctctgattggggccacgattttcgcccggattaccgacgtatattagatattttgcgccaactgcctgcgaataccccagttctgggtacaaccgcgacagcgaataaccgtgtcgttgaggatatccgtcagcaattgggtgacattgtgattcagcgtggaacgctggctcgcgaaagtttggcgcttgatgccttagtcttaggtgaacagtcatcccgtctggcatggttagcaacggttatccctcagttttccaaatcgggaattgtttataccctgactactcgcgatgccgaccttgtcgccgagtggttaaggacaaatggtatcagtgcatttgcttactacagcggcgtgacttgtgaaggcgcggaagattctaatactgccagggaatatctggagcaggcgttgctggcaaataaaattaaagttctggtcgcgacgacggcgctgggaatgggctttgacaaaccggatttggggtttgttattcattaccagatgccggggtctattgtcggttactaccaacaggtagggcgtgccgggcgtgctatagattccgctgttggcatattgctttgtggtggtgaagaccgcgctattcataaattcttccgtgaaagcgcctttcctgcggaggcgcaaattcatgaaatactcaacgtacttagcgagaatgacggtcttaccctacgaggcattgaacaacggacgaatctccgttatgggcaaatagaaaaagcactgaaattattggtagctgaaaatccatcgcctgtggtgtataccgagaaattatggcgcagaactatcgtcagtttctctcctgaccatgaacgaattaaccatttgatgaatcagagaaaaaatgagctggcagatgttgaaagctatatcacgaccaaggagtgcaaaatgcaatttctgcgccgcgcactcgatgagccaagtgccgaacgttgtggtaaatgtagcagttgtcttcagcatccgttgttatcgcccgatattgatagcggcttactccatgcggcaaatttatttattaaacacgctgacctgccattaaatctcaataaacaggtagcatctggagcttttacgcaatacggatttaaagggaacttgcctgcgggtttacaaggatctacggggcgagtcctttctcgttggggagattccggatggggaaagcaggtagcacaggagaaaaaaacggggcgattcagtgatgagctggtggaggcatgtgcggaaatggttcgccaacgctggaatccgcatcctgaaccaacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 120 - DNA, 2100 bp, Escherichia coli O150:H5 SE15
atgatggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttattacagcggcgtgacttgtgaaggtgcggaagattctaatactgccagggagtatctggagcaggcactgctggcaaataaaatcaaagtgctggtcgcgacgacggcattaggtatgggatttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaggagtgcaaaatgcaatttctgcgccgcgcactcgatgagccaagtgccgaacgttgtggtaaatgtagcagttgtcttcagcatccgctgttgtcgcccgacattgatagcgacttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcccaggagaaaaaaacggggcgcttcagtgatgagctggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgatgatatcgtggattctgcatggacgctgacagttctgacagcactgttacgccaggcaggttgcccgacggtttatcctcttgcccttgcttctacctcggtaaaaaattga

SEQ ID NO: 121 - DNA, 138 bp, Escherichia coli O157:H7 EC4076
atgcctggtccggcgttgctggttgacgatatcgtggattctgcatggacgctgacagttctaacagcactgttacgccaggcaggttgcccgacggtttatcctcttgcccttgcttctacctcggtaaaaaattga

SEQ ID NO: 122 - DNA, 138 bp, Escherichia coli O157:H7 EC4113; identical to SEQ ID NO: 121

SEQ ID NO: 123 - DNA, 156 bp, Escherichia coli O157:H7 EC4196
gtgattacccctcctttgatgcctggtccggcgttgctggttgacgatatcgtggattctgcatggacgctgacagttctaacagcactgttacgccaggcaggttgcccgacggtttatcctcttgcccttgcttctacctcggtaaaaaattga

SEQ ID NO: 124 - DNA, 156 bp, Escherichia coli O157:H7 EC4401; identical to SEQ ID NO: 123

SEQ ID NO: 125 - DNA, 138 bp, Escherichia coli O157:H7 EC4486; identical to SEQ ID NO: 121

SEQ ID NO: 126 - DNA, 1098 bp, Escherichia coli O157:H7 EC4501
gtggggcgtgccggtcgcggtatcgattctgctgttggcatactgctttgcggcagtgaagaccgtgctattcataaattcttccgtgaaagcgcctttcctgcggaggcgcaaattcatgaaatactcaacgtacttagcgtgaatgacggtcttaccttacgaggcattgaacaacggacgaatctccgttatgggcaaatagaaaaagcactgaaattattggtagctgaaaatccatcgcctgtggtgtataccgagaaattatggcgcagaacaattgtcagtttttctcctgaccatgaacgaattaaccatttgatgaatcagagaaaaagtgagctggcagacgttgaaagctatatcacgaccaaggagtgcaaaatgcaatttctgcgccgcgcactcgatgagccaggtgccgaacattgtggtaaatgtagcagttgtcttcagcatccgttgttgtcgcccgacattgatagcggcttactccatgcggcaaacttatttattaaacacgctgacctgtcattaaatctcaataaacaggtggcagctggggcttttacgcaatacggatttaaagggaacttgcctgcgagtttacaaggatctacggggcgaatcctttctcgttggggatattccgggtggggaaagcaggtagcacaggagaaaaaaacggggcgattcagtgatgaactggtggaggcatgtgcggaaatggttcgccaacgctggaatccgcatcctgaaccaacctgggtatgctgcgttccttcattaaagcacctcgacctggttcctgattttgcccggcgactggcggcgaaacttggcttaccttttattgatgccattgaaaaagtcgtggacaatccaccgcagaaaatgcagcaaaaccgtttccaccagtgtcaaaatctcgacggggcgtttgtgattacccctcctttgatgcctggtccggcgttgctggttgacgatatcgtggattctgcatggacgctgacagttctaacagcactgttacgccaggcaggttgcccgacggtttatcctcttgcccttgcttctacctcggtaaaaaattga

SEQ ID NO: 127 - DNA, 156 bp, Escherichia coli O157:H7 EC508; identical to SEQ ID NO: 123

SEQ ID NO: 128 - DNA, 156 bp, Escherichia coli O157:H7 EC869; identical to SEQ ID NO: 123

SEQ ID NO: 129 - DNA, 975 bp, Escherichia coli O157H7 EDL933
gtggggcgtgccggtcgcggtatcgattctgctgttggcatactgctttgcggcagtgaagaccgtgctattcataaattcttccgtgaaagcgcctttcctgcggaggcgcaaattcatgaaatactcaacgtacttagcgtgaatgacggtcttaccttacgaggcattgaacaacggacgaatctccgttatgggcaaatagaaaaagcactgaaattattggtagctgaaaatccatcgcctgtggtgtataccgagaaattatggcgcagaacaattgtcagtttttctcctgaccatgaacgaattaaccatttgatgaatcagagaaaaagtgagctggcagacgttgaaagctatatcacgaccaaggagtgcaaaatgcaatttctgcgccgcgcactcgatgagccaggtgccgaacattgtggtaaatgtagcagttgtcttcagcatccgttgttgtcgcccgacattgatagcggcttactccatgcggcaaacttatttattaaacacgctgacctgtcattaaatctcaataaacaggtggcagctggggcttttacgcaatacggatttaaagggaacttgcctgcgagtttacaaggatctacggggcgaatcctttctcgttggggatattccgggtggggaaagcaggtagcacaggagaaaaaaacggggcgattcagtgatgaactggtggaggcatgtgcggaaatggttcgccaacgctggaatccgcatcctgaaccaacctgggtatgctgcgttccttcattaaagcacctcgacctggttcctgattttgaaagcacctcgacctggttcctgattttgcccggcgactggcggcgaaacttggcttaccttttattgatgccattgaaaaagtcgtggacaatccaccgcagaaaatgcagcaaaaccgtttccaccagtgtcaaaatctcgacggggcgtttgtga

SEQ ID NO: 130 - DNA, 1098 bp, Escherichia coli O157:H7 TW14588; identical to SEQ ID NO: 126

SEQ ID NO: 131 - DNA, 2097 bp, Escherichia coli 536
atggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgactggttaaggaaaaatggtatcagtgcatttgcttattacagcggcgtgacttgtggaggtgcggaagattctaatactgccagggagtatctggagcaggcactgctggcaaataaaatcaaagtgctggtcgcgacgacggcattaggtatgggatttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaagagtgcaaaatgcaatttctgcgccgcgcactcgatgagccaagtgccgaacgttgtggtaaatgtagcagttgtcttcagcatccgctgttgtcgcccgacattgatagcggcttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcccaggagaaaaaaacggggcgcttcagtgatgagctggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgatgatatcgtggattctgcatggacgctgacagttctgacagcactgttacgccaggcaggttgcccgacggtttatcctcttgcccttgcttctacctcggtaaaaaattga

SEQ ID NO: 132 - DNA, 2100 bp, Escherichia coli CFT073; identical to SEQ ID NO: 109

SEQ ID NO: 133 - DNA, 2097 bp, Escherichia coli SMS 3 5
atggaaaagcacggagctgaattgcttttacagcggatgttaggaaataccaccgctactttcagggaagggcaatgggaagccatagatgcagtggttaatcagcggcgaaaactgctggttgtacagcgcaccggctgggggaaaagtgccgtgtacttcatcgccagtaaaatcttccgcgatcgcggcgctggcacgacaattatcatctctcctttgcttgccctgatgcgtaaccaggttgccgccgctgaacggttaggtattacggctgaaacgttgaattctacaaacagggaagaatggcagcgcattagcgataagttgctgcaaggtgaggtcgattgcttgctggtttccccggaacgtttggcaaaccaggactttatcgaaacggttttatatcctatagccgatcgtattggcttgcttgtggtcgacgaggcgcactgcatctctgattggggccacgattttcgcccggattaccgacgtatattagatattttgcgccaactgcctgcgaatacccctgttctgggtacaaccgcgacagcgaataaccgtgttgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttactacagcggcgtgacttgtgaaggcgcggaagattctaatactgccagggaatatctggagcaggcactgctggcaaataaaatcaaagtgctggtcgcgacgacggcattaggtatggggtttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagcggaaaatccatcgcctgtggtgtataccgagaaattatggcgcagaactatcgtcagtttttctcctgatcatgaacgaattaaccatttgatgaatcagagaaaaagtgaactggcagacgttgaaagctatatcacgaccaaggagtgcaaaatgcaatttctgcgccgtgcactcgatgagccaagtgccgaacgttgtggtaaatgtagcagttgtcttcagcatccgttattgtcgcccgacattgatagcggcttactccatgcggcaaatttatttattaaacacgctgacctgccgttaaatctcaataaacagatggcagctggggcttttactcaatacggatttaaagggaacttgcctgcgggtttacaaggatctacggggcgaatcctttctcgttggggagattccgggtggggaaagcaggtagcacaggagaaaaaaacggggcgcttaagtgatgagctggtagaagcatgtgcggaaatggtttgccaacgctggaatccgcatcctgaaccaacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattatccctcctttgatgccaggtccggcgttgctggttgacgatatcgtggattctgcatggacgctgacagttctgacagcactgttacgccaggcaggttgcccgacggtttatcctcttgcccttgcgtctacctcggtaaaaaattga

SEQ ID NO: 134 - DNA, 2079 bp, Kingella denitrificans ATCC 33394
gtggcctacaacccaaaacgcgcgttggaattgctccggatcggttctggacgtgccgatgctattttccgcgatggtcaagaagatgccattcgtcacatcgtagatggcaagggccgcttgctggtcgtgcaaaagaccgggtggggtaagagcttcgtctactttattgcgatcaagttgttgcgggaagccggaagtggtccggcgttacttatctcgccgctgctggcgctgatgcgaaaccagattgcagcggcagagcggatgggggttcgcgctgccaccatcaactccgacaacgtggaagactggacggatgtcgagggcaaactgggcaagggagagatcgatgttctcttgatctcgccggagcgcttggcgaacgagcgcttccggacgcaggttcttgccggaatcgctgcacaagtttcgatgctggtcatcgatgaagcgcactgcatttccgactggggacacgacttccgtccccactaccgcttgctggagcggatcgccaagacactgccgccaaacctgcgcttgcttgccaccacggcgacagcgaataaccgcgtgatggaggaccttgctgctgtgctcggtcctaagttgcaggtctctcgtggcgacttgaatcggacctcacttactctgcaaacaatccgcctgcctagtcaggccgagcgtcttgcttggctggcggagcaactgattacgctgcacgggcatggcatcatctacacactgacggttcgcgatgccaatcaagttgctctgtggttgaaagctcaaggcttcaacgtggaagcctatacaggtgaaaccggtgatcgtagagagcagcttgaacaggcgctgctaaaaaaccaagttaaagcgctggttgccacaacagcgctaggtatgggttacgacaagccggatctggcatttgtcatccactatcaaacgccgggatcggttgtcgcctattaccaacaggtcggtcgcgcaggacgcgcactggagtctgcttatggagtgctcctcagcggtgaggaagagtcagacatcactgactggttcatccggagcgccttcccgacacggcaagaagttgcggatgtcctgagagcgcttgaaggcgagccaaacgggctatctgttcccgagcttctaagccgagtcaatctaagcaaaggtcgtgttgaaaaaacgattgcactgctgtccctcgaagcgccggcacccatcgccaagcaaggtagcaagtggcagctcacggcggctacgctgagtgaagcattctgggatcgagcggaacgcctcactgtgctacggcgagacgagcaccagcagatgcaggactacgtgagcctaccgtttggtgagcacatgggctttttgattggcgcgctcgacggcgatccaagtgttgtgacagaaccagccttaccgccattgcctgcaaccgtgaataccgagctggtaaaagctgccgtcgaatttcttcgtcgaaccagcttgcccatcgagccccgcaaaaaatggcccgacggtggaatgccccagtacggcgtcaagggattcatcgcacctgcccatcaggctgaatccggcaaggcgctatgcgtctggggcgatgccggttggggtggattggttcgacagggcaaataccacgacggctacttttccgatgacctcgttgctgcgtgcgtgaagatgattcaggagtggaatccgcaaccgagcccgacctgggtgacctgcgttccttcgcttcggcatcccgaattggtgccgaatttcgcgcaacgcttggctgctgcgctgggtctgccgtttcatatggtcatcgcaaaaacagacgcaaggcccgaacagaaaacgatggcaaacagtacacaacaggcgcgcaacattgatggttcgctcgcactcaacggccagcccattcctcccggcccggtcctcctggttgatgacatggtcgactcgcgctggacgctgacggtgtctgcatggctgctgcgcaaaagcggtagcggcgcggtttggcctatggccctttcacagacggggcccgacgaatga

SEQ ID NO: 135 - DNA, 2100 bp, Lyngbya sp. CCY 8106
atgaataacccgttaaaagataaggctctgttgctattacgtcaagccctgaaaaatcccgatgcaaattttcgggagggacagtgggaagcgatcgcagaattggtagaaaatcgctctcaattgttagtcgtacaacggacaggatgggggaaaagtttagtctattttctcacaactcgtctgtttagagaacaaggaagcgggccgacattattaatctcaccgttgttagccttaatgcgaaatcaaattgtagctgcggaacgaattggcgttaaagctgcaacgattaattctagtaataccgaagactgggaagctgttagcagtcaattaattaacggaaaaattgaccttttattaatctctcccgaacgattagcaaatgaagaatttcaaaacacggttctctcccaaatttctcaaagaataggattatttgttgttgatgaagcccattgtatatcggactggggacatgattttcgccccgactatcgccgcatagttcgagtgttacaagcattaccccgcaatattcccgctttggctacaaccgccaccgcaaataatcgagttgttcgcgatattatcgatcaattgggttcggaactttgggtatttagaggaactttaacccgttcaagtttaaaactacaaaatattaaactttcgagtcctgctgaacgtttagcatggttagttgaaaacctcccaaagttacccggaagtggtataatttatgcgttaactgtcaaagataccgaacgaattgcaaattggttaaaacagaatggaattaatgcaaaaccttaccatgctgatgttaaagaaaaccgagaacttcttgaagatcaactgttgaataatgaactcaaagcattagtcgcaaccacagcgttaggaatgggttttgataagccagatttggggtttgtaattcactatcaacgtccgggttcggtggttcattattatcaacaagtgggacgagccggacgagcggtggaatcagcctatggtattttattaagtggggaagaagacgaagaaatcaccaactattttattcaaaccgctttccccccagaggctcacacccaacaaattttagactgtttaaatcaagccgaaaatgggttatcaattcctcagatacagcaatatttaaacctctctcaaggtcaaattagcaaagtcttaaaactgttatcgctggaatctccaactcccgtaaccaaacagggttctaaatggtttgctacacccgttatttatcaacccaatcagaaaaaaattcaacaattaacagaacttcgctatcaagaacaagaacaaatgcgagaatatatggaaactaaaaactgtttaatgcagtttctcgccaacgctcttgatgatccgaattgtgttccttgcggtaaatgtgcggtttgtttgggaaaacctttacttccgatcacttcttcaattgaacgaacaaatcaagccattcaatatcttcgccgcagtgatcacaaaattttacctcgcaaacaatggactccacaagccttgcaaatttacggtttttctggtaatattcgggagaatttaagagcagaagaaggacgggcgttatctctttggggggatgcgggatggggaaaattggtaaaaaaaggaaagtatgaagattgccagtttagtgatactttagttcaaggtatggcagagatgattcaacgctggaagcctcaaccttttccaacttgggtgacttgtataccctccctaaaacgtcctgaattggttcccaacttcgcccaacgactcgcccatcaattacaattaccgtttgttccagtggtgaaaaaagttcgtcaaaatcaacctcaaaaaacgatgagtaatagctaccaacaagctcataatttagatggtgtgtttgtagttgaaagttgggaaggaatgaaaggatcggtttttttagtggatgattttgttgattctcgctggacatttacagtcgttgctgctcttttacgtcaagccggaagtgaaaacgtttttccgattgctttgactcagaattctttaggctttacaagtgattaa

SEQ ID NO: 136 - DNA, 2091 bp, Maribacter sp. HTCC2170
atggataaaaacggagcagttgcacttttaagaaaagcacttgatttaccagacgcgacctttagggaaggacaatgggaagctatcgaaaaacttacgataaataaggaaaaattattagtcgtacaacgaacgggttgggggaaaagttcagtttattttatcagtactagaattttgagggaccaaggtaaaggaccaactataattatatctcctttgttggcattgatgcggaaccaaatagaagccgcgaaacgtttaggtattaaggctgctagtattaattcgaacaactttgaagactggaaaactatacaggcggaggttttaagaaacaatattgatacacttttaatttctcctgaacgtttggcgaatgaacgttttatgaatgagatactacttcctatagcaaataaaataggtttgtttgtagttgacgaagcccattgtatttcggattggggtcacgattttagaccagactacagacgtattgttggtattttgaaagttatgccaaaaggaatgcccgttttaggaactacagctacagccaatgacagagtagttgccgatattaaagagcaattaggtggcattaatgttttaagaggagcattaaccagagaaagtttaaaacttcaaaacataattctaaaagaccaagcatctagattggcatggcttaaagaaaacatcccaaatcttaatggtagtggaataatatatgttttaacaaaacgtgatgcaaagactgtaacacaatggttaaatgattgtaatatagatgctgctgcatattattcaggagtaacggatgaaaattttgaaaatactgcggtttacagagaagttttagaagacgctttgtataataacgagttaaaagtattggttgctactacagcattagcaatgggttatgataaaccagacttaaattttgtaattcattttcaagcacctgattcaattattagttattaccaacaagtagggcgtgcagggcgtgctataaatactgcctatggtattttattatctggacaagaagatgctgatgtgcaccagtattttagggaatctgcgtttccgccagaacatgtggtacaagatatattaaaagccttaatagaccacgatggcttgtcaatccctaaattacaggaagtactaaatataaaacatggtcaaatagacaaaacaataaagtatttaacagtagaagaaccttctccaatcattaaagaaggcacaaaatggaagcgttcagctgtatcttttactatggatacagacaaaatagagcgtttaaccaatcaacgtctatttgaatggaaaacggttcaagactatatacaaacagaggagtgtttaatgacgtttttgcaaaaagaattagatgacccaaatgtagaaccatgtggcaaatgttcgaattgtctaggtataaaaacaataccagatatggtttctcataataatacagttgaagcctctatttatttgaaacactcggaattcgatattttgccgagaaaacaaattgctgcaaatgccttacccatatatgaatggagcgggaggttaaataatttaatagccgaaaaaggtaaagtattatcacgttggggagatgctggttgggggaatattgttgctaacgataaacatcaaggtttctttagaaatgaattagtggatgcaatgaatgagatgattgtagaacgttggtgtccagacccatatccagaatggctaacttgtattccatcattacggcacccagatttagtgcccgatttcgcaaaacgcttagcagaaaaattaggcataccgtttaggcccataatattaaaagtgaaagatacacagccacaaaaggagcaagaaaatagttttcatcaatgtcataatttagatggtgtttttcacattgaagaagatgttgagaataaacctgtatttttggtagatgatgctatagattctggttggacgtttacaattgtaacaacactattaaaaaaatcgggttcaggtttggtttatccagtagctttaacttcaacatcagtaagctaa

SEQ ID NO: 137 - DNA, 2097 bp, Marinobacter aquaeolei VT8
atgaacagaaccgatgccgaagcattgctgcgtactgcggtgggaaacgcagccgcaagcttccgtagtggccaatgggaagccattaatgctctggtaaatcagcgccaaaagctactggtggttcaacgaaccgggtggggcaaaagctctgtctatttcatagcgacccgaatcatgcgtgatcagggctatgggcccaccatcattgtctcgcctttgctggccttgatgcgtaatcagattgaatcagctcgaagactgggtattcacgcgatcaccatcaactctaccaaccgtgatcaagcggaagcattgatccagcaggtacatacaaaccaggtggattgtttgttgatctcaccggaaaagctggccaacgagcagtttgttgagcaagcgctccaccctattctggataacgtagggttattggttgtggatgaagcgcactgtatctcggactgggggcacgactttagaccggattatcgtcgcctgctcaatattttgcgccagatgccccccaacatgccggtattaggtacaacggccaccgccaatgatcgggtcattacagatgttttagatcagctgggtgatattgaggtgctccgcggccctttggttcgcgatagcttgtcccttcaaaacattgtccttgcagatcaggcaagtcgtctcgcctggctgtcagaaacaataccgactctgcagggggctggaatcgtctatgtgcttacaaagcgagatgcagaacaggtaaaaagctggctgttgagtcagggaattgatgccaaggcctactacagcggcattgagcattctgatttcgagaactccgatcagtaccgggagcatctggaagatctgctgctcaacaatcagctgaaggtgcttgtagccacgacggcactgggaatgggttacgacaaacccgatcttcactttgttattcactaccaaacaccgggatcaatcgtatcctattaccagcaagtaggccgggccgggcgcggtattgacgagtctctcggcattctactttcaggggcggaggatgagcgtattcacgactttttccgtcgctccgcatttccgaatcagccccagattaaccaggtgctttccgttctcgaagacagtgatggcttatctgtaccgaaactggaagaacgcttgaatatgcgcaaagggcaaatcgaaaaagtccttaaatttctgagcgtggagacccctgcgcctgtatacaaagcgggcagccaatggacaagaacaccggttgcttaccagctagatcatgaccaagtccagcggctcacgaacatgcgagagcaggagtggcaagaaatccaggagtacacgacaacttcgggctgcttgatggaatatctgcgaaggtctcttgatgacccggaggcgcaaccctgtggcaagtgcgctaactgtcttggtgcgccgctggtcagtgcctcgcccgatcgccaaagagtcattgctgcagcgcagttccttcgccactcagaattcgttttcaagcccagggttcaagtggccgccaatgggtttccgcaatacggattgcgagggaacctgccacaaaacctcagagcgcaggaaggcagagtacttagtcggtgggctgacgcagcatggggcggtttggtcgaacaggacaaacatgggggctatttccgggatgaattagtggacgccatggcggaaatgattcagcagcgttggcagccaacgccacggcctgagtgggtcacctgcgtaccctcgctcaagcaccccgaactggtgccggattttgcgcggcggctggcgaataaactgggtctgccattccatccggtaatctccaaagtgcaagataacgaaccacaaaaactacagaacaaccgctatcaccagtgcagcaacctggatggagtgttcgcggttgatgcaggcctcccttccggcccagtcctattggtggacgatgtcgtcgattccggttggaccatgaccgtactggcagccttacttcggcaacaaggaagtggcgaagtctatccggtcgctcttgcctcttctgcaacgggagattga

SEQ ID NO: 138 - DNA, 2091 bp, Microcoleus chthonoplastes PCC 7420
atgacaacccaactgaaagcccaagcactatcgctgctgcgccaagctcttaacaacccaaccgctcaatttcgggatggacaatgggaagccatcgctagcataattttagcgcgatcgcggcttctggttgtacaacgcacaggctggggaaaaagcattgtctactttctcgctactcgcttgctgcggaatagtggtgcaggttccactctcctcatttcacccctcctggctttgatgcgaaatcaaattgtcgctgctaaacggattaatattaacgccgccacgattaactccagtaatcccgaagagtgggaacagattaacgctcaattacaagcaggaatcattgatattctgctgatttctcccgaacgactcgccaatgaagactttcgccaaaaaattctgttacccatctcccaacgaattggcttatttgttgtcgatgaagcccattgtatctcggattggggacatgattttcgccccgactatcggcgcattgtccgtgttttgcaagcgcttcctcaaaccattcccgccctcgctacaaccgccacggcaaataaccgcgttgttaacgatattattacgcaactgggtgcaaatttgctggtatccagaggtactcttacccgaaaaagcttacaattacaaaccattaaattatcgagtcccgccgcacgtatggcgtggttagcggaacatttgcccaacttacccggaagtgggattatttacgcattaactatcaaagatacggaacgagttgcccattggttaaatcagcaagggattcatgctcaagcctaccatgcggctctaacccatgaacagcgtttaaccttagaagaccaactaattaacaatcaaattaaagctttagtcgcgacaacggctttaggaatgggatttgataagccggatttaggatttgttatccactaccagcgtccgggttctgttgttcattattaccaacaagtcggacgagcggggagagcggtagagcaagcttatgggattctgctcagtggggatgaagatcaggaaattactgattattttattcaaacggcctttccaccagaggctcatgttcaggatgttttaaatgcgttagaacaagccgaagatggattgtcggttccccaaatcgagcagcatctcaatctctcgaatgggcaaattaagaaggtattgaaactgttatccctagagtctcctgcacccataactaagcaaggctataaatggtatgcgacgcccgtattttatcaaccggatacagagaaaattgaacggttaacccaaattcgtcgccaagaacaaactcgcatgtttgactatatgaacagtcgagaatgcttgatgacatttctcgccagagaattagatgatccgcagccaacgccttgcggaaaatgtgcggtatgcttgggtagaccgttattacccgaaacctattcactaaaccgagtaaatcaagcgattcagtatctccgtcgcagtgaccaaattatcgaacctcgtaaacaatgggcatctaaagcgctccctagttatgggttttctgggaaaattcgtgacaatttacgcgctgaacccggacgagcattatcactttggggtgatgcgggttggggagaattagttaaacgagggaaatacgataatcatgattttgatgacgccttggtgcagggtgcatttgagatgattcaacgttggcacccccagccttttcccacttgggtaacttgtgttccttccttacatcatccccaacttgtccccaattttgcccaacgacttgcccatcaattacaattaccctttcagccaattgtgcagaaagttcgccatactcagcaccaaaaacagatggggaatagttaccaacaagcccataatctcgatggtgtgtttgacgtgaattcttggcaagggatgaagggggcagtattcttaattgatgatatggtagactcacgttggacattcactgtcattgctgcactgttacgtcgggctggaagtggtctagtttttccgttagcattggcacttaattcgttagcgtaa

SEQ ID NO: 139 - DNA, 2094 bp, Nitrococcus mobilis Nb-231
gtgagagaatacgccgaacacatattgcgtagcgcactggacaatccacaggcgagcttccatccgggccagtgggaggcaatcgacgcgctggtgaacgaacgcaagaagctactggtggtgcagcgcacggggtggggcaagagtgtgatctattttctggtggctcgtttgctgcgtgagcaggggcgtggtcccagtgtcattgtttctccgctgctggcgctgatgcgcaaccagatagatgccgcggacagattgggtgtccgtgccataacgcttaattctaccaactacgatcaggctgatgatctcatcgcggagattcaagccaaccgcgtggactgtctgctggtgtcgccggaaaaattggccaatgaagattttgtgacgcgggccatcgagccagtgctggagcagattggcttcctggtagtggacgaagcgcattgcatttccgactgggggcatgattttcgccccgactatcggcggctgctgaatatcctgatgcaaatgccgcccaacatgtcggtgctagcgacgacggccacggcaaacaaccgtgtgattgacgatgtcgtggcgcagttgggccatatcgaagtgcagcgtggcccgctgatgcggcatagcctgtctttgcaaaacgttgtgctgtctgatcagggcagccgccttgcctggctggctgatactttgccgaagttgcccggcactggcgtcatctacgtccttaccaagcgcgatgcacaacaggtacgcgactggctcgtccattgcgggatcaatgcccaggcatattacagcggcattgagcatgacgattttaccgacaccaaccattatcgcgagcatctggaagcgcggctactcaacaacgagttgaaggtgctggttgccaccacggcgctgggtatgggctatgacaagccggacctggcctttgtcatccactaccaggcgccgggctctatcgtgtcttactaccagcaggtaggccgtgccggccgtggcatcagtcaggcttatggatttttgctggctggttgcgaggaccaggatattcacgagtatttccgccgctcggcctttccatccgaaaatcaggtgcagaaactgctggatgtgctgggcgagtctgatggtctgtcagtggtagagttgcaaaggcacctgaatctgtgtcagggacaaatcgacaagctgctcaagttcctgagcgtagaaagtccgtcgcctatctacaagcaagacaggaagtgggtgcggacgccagtttcctaccagatggatcacgaacaaatcgctcgtctgaccagaatgcgcgagcaggaatggcaggaggtgcaggcttatgtccagaccgatgattgtctgatgatgtttctcggaaaggcactggatgacccttacctcaatccgtgcggcagatgtgccaactgtctggggcaaacactcgttgctaccgagccttcgctagataccgcgcgcaaagcctgccagttcattcgccacgcggaattcgacttccagtccaggaggcaggtggcttccggtgcctttcccaaatacaatttcacgggcaatttgccgcaacgactgcgcgcctcgaaaggtaaaatccttagccgctggaacgatgctgcctggggcagactggtggctgatgataagcacgccggccacttccaggatgcgctggtccttgccatggctgagatgattcgcgagcgctggcagcttgcgccgccaccgcagtgggtcacctgcgtgccttcgcttcgccaccccgaactggtgccggattttaccatgcggcttgcaggccaactgggtctgccgttccgggcagtgatcgacaaggtcaaggataacgcgccgcaaaagttacaggaaaaccgttaccatcagtgcagcaatctggatggtatttttgccataacgggcgatgttacaaatgaaccggtgctgttggtagacgacattatcgactcaggctggacgatgaccgtgctagccgcacttctcaaacagtatggcagcggtgatgtgtaccctgttgcgctcgcttctgccgccccagggaaataa

SEQ ID NO: 140 - DNA, 2079 bp, Nitrosomonas europaea
gtggcctacgacccaaaacgcgcgctggaactgctccggattggctccggacgcgccaatgccactttccgcgacggccaagaagatgccattcgtcacatcgtcgaaggcaaaggccgcttgctggtcgtgcagaagaccgggtggggtaagagctttgtctacttcatcgcgaccaagttgctgagggaagctggggccggccctgcgttactgatctcgccgctgctggcgctgatgcgaaaccagatcgcagcagcagagcggatgggggttcgcgccgccaccatcaactccgacaacatggatgactggacggtagtcgagggcaagctggccaagggggagatcgacatcctcttgatctcgccggagcgcctggcgaacgagcgcttccggacgcaggttctggccggcatcgctgcacagatttcgatgctggtcatcgacgaggcgcattgcatttccgactggggtcacgacttccgccctcactatcgcctgttggagcggattgtcaaaacgctgccgccaaacctgcgcttgctcgccaccacggcaacagcgaataaccgcgtgatggaggaccttgctgctgtgctcggtccgaagctggacgtctcgcgtggcgacttgaatcggacttcgctttcactgcaaacgatccgcctgcccagccaggccgagcgccttgcctggctggcagagcaactggccacgctgcagggccacggcatcatctacacgctgacggttcgtgatgccaatcaagtggctcaatggttgaagacccaaggcttcaacgtggaagcctatacgggtgaaaccggcgatcgccgagaacagcttgagcaggcgctgctcaacaaccaagtcaaagcgctggttgccacaacagcgctaggcatggggtacgacaagccggatctggcgtttgtcatccactaccaaatgccgggatcggtcgtcgcctactaccagcaggttggtcgcgcgggacgcgcactggactccgcctatggagtactcctcagcggtcaggaagagtctgacatcactgactggtttatccggagtgccttcccgacccggcaagaagttgccgacgtcctgggagcgcttgaagacgagcccaatgggctgtctgtccctgagctgctgagccgagtcaatctgagcaaaggacgtgtcgacaagacgattgcactgctttccctcgaagcgccggcgcccatcgccaagcaaggcagcaagtggcagctcacggcggcaacgctgagtgaagcgttctgggatcgagcggaacgcctcaccgcactacggcgagacgagcaccagcagatgcaggactacgtgagcctgccgtttggtgagcacatgggctttttgattggcgcgctcgacggcgatccaagtgttgtcgcagaaccagccttaccgccattgcctgcaaccgtggatgccgagctggtcaaagccgccgtcgaatttcttcgtcgaaccagcttgcccatcgagccacgcaaaaaatggcccgatggtggaatgccccagtatggcgtcaagggattcatcgcacctgcccatcaggccgaatccggcaaggcgctatgcgtctggggcgatgccggttggggcggcttggttcgacagggtaagtaccacgacggccacttttccgatgacctcgttgctgcgtgcgtgaagatgattcaagagtggaatccgcagccgagcccgacctgggtgacctgcgttccttcgcttcggcatcccgaattggtgccgaatttcgcgcaacgcttggctgctgcgctgggtctgccgtttcatatggtcatcgcaaaaacagacgcaaggcccgaacagaaaacgatggcaaacagtacacaacaggcgcgcaacattgatggttcgctcgcactcaacggccagcccatacctcccggaccagtcctcttggtggatgatatggtcgactcccgctggacgctaacggtgtctgcttggctgctgcgcaagaatggtagtggagaggtatggccgatggccctttcacagacggggcatgacgaatga

SEQ ID NO: 141 - DNA, 2097 bp, Nostoc sp
atggtaactccaaataaagaaaaagcattattactgttacgtcaggcattagataacccaacatctaattttcgtccaggacagtgggaagcaatagaagaattaattgaaaggcgatcacgtttactcgtcgtccaacgtactggctggggtaaaagcttagtttattttttagcaacaaaactattgagagataaaggtgctggctgtacccttttaatttcacccctactagccttgatgcgaaatcaaattgcagccgcacaacgcattggaatcaaagctgcaacaattaactctagtaatcaagatgaatggcgagccgtcaaaacacaattattagcaggacaagtagatattttactgatttcccctgaaagactagctaataatgattttagggagaatattctcttaccaatatctcaaagtataggcttatttgtagttgatgaagcccattgtatttctgattgggggcatgactttcgccctgattatcggcgaattgtgagaattttacaaggactaccaaaaaatattcctatcctcgctacaacggctactgctaataaccgagttattgatgatattatcgctcaattaggtgctaatttgcaggttgtgagaggtaatttaactagagaaagtctgcggttgcaaaatatttcccttcccagtccagcagcaagaatggcttggttagtcgaacaattacctcaactacctggaagcggaatcatctatacattaacagtgagagatgctaatcgggttgctaactggttacaaactcaaggcattaatgctaagtcataccatagcgatttagaaagtgatattcgtataacattagaagacgaactattaaataatcaaattaaagctttagtagcgactacggctttaggtatgggttttgataaaccagatttaggttttgtgattcattatcaacgccctggttcggttgtccactattatcaacaagtaggcagagcaggtagagcagtagacattgcttatggcattcttctgagtggtgatgaagatgaggaaattactaactactttattaatacagcttttcccccacaaattcatactcaacaggttctgaacatactcaaccaagaagaaggtctttcagtaccacaattagaacaaaaattaaatctttctagaggacaaatcgacaaagttttaaaactgttatcattggaatctcctagcccagtcactaaaatagattctaaatggtatgtgactgctattaactatcaatatgatgaacaaaaaattgccaacttaacagcaattcgccgccaagaacaagccacaatgtcagcatatatgcagagtcaacaatgcttaatggcttttctggcaaccgaattagatgacgcaaatccgcaaaattgtggtaaatgtgctgtttgcgtaggtagacctttgctaccagtaaattgttcaatagaaatgctaaatcaagctgttttatatttacgtcgcagtcaacaaatcattgaaccgcgtaaacaatggccctcacaagcattactcagttataaattttctggaaatattagcaataatttaagggcgcaggaaggaagggcattatcattgtggggtgatgctggttggggtgaattagtaaaacaaggtaaatatagagataattattttaatgatgtattggtgcaaggtactgtagagatgattaaacgttggcaaccacaaccgtttcctagttgggtgacttgtgtgccttcattaaatcgtccagaacttgtaccaaactttgctcaaaggttagctgagaagctaggtataacttttgtgccaattgtgcgtaaggttaagcaaacacagctacagaaagatatgagcaacagttaccaacaagctcataatttggatggcgcatttaaaattgatgcttggccaggaattggtggttctgtattcttagtggatgatatggtagattcccgttggacttttactgtaattgcggcgcttttacgcggtgctggtagtggacaggtttttcctgtggcattagccctcaatacattaggtcaaggggattag

SEQ ID NO: 142 - DNA, 1401 bp, Oscillochloris trichoides DG6
atggcttggttggcagaatatatcccccaacttccactgagcgggattgtttatacccttactgttcgtgactgtgagcgtgttgctagttggttacaatcgcaacacatagatgcagccgcctatcattctgatattgattcagcgcaacgcgaagaacttgagcaacgcctcctgagcaatgatctcaaagtgcttgtagcgacaacggcgttgggcatgggctttgataagcctgatctcggctttgtgatccacttccaacggcctgcatctgttgtccattactatcaacaagttggacgtgctggtcgggcggtcaacgatgcttacggaataatgctcagtggcgatgaagatcaggatattgctgactattttatccgcacggcatttccgccagaaggacatgtgcttgaggttctgtctgcgttggaatatgctgacaatggcttaacattgaaccaactcgaagcacggttgaatctgtcgcatagtcagatcgaaaaggtgctgaaattgttatcacttgagtcccccgcgcctatcattaaggaaggaacatgttggcgggtgactcatatcacctatattcctgatacacaaaaggtaaaacgcctgaccgatctgcgaaggatggaacaagcgcggatgcatgattatttgcacagccgcgagtgtttgatgcagtttctcggtcgtgaattggatgacccaagcgccaacccgtgtgggcgttgcgctgcttgtattggtgcgccacttattcccgtggagtacggtaatgagatcgcaaatcaggctgccacatttctacggcgaactgagcaggtcattgagcctaagagatcttggaagggtgattccctcaaccaacatggctggtctggacgtattccttctgaactgcgtgccgaaccaggccgtgcgcttagtatctggggcgatgctggttggggggcactcgtcaagcacgggaagcagcacgatggacattttgatgatgcactcgtccagggtctggttgagatgatacgggatcgctggaaacctcagccgtttcctagatgggtaacatgtgtcccttcacagacgcaccccgatctggtgcctgatcttgcacgccgtcttgctgtagcacttaatctgccatttgttgcctgtattcagaagattcgtcctaccaagccacaaaagttcatgcagaatagctatcaacaggcacacaatctggcgggagcctttagcgttgaggcatgggagcggatggctgaacccgtctttctgattgatgatatgattgattcaggctggacactgacggtcatcgcagcattgttacgcaacgcaggcagcggcccagtctttccagtcgctctggccctggttcaacatacgtag

SEQ ID NO: 143 - DNA, 2076 bp, Pelodictyon phaeoclathratiforme BU 1
atgatgtatacgtcggcaagggcattggagcttctcaggattggttccggttatccctgtgcggtgttccgtgagagtcaggaggaggcaattcgttatatcgttgaaggtcagggacgattgttggttgtccagaagactggctggggtaaaagctttgtctattttatcgctaccaaattgcttcgtgaagggggtaatggtccagcgctcttgatttcaccattgcttgcattgatgcgaaatcagattgaggctgcagagcgaatgggtgtacatgcagtgacgatcaactcagataatccggatgactgggctgaagttgaaatgagcatcgctcgtaatgcgatagatattctgatcatttcacctgaacgacttgcgaatgaacgcttccgcaccaatgttctggctcctattgcttcgcagattgcgatgttggttattgatgaagcgcactgtatttctgactgggggcacgactttcgaccccactaccgactgctcgaacggattgtcaaaaccttgccaccaaacctgcgacttctggcaactactgctaccgcaaacaatcgtgtcatggatgatttagtcgaagtgcttgggccgcaattggaggtgttccgtggtgatttgaatcgtccttcgttgaccttgcaaaccatatctctacctgatcaagcccagcgccttgcatggctggctgaacagctcgatacgcttcaaggccacggaatcatctataccctcaccgttcgtgacgcgaacatggttgcaggttggctgaaaagtcgtgggttcaatgttgaagcctacacgggcgaaactggtgatcgccggccggagtttgagcaggctctgcttaataaccgggttaaagctcttgttgctacttccgcactgggaatgggttacgataagccggatctggcatttgtgattcattatcagatgccgggatcggttgttgcctattatcagcaggtagggcgtgctggacgtgctcttgaatcagcatatggtatcttgctgagtggcagggaagagacggatattactgattggtttatcaagagcgcttttccgaccaggcaggaagttgatgatgtcattaacgctcttgaaaatgaaccttcggggctctctgtgcctgaacttcagggaaaagtgaatatcagctatggacgtattgaaaagaccattgcattgctctcgctggaatcacccgcccctgtcgcaaagcaagggagcaagtggcaattgacagccgccaaacttggtgaaggattttgggctcgtgcggatcgacttaccgcgttacgtcgtgatgaacaacgacaaatgcaggaatatcttaaacttccatttggtgaacatatggggtttcttgttcaggcgcttgatggtgatccgaatgaggtcagttttcctttattgttaccgttaccgataactgttgaagaggctcttgttcaggaggctgtcgcttttttgcgccgcaccagtttgcctattgagccaagacttcagtggcctgccggtggtatgccacaatatcgggtgaaaggaaaaattcctgtaaacctgcaggcagggcccggaaaaacactctgtgtttggggtgatgcagggtggggtggactcgtcagacaaggaaaatatcatgacaactgtttttctgatattttggttactgcttgtgttgaaatgattcagcaatggaatccggaaccagcaccgacatgggtaacgtgcgttccgtcgttgcgtcaccccaatctcgttccggattttgcgaagcgccttgctgatgctctgggactgccgtttcaactgcttcttgtaaaaacaaataaccggccagaacagaaaacaatggcaaacagtacccaacaggctcgaaatattgatggttcactcgcggtcaaggaacaaagagtgccggatggtccggttcttctggttgacgacatggtagattctcgctggacattgacggtatctgcctggctcttgagaacatatggaagtggtgaggtttggcctttggcacttgctcaaacaggatacgattaa

SEQ ID NO: 144 - DNA, 2103 bp, Photorhabdus luminescens
atgaatcgagctcaggcccaacaactactacaaactgcactagccaatccaaatgctgagtttcacgatggtcagtgggaagctattgatgctttagttaaccaacggcagaaactgttggtagtacagcgtactggctggggtaaaagctcagtttactttatcagcaccaaaattttccgtgatcgcggcatggggccgacgattattgtttctcctttgctggctctgatgcgtaaccagattgagtccgcccagcgcctgcgcatcatagccgagactatgaattccaccaatacagcggactggcagacggtgacacaaaggattataaataatcaaatagattgcctgctgatttctcctgagcggctcgccaatgataacttcattgaaaccgtgcttcatcctatcgctgaccgtattgctctgatggtgatcgacgaagcccactgcatctccgactggggccatgacttccgcccagactatcggcgtatagtcaatattttgcgccagttgccacctaatacaccggtattaggcacaacggccactgccaataaccgcgtggtggctgatatccaaacacaactgggtaatatccagatccagcgtggtccactgatccgtgaaagcctctcgctacaaactatggtgctgcctgatcaatcctctcgcctagcttggttggcgcaagtgattcccacattgcatggtactggcattgtgtacaccttaacagtgcgtgatgccgaacaggtagcaaattggttgaacgtcaatggcataaatgccagagcctaccatagcagtattgaggctgatggttttgaaaacagtaacgattaccgacaatatcttgaagagttattgctaaccaatcaacttaaggtgctggtggcaactactgcattgggtatggggtacgacaagccggacttaagctttgtgattcactatcaagcaccaggttctatcgtggcttactaccagcaggttggccgcgcagggcgtggtatcgacaacgctattggtgtgttgatatctggtatagaagatcaagatattcataagtttttcaggaattcggcattcccatcagaaactcaggtaaacgaaattttgcaagtactagataatagtgatggtttatcgcttcgtagcattgaagagcaaaccaacctacgctatggccagattgaaaaggtattaaaactgctaagtacagagaacaccgctcctgtgattaaagtcggaaacttatggcgcagaatacccgtgccttatgctatggatcgcacccgtatcgctcacctcaccaaccagcgtaagcaagagtgggctgaagtacaggcttatctgtcagataccagatgtaagatgactttcttgcgccgtgtactggatgatcacgaccctacaccttgtggcaaatgctcgtcatgcatcggccagcctgttgttaatcaggctattaatccagtgttagttcatcaggcaggcacttttcttaaacatgccgaaatgattatccagccaagaaaacaggtagcaacttctaatcgagcctttcctacatattgttttccacggcagttaggttgcttagttgctcagccaggtagggttctctctcgatggggagatgctggttggggaaagactgttattgaaaataaacattcgggttatttttctgatgaactagttgatgctatggctgaaatgatctcacagcgttggcagcctaatcctagtccaacttgggtgtgttgtgttccttccttaagacacccgaatttagtccctgcatttgcatgtcgtttagcacaaagattgaacctgacatttgttgatgcggtagcaaaagttcaagataaccagccccaaaaggaacaacaaaatagttttcatcaatgccacaaccttgacggtgtttttgagataacacaaattatacaaaatcaaccagtactccttatcgacgacatcgttgactctggttggactcttaccgttattgcagctttgttacagcaagcgggtagtggtattgtatatcccgcagcacttgcctcttcttcggtgaaagactcatga

SEQ ID NO: 145 - DNA, 2082 bp, Polaromonas naphthalenivorans CJ2
atgcctttttatgtgcctgagcgagcgttagaacttctccgaaagggctcgggccgtgccgatgccaccttccgagatgatcaggcgcaagcaattcgtcatgttgttgaaggccgaggccgcctgctggttgtgcaaaagaccggctggggcaaaagtttcgtttacttcatcgccacaaagttgcttcgtgatgctggtcagggtccagttttgttgatttcgccgttgctggccttgatgcgaaatcagattgccgcagcaaaaagaatgggtttgcgggccgccaccatcaattctgacaatctggaagactggactgatgttgaagccaagctgggcagcgatgagattgatatcctgctgatttcacctgagcggctggcaaacgaacggttccgcacacaggttcttgtaggtatcgccgggcgcatctcgatgttggtgattgatgaagcgcactgtatttcagactgggggcatgacttccggccgcactatcggctgctggagcgcattgtcagaaccttgcctcccaatttgcggcttctggccactaccgcaacagcaaataaccgggtgatggacgatctcgctgctgtactgggtccgaatctggaggtatcacgcggtgacctgaaccgtacttcgctgacgctgcaaaccatacgcttgccaagccaggctgaacgtctggcttggctggccgaacagctcgccacccttgaaggtcacggcatcatctatacgctgacagtgcatgatgccaatcaagtggctgattggttaaaaactcgtggttttaacgtcgaggcctacacaggtgaaacaggtgaccgccgggaggagctggagcaggcgttgctcagtaaccaaatcaaggcactcgtagccaccacggccttggggatggggtatgacaaaccagatttagcctttgtgattcattatcaaatgccgggttcagtcgtcgcttactaccagcaggtgggccgcgcaggacgcgctctggagtctgcctatggcattttgttgagcggcgaagaggagtcgagaatcgctgactggttcataaaaaccgctttcccgacccggcaagaagtcgctgatgttctggatgcacttgaaagggaacacaacggcctttcggttccagaattgttgagccgagtcaatctgagcaagggacgtatcgaaaagacactggcgctgctttctctcgagtcgcccgctcccatcgcaaagcaagacagcaagtggcagcttacagcggcaattctgagtgaggggttctgggcgcgagcggagcgacttaccgcattgcgtcgcggcgaacaccggcagatgcaggcgtatgtcagcttgccgtttggcgagcatatgggttttcttatccgggcactcgatggtgattcgagtgttgtgaatccgcctgcgctaactccactgtcaacccatgtaaatgatgaccttgtgcgggacgctgtggcttttttgcgtcgcaccagcttgccaatccagccccgtctccagtggccagctggcggaatgccgctgtcgcatatgaaaggaaaaattcctgaaaatttacgagcccagcctgggaaagcgttatgcacctggaatgacgccggttgggggcaactcgtcaaacagggcaaataccgcgatagccactttgcagatagtctggctgccgcttgcgtgaagatgattcacgagtggagcccgcaaccgacaccaacctgggtgacttgcgttccatcactgcgccatcccgatttggtgccgaattttgcgcagcgattggcggctgcgctgaacttaccctttcacagactactccaaaagacagacaacaggcccgaacaaaagaccatggaaaacagcgctcagcaggcgcgcaacattgacggttcgctggccctcaatggtcaggccgttcctgatggcccggtgctattgattgacgacatggtggattcgcgctggaccttcactgtcgctgcttggctattgcgcaaaggtggcagtggcgaggtttggccgctagcgctttcacaaacggggagtgaccaataa

SEQ ID NO: 146 - DNA, 2100 bp, Providencia stuartii ATCC 25827
atgaaccgtgccgaagccctacaactactaagaaccgctctagctagccctactgctgaatttcgagatggtcagtgggaagcgattgatacactagtaaatcatcgacagaagttactcgttgtacagcgaacaggttgggggaagagttcggtttattttatcagtacgaagattttccgcgatagaggtatggggccaacgattattgtatcgccattgttggccttgatgcgcaaccaaattgaatcagcggaacgtttggggattgtggctgagacgatgaactcaactaaccaagatgattggcaaagtgttacgcagcgtattcacaataatcaaattgattgtttgttgatttcacctgaacggttagctaatgatagttttattgaaacagtacttcagcctattgcagatcgtatcgctttgatggtgattgatgaaactcattgtatttccgattgggggcatgatttccgccctgactaccgtcgcattgtgaatattttgcgtcagttacctgcaaacaccccagtattaggcaccactgcgacggctaataatcgtgttgtcgatgatattcaggccttacttggtcatatccggatccagcgtggttcattgatccgagagagccttgcattgcaaaccatggttctgcccgatcaaagttctcgtctagcatggctagctcaggtaattcccaatttgccgggtacaggcatcgtttacacattaacagtacgtgatgctgaacaagttgctgaatggctaaatcgtaacggtatcgatgcgaaggcttatcatagcagcgttgaaagtgatgattttgaaaatagtaatgtttaccgtcaacatttagaggaattactatttaataatcaattaaaggtgttggtggcgacgaccgcgttaggcatgggttatgataaacccgacctaagtttcgtcattcactatcaagctccggggtctattgtcgcttattatcagcaagtagggcgtgctggccgtggtattgaccatgcagtaggcgtattaatgtctggtgtagaggatcgggacattcatgaatttttctggggctcagcgtttccatctgaaatgcaagtcaatgaggttttacaggcgctagaacagggtgatggtttatcaatacgtaatatcgaggagaaaactaacctgcgctacgggcagattgagaaggtacttaaattattgagcgtggaaaacccggcgcccgtcattaaaaatggtagccgctgggtaaggacgcctgtacattaccaaatggatcatgcgcgtattgaacatttaacaggacagcgtgttcaagagtggcaagaagtacaggcctatttgaaagacagtggatgcaagatgacctttctgcgcaaagctctagacgaccatgacccgactccttgcggtaagtgtgcatcctgtatagcacgcccagttgtcaaccaagccatcgaccccgctttggttcatcgggcgggaacttttcttaagcacgccgagatggcgattaaacctaaagcacaggttgccgctaatgctttcttggagtatggctttaaaggtagtctgccacaaaatctccgtgctcaagaaggacgggttttatcacgttggggggatgctggttgggggcgtttagttgcaaacaacaaatatgctgggtattttagtgatgaattagtcgaagcgatggcagaaatgatccaaaaccgctggaaaccaacccctgcaccacaatgggtctgttgtgtaccatcgcgaaaccatccagaattagtaccaagttttgctcgccgtttagcctcgcgactaggcttgccatttgtgaattctgtgagcaaaattaaagataaccagccacaaaaaagtcagcaaaatcgtttccaccagtgccagaatttggatggcgcatttgctattacagaattattatgtgggcagcccgtacttttggtcgatgacattgtggactccggctggacgctaacagtcatcgcggcattattacagcaggcaggcagtggtatggtatatccagttgcacttgcctcttcttcggtaaaagactcatga

SEQ ID NO: 147 - DNA, 2208 bp, Pseudomonas aeruginosa 39016
atgcttgtcgtttttctgtcttgggctgatttccggtattttggtcaccgttgggtcaccgttagtggaagtctacatagcagcaagcagttgtcgctttggccgaaaatggcaagggagggcagtaaagtggcttacgatccaagacgcgcgttggaattactccaaattggctccggaagtgccgatgccaatttccgtgacggccaagaagatgccattcgccacatcgttgaaggcaaaggccgcttgctggtggtgcagaagactgggtggggaaagagcttcgtctatttcatcgcgaccaagttgctgcgtgaagagggctccggtcctgcactactgatttctccgctgctggcgttgatgcgaaaccagatcgccgcagcagatcggatgggcgttcgtgctgccacgatcaactcagacaacatggacgaatggacggcagtcgagggtaaactagctaagggggaggtcgacattttgttgatctcgcccgagcgtctggcaaacgagcgcttccgcacccaggttttggctggcatcgccgcacagatctccctgctggttatcgacgaagcgcattgcatttccgattgggggcatgacttccgcccgcactatcgtctgttggagcgcatcgtcaaaacgctgccgcccaacctgcgactcctcgctaccacggcgacagcgaacaaccgcgtgatggaggaccttgctgccgtactcggtccgaagcttgatgtctcgcgtggagacttgaatcggacttcgctttccttacagaccatccgcatgcccagccaggctgaacgtcttgcttggctggcagagcaactctctacactgcaaggtcacggcatcatttatacgctgaccgtgcgtgacgccaatcaggtcgcggaatggctgaagacccaaggcttcaatgtggaagcctacaccggggaaactggtgatcgccgcgagcagctggaacaggcgctgctcaataaccaggtcaaagcgctggttgccactacggcattgggcatgggctatgacaagcccgacctggcgtttgtcattcactatcagatgccaggctcggtggtcgcctactaccaacaggttggccgcgcggggcgtgcgttggactccgcctacggcgtactgctaagcggcgaggaggagttcgacatcacggactggttcatccgcagcgccttcccaacccgaaaggaagtggccgatgtcctgggagcgctcgaagaagagcccaacggcttgtccgtccctgagctgctgagccgagtcaatctgagcaaagggcgcgtcgagaagacgattgcgctgctctcactcgaagcgccggcccctatcgccaagcaaggcagtaagtggcagctcacggcggcaatgctgagcgaagcgttttggagtcgcgcggaacgtctcactgcacttcggcgagacgaacaccagcagatgcaggactacgtcagtctgccgtttggtgagcacatgggctttctgattggagcactcgacggcgatccaagtgctgtcactgaaccagccttaccgccactgccaataagcgtggatgctgagctggtcaaagcggccgtcgcatttcttcgtcgcaccagcttgcccattgagccacgcaagaaatggcccgatggcgggatgccccagtacagcatcaagggattcatcgcgcccgagcatcaggccgagtccggcaaagcgctatgtgtctggggagacgctggctggggcggcttggttcgacagggcaaataccacgacggtcatttttcagatgaccttgttgctgcctgcgtgaagatgatcaaagagtgggatccgcaaccagcgccgacctggttgaccagcgtaccttcgcttcggcatcccgatttggtaccgaatttcgcacaacgcttggctgccgcgctgggtctgccgtttcatatggtcatctcgaaaacagacgcaaggcccgaacagaaaacgatggcaaacagtacacaacaggcgcgcaacattgatggctcgctcgcacttaacggccagcccatcccgcccgggcccgtcctcctggtagatgacatggttgattcacgctggacgctaacggtgtctgcgtggctgctacgcaagagcggcagtggcgcggtttggccgatggccctctcgcagacggggcacgacgaatga

SEQ ID NO: 148 - DNA, 2097 bp, Pseudomonas syringae pv B728a
atgcaacggaacgatgcagagaaactactgaaagtcgccatcaacaacggagccgctacgtttagggatgggcaatgggaggcgattgatgctctggtcaaccatcgcaagaaactgttagtcgttcaacgcactggttggggcaagagctctgtttactttatcagcacgcgaattctgcgtgatcgagggcaaggcccaaccataatcatatcgcccctactagccctgatgcgcaatcaggtcgacgcagctcagcgactagggatcaatgccgttaccattaactctaccaatactgacgaatgggaaaaggcccgtcaggatgtgcacgccaaccgagtagattgcttgttgatctcaccagagcggctagcaaatgacggcttcatggaaacctttctgcagcccatcgcagatcgcatcggcttgatggtaatagatgaggcgcactgcatttccgactgggggcatgatttccggcccgattatcgccgtatcgtcaacattctgcgcttccttccccccaacacacccgttttgggtacgactgcgactgcaaatactcgggtggtgaacgatattcaggctcagtttggagatataaacatcgtccgtggccctctggcccgagaaagtttggcgttacaaaatttgatcatgcccgatcaagccagccgtctggcatggctggcgcagaccattccaaccttacctgggacgggcatcgtttatgcgctcacccagcgcgatagtgagcaggtcgcccgctggcttcgcgctaacggaatcgatgctgcttcctatcacagtgatgtcgcccactctgactttggcaatagcgatcaatatcgccaacatctagaagatgaactgctggcaaacaagctcaaggtgctcgtcgcgaccactgcgttaggtatgggctatgacaagcccgaccttggcttcgtcattcactatcaagcgcctagctcgcttgttgcctactaccagcaggtcggtcgggcaggacgggcaatcgattactcactcggcttgctcatgtctggggaagaggacgagaaaattcatgcgttttttagacgcgcagcttttcctcccgcagggcaggtcaatcatttgctgagtgtcctagcgaaatccaatgggctgacgattcgtgaactagaagagcacagcaacctctcacatgggcagattgagaaaattctcaagctcctgagcgtggaaagcccagcgccactcatcaagcaccaaagcaaatggctacgcaccccaatccattacgagctggatcagaatcgtgttagcaggcttaccgagctacgagagcatgaatggcagcaggttctggcatacttgaatgaaccaaggtgccttatggcgttcctacgacatgcattggatgacgcggagaatgatgcttgcgggaaatgcgtgcgctgcctagagagggagttggtatcaagtaaagtagacggtagattggtgcatcaagccgctacctttattcgccatgccgagcttccaatcaagcccaagaagcaaatcgccaagggaggctttgagtattacggcttcccgaccaacctccctctcaacatacaggcggctgaaggtagagtcctttcacaatggcgtgatggaagctggggagaattagctgccaacggcaaggagctcggccattttgacgatgctctggtttcagccatggcagaaatgatccaatcgcgctggcaaccgaatcctaaacccacgtggttgtgctgcgtgccttctctagggcatccaatgttagtacctgactttgctcagcgcttggcgaatgcattggggatccccttcgtcaactgtgtgaccaaggtaaggcaaaacgagccgcaaaagtggcaaaacaatcgcttccaccagtgtcggaatctagatggtgtgttcgccgttagtgcacatattcctcctggcccggtgctgctggttgatgacatgatcgattcaggctggacaatgaccgtcattgccgcactgctcaaacaagcgggcagcgaacacgtctacccgctggcaatctcatctacggcaagcaacgcatga

SEQ ID NO: 149 - DNA, 2127 bp, Roseiflexus castenholzii DSM 13941
gtgcacgccctgaacgaggttctcactctatcaacatctatgcccctgcgacactacgccgagcatcttctaaagcaggcgctacgcaatccatcagcaacttttcgagacggtcaatgggaagcaattgccgatctggttgaacgtcgcgcgcgtctgctcgtcgtgcagcgcaccggttggggcaagagtctggtctatttcctggcgacacgcttgttgcgtgaacgtggatcaggaccgacactgctcatctcgcccttgcttgcactcatgcgcaaccagttgcttatagcagagcgtgttggcgttcgtgctgcaacgatcaattcaagcaacaagaacgaatggaccaacgtgctatcccacctccacgctggcggtatcgatatgcttctcgttgcacccgaacgtttggcaaacgacgagttccgcagtgaggcgctgcgcccgattgccgacacgatcagcttgttcgttgttgacgaagcgcattgcatctcggattggggccacgattttcgtcccgattaccgccggatcgctcgtgtgctccaaatgcttcctcctactattcctgtcctggcaacaactgctactgccaataaccgtgtcgttgctgatattcaggtgcaattaggcgtgaacttgcggattgtccgcggacctctagcgcgcaacacgctgcgtctgcaaaacatcgcgcttgacagtcaggcggaacgactggcgtggcttgcagcacatattcccgacctgccggggagcggcgttgtttacacactgaccgttcgtgatgcacagcgtgtggcgtcctggctgcaatcgtgcggaattgatgcgcatgcctactggggagacctcgatagccagactcgtgaggatctcgagcaacgtctgctggagagtcgtatcaaggtattggttgcaacaacggcgcttggcatggggttcgataagccagatctcgggtttgtggttcattttcagcgaccgggatcggtcattcactactaccagcaggttggacgcgccgggcgcgctatcgatcaggcatatggcattctgttgagcggcaaggaagatcaggatatcaccgaatacttcatcacgaccgcatttcctccacgagaccacattgagatggtgttgcacacgcttgagtcggcagacgaaggtttgacgatggcgcagattgaaagtcgggtcaacctctcacgcagtcagatcgaaaaaacgcttaagatattatcggtggaaacgccgtcccccgttaccaagatcgacaaccgctggttcgcaacgcctgtcaactacacgatcgatctacaaaggatcgaggacctgaccactctgcggcgcgctgagcaggaacggatgcgcgaatatgttcatgctagcgaatgtctgatggtctttctcaaacgggaactggatgatcccgatctgcagccgtgtggccagtgcgctgtgtgtatcggtcaaccgctggtatcgccgacttatcctgaggcgctagagcgtcgggcggttacttttttgcaacgtcatcaccagcgtatcgaaccgcgtcgtatgtggcccggcgacgcattgcaggtttatggatggcgtggcaaaatatcaccatcgttaatggccgaggaaggacgggcattgtgtatctggggcgatgctggttggggcgagttggtgaaacgtggtaagcagatcgatggacgcttcgataatgcgcttattgacgctctggtcgagttggtgcgtcagcgctggcttccagaaccggcgccagggtgggttacctgtgttccatcgctcacgcacccgacgctggttgcggatatggcgcaacgtctggcgcagcggctgggattgccctttgtggcggcagtgcgcaaagttcgtccgacggaacctcaaaagcgcatgcagaatggttttcaacaggcgcataatattgcgggcgcttttgtcgtggatcgctggagcggcattgatggcccggttctgctggttgatgacatggtcgactccgggtggacgtttacggttgtcgctgcacttttgcgcgaagccggcagtggaccggtctttccgctggcgctcgcactggtgcagggacattga

SEQ ID NO: 150 - DNA, 2100 bp, Shewanella baltica OS155
atgaatagagatcaagctaagctccacctgcaaactgctttggcaaatactgacgccgatttccgtgatggccaatgggaagcgattgatgctctggtcaatcatcggcagaaattgttagtggtgcagcgtacaggttggggtaaaagctcggtttactttatcagtaccaaaatttttcgtgatcgcggcatggggccaaccattatcgtttcgcctttgctggcgttgatgcgcaatcagattgaatctgccgcgcgtttaggtatcgttgctgaaaccatgaactccacgaataccgctgattggcaggcggttactcaacggattcttaataatcaaatcgattgtttgctgatttctcctgagcggctggccaacgataacttcattgaaaccgtcttacagcctattgccgaccgtatcgccctgatggtgattgatgaggcgcactgtatttctgattggggccacgacttccgccccgactatcgccgtatagtaaatatcctgcgccagctacccgctaacacaccggttttaggcaccactgcgaccgcgaataaccgcgtagtagccgatattcaaacccaggttggtgacattcaaatccaccgtggcccgttaactcgcgaaagccttgccctacaaaccatggtgttacccgatcaggcgtctcgcttggcctggttagttcaagtcattccaactttaccgggtacggggattgtttacacattaacagtgcccgatgcagagcaggtagctaactggctcactaataatggtattgatgctaaggcttatcatggcagcgtagaggcagaaggctttgaaaatagcaatacgtatcgccagcacttagaagagttgttactcaacaatcggttaaaggtgttagtcgccactacagccttgggtatgggctacgataaaccggatttaagttttgttattcactaccaagcgccgggctctatcgttggttattatcagcaggtaggccgagcagggcgtggtattgaccatgctgttggcgtattgatgtctggtgtggaagatcaggatattcatgaatttttccgcgagtcggcgttcccatctgaggcacaggtgaatgaaattttacacgtactggaacaaagcgatggtttgtcattgcgcagtattgaagagcaaaccaacctgcgtcacggtcaaattgagaaagttcttaaattattgagtgtggaaaacccggctcctgtaatcaaagacggcagccgttggttcagaactcctgttcgatatcaaatggatcatgcccgaatcgctcatttaacaggccagcgtgttcaggaatggcaagaagttcaggcataccttgcagatactgattgtaagatgaccttccttcgccgagcgctggacgattttgatccaacgccctgcggtaagtgcgcatcttgtgttggtcggctcgttatcaatattccggtagatcctagtttggcgcatcgtgcggggacctttcttaaacacgccgaaatggtaattagtccaaaagcacaggtcgcagccaatgcgtttttagaatacggctttcgtggtaacctcccacttaaccttcgagcacaagaagggcgtgttttatcgcgctggggcgatgctggttgggggcacatggtagcggacaacaagcatgctggacggttcattgatgaattagtcgaagccatggttgaaatggttcaacagcgctggcagcctaatcctgcacctcagtggatatgctgcgtaccttctcggaaccatccagaactggtgccagattttgctcgcagactagcaattcgtttaggcctaccttttgttgatgctgtaagtaaagtaaaagacaatcaacagcaaaaagggcagcaaaatcggttccatcaatgtcgtaatttggatggggcatttgctgttaatcaagatatcccaactactccagtgttacttgttgatgacatagtagattctggttggacgctgaccgttatatcagcattattacaacaagcaggtagcggtgtagtgtatcccgtggcacttgcttcctcttcggtgaaagactcatga

SEQ ID NO: 151 - DNA, 390 bp, Shigella dysenteriae 1617
gtggaggcatgtgcggaaatggttcgccaacgctggaatccgcatcctgaaccaacctgggtatgctgcgttccttcattaaagcacctcgacctggttcctgattttgcccggcgactggcggcgaaacttggcttaccttttattgatgccattgaaaaagtcgtggacaatccaccgcagaaaatgcagcaaaactgtttccaccagtgtcaaaatctcgacggggcgtttgttattacccctcctttgatgcctggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 152 - DNA, 489 bp, Shigella dysenteriae
atgaatgttaacgctggccatgaaagaacctcaaaagcccgcattatacatcagattcaactaattagaggcatcaccaaattattggtagctgaaaatccatcgcctgtggtgtataccgagaaattatggcgcagaacaattgtcagtttttctcctgaccatgaacgaattaaccatttgatgaatcagagaaaaagtgagctggcagacgttgaaagctatatcacgaccaaggagtgcaaaatgcaatttctgcgccgcgcactcgatgagccaggtgccgaacattgtggtaaatgtagcagttgtcttcagcatccgttgttgtcgcccgacattgatagcggtttactccatgcggcaaacttatttattaaacacgctgacctgccattaaatctcaataaacaggtggcagctggggcttttacgcaatacggatttaaagggaacttgcctgcgagtttacaaggatctacggggtga

SEQ ID NO: 153 - DNA, 2100 bp, Teredinibacter turnerae T7901
atgaaccgtgcccaagcccaacgattactgcaaacagcgctagctaaccccgctgccgaattccgtgatgggcaatgggaagcgattgatgccttggtgaatcatcggcaaaagctattagtggtacagcgtaccggttggggtaaaagttcggtttactttatcagcaccaagatttttcgtgatcgtagtatggggccaaccattattgtttcccccttgctggccttgatgcgcaaccaaattgaatcagcgcagcgtttgggcattgttgcggagaccatgaactctaccaatcaaaacgactggcaggcggtgacgcagcgcattctgaataatcaaatcgactgtttgctgatttcccctgagcgattggctaacgacacctttatcgaaaccgtgatgcagcccattgccgaccgcatcgccctgatggtgattgatgaagcacactgtatttctgactggggccatgattttcgcccggattaccgccgcatcgtgaatattcttcgccagttgcccgccaacacgccggtgttgggtactacagcaacggcgaataaccgtgtcgttgcggatattcaaactcagcttggaaatattcaaattcaccgtggccctttaacccgggaaagcctcggattacaaaccatggtgctgccggatcaggcgtcccgcttggcctggttagcccaggtgatccctaccttgccaggcacgggcattgtttacacttcaactgtggatagtgcagaacaagtggcacagtggttaagcggcaatggtattgacgctaaggcttaccacggcagcgttgaagccgatggctttgaaaacagtaactcctaccgccagcacctagaggagttgctgctcatcaaccagttaaaagtattggtagccaccacggcattgggcatgggttacgacaagccggatttaagctttgtaatccactatcaagcgccgggttctatcgttgcctattaccagcaggtgggccgtgccgggcgtggcattgctcatgcggttggtgtgttgatgtcgggtgtggaagatcaggatattcacgaatttttccgcgattcggcctttccgtcagaagctcaggtgaatgagattttgcaggtgctggaacaaagcgacggtttgtcgattcgcagcattgaagagcaaaccaacctgcgccacggtcagattgagaaagtgctgaagctgctgagcgtggaaaacccggctcctgtgatcaaagacggtagccgctgggtcagaacccctgttcgctatcaaatggatcatgcccgaatttctcacttaaccgggcagcgtgtgcaggaatggcaagaggttcaggcgtatctggatgatgctggctgcaaaatgacatttttacgccgggcgctggacgatctcgatcctacgccttgcggcaaatgttcgtcttgcttggggcagcctcttctcaatgcagcgattgatcccgctttggcccatcgcgcagtcaccttcctaaagcacgcggaaatggtgatcactccaaaagcacaggtggcggccaatgcctttctggaatacggctttcgcggcaatttgccccagcaacttcgcgcccaggaaggccgtgttttatcccgctggggtgatgccggctgggggcggacggtagcggataataagcatgccgggcgtttcggtgatgaattggttgaagccatggcagaaatgattcgagagcgctggcagcccgacccagatcctcagtgggtgtgttgcgtaccttcgttgaatcatcctgaattggtaccggagtttgcgcgtcgtctggctgcacgattgggcttgccgtttatgggtgcagttagcaaagtgaaagacaaccagcctcaaaaaggtcagcagaatcgcttccaccaatgccgcaatctggatggcgcgtttgctgtaactcagctttatcaggggcaaccagttctgttagtagatgacatagtggattccggctggacgctaacggtcatcgcggcactcttacagcaagcaggcagcggtgtggttttccccgttgctctggcttcatcttcggtgaaagactcatga

SEQ ID NO: 154 - DNA, 2082 bp, Trichodesmium erythraeum IMS101
atgattcaaaaagaagcattatcattactaaggcgggctttaaataattccacagctgaatttcgtgatggtcaatgggaggctattgcagctattacggaacatcaaagccgtcttttagttgtgcaacgtactggttggggtaaaagttttgtctattttttagctactcgtttacttagggataaaggtaagggtattactctattaatttccccacttttagcattaatgcgaaatcaaattgctgctgccgaacgaattggaattagggctcaaacaattaattctagtaacaaggaagaatgggaaaaagtagaaaataatttaatggtaggaaaagtagatattttattaatttctcctgaaagattagctaatgaaaacttccgagaaaatattttaatttatatagctaaaaatatcggcttatttgtagttgatgaagctcactgtatttctgattggggacatgattttcgtcctaattatcgaagaattgcgagaattttacaagccttaccaaaaaatattcctgtgcttgctactactgctactgctaataatcgagttgtggatgatattactgttcaactaggtgcaaatctgaaaatatttaggggtttattaactagagatagcctccaattacaaaatatttatttgccatcttattgtgatcgtttaggatggttagcagaacatttacctaatattcctggcagtggaattatttacactttaactgtgagagatacggaaatagttgctaattggttgaagtctcaaggaataaatgtagcagcttatcatagtaagaaaaatacggaagagaaagaagaattagaacagcaattattgaataatgaaattaaagcattaatagcaactgtagctctaggaatgggttttgataaaccagatttaggatttgttattcattatcaacgtcctggatctgtagtacattactatcaacaagtaggtcgtgctggtagggcagtagaaaatgcctatggtattcttctaagtggtgaagaagataaagaaattactaattattttattaaaactgcttttcctccagaagctcataatcaggcaattttggatgcattaaatcaagctgaagatggtctttctgttccaatgttagaggaaaagttgaatcttactaatgggcaaataaataaagttttgaagttattatctatcgaaactccatccccaataaaaaaaatacagtcaaagtattatgctaccccaattaattatcaaacggacacagaaaaaatagcaagattgaatgaaatacgccatcaagaacaggatcgaatgttggattatatgcacagtcaagaatgtttaatgcaatttctgagaaaagaattagatgacccaaatcctagcccttgtggtaaatgtgctatttgcttaggaaaaccacttttaccggggaatgtttcctcaaagtttgtgacagaagctgtacaatttttacgaactagggaacaaattattgagacgaggaaagtctggcggaagaatgctttattaacttataatttaacaggcaaaatatctaaagatttacaagcagaaattgggcgatcgctttctatttggaatgatgctggttggggccaatttgttgaaaaaggtaagtataaagataatcattttgaggatagcttagttcaagctacatacgatatgattcaacgttggcagcctcaaccttttcccacttgggttacttgtattccctctttaacacatccggaacttgttcctaattttgctcaacgtcttgctaaaaaattaggtttaccctttgttccatgtattataaaaattcgtcagacttcactacaaaaagacatgactaatagttaccaacaagctcataatttagatggtgcttttaaagtttataattgggagggaattaggggaaatgtatttttagtagacgatattgtagactcaagatggacttttactgttgttgcggcgcttttacgaaatgctggttctggtaaagtttttccattggctttagcaataaatagatttaaataa

SEQ ID NO: 155 - DNA, 2100 bp, Vibrio furnissii CIP 102972
atgaaccgagttcaggcccaacaactattacaaactgcattagcaaaccctaccgctgagttccgagatgggcagtgggaagcgatagatgccttggtcaatcatcggcagaaattgctggttgttcagcgcacgggctggggtaaaagctcggtttattttataagcaccaaaatttttcgtgatcgcggtatggggccaaccattatcgtttctcccttgctggctttgatgcgcaaccagatagaatcggcacagcgtctaggtattgttgcggaaaccatgaactctaccaataccgcggattgggaagcagtaaagcaacgcattttgaataatcagatcgattgtttattgatctcccctgagcggctggcaaacgacaacttcattgaaactgtacttcagcctatttctgatcgcatctcgttgatggtgattgacgaggcgcactgtatttcagactgggggcacgacttccgccctgattaccgccgcattgtgaatattctgcgtcagttaccgcccaatacgccagtcttgggcacaacggcaacggcaaacaaccgtgtggtggaggatatccaaatacaactgggtgacattcaaatccaaagagggcctttgtctcgcgacagcttggcgctgcaaaccatggtactgccggatcaggcatcgcgtttggcatggttagcgcaggtgatccctacgctagaagggactgggattgtctacacactaacggtgcgtgatgcagaacaagttgcacagtggcttaaagataacggcattaatgcttgtgcttaccatggtagtgttgaggctgaaggctttgaaaacagcaacgactatcgtgagcatctcgaaaatatgcttctccaaaacgatattaaggcccttgttgcaacgactgcactggggatgggctacgacaaacctgatctgagctttgttatccattatcaggctccgggatctattgtggcttattaccaacaggttggtcgtgctgggagaggcattgagcatgcgattggtgtactgatgtcaggagcggaagatgctgatattcatgagtttttccgttcatcagcgtttccttctgagccgcaggttaatgaaattcttgctgtattggcggccagtgatgggttgtcgattcctcgtatcgaagagagaaccaaccttcgtcatggtcagattgaaaaggtcttgaagctgctgagtgttgaaagccctgcgcctgttatcaaagtggaatctcaatggcgcaggacggctgttcatttcaccatggatcgggagcgtatcgaacacctcacgtctcaacgagaacaagagtggcaagaagttcaggcttaccttggtgctgctggttgtaaaatgacctatcttcgccgtgcgttggatgacaatgaccctaccccttgcggaaagtgcgcatcttgtcttgggaaagctgtcattaatcttccagtcaatcctgcattagcccatcaagcggccacattccttaaacatgcggagatggttataaagcctcgagcacaagtcgctgcaaatgcctttttggaatatgggttccgtggcaaccttcctcagaaccttcgggcgaacgaggggcgtgtgctttcccgatggggtgatgcaggctggggtagattggtagcagatcaaaaacacgctggtgagtttagcgatgaactggtcgaagcgatggcgactatgatcttggagcgttggcatccaaacccgatgccgcaatgggtgtgctgtgtgccttcccgtaaccatcctgagctagtgcctcaatttgcacgtaagctggcacttaggcttgagctgccatttatagacgcagtaagtaaagtgaagaacaatcagcctcaaaaaggtcaacagaaccgattccatcagtgtcgtaatttggatggtgcgtttgccatcactcaacccgttcctaatacctcaatgttacttgttgatgatattgtagattcaggatggacgctgaccgttatcgcagcattactaaaacaagcaggcagtggtgatgtatatcccgttgctttggcctcttcttcggtgaacgacgcatga

SEQ ID NO: 156 - DNA, 2097 bp, Escherichia coli E22 (EPEC)
atggaaaagcacgcagctgaattgcttttacagcggatgttaggaaataccaccgctactttcagggaagggcaatgggaagccatagacgcggtggtgaaccaacgacgaaaactgctggttgtccaacgcactggctgggggaaaagtgccgtgtacttcatcgccagtaaaatcttccgcgatcgcggtgctggcccgacaattatcatctctcctttgcttgccctgatgcgtaaccaggttgccgccgctgaacggttaggtattacggctgaaacgttgaattctacaaacagggaagaatggcagcgtattagcgataagttgctgcaaggtgaggtcgattgcttgctggtttccccggaacgtttggcaaaccaagactttatcgaaacggttttatatcctatagccgatcgtattggcttgcttgtggtcgacgaggcgcactgcatctctgattggggccacgattttcgcccggattaccgacgtatattagatattttgcgccaactgcctgcgaataccccagttctgggtacaaccgcgacagcgaataaccgtgtcgttgaggatatccgtcagcaattgggtgacattgtgattcagcgtggaacgctggctcgcgaaagtttggcgcttgatgccttagtcttaggtgaacagtcatcccgtctggcatggttagcaacggttatccctcagttttccaaatcgggaattgtttataccctgactactcgcgatgccgaccttgtcgccgagtggttaaggacaaatggtatcagtgcatttgcttactacagcggcgtgacttgtgaaggcgcggaagattctaatactgccagggaatatctggagcaggcgttgctggcaaataaaattaaagttctggtcgcgacgacggcgctgggaatgggctttgacaaaccggatttggggtttgttattcattaccagatgccggggtctattgtcggttactaccaacaggtagggcgtgccgggcgtgctatagattccgctgttggcatattgctttgtggtggtgaagaccgcgctattcataaattcttccgtgaaagcgcctttcctgcggaggcgcaaattcatgaaatactcaacgtacttagcgagaatgacggtcttaccctacgaggcattgaacaacggacgaatctccgttatgggcaaatagaaaaagcactgaaattattggtagctgaaaatccatcgcctgtggtgtataccgagaaattatggcgcagaactatcgtcagtttctctcctgaccatgaacgaattaaccatttgatgaatcagagaaaaaatgagctggcagatgttgaaagctatatcacgaccaaggagtgcaaaatgcaatttctgcgccgcgcactcgatgagccaagtgccgaacgttgtggtaaatgtagcagttgtcttcagcatccgttgttgtcgcccgatattgatagcggcttactccatgcggcaaatttatttattaaacacgctgacctgccattaaatctcaataaacaggtagcatctggagcttttacgcaatacggatttaaagggaacttgcctgcgggtttacaaggatctacggggcgagtcctttctcgttggggagattccggatggggaaagcaggtagcacaggagaaaaaaacggggcgattcagtgatgagctggtggaggcatgtgcggaaatggttcgccaacgctggaatccgcatcctgaaccaacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 157 - DNA, 2097 bp, Escherichia coli M605
atggagaaacacggagctgaattgctgttacagcggatgttaagtaacaccagcgctactttcagggaagggcaatgggaagctatagatgcggtggttaatcagcggcgaaaactactggttgtacagcgcaccggctgggggaaaagtgccgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagggaagaatggcagcgcattagcgataagttgctgcaaggtggcgtagattgtctgctgatttcacctgaacggttggcgaatcaggattttcttgaaacggttttatatccagtcgctgaccgcatcggtttactggtggtcgatgaggcgcactgcatctctgattggggccacgatttccgcccggattaccgacgtatattagatattttgcgccaactgcctgcgaatacccctattctgggtacaaccgcgacagcgaataaccgtgtcgttgaggatatccgtcagcaattgggtgacattgtgattcagcgtggaacgctggctcgcgaaagtttggcgcttgatgccttagtcttaggagaacagtcatcccgtctggcatggttagcaacggttatccctcagttttccaaatcgggaattgtttataccctgacgactcgcgatgctgaacttgtcgccgagtggttaaggaaaaatggtatcagtgcatttgcttactacagcggcgtgacttgtgaaggcgcggaagattctaatactgccagggagtatctggagcaggcactgctggcaaataaaatcaaagtgctggtcgcgacgacggcattaggtatggggtttgataaacctgatttaggtttcgtcattcattatcagatgccggggtctattgtcggttactaccaacaggtggggcgtgccgggcgtgctatagattccgcagttggcatattgctttgtggtggtgaagaccgcgctattcatcaattcttccgtgaaagcgcctttcctgcggaggcgcaaattcatgaaatactcaacgtacttagcgagaatgacggtcttaccctacgaggcattgaacaacggacgaatcttcgttatgggcaaatagaaaaagcactgaaattattggtagctgaaaatccatcgcctgtggtgtataccgagaaattatggcgcagaactatcgtcagtttttctcctgatcatgaacgaattaaccatttgatgaatcagagaaaaagtgagttggcagacgttgaaagctatatcacgaccaaggagtgcaaaatgcaatttctgcgccgcgcactcgatgagccaagtgccgaacgttgtggtaaatgtagcagttgtcttcagcatccgctgttgtcgcccgacattgatagcgacttactccatgcggcaaatttatttattaaacacgctgacctgccattaaatctcaataaacaggtggcatctggggcttttacgcaatacggatttaaagggaacttgcctgcgggtttacaaggatctacggggcgaatcctttctcgttggggagattccgggtggggaaagcaggtagcacaggagaaaaaaacggggcgcttcagtgatgaactggtggaggcatgtgcggaaatggttcgccaacgctggaatccgcatcctgaacccacctgggtatgctgcgttccttcattaaggcacctcgacctggttcctgattttgcccggcgactggcggcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 158 - DNA, 2097 bp, Escherichia coli M718
atggaaaagcacgcagctgaattgcttttacagcggatgttaggaaataccaccgctactttcagggaagggcaatgggaagccatagacgcggtggtgaaccaacggcgaaaactgctggttgtccaacgcactggctgggggaaaagtgctgtgtacttcatcgccagtaaaatcttccgcgatcgcggcgctggcccgacaattatcatctctcctttgcttgccctgatgcgtaaccaggttgccgccgctgaacggttaggtattacggctgaaacgttgaattctacaaacagagaagaatggcagcgcattagcgataagttgctgcaaggtgaggtcgattgcttgctggtttccccggaacgtttggcaaaccaggactttatcgaaacggttttatatcctatagccgatcgtattggcttgcttgtggtcgacgaggcgcactgcatctctgattggggccacgattttcgcccggattaccgacgtatattagatattttgcgccaactacctgcgaatacccctgttctgggtacaaccgcgacagcgaataaccgtgtcgttgaggatatccgtcagcaattgggtgacattgtgattcagcgtggaacgctggctcgcgaaagtttggcgcttgatgccttagtcttaggtgaacagtcatcccgtctggcatggttagcaacggttatccctcagttttccaaatcgggaattgtttataccctgactactcgcgatgccgaacttgtcgccgagtggttaaggaaaaatggtatcagtgcatttgcttactacagcggcgtgacttgtgaaggcgcggaagattctaatactgccagggaatatctggagcaggcgttgctggcaaataaaattaaagtgctggttgcgacaacggcgctgggaatgggctttgacaaaccggatttggggtttgttattcattaccagatgccaggttcgatagttggttactaccaacaggtggggcgtgccggtcgcggtatcgattctgctgttggcatactgctttgcggcagtgaagaccgtgctattcataaattcttccgtgaaagcgcctttcctgcggaggcgcaaattcatgaaatactcaacgtacttagcgtgaatgacggtcttaccttacgaggcattgaacaacggacgaatctccgttatgggcaaatagaaaaagcactgaaattattggtagctgaaaatccatcgcctgtggtgtataccgagaaattatggcgcagaacaattgtcagtttttctcctgaccatgaacgaattaaccatttgatgaatcagagaaaaagtgagctggcagacgttgaaagctatatcacgaccaaggagtgcaaaatgcaatttctgcgccgcgcactcgatgagccaggtgccgaacgttgtggtaaatgtagcagttgtcttcagcgtccgttgttgtcgcccgacattgatagcggtttactccatgcggcaaatttatttattaaacatgctgacctgccattaaatctcaataaacaggtggcagctggggcttttacgcaatacggatttaaagggaacttgcctgcgggtttacaaggatctacggggcgaatcctttctcgttggggagattccgggtggggaaagcaggtagcacaagagaaaaaaacggggcgtttcagtgatgagctggtggaggcatgtgcggaaatggttcgccagcgctggaatccgcatcctgaaccaacctgggtatgctgcgttccttcattaaggcacctcgacctggttcctgattttgcccggcgactggctgcgaaacttggcttaccttttattgatgccattgaaaaagtcgtggacaatccaccgcagaaaatgcagcaaaaccgttttcaccagtgtcaaaatctcgacggggcgtttgtgattacccctcctttgatgccaggtccggcgttgctggttgacgatatcgtggattctgcatggacgctgacagttctgacagcactgttacgccaggcaggttgcccgacggtttatcctcttgcccttgcttctacctcggtaaaaaattga

SEQ ID NO: 159 - DNA, 2097 bp, Escherichia coli O111:NM B171 (EPEC2); identical to SEQ ID NO: 156

SEQ ID NO: 160 - DNA, 2100 bp, Escherichia coli O139:H28 F11 (ETEC); identical to SEQ ID NO: 115

SEQ ID NO: 161 - DNA, 138 bp, Escherichia coli O157:H7 EC4042; identical to SEQ ID NO: 121

SEQ ID NO: 162 - DNA, 138 bp, Escherichia coli O157:H7 EC4045; identical to SEQ ID NO: 121

SEQ ID NO: 163 - DNA, 138 bp, Escherichia coli O157:H7 EC4206; identical to SEQ ID NO: 121

SEQ ID NO: 164 - DNA, 639 bp, Acidovorax avenae citrulli AAC00-1
atggccgtgcccgaccgcccgaagctgtaccacatctgccatgtagaccggctaccgtccatcattgccagtggcggcctgctgtccgacgcagccgtggtgcaggtggcggcgcctgggactgtcatcggcatgaaccacatcaagcagcgccggatgacagagctgcagctgaccagccacccgggcttgtatgtggggcaatgcgtgccgttctacttctgcccgcgctcggtcatgctctacctgatccacaggcagaacgcggacctggcctacaagggtgggcaagggcccatcgttcacctggaggctgatttgcacaccaccgtggcctgggcaaatgggcaagggctgcgatgggcgttcacgctctcgaacgctggggcgcggtactttgaagaccgtgccgaccttggccggctgggcgaagtggactgggacgcggtggctgcgcgcaactggagtgcccagaaggaaggcaagcaggcggagttcctgctggagcggggcttcccctggcaattgattgaacgcattggggtgctgtcgcagcccattgccacccaggtcgcgcatgcgctgccggtgggaggccatcggccccccgtgcagctcatgcccgcctggtactactga

SEQ ID NO: 165 - DNA, 553 bp, Actinosynnema mirum DSM 43827
gcaggggagtccgctcctcagcgaaccgggcccgctaattggctggtgtggcacttcacgcacgtcgacaacctgacgtccatcgcggccgccgggcaggtcggtcgcggaccacgtcccgttctacatcgcggcgaagtcccccatgctgtacgcggtgcccaaggggcgcgctgaccatcccggtggcgaccgggacacagtgttccagggacttgccgtgggagcgatcgccgcctccggtgctacgtggtgcgtgagcgatgtcaacgcgtcgatcagaacagtctggttcacccgcgacctgaccgctctgggcgagcacgtcgacttcgacctgctgtgccagcgggcctggaattcgacagagcaggacaaccacaggccgaacaggcgagccgccgaagtgctggtcctggacgaagttccgctcgagaacctcgctttcgtcgccacaaaggaagaaaaaaccccggcaagagcgcgaagcgcactcggcacggccggaaccgcgctccagcaccatgtggttccgcacctctaccacagctaa

SEQ ID NO: 166 - DNA, 216 bp, Aliivibrio salmonicida LFI1238
atgaaccaacgagattatggggatgatgaggggcgtagtgtatgtatggctgaatgtttatctccaaatccggttccagctacaaatataactcagatatatgttgccactcaggaaaataaagagtcagttgaatctattttaagagactaccaactctcacctcacgtaaatcttaatgctgctatgtttcccaaacgaggaagccgcgactag

SEQ ID NO: 167 - DNA, 291 bp, Alkalilimnicola ehrlichei MLHE-1
atggccaatgactggtcgcatggtctcaatcccgagaaggccctgatctttcgcatcatgcaccgggataacctcccatgggttctggagcacggcctttactgttgctcagcgccggagaagacggagcgctatcaggcagaggcgctgattcaccaccacttgcctgtctctgcactgctgggtatcggtgcgtatactgatcgggtacgggccgacatcgagagtcaggcgttggctgtcggtcttcagttaaaggtggtcacgcggcccaactggttcttctcatga

SEQ ID NO: 168 - DNA, 627 bp, Arthrospira maxima CS-328
atgaccacctatatctaccatattacccatcttaaaaatttaccctctattttgcgttctgagggcctccttgctaacaatcacttaaaatctcagccgatcaattatgtagatattgctcacgaaaccatccagaataaacgcgctcaaattaatattccttgttccaggggcggcactcttcatgattacgttccttggtattttgcgcctcgttctccgatgctttacgccatatccagaggcaacgttcaaggatatgaacaggggcaaagtccggtgattcacttagtggcaacagcggaggatatcgcagcagcaagtcttccttttgcatttacggacggtcacgcaattgttaggtattcagaattttatgacaatctcgactctctcaatgcgattgattgggagattatgaatgcagggtattgggcagataccctggaggatggagaccggaagcgccgcagacaagccgaattcttggtttatgagttcttcccttggacactcgtgcgagaaatcggggtgatagatgccggaagaaaagccgaggttgaagaaatattacaaaactttacgatttcgacacctgtaaaggtttttcgggaatggtactattaa

SEQ ID NO: 169 - DNA, 627 bp, Arthrospira maxima CS-328
atgaccacctatatctaccatattacccatcttaaaaatttaccctctattttgcgttctgagggcctccttgctaacaatcacttaaaatctcagccgatcaattatgtagatattgctcacgaaaccatccagaataaacgcgctcaaattaatattccttgttccaggggcggcactcttcatgattacgttccttggtattttgcgcctcgttctccgatgctttatgccatatccagaggcaacgttcaaggatatgaacaggggcaaagtccggtgattcacttagtggcaacagcggaggatatcgcagcagcaagtcttccttttgcatttacggacggtcacgcaattgttaggtattcagaattttatgacaatctcgactctctcaatgcgattgattgggagattatgaatgcagggtattgggcagataccctggaggatggagaccgaaagcgccgcagacaagcggaattcttggtttatgagttcttcccttggacactcgtgcgagaaatccgggtgatagatgccggaagaaaagccgaggttgaagaaatattacaaaactttacgatttcgacacctgtaaaggtttttcgggaatggtactattaa

SEQ ID NO: 170 - DNA, 354 bp, Arthrospira platensis NIES-39
ttgcgttctggtggcatcctggctaacaagcgcttaaaatttcagcggatcaattatgtagatattgctcacgaaactattcagaataaacgcgctcaaattaatatcccttgttcaaggggcggcacgcttcacgattacgttccctggtattttgcgcctcgttctccgatgctttatgccatctccagaggcaatgttcaaggatatgaagaggggcaaagtccggtggttcacttagtggctacagcggaggatatcgcagcggcaggtcttcctttaaaatcagttaaaatgaatgggttgatcacaacgagaactcgggaatttttatccggcaatgattcagtttaa

SEQ ID NO: 171 - DNA, 354 bp, Arthrospira platensis Paraca; identical to SEQ ID NO: 170

SEQ ID NO: 172 - DNA, 639 bp, Aurantimonas manganoxydans SI85-9A1
atggctgatttgacggcagagagggccctgatcttccggatcgtacatcgggacaatgtcgaatggattttggacaacggcctgcactgcaagaaggcccacgtctcggacccaaactacgtcgctatcggcaacctcgagctgatcgataggcgaaccaatcacccggttccgtgtcatccaaacggcacgctgggcgactacgtaccgttctacttcaccccattctctccgatgatgctcaacatcaaaactggatatggcgggatccggaagagggccaatgaggagatcgtcgttctcgtctcgtcgctacacaagcttaatgaagctgggttaccaatcgtcttcacggatcggcatgcatatctacaggctgcaagattctatacggacatgcaaaggttgaatgaaatagactgggcaatattgcgggcgaaggacttcaagagaaatgcggaggatcccggcaagttcgagcgatatcaagcagaagcacttgtccacaggtcgcttccgtgtgctggtctattgggtatcgcatgctataatgaggccgtcatggcttctgtgaagcgccagaccgagcgccgggggttaaatatgcgggtcatcgcacagcggaaatactacttctga

SEQ ID NO: 173 - DNA, 633 bp, Bacillus thuringiensis IBL200
atgcattcaaacacatttatatatcatatgactcattatagaaatttatcaaaaatattatcttcaaatggactcgtgtgtgtctctaacatcatgaataatggacaaacatattgtaatattgctaataatgatatacaaagcagacgagcttcttactcagttccagtagaaccttttggaacattacataaatatgttccattctatttcgctccaaaatcacctatgttatacagtatctataaaggtaatgtcatacaatataatgaggggcaagaacctctcatttattttgtatcgtcagcgcaaaaaataaagcaaaacggggttcctttttgttttactgatgggcatggaataatgcatttcactgagtattacaatgatcttacagaattgcacaacattgattgggatataatgaagagtaaatattggcatgacacgatcgaagacaatgatagaaagcgtagaagaatggcagaattcctggtttaccaatatgtcccacttgactgtattattgggattgcggtctatagtcaaaaatataaagaagaaaccgaaaaaatattaactgaacataatgtttctttaccggttaaattaaaacctaattggtattattaa

SEQ ID NO: 174 - DNA, 642 bp, Beggiatoa sp. PS
atgacagttcccgcgcaaccaaagatttatcatatcgtccacatagatcgacttgcctcaattattgcagcaggtgaactgtggtgtgatgctcagattgttgcacaaaatcctggtggcacaacaataggcatgaccagtatcaaacaacgacgtttgtatgaactctccttaaatagccatccaaatttgcatgtgggtgactgtgtgcctttttatttttgtccacgctcaattatgctgtatttaatttaccaggcaaaccatcctaaattagcttattatggtggacaagagcctatagtacatctacaggctgatttacacgcttcagttgcttgggctcacaagcaaaagcgttgctgggcatttaccctttccaatgccggttcatattattttgaagatcgttgtgatcttgcacaacttaatgagctggattgggctgctatccagagcaatcaatggcagcactgtaaagaaggaaagcaggcagagttcttaatggaggctagctttccatggaatttaattgaacgtattggtgtattctcacaaccaatctatcagcaaacaatgaatattttacaaactggcgtgtatcgcccacctattacaattagtcgagaatggtattactga

SEQ ID NO: 175 - DNA, 621 bp, Brachyspira hyodysenteriae WA1
atgagtgctaaaacaggaaaacttatatatcatttaacggctataaataattttgaatctataataagaaatggattatgtcctagaaataaaattaaacctaatattgatgtggcagataatgaaatattaaatggtagaaataaatataatctgttagactatgtaccatttcacttttttattaatacaccatttgacggagctgtaaaaaagaaatataaaactactgattttatttatatatgtttggagcgagaaattgctaaaatgaatgaatttaagattataccatgtcatccgttatctaataggcttattaattatgaaaatattttatttgattatgataaaggatttgatttaatagaatgggataaaatagattcagataatagaaattatgttgatcaagatataaaaaatgcgtgtatggctgaatgtctgtataaaggggttatatcttgcagaattttttcatctatatcagtaaaagatgttgaaagttttaaaaaaatagataaaattttattaaaatttggatttataagtgataagaataaatatacttatcatggggaatatagtttttttgtcgatattaatcctagttggttttaa

SEQ ID NO: 176 - DNA, 642 bp, Candidatus Accumulibacter phosphatis clade IIA UW 1
atgaccctgccggcacggcccaagctttaccatatcgcccatgtggaccgcctgccgtccatcgtgacggacgcctgcctgtggtgtgattcggaggtgtcgcggcgcggaccggcgggaacgatgatcggcatcagcagcatcaagcagcgacgcttgagcgagctcactctgagcagccatccgggattgcacgtcggcgattgtgtgccgttttatttctgcgcgcgttcggtgatgctgtacctgatccaccaggccaatcatccggaactcgcctatcgtgggggccagagtccgatcatccacttcgaggccgatcttggcgcggtggtcgactgggccgatcggcagggccgccgctgggcgttcaccttgtcgaacgcgggatcacgcttcttcgaggatcgctgcgaccttgcccaactcggcgagatcgactggaatgccgtgcaggcgcgcgactggcggcagtgcaaggaaggcaagcaggcggagttcttgctggagcacagtttgccgtggcatctggttgagcgtatcggcgtgcagtcgcgaccgatcttccagcaggtgtccaacgcgctgccggcaagtggataccggccagcggtcgacatagtgagcgattggtattattga

SEQ ID NO: 177 - DNA, 633 bp, Cyanothece sp. PCC 7822
atgccgccttctatctatcacataacccatcttaataatttagcctctattctccgtgcagggggattaattgctaatagtaggctcagacaacaacaaattaattatactgacattgcccacgaacaaattcaagatagaagagctagaaagcgtctcccatgtggagccggtggaacattacatgattatgttcccttctattttgctcctcgttctcctatgctttatgcaattcatacaggtaatgttagaggataccaagatgggcaagactcaattattcatttagttactgatattgaagcccctttttttgaagaggaaaatgcttttgtctttaccgatggtcatgctattatggattattcggatttttatgatgaccttaatgctttagatttcgtcattgattgggaactgatgaaatctaaatactggtttgatacagaagattatccagaccgtaaatggcgcagacaagcagaatttttggtttatgagcgttgcccttgggatctaatcacagaaataggtgtaattaactccacgatacagctacgggttcaaaacatcctaaaaaattttagtgacttgactcctgttagggtttatcctaattggtactattaa

SEQ ID NO: 178 - DNA, 636 bp, Dermacoccus sp. Ellin185
atgtggccgggcatcgttcatttcacgcgtgtggagcatctggggactatcgtccagcagggcctgctcagcgatcatgccgtcggtagcgctctgcagcatgagatcggcaatcgcaacatcaaggcccagcgcacccgtcgagtcgtaccgattcctccggggggagtggtcgccgattatgtccccttttacttcgcggccaggagcccgatgatgtactccattgcgatgggcaacgttccgggctatgccgagggcaccgcacgcatcgtctatctcgtcagtgacgtgggccgtgtgctcacggacgggatgcgcgtggtcatcagtgaccgcaacgcggcgttgcacgtagcagcgttccgaccaccgacggttgagctgttcgcgggggatttcatcgactgggatctcatgcgtgcccgctactggggtcagtacgacgatggctcgacgcgcgctgatggcagggaacggcgcatggcggagtgcctcgtgcaccaaaaggtcagctggggttgcatcacgcatgttgtggcgaagtcggaagccgtcgcgcgtgaggcacgtctactcttgggcgatcgtctgccgccgggcggagtcgttgtcagacctgagtggtacttctag

SEQ ID NO: 179 - DNA, 387 bp, Desulfovibrio sp. 3 1 syn3
atgtatacacaatttaaaaatgatatcattaaaaatgatgaaacaatatatcttgttgcaaatgcgcatgacttaatacctaaatataaatggtgttgtagcaatatgaatgcagcaaaaaacgataccagtttttttgaaacagttgaagaccttgaaaaagagttatcttgggaaatattttctacacaatattggaataatacagatgcatatcctgacagaatggaacgcaggatggcagaattcctagtttacgaacgagtagcatgggatgactttttaggtgtcgccgtttataatgaagcagcaaaagttaaagtttatgatatgatgtgtgaatcacaacgcaaagacgtaatagtaaaaaatgattggtatttttga

SEQ ID NO: 180 - DNA, 648 bp, Dickeya zeae Ech1591
atgccgatccctgaacgtcccaagatttaccacatccttcacattgatcggcttcattcaatcattgccgaagggttgttgtctgacgagcaaatctcggttcgtcatggtgccggtacaatgataggaatgagtagcattaaacagcgtcggctccatgagttgacgcttacaaaccatcccaatctgtatgtggggcaatgtgtacctttttatttttgtccccgctctgtcatgctatacctgatatacagagccaatcatccagagttggcttaccgtggtggtcaggaacctattttgcatcttgaagctgacctctatacaaccattgcatgggcggagcaacatcgccaacgctgggcgtttacgttatctaatgccggttcactttacttcgaagatcgttgtcaacaatcccagcttggagaactgaactgggaagcgatacaaagcaatcagtggagcggcggtaatggaactaaagaggcgaaacaggctgagtttttgattgagcgctgtttcccttggcatttaattgagcgcatcggtgttcattcacctttgatttatcagcaggttgctaacatgatcccgcttgatgggcatcgtcctcctgttgaggtgaaacgagaatggtactactga

SEQ ID NO: 181 - DNA, 657 bp, Edwardsiella ictaluri 93 146
atggcttatgattacagcgccaacctcaacccggaaaaagccctgatctggcgcattgtccatcgggataatatcccgtggatactggaccacggtctgcactgcggcaacagcccggtgcaggcggcaaactggatcaatatcggcaacccggaacttatcggcaaacgcgccgggcatccggtgcctgtcggtatgggcgggacgctgcatgactacgtgccgttttactttacccccttttcgccgatgctgatgaatatccacagcgggcgtggcggcattacgcagcgccccaatgaggaaatcgtcattctggtcagcaacctgcgaaacgtggcggcgcagaacatccccttcgtgtttaccgacagccacgcctactataactgggtcaactactacacccgtctggacgatctgaaccagatcgactggtctatcttacaggcgcgggatttccgtcgcgatccggacgatccggcgaagtttgaacgctatcaggccgaggcgttaatctggaagcactgccccatcacactgctggtcgggatgatttgttacaacgatggcgtcaggttacaattagagcagtggctgtcgcaacgtaatctgacaatgcccgttcacgcacgggccgggtggtacttctcatga

SEQ ID NO: 182 - DNA, 657 bp, Edwardsiella tarda EIB202
gtggcctacgactacagcgccaacctcaacccggaaaaagccctgatttggcgcattgtccatcgggataatatcccgtggatactggaccacggtctgcactgcggcaacagcccggtgcaggcggcaaactggatcaatatcggcaacccggaacttatcggcaaacgcgccgggcatccggtgcctgtcggtatgggcgggacgctgcatgactacgtgccgttttactttacccccttttcgccgatgctgatgaatatccacagcgggcgtggcggcattacgcagcgccccaatgaggaaatcgtcattctggtcagcaacctgcgaaacgtggcggcgcagaacatccccttcgtgtttaccgacagccacgcctactataactgggtcaactactacacccgtctggacgatctgaaccagatcgactggtctatcttacaggcgcgggatttccgtcgcgatccagacgatccggcgaagtttgaacgctatcaggccgaggcgttaatctggcagcactgccccatcacactgctggtcgggatgatttgttacaacgatggcgtcaggttacaattagagcagtggctgtcgcaacgtaatctgacaatgcccgttcacgcacgggccgggtggtacttctcatga

SEQ ID NO: 183 - DNA, 657 bp, Edwardsiella tarda FL6-60
atggcttatgactacagcgccagtctcaacccgcaaaaagccctgatctggcgcattgtccatcgggataatatcccgtggatactggacaacggcttgcactgcggcaacagtcaagtgcaggcggtaaactggatcaatatcggcaacccggaacttatcggcaaacgcgccgggcatccggtgcctgtcgggacgggcgggacgctgcatgactacgtgccgttttactttacccccttttcgccgatgctgatgaatatccacagcgggcgtggcggcattacgcagcgccccaacgaggaaatcgtcattctggtcagcagcctgcgaagcgtggcggcgcaaaacgcccccttcgtgtttaccgacagccatgcctactataactgggccaactactacacccgcctggaggacctgaaccagatcgactggtctatcttacaggcgcgggatttccgtcgcgatccggacgatccggcgaagtttgaacgctatcaggccgaggcgttaatctggcagcactgccccatcacactgctggtcgggatgatttgttacaacgatggcgtcaggttacaattagagcagtggctgtcgcaacgtaatctgacaatgcccgttcacgcacgggccgggtggtacttctcatga

SEQ ID NO: 184 - DNA, 651 bp, Enhydrobacter aerosaccus SK60
atggtttatgactatagcaatacacttaacccacacaaagggctgatatggcggattgttcatattgcgaacttaccgtggatttttgccaatggcttgcacagtggtaatagccctatccaatcacctaattggcaacatattggtaatccagaactgattcaaaaacgagccaatcaccctgtgcctgttggacggcaaggttatctaaatgactatgtgccgttttattttacccctttttcgcccatgctacttaatatcaaatcgggtcggggagtcatgcagcgacccatgcaagatatcgtgattttggtatcgtcgattgatacggtagaaagccagcatttggactatgtttttaccaatagccatgcttattaccaatggacaaacttttttaccgacagaaaagacctagacaaaattgactgggcattattgcaacgtcgagattttagccgtgaccctaacgacttggcaaaattcgagcgttatcaagccgaatttttgatttatcagcattgccctatatcggcaatcatcggtatctgttgttataatgacaacgtcaaacaaagcattcaacaattaatcaatatgtctggcattacattggacgtgcatagccgacccaactggtatctttaa

SEQ ID NO: 185 - DNA, 657 bp, Escherichia coli 0127 H6 E2348 69
atggcctatgactacagcgccagcctcaacccgcaaaaagccctgatctggcgtatcgtccatcgggacaatatcccgtggattctggataacgggctgcactgcggcaacagtctggtgcaggcggaaaactggatcaatatcggcaacccggagctgatcggcaagcgtgccgggcatccggtacctgtcggaacgggcgggacactgcatgactatgtgccgttttattttacccccttctcgccaatgctgatgaacatccacagcgggcgcggcggcattaagcgacgccccaatgaggagatcgttattctggtcagcaacttgcggaacgtggcagcacacgacgtgcccttcgtgtttaccgacagccatgcttactataactggaccaactactacaccagtctgaatagtctggaccagatcgactggcccattttgcaggcacgggactttcgccgcgatccagacgatccggctaaatttgaacgctatcaggcagaggcgctaatctggcaacactgcccgatctctctgctggatgggataatttgttacagcgaagaggtcaggttacaattagaacaatggctgtttcagcgtaatctaacaatgtccgttcacacacggtctggatggtacttctcatga

SEQ ID NO: 186 - DNA, 657 bp, Escherichia sp. 4 1 40B
atggcctatgactacagcgccagcctcaacccgcaaaaagccctgatctggcgtatcgtccatcgggacaatatcccgtggattctggataacgggctgcactgcggcaacagtctggtgcaggcggaaaactggatcaatatcggcaacccggagctgatcggcaagcgtgccgggcatccggtacctgtcggaacgggcgggacactgcatgactatgtgccgttttattttacccccttctcgccaatgctgatgaacatccacagcgggcgcggcggcattaagcgacgccccaatgaggagatcgttattctggtcagcaacttgcggaacgtggcagcacacgacgtgcccttcgtgtttaccgacagccatgcttactataactggaccaactactacaccagtctgaatagtctggaccagatcgactggcccattttgcaggcacgggactttcgccgcgatccagacgatccggctaaatttgaacgctatcaggcagaggcgctaatctggcaacactgcccgatctctctgctggatgggataatttgttacagcgaagaggtcaggttacaattagaacaatggctgtttcagcgtaatctaacaatgtccgttcacacacgggctggatggtacttctcatga

SEQ ID NO: 187 - DNA, 609 bp, Eubacterium saburreum DSM 3986
atgaaggcttcagagaggtttactgaaattacaggacaaacggggatttataatattcaggctattgataatattccgtctattattagaagagggttgttatcgaatgaaagagcggtttctataaaacacaagtctattgctatggatgaagtacaggctcgtagagataatattataattccaaatggattgaaactgcatcaatatgcaaatctttattttgatccacgaaatccaatgttgtttaaaagaaaatcacaaaacgaagaaatatgtatattaaagttcgatcgagtgatattggattttaacggagttgtgttatcagacagaaatgcgtcgagcagttatgcagctttttatgaagcgaaatatggattagaaaatatagattttaaattagtctatgcaagatactggacagatgataattactttgaacaatgtaggagaaaatcaataaagtgtgccgaggtcttggtaccgtacggcatttcatatgattatgttgtttttgccgcggttgtaaatgatgctgcggctgatagattgaggttgaacggatttgataaaaatatatttatagaaccaaagatatttttttag

SEQ ID NO: 188 - DNA, 642 bp, Geobacter lovleyi SZ
atggctattcctgatcgtcccaaaatctatcatatcgtgcatgttgaccgcctgacatcaatcattgccagcaacggtctgctgtgtgatgcggagattgtgcgcagcaaaccgcccggcacaaccatcggtatggggactatcaagcagagacgtcttaacgagctatttctgtccagccactttggattgaatgtgggcgattgtgtgccgttttatttttgtccgcgctcagtcatgctgtatcttatctggcgggccaacgatcctgaactgacctatcgtggcggacaagccccaattgtgcatctggaagcagatctgcatcagacggttgcctgggctgaatcacaaaacctgagatgggcctttacgctgtctaatgccggtgcgtattattttgaagaccgtagcaatcttgaccggcttggggatattgactggcaggccgtagaagccaccaactggcaaaaatgtaaagaaggcaagcaggccgagtttttgattgaacagcggtttccgtgggaactggtcacccggataggcgtgatgacaacgcagactcacgcgcaggccagtgcagccattgcagcatcaacccataaacctcgtgtagaattgatgcagaattggtattattag

SEQ ID NO: 189 - DNA, 585 bp, Gloeobacter violaceus
atgattgattgcggttgcatttggtcggacgttcaaatgattgcccggggcttggccaatctgaacattggcataagcgatatcaaggagcgtcgtagaaaactacaggtgcactgcaatccagggaccaaggttggagagtacgttccattctacttctgtcctcgctctatcatgctatacatcttgcactgcaaaaaccacaaagatctaaaatacacaggtggacagcagcccatattgcacctcgaatcgaaattaaaagtagtagtccaatgggcagaagcaaatcaaaagccttgggctttttctaccagaaatgctggtacgcactacgctgatttctacaatgatttgagggatttatatcggattaattggtcagcagtgagcgctaccgattttcgagatgccacaatcaaagagggcaagcaagcagagtttttgctgtttgagtcgtttccattgaccttcgtggatcgcgtcggcgtctttgattcgcaagtagagcaacaaatcgaatcactctttgagggaacgaagtacaatcccgtggtggtagtgcaacgcaactggtactattga

SEQ ID NO: 190 - DNA, 681 bp, Gluconacetobacter diazotrophicus PAl 5, DSM 5601
atgacatattataagaacctgaaggcattcctcgcgaatggcgcggagttcgcgaaagatagccctgatggaaggccacgctatagaatttcttttgaagaaatcgttgctcggcgaggtacggtttttagggtgcctagtggttatagtgttaacgaatttgtgccgttctatttctcgccctcgactaaaatggcttactccattcacacgaaaaatgttcccttgagaactccggacgaccaaaatctggggcctgcgagtatggacgatgtggcttacatggttgtcgacccagaggtcctctttcggtcagggcgtgaatgctggtttacggaccaagcttgcaattcggcaatcacaccagcctatgagagtgatcccggcaacctgtcacagcacgtcgcttggccactcttcgatgagtaccccaggatggccacgatcccgcaactggggtatggtggggtatgtcaatatcagcatgaccgcgacgctctggggtaccagcagcgaagcaaacagcgcatggcggagttcttggtgaaagaccatttgaggatggacgagctttcggcgatcgtactcaaaactgacgttcaccgggcacaggttgaggcgtggatccggcgggccgggttcagcatacctgtgttcgtcaatccaggatgttatttttaa

SEQ ID NO: 191 - DNA, 657 bp, Klebsiella pneumoniae 342
atggcttatgattacagcgctaatctcaacccggaaaaagccctgatctggcgcattgtccatcgggacaatatcccgtggatactggacaacggcctgcactgcggcaacagcccggtgcaggccgcaaactggatcaatatcggcaacccggagcttatcgacaaacgcgccgggcatccggtgcctgccgggacgggcgggacgctgcatgactatgtgccgttttactttacccccttctcaccgatgctgatgaatatccacagtggacgcggcggcattaagcaacgtcccaacgaagaaatcgtcattctggtcagcagcctgcgacacgtggctacacaaaacgtccccttcgtgtttaccgacagccacgcctactataatctggcgaattactataccgatctaaacaatctgcaccggatcgactggcccattttacaggcgcgggatttccgtcgcgatcaggacgatcttgccaagtttgaacgctatcaggccgaggcgttaatctggcagcactgccccatcacgctgctggtcgggatgatttgttacaacgatggcgtcaggttacaattagagcaatggctgtcgcaacgcaatctgacaatgcccgttcacgcacgggccgggtggtacttctcatga

SEQ ID NO: 192 - DNA, 603 bp, Leptotrichia goodfellowii F0264
atgtggattcatcatttgacacatatagataatttagaaagtatattggagagagggttaatttccagaaatcaattaaagcagtttaatataaaatttaatgatacagcagataaaagaattataggagagcgaaatgatttgaataattatattccatttcatataaattatttacagaaaaaatacagtataccttataattggaaagttttgaaaaatcaatcgagtgaaaatatgatttttttaaattataatatagatgattttagcaataatgaattagatttttatttatatcatccaatctcaaaatcacaaaataatgcaataaaaataaatgatttaatgggatttaaggaaaaattgttgaaagaagaaaagaaattacaaaatgatatgggatatttagatttttccgataataaaactcagcaatttttaatgtcggaagttttaataaaagatagaatatatttgagtgaaaaatggaaaataggagttttttcatttgcacagaaacaaatagtagaaaaaaagcttgaaaaaaataatttgaaaatagaagtttttattgatgataaaagatatttctacagataa

SEQ ID NO: 193 - DNA, 630 bp, Lyngbya sp. CCY 8106
atgtctacaccgatttaccacatcactcatattgataatcttgtttctattatcagttctggaggattaattgcttgcagtcaactcagacaacaacaagttcgttatacagatattgcccatcaaaatattcaagatagaagggcaaataaacctgttccttgtagtgttgggggcttactccatgattatgttcctttttacttcggacctcgttcacccatgctttacgccatatatagaagaaatgtacaggggtatcaaggaagtcaaagctcaatcattcatttagtgaccgaaatagaaacaatagcaaactcagacttagattttgcttttactgatggtcatgcaattatggattactctgatttttatgacgatctctggcaactaggtgaagtaattgactggggactaatggaagaaagatattggagtgatacagaagaagatcgaaatcgcaaatggcggcgacaagctgaatttttggtgcatcgtttttatccttggagattcattacagcaattggtgttatcaatgacagcatcaaaacaaaagttcaaagtatattacaaaaaaaacaacatcagcctttagtaagagtctgttctaattggtactattag

SEQ ID NO: 194 - DNA, 642 bp, Marinobacter sp. ELB17
atgactgtcccagctcaaccaaaagtctatcacatcgtccacgttgatcggctggcatcgattattgccgatcaggtgttgtggagcgatgcgcaagtcatcgctcgtgcgccagcaggcacgaccattggcatgagtggaatcaagcagcgccgcctcaatgagttgaccttgaccagccaccccgatttgtatgtgggtgcttgcgtaccattttacttttgcccacgctccatcatgttgtatctgatttatcagggtaaccatccggatctcggctacaagggagggcaaggccccataattcaccttgaggcagacttgaatgattctgtggcctgggctgaggcgaatcaacaacgctgggcttttaccctttctaacgcaggctcgtgttacttcgaagatcgttcagacctgttcaggctgaatgagataaactggactgcggttggcgcacgcaactggatgtcctgcaaggatggcaaacaagccgagttccttctggaaaactgctacccctggcaccttgtcgaacgtgtcggggtatgttcgcaggcgatctacacacaggtggcaaatattttggccggtgtaccccaccgaccagacctacaaatcaaaccagactggtactactga

SEQ ID NO: 195 - DNA, 585 bp, Micromonospora aurantiaca ATCC 27029
atggagagaggccgggtacaggagcttcacttcattacaccgatctccaacctagagtcggtgttgcggcatggcatcctgagtcacaacgcagcacgacgtctcccacacctctcagtagcggacgaggacgtgcaatcgcgcagacggcagaagagagtcccaggcgggatgcaacttcacgattatgccaacctgtacttcgacgctcgaaatccgatgatgtatcggataaagggcaacgggacgccgctggccgtcgtttgtgtaaatccgtcgatcctggatctaccaggggtagtgatcactgacggaaacgcagcatctgatggtacccggtttgctgcatccccggggggaattgctatactagatgaagggctggtatatgcacactcttggactagtagcgacaggtgggactacatcgagcgtaagcgagctcggtgcgcggaggtgctagttccaaactgtgtagacccaagctatatcgacaaggcaaaagtgattcgacagtcacatgtgatttcgtgccatgcggctggcctgcgaggggaggtgttcgccaatgtcttctttgcctag

SEQ ID NO: 196 - DNA, 693 bp, Mycobacterium bovis
atgatcaccagatacaagcctgagtcggggtttgtcgcccgtagcggtggtcccgaccggaagcgtccccatgactggatcgtttggcacttcacccatgccgacaatctccctgggatcatcaccgctggccgtctgctggccgattcagcagtcaccccgacgaccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcccgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 197 - DNA, 693 bp, Mycobacterium bovis BCG Pasteur 1173P2; identical to SEQ ID NO: 196

SEQ ID NO: 198 - DNA, 693 bp, Mycobacterium bovis BCG Tokyo 172; identical to SEQ ID NO: 196

SEQ ID NO: 199 - DNA, 693 bp, Mycobacterium tuberculosis 210; identical to SEQ ID NO: 196

SEQ ID NO: 200 - DNA, 371 bp, Mycobacterium tuberculosis 98-R604 INH-RIF-EM
actccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcctgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 201 - DNA, 693 bp, Mycobacterium tuberculosis CDC1551; identical to SEQ ID NO: 196

SEQ ID NO: 202 - DNA, 693 bp, Mycobacterium tuberculosis F11
atgatcaccagatacaagcctgagtcggggtttgtcgcccgtagcggtggtcccgaccggaagcgtccccatgactggatcgtttggcacttcacccatgccgacaatctccctgggatcatcaccgctggccgtctgctggccgattcagcagtcaccccgacgaccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcctgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 203 - DNA, 693 bp, Mycobacterium tuberculosis H37Ra; identical to SEQ ID NO: 196

SEQ ID NO: 204 - DNA, 693 bp, Mycobacterium tuberculosis H37Rv; identical to SEQ ID NO: 196

SEQ ID NO: 205 - DNA, 693 bp, Mycobacterium tuberculosis KZN 1435; identical to SEQ ID NO: 202

SEQ ID NO: 206 - DNA, 693 bp, Mycobacterium tuberculosis KZN 4207; identical to SEQ ID NO: 202

SEQ ID NO: 207 - DNA, 693 bp, Mycobacterium tuberculosis KZN R506; identical to SEQ ID NO: 202

SEQ ID NO: 208 - DNA, 693 bp, Mycobacterium tuberculosis KZN V2475; identical to SEQ ID NO: 202

SEQ ID NO: 209 - DNA, 693 bp, Mycobacterium tuberculosis SUMu001; identical to SEQ ID NO: 196

SEQ ID NO: 210 - DNA, 693 bp, Mycobacterium tuberculosis SUMu002
atgatcaccagatataagcctgagtcggggtttgtcgcccgtagcggtggtcccgaccggaagcgtccccatgactggatcgtttggcacttcacccatgccgacaatctccctgggatcatcaccgctggccgtctgctggccgattcagcagtcaccccgacgaccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcccgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 211 - DNA, 693 bp, Mycobacterium tuberculosis SUMu003; identical to SEQ ID NO: 210

SEQ ID NO: 212 - DNA, 693 bp, Mycobacterium tuberculosis SUMu004; identical to SEQ ID NO: 210

SEQ ID NO: 213 - DNA, 693 bp, Mycobacterium tuberculosis SUMu005; identical to SEQ ID NO: 210

SEQ ID NO: 214 - DNA, 693 bp, Mycobacterium tuberculosis SUMu006; identical to SEQ ID NO: 210

SEQ ID NO: 215 - DNA, 693 bp, Mycobacterium tuberculosis SUMu007; identical to SEQ ID NO: 210

SEQ ID NO: 216 - DNA, 693 bp, Mycobacterium tuberculosis SUMu008; identical to SEQ ID NO: 210

SEQ ID NO: 217 - DNA, 693 bp, Mycobacterium tuberculosis SUMu009; identical to SEQ ID NO: 210

SEQ ID NO: 218 - DNA, 693 bp, Mycobacterium tuberculosis SUMu010; identical to SEQ ID NO: 196

SEQ ID NO: 219 - DNA, 693 bp, Mycobacterium tuberculosis SUMu011; identical to SEQ ID NO: 196

SEQ ID NO: 220 - DNA, 693 bp, Mycobacterium tuberculosis SUMu012; identical to SEQ ID NO: 196

SEQ ID NO: 221 - DNA, 654 bp, Nitrosococcus halophilus Nc4 uid46803
atgagtaccccaatcacctacaatctcaatccagtgaaggggctgatcttccgcatcacgcatcgcgacaatatcctctggattctagatcatggtctgcactgtcccaacgggacagtcttcgaccataactttgtacccatcggcaatccagaactgattgacagacgccatcaccgagaggtcccaattccgccgggcggtgtgcttggtgattatgttccattttacttcacgccctattcacccatgatgtacaacatcaaaacgggctatggcggtgtcaaaaagaggcgcaatgatgaaatcgtggtattagtcagctcattgcatcaagttgctaaagagcagaggaaatttgtgtttactgatcgccacgcgtacctacgagcagcaaatttttataataatattaatgacttgaatcttgttgactttaaactgctgcgtagccgggattttagccgtgacgttgaggatccggaaaaaatcgagcgctaccaggccgaagcactggtccaccaatccctcccagtacaggccttattgggcatcgtttgctacactaaggctgtagccgatgaggtgcagtctgttcttcgagttcgcaagataacgatgagaacgctcgtgaaaccaagctggtacttctga

SEQ ID NO: 222 - DNA, 723 bp, Nitrosomonas europaea
ttgcgttttcaccatgcgcacggtagcttgttcccacgaaaaatactcatctgtattaaagcaagaataaatccggatcttgtgatgaatggaatacccttatgcccaaagctctatcatatcgtccatgttgatcgcctatcttctatattgaaagatggcttcctgtggtgcgatgtacatatggcgcaacatatacctgttggaactactattggcatgaacaacattaagcaacgacgtctccaaaattgtctcaatagttatcctgatttacatgttggtgactgtgtgccattctatttctgcccgcgttctgtgatgctctatttaatttatcgccaaaatacagagctggactataaaggaggtcaaggacctattattcaccttgaggcagatttgaatgctgttactacatgggctaagacacaatcagcgagatgggtttttacgcttacgaacgcaggatcgttctactttgaagatcgaaacgatctgacgtgtctgaaagaagtcaactggactgccgtgcatgctcttaactggaaggagcataaagaaggaaaacaagcagagtttcttatagaacaatgctttccctggaatttggtcgaacgtattggtgtccaatcagaagttatttacaaccacgttgttaacgctcttccagtcaacggacaccggcccaaggtagaaatcaagccggaatggtattactga

SEQ ID NO: 223 - DNA, 636 bp, Oscillatoria sp. PCC 6506
atgccaacatttatctatcatattacccatatcaataatctggaatccattgttaaagccggtggattattagcttgcaacgctatgtatgaagccaacgccgagtacactaatattgcctacgatggtatccaagatcgccgtgccagaacttccgtaccttgcagtgtaggtggagtattacatgattatgttccattctattttgccccccgttcccccatgctctgtgctattaacaacaagggaaaagtaaaaggctatagcgaaggtcaaactcctataatttacctagtttctgaagtagaaaaaattgccgatagtaatttacattttgcctttacagatggtcatgcagttatgacttttaccgatttttttgataacctagaatatctggatgaggctattgattgggaagttatggaatcccgatattggtttgatactgatgaagataatgatagaaaacgcaagcgtcaagctgagtttttagtttacaaattcttcccttggcagttagtaacagaaatcggagttaaaaactaccaaattaagacagaagtagataaaatcttagaaaagaataccacacatcagccaccagtcaagactcgcacagcttggtattattaa

SEQ ID NO: 224 - DNA, 645 bp, Parvibaculum lavamentivorans DS-1
atggccatccctgcacagccgaagatttaccacattgtgcacgtccaaaatctcgcgtcgatcgtgacggatggccatttgtggtcagacgcgaccatggtcaatcgaccacctggaggaacagtgatcggaatgggtggcataaagctgcggcgattgcgtcttcccgtgacgtgccaccagggaacacatgttggcgactttgtcccgttctatttctgttctagatcaattatgctgtacgtgcttcattgcgcgaaccatgcggaactaacttatcgaggtgggcagcagcccattgttcatctggaagcagacctttaccggtccgttcgatgggcagaagaaaatgggtcacgttgggcattttctctctcgaacgcgggtgctgcctatacacagtttcgttcaaagagagaacaactaagcgaagtcaactgggaggctgtgagagctaccgattttcgaccagcggacgtcaaagagggtaagcaggcagaatttttggttgaacgctccttcccgtggcatctggtagagcgtgttggagttcactcgcaagctgttgtggatcaagtgtctaccgcaatgcggggtgtgcgacatcggcctcagatcgaaatcaggaaggactggtacttttga

SEQ ID NO: 225 - DNA, 657 bp, Pectobacterium carotovorum PC1
atggctaatgactacagcgccagtctcaacccacaaaaagccctgatctggcgtattgtccatcgggataatatcccgtggatactggacaacggcctgcactgcggcaacagcccggtacaggcgggaaactggatcaatatcggcaacccggagcttatcggcaaacgcgccgggcatccggtgcctgccggggcgggtggtacgttgcatgactatgtgccattttactttactcccttctcgccaatgctgatgaatatccacagcgggcgcggcggtattaagcaacgccccaatgaagaaatcgtcattctggtcagcagtctgcgcaccgtggcagcgcaaaatgttccttttgtgtttaccgatagccacgcctactataactgggctaactattacaccgatttgaacaatctgaaccaaattgactggcctattttacaggcgcgggatttccgccgcgatcctgacgatccgggcaaatttgaacgctatcaggccgaagcgctgatctggcgacactgcccaatcacactgctgagcgggatggtttgttacaacgacagcgtcaagttacaattagaacagtggctgtcgcaacgcaatctgacaatgcccgttcacgcacgggccgggtggtacttctcatga

SEQ ID NO: 226 - DNA, 420 bp, Pedobacter sp. BAL39
atgctctacaatatcattaccggtcatggcgttaatccagtaaatcaagcggagattatttatctttgttgtaagctgtcagatttagcttgtgaagattttaaatggtgttataccaatggtaatgctgctaagaaaattacaaagttttttgatagttttgatggcattgcaaagaacatcgactggcattctattaaaacgactgattttcgcgatgccaatgcagatggtgatgaagataggatcaggaagaagcatgcggaatttctcgtccttgatcatgttccggcacattttatcagaaatatcgtagtgttaaatgcaaaagtaaaggttcaggtagaggaaattttggcaactcaaggctttgaagtaaatgtacatatcaatcctaaaaattcattttattttacatga

SEQ ID NO: 227 - DNA, 636 bp, Prevotella timonensis CRIS 5C-B1
atgtctgataataagattaaatacgcatttaggatagttcacattgataatattccatatattcttgaaaatggaattgtgaatgctgctaaatctacaaagaaagatgatagctatatctctattggcgacgaaagtttaatagaagtgcgacgaaatcagaatatcattcatacagaaagttgcataggcgattatatacctttttattttgggcctcgaacaccaatgttatatactatccagcatggatataatggagtaaaaaaatgtgatgccacgaatttggtataccttgtattaaaaatttcggatattataaaaagcggatttcaagggtattttactgatgggcatgctcgaaatatttgttcacatacctatgaaatagataaattaaatcagcttaacgaacttgttcattacgaaaatgtatatcgaacatattggtctattagagaagataatagtggggaatataaacgattgaagtcagcggaattgttaattgagaataatattccaacaacaatgattgcaggctatgttgtatatgataaagcagcccatgataaacttgtttcttttggcatagacaacgagaaaattatcattaataataactattatttttaa

SEQ ID NO: 228 - DNA, 642 bp, Pseudomonas entomophila L48
atgacgtataccagacttaacccaagcaaagccctgatctggcgagtcgtccaccgcgataacctcccgtggctactggacaacggcttgtgtgcggtttccagagggaacctctccagcggctacgtcggaattggtaatcctgacttgatcagcaagcgttccaggcgagcggtgcccatccatcccggtgggacgctggcagactacgtgccgttctacttcacaccgttctccgtgatgatgaaaaacatccattcaggacggggagtacagcaacgtcggaacgaggagatcgtgattcttgtctccagcctgtaccatgtgcggtccctggggctgccctttgtctttactgatgctcatgcgtatccggactgggcaggctactacagcgacctggagcatctggacaagatcgactggcagatcttgcagtccagagatttcaagcgtgacccagacgatccacgaaaaatggagcgctatcaggctgaagccctgatccacgggcacgttccagtcgctggccttctagggattgtctgctacaacgaagctttgcaacgtcgtgttgatcaggaggtccggcaacgtcagctggatcttcccgtgcatgctcgacctgggtggtatttctga

SEQ ID NO: 229 - DNA, 654 bp, Pseudomonas mendocina ymp
atgcctaaccactaccccaacctgaatccggagaaggcgctgatctggcgtattgtccaccgcgataatctggtgtggattctggataacgggctgcactgcgcctcggcgaatgtgcaggccccgaattatgtggtgattggcaacgtcgatctgatcagccggaggcgtgagcgcacggtgccggttgcgccgggcggcaccttgtccgactacgtgccgttctatttcaccccgttctcgcccatgatgtacaacatccatactggtcgcggtgaggtgcagcagcggcacaacgaggaaatctgcatcctggtgtcgagcctgcgtcgagtgcatgagctagggttgggttttgcctttacggatcggcatgcctacaccccgctggccaggtacttcaatgagctggatttgcttgaacagttggattggccgttgctgcaagcgcgcaatttttcgcgcaacccggatgatccggagcagatcgagcgataccaggccgaagccctggtacaccgctatttgcccatagagggcttgctcggcgtggtgtgttttacccaagccgtgaaagatcgactggatgcacaggcccaggctaaaggcttgaaactggatatacgtgttatgcctcagtggtacttccgatga

SEQ ID NO: 230 - DNA, 672 bp, Rhodopseudomonas palustris TIE 1
gtgccacctccaattccgacagccattttccacatcactgcgatcgccaatctggactcgatcgcgaagcagggcgccctgctttcaaagaacgaggctgcggcgcgcggattggtcgcggcaaatatcgcttatgaccatattcagggacgccgcgccgtacgcacggtgcccatcgcgcccggcggaacgttgcacgattacgtgccgttctattttgcgccacgctccccgatgttgttcaccatcaaccaaggcaacgtacccgactgtatctatcgacaggacgatattgtacatctcgcgacgaccgctcaaaccgtcgcggacacggggcagcagattgtattctcagacatccacgcggccctggattacgctaggtttttcagtgatctcggcagcctgacggagatcgactggagaatcttcttcgagccgccacgtctcgaaggctattgtaaattctggcaaaatcgccagattcccattcatcatttacggcgtctggagattcggcaggcggagttccttgtgcatggcgagctgccgattgccgcgatctcagaaattggcgtaaaaaccgcccaagcagctgcgcaagtcgaacaggcagtcgctggttctggatggactcccacggtcagggtggtgcccggctggtacttctaa

SEQ ID NO: 231 - DNA, 681 bp, Roseiflexus sp. RS-1
atggcacgaattatgattccgacgtttccgaaaaagcccattccggaaaatccaaaaatctaccatattactcacgttgacaatatacgaaacattgtatcaacaggagggctgctgtctgacgcgcgcatacttcagcagggcgggccgacgcaaatgatcggtctatccaacatcaagcgacgtcggattgaagaactggaggttcgatgtcatcctggcacaaaagtgggtgaatatgtccctttttatttctgcccccgttcgattatgctgtatgtgattcaccgtgcagaccaccccgaacttatgtatcgcggagggcaagattcgatcgcgcatcttgaggccgatcttcatcaagttgtagactgggctgacaataacggcgttcgctgggcattttcactctccaatgcgggcgcccgctatacgcagtttcggtctaatctgcgctatcttcacgaactcgattgggatgccatcgccgcgacggatttccgtgattccgatgtcaaggaggggaaacaggcagaattccttgtccatggcttctttccgttcgatctcgttgagcggattggtgtgcatcgtgctaatatctggaataaagtacgcagcgtgctggcagggagcggctatactcctcgcgttgaagtgcgcgacgactggtatttttga

SEQ ID NO: 232 - DNA, 336 bp, Roseovarius nubinhibens ISM
atggcacctctgccgacgctcagcgcagacattggccagttagaaacgcatgttcattggagtgtgtttgatgactacccgcttaccgcccggattccggagattggatatgatggtgtctgcaagttctttttcaacaagttcccacctcctaaataccagctccgcaagcagcagcgcatggctgagttcttggtgaaggacgcggtgtcgcttcagcaagtaacttgcattgttgtgccttcggatggcatgaagaggacaattcaggcgcaagtagacacctcagggtggggaacccccgtcttggagaaaccagggtgctttgttcgatga

SEQ ID NO: 233 - DNA, 621 bp, Ruminococcus flavefaciens FD-1
atgaaaccatcagaaatattccgttcaaaatttcataataaaaacggattttataatataatgcctatttctaatttagcttctgttctcaagtatggaattctgtctaatgagttggcagaaagaataccacacaggtctgtggctatgtccataatacaggatagaagagatcaggtgttgatccctaatggtcttatgcttcatcaatatgcaaacttatacattgatgcgagaaatccgatgctttacaaacgtaaagacgaagatgtcattgtactaaaggtagattgcagaatacttgatttgccagatgtagttgtttcggatcaaaatgcttcaagtagttatgtcagattctatgagccggaggaagcaatgaacaagttggattttaacatgatatttgctcgttcatgggaatctgacaatcagttcgaatactggaggaagaaatctgcaaaatgtgcagaagttcttgttccgggaaagatagagccttcatatgtaattgctgcagctgtaaaaaatgatgcagataaggaaaaaattatagctttaggctttgataaaagaatctatgttaacggcgatctgtttttcggaaaagaggtggaataa

SEQ ID NO: 234 - DNA, 639 bp, Shewanella putrefaciens CN-32
atggtacctgcacagcctaaaatttatcatattgttcatgtcgatcgcttagctcccattctggcttcgaatgcgttgctttgtgatgctgagattattgctcaacaggccgcaggtactacgataggcatgaacactatcaaacagcgccgtctcaatgagctaacgttggatagttaccctgatttgtatgttgggcaatgtgtaccattttatttctgcccgcgttcgatcatgttgtacgtgattcatagggctgacagtgctgagttagtttaccgaggtggccaggggccgattatccatcttcaagcagatctgcacgctacggttcaatgggcacagcagcaagggcgtcgatgggcgtttacgctttcaaatgctggctcatactattttgaagatagaaatgatctcgctcggctaaatgagttagattggcaagcgattggagcaagacaatggcaaggttgcaaagaaggcaagcaagctgaatttttgatggaacatagttttccttggcatttagtggaggaaattgttgtacaatcaccgatcattcaccagcaggtagtcaatacgttgcaaagagttggacacagaccacctgttcgaattaaccctaattggtattactga

SEQ ID NO: 235 - DNA, 630 bp, Stigmatella aurantiaca DW4/3-1
atgaacctcccgagaggtgtcccgcaggatccactgatcttccacatcacgcacgtggacaaccttccgaacatcctgagagaaggcgggctttggtgcgatgcccagcggatcgcacgagggctgagtagcacgaacattggtcaccttcacatcaagcaacggcggctcttacggccggtgacgacgacagcaggcggtacgctgggcgactatgtgccgttcaacttctgttcgcgctcggtgatgctctacgccgtccactgcggccatcaggattataagggtggccaggagagcatcgttcacatggtgagttcggtgagccgcgcgacggcgctcggccgggcgtgggcgttcacggatcgccatgctgaactcgctcatgcgcttcacttcgacgatcttggcaaactcggagaggtgccttggcaggtcatgccgcttcagtattggagcgaggtgaaggaagagcgccaggcggagtttctggtacgcgagttctttccgtgggaggcagtgacagaggtcgcggcaatgacgccggcagcttcggcgcgtgtccagcaggcgctcaggggggcggcccaccatccccccgtgacaacccaggctggatggtattactga

SEQ ID NO: 236 - DNA, 639 bp, Synechocystis sp. PCC6803
atgaccgttcccgctcagcctaagatttaccacattgtccatgtggatcggttgccctcaattattgctgatgggtgtctgtggtgcgatgcggcgatctctcaacggaatccggcagggacaaccatcgggatgaacaaaatcaagcaacggcggttgaaggaattaaccttgactagccatccaagtttgtacgtaggccaatgtgtgcctttctacttttgtccacgttccatcatgttgtttttgatccacaaaaagaatacagagttgacctatcagggaggacaggaaccgattattcacctggagggagatttaatccaagctgtgaactgggcagatcaaaacaacctccgctgggccttcaccctctccaatgctgggtcatcttactttgaagaccgcaatagcttagcgcagttacacgaaattgactgggccgccgtgcaagcgactaattggcagacctgtaaagagggcaagcaggcagagtttttggtggaaagcacttttccatggcatcttgtcgagcgtatcggggtaaaatcacgagtaatttatgatcaagttatcaaagctctgcccacaggaggacaccatccacaggtagaggttcgaccggactggtattactaa

SEQ ID NO: 237 - DNA, 678 bp, Syntrophothermus lipocalidus DSM 12680 uid49527
ttgaaagcgataggactggacgtcccgccgatacgagatatgcttcccaccgtaatcccggtagccgaggtcaaagaagatatgaaaccggaagagcttaccgaactacattatataacccatattgaaaatatgaaatcaatcatgcggtttggcttattgtcaaataggagagcatcaaggactcggcataattcagttgcgatgcaggtgatacaggaacggcgtgcggggaagagggttccaggtgggcttttgctccacgactacgtcaacctttatctatgcgcacgcaatcccatgatgtacaagctgcgaggccggcacaaagagctatgcgtactgcggatcgacgtcggggttttaaatataccagggactatcgttactgaccgcaatgcttcgagtgattgggcatgtttttacccgtcgcctgtaggccttaagcatgtcgacctcgagctcgtttgtgcccagtcatgggttcacaacgatgagatagaaacgttcaaacacaaatcgattaagtgtgcagaggtacttgtaccgcaccatgttccaacttccttcttcaaaggcgtttacgtatcgtgtgctgaaagcatgagtaggctccactgtttagctggggatggcaaactggagattgaagtgtacccccatatgtttttcctgtag

SEQ ID NO: 238 - DNA, 675 bp, Thauera sp. MZ1T
atgccagcaccgtacccaacgcgactgttccacatcactgcgatcgccaacttgccggcaatcttcgctgccggggcgctgctgtcgaagaacggtggcgctgcggcaggcatcaactaccagaacatcgctcatgcaggcgcccagggagcgcgggccgtgcgtgctgtgcccaatccgccgggcgggttggtgcacgacttcgtgccgttctacttcgcgccgcggtcgccgatgctgttcgccatcaacggcggccgggtcgcgggatgtcagtggcggcagactgacatcgttcacttcgagactaccgtgcagtgcttggtggccagaggccgcccgttcgtcttctatgaccgcaacgcaacgctggctttcagcaccccgtacaccgatctcgcccacctggacacggccgttgcctgggacttgatgaccgaagcgccgcagctcgacggctattgcaagttctggcagaacaatccggccgttgcacggtacgccgaccggatggagcgtcggcaggccgagtttctggtgagggacaatgttccccttgactgcatgactcgcttgggcgtgatcgacgccgcgcggcaagcgcaggtactggcgttgctggcccaggccggcgtagcattgacggtcgacatcatgccggcctggtacttctga

SEQ ID NO: 239 - DNA, 669 bp, Thermus aquaticus Y51MC23
atgccacagcaaggcctagcctacccggtgcccacgctcatctaccacatcacccacctgaataacctccagggcatccttcaaagaggaggcctcctcccctactcccaaagaccccccacacagcaaaacgtggcctacgggcacatccaggcccaccgcgctcaagtcgtggtacccgtgggcccgagaggcaagctccacgattacgtgccgttttacttctgcccccgttccccaatgctctacgccattcacacacaacaaaccgactatcaaggggaccagcgtcctatcctgcacctggtctcctccgcgcaaaaggtggcggaagcccgcatccccttcgtgttcacggaccgccatgcggccgtgcagtatgtttgcttcttccataagctagaacacctgaaagccttagactggcaagccatccaggcctcttactgggccaatgtgcgcgagaaaaagcaggccgagttcctggtcaaggacttttttccctgggaactcgttgaggagatcggcgtgatagacaaaaccatccaggcccaggtggagagcatcctcgcccagttccccgatcttcaccatcccccggtgcgggtgcgccgaagctggtactataagaagcgcttatgctccgcttcgtgcgaggcaaccttctag

SEQ ID NO: 240 - DNA, 681 bp, Thiobacillus denitrificans ATCC 25259
atggcggtgccaaatcctgtccgcctgtttcacatcacggcaattgccaatttgccggcaatttgtgcggcaggcgcgttgctgtccaagaatcagggcgcaacgaatggcattgcttaccagaatatcgcccatcaaggtgcgcagggtgcccgctccatcaagtcagtgcctaacccgccgggcgggctggttcacgactttgtgccgttctatttcgcgccgcgttcgcccatgcttttagccatcaacggcgggcgtgtcgctggatgtgactggcggcaggcggatattgcccattttgaaacgacggtggaacatgtgacggcagcgggggaagactttgtgttctatgacctcaatgcaacgctggcctggagcacaccgtatacgggcttggccaacctcgacaaagtggcttgggatttgatctgcgagtcgcccgccctggatggctactgcaagtattggcagagcaaactggaccatgcacgttatagcgaccgaatggagcggcggcaggccgagtttctggtcaaaggcatggtgcccttggtcagatttacgcgcatcggcgcgatcgatcgaggccacgccgacgtggtacgtgcgattctggatcaggcaggcgtaaaattgccggtggtggttaaacccgagtggtattttctggggcaatag

SEQ ID NO: 241 - DNA, 645 bp, Zymomonas mobilis
atgatctataaaagttttaatccacaaaaagcattgatatggcggattgtccattacagcaatttgccatggattttggataatggtctctactgtggcaatagtaagataaaatcacccaattggtttaatattggcaatcctgaattaatccaaaaacgcgctgaccattcagtaccactgcctccatctgggatgctgaatgactatataccattttacttcacaccattttctccgatgttacggaatatttcgacaggctggggcggtataccccaattacccaatgagaaaattataattttggtatccagtcttcaccatattgctgatctgggattaccctttctttttacagatagtcatgcctactctccgtgcgctaattattactctaacctatctgatcttaaccagatcgattggccaatattgcaacatagagattttaaacgtgacccagatgatcctgccaaatttgagcgatatcaggctgaagcacttatttaccagcatttgccgatcaacggactatatggcattatatgttatacagaattgttgaaacaacgcattgagcaagagatttgtgctcgtaatctcaatcttcgggtttatgcccgaccggaatggtatttctga

SEQ ID NO: 242 - DNA, 627 bp, Arthrospira sp. PCC 8005
atgaccacctatatctaccatattacccatcttaaaaatttaccctctattttgcgttctgaggacctccttgctaacaatcgcttaaaatctcagcggatcaattatgtagatattgctcacgaaaccatccagaataaacgcgctcaaattaatattccttgttccaggggcggcactcttcatgattacgttccttggtattttgcgcctcgttctccgatgctttacgccatatccagaggcaacgttcaaggatatgaacaggggcaaagtccggtgattcacttagtggcaacagcggaggatatcgcagcagcaagtcttccttttgcatttacggacggtcacgcaattgttaggtattcagaattttatgacaatctcgactctctcaatgcgattgattgggagattatgaatgcagggtattgggcagataccctggaggatggagaccggaagcgccgcagacaagccgaattcttggtttatgagttcttcccttggacactcgtgcgagaaatcggggtgatagatgtcggaagaaaagccgaggttgaagaaatattacaaaactttacgatttcgacacctgtaaaggtttttcgggaatggtactattaa

SEQ ID NO: 243 - DNA, 627 bp, Arthrospira sp. PCC 8005
atgaccacctatatctaccatattacccatcttaaaaatttaccctctattttgcgttctgagggcctccttgctaacaatcacttaaaatctcagccgatcaattatgtagatattgctcacgaaaccatccagaataaacgcgctcaaattaatattccttgttccaggggcggcactcttcatgattacgttccttggtattttgcgcctcgttctccgatgctttacgccatatccagaggcaacgttcaaggatatgaacaggggcaaagtccggtgattcacttagtggcaacagcggaggatatcgcagcagcaagtcttccttttgcatttacggacggtcacgcaattgttaggtattcagaattttatgacaatctcgactctctcaatgcgattgattgggagattatgaatgcacggtattgggcagatactccagaggatggagaccggaagcgccgcagacaagccgaattcttggtttatgagttcttcccttggacactcgtgcgagaaatcggggtgatagatgccggaagaaaagccgaggttgaagaaatattacaaaactttacgatttcgacacctgtaaaggtttttcgggaatggtactattaa

SEQ ID NO: 244 - DNA, 435 bp, Desulfonatronospira thiodismutans ASO3-1
atgaagctggatgagcctattcctatttatcggctcatgcatgtagacaatctgccggtttgtttgaatcgaggtggactacacgcacctcattacgttcctgaaaacgggctcagctacacggcaattcacaatattgacatccagcagatcagacgtgtcagatatataaaatgcggtccaggaggtacggtgcatgattatgtgggtttttattttggcccacgcccacccatgctcctgcaattgcataccggacaggtacctggatatgatcaaggacaggagccattgatttatatcgtgtctacagtacaatctgtaattgaggcgggccttgattatgtcttttcagacggccatgggatagccgcctatacacaatggtttagtaatattgaagatttagacaaggtggattggaatacggtataa

SEQ ID NO: 245 - DNA, 645 bp, Methylobacter tundripaludum SV96
atgatttacaaaaatctcaatgctgagaaagcgctaatctggcgtatcgtccatcgcgacaacctgtcgtggattttggataatggcttacattgtgcaaattctaagacgttatcaccaaattacatcaatattggtaactctgatttgatcgataagcgccgccatagggtagtgccgattgcgccaagcggcacactagcagactatgtgccgttctatttcacaccgttttcagtcatgatgctaaatattcattcgggccgggggggggtgccgcgacgccgaaatgaggaaattgtgatcttggtgtccaatctgcatcacgtgcattccatcggattgccatttttgtttacaaacgctcacgcttatccgaactggactaattattacagtaacttggcgcagttatacaatattgattgggatatcctgcaacgccgggattttaaacgtgacccagatgatctaagaaaaatggaacgttatcaggcggaagctttaatatttaaacacttaccgattaatggcatactaggtattgtatgctatacagaacaactaaaacatgacattgaacagcaggttcaggatcgtaacctgatgttagaagtttatgcccgtactaagtggtatttttaa

SEQ ID NO: 246 - DNA, 527 bp, Mycobacterium tuberculosis 02 1987
ccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcccgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 247 - DNA, 693 bp, Mycobacterium tuberculosis 94 M4241A; identical to SEQ ID NO: 196

SEQ ID NO: 248 - DNA, 693 bp, Mycobacterium tuberculosis C; identical to SEQ ID NO: 196

SEQ ID NO: 249 - DNA, 693 bp, Mycobacterium tuberculosis CPHL A; identical to SEQ ID NO: 196

SEQ ID NO: 250 - DNA, 693 bp, Mycobacterium tuberculosis EAS054; identical to SEQ ID NO: 196

SEQ ID NO: 251 - DNA, 693 bp, Mycobacterium tuberculosis GM 1503; identical to SEQ ID NO: 202

SEQ ID NO: 252 - DNA, 693 bp, Mycobacterium tuberculosis Haarlem
atgatcaccagatacaagcctgagtcggggtttgtcgcccgtagcggtggtcccgaccggaagcgtccccatgactggatcgtttggcacttcacccatgccgacaatctccctgggatcatcaccgctggccgtctgctggccgattcagcagtcaccccgacgaccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcctggtatacggccatgtcccgttcgagctggtcagctacgtgtgttgctataacaccgagacgatgacacgggtacgaactctgctcgatcctgtcggtggggtgcgaaagtatgttatcaagcccggcatgtactactaa

SEQ ID NO: 253 - DNA, 693 bp, Mycobacterium tuberculosis K85; identical to SEQ ID NO: 196

SEQ ID NO: 254 - DNA, 693 bp, Mycobacterium tuberculosis KZN 4207 (DS); identical to SEQ ID NO: 202

SEQ ID NO: 255 - DNA, 693 bp, Mycobacterium tuberculosis T17
atgatcaccagatacaagcctgagtcggggtttgtcgcccgtagcggtggtcccgaccggaagcgtccccatgactggatcgtttggcacttcacccatgccgacaatctccctgggatcatcaccgctggccgtctgctggccgattcagcagtcaccccgacgaccgaggtggcatataacccagtcaaggagttgcgccgccacaaagtcgtcgcccccgacagcaggtacccggcgtcgatggcaagcgatcatgtgccgttctacattgcggcgcggtcgcccatgctctacgtcgtatgcaagggccactccggctactccggcggtgccggcccgctggtgcacctcggggtggcgcttggcgacatcatagacgcggatctgacgtggtgcgccagtgacggcaatgctgcagccagctacaccaagttcagccgccaggtcgacacgctcggcaccttcgtcgactttgacctgctctgccagcggcaatggcacaacaccgatgacgaccccaaccgccagagccgccgcgccgccgagatcttggtatacggccatgtcccgttcgagctggtcagctacgtgtgttgctataacaccgagacgatgacacgggtacgaactctgctcgatcctgtcggtggggtgcgaaagtatgtcatcaagcccggcatgtactactaa

SEQ ID NO: 256 - DNA, 693 bp, Mycobacterium tuberculosis T85; identical to SEQ ID NO: 196

SEQ ID NO: 257 - DNA, 693 bp, Mycobacterium tuberculosis T92; identical to SEQ ID NO: 196

SEQ ID NO: 258 - DNA, 642 bp, Providencia rustigianii DSM 4541
atgagcataccgaaagaacccaaaatatatcatattgttcatgttgatagattaagttcaatttttgcttcaaatggattgctatgtgatgctgaagttatttttcagaatttatctggaacaaatataggtatcagcaatataaaaaagcgtcgacttaccgaactacaattatcaagccattcgaatttatatgttggtcagtgtgtccctttctatttctgtcctcgctctatcatgctgtatgtcatacatagaggaacaaatacaaacttaacatatcagggtgggcaaaacagcattatacatcttcaagctgacctttatgctagcgttcaatgggcaaaaaaacataagaataggtgggcatttacgttatctaatgcgggctcttatttctttgaggatagatgtgatttatcacaactcaatcagcttgtttggcaggatattcaggcaactcaatggcaaaattgcaaagaaaacaaacaagctgaattcttgatggagcgttattttccgtggcatctagtggaacaaatcgtcgttcattctcaagatatacaacaaaaagttatccaattattaaggatggaagaacatcgaccacctgttacaattaagtctgactggtattactaa

SEQ ID NO: 259 - DNA, 966 bp, Acidovorax delafieldii 2AN
atgagggtgctggcgccagagcggcgggaactgatcgaagcgctggtcgcggaagccgagtcaggcgcgatcacggcgggcctgctggaaaaggacgagcacctgaccgatgcgttgcgggccctgttcgccttgaagccggaaggggtgcaactggtgttctgcggcggcaccagcctgtccaaggcctacggactgatcgaacgcatgtccgaggatgcggacctgaaggtggtgctcccggatgcgggccaggcatcccgcgccgatatccgccgccggctttccgcgctaaaagcccaggtgaccaaaaccctggccggcatcggtctggtcgaaaacaaggccaaagggctggctttcaacgagaaccggtacttctgcagcgaatggacctacgagcggcactatgcctctgccgccgggcttcgccctcacctgcagatcgaattgacggcacgcgcgccggttctgccttcgcagatctgccgcatcaccacgctggccgaccaactcgccggccgcagcgaccaggcctttgaagttcctgtggtggccgtggccgagaccgtcgcggaaaaaatcctctcgttcctgcgccgctacgcccagcaccgcgccggcctgatgcgccaggcctgggatacggccctggtccggcacctgtatgacgtgcaccgcattcaccagcgccagcccgaagcattggccgacgcccggcgggccttccccgcgctggtcgcgggcgaccagaaggagttcggcgcccagttcccggactttgccgcagcgcctcttgaagtgctgaacggcgcgctgcggcaagcccgcgccgataccaagatccaggcggaattcaccggcaacctgctgcccctggtctatggcggcgagacaccggcattcgagcaggctttcagtgacttcaacacggtcgccgaagcgctcctcgaagcgctgccatag

SEQ ID NO: 260 - DNA, 966 bp, Acidovorax sp. JS42
atgagggtactggcgcccgagcggcgggagctgatcgaggcgctcgtcgcggaagcggcgcctggcggaatcacggccggcctgctggaaaaagacgagcacctgaccgatgcgttgcgggccctgttcgccttgcagcccgaaggcgtgcagctggtgttctgtggcggcaccagcttgtccaaggcctatggactgatcgaacgcatgtccgaggacgcggatctgaaggtggtgatcccggatgtcggtcaagcatcccgcgccgaaatccgccgccgactttccgcgctgaaagccctggtgaccgaaacactggccagcatcggcctggtcgaagacccagccaaggggctggcattcaatgagaaccggtacttctgcagcgaatggagctatgcgcggcactatggctccgccgcggggctgcgccctcacctgcagatcgaattgacggcacgcaccccggttctgcccgcgcaagtctgccgcatcaccacactggccgaccagctcgccggccgcagcgatccagccttcgaggcgctggtggtcgccgtggccgagacggtcgcggaaaaaatcctctcgttcctgcgccgctacgcccagcaccgcgccgggctgatgcgccaagcctgggatacggccctggtccggcacctgtacgacgtgcacagcattctccagcgccaacccgaagtgctggccgacgcccagcgggcattccccgcgctggtcgcaggcgaccagaaggagtttggcgtccagttcccggactttgccgcggcaccccaccaggtgctgaacggcgcgctgcggcaagcccgtgccgatacgaagatccaggcggagttcaccggcaacctgctgcccctggtctatggcggcggcacaccggcattcgagcaggctttcggggactttgagaaggtggcggccacgctgctggagacgttgcgctga

SEQ ID NO: 261 - DNA, 927 bp, Burkholderia pseudomallei 1106a
ttgatcgacgccctgctcgctgaaaaagacgtcggtcgaatttcggcagccattctcgagaaggatatccatgtcacagatgccttacgggcattgtcgaccctggcgcacgaacacgtcacgctggtcttctgtggtggcaccaacctctcgaaggcacacggcatcattgagcggatgtcggaagacgttgacctcaaaatcgtgctgtctccttcgcacggtctgagcgacagcgcgttaaagaagcatctttccgcattgaaaaagaaggtggccgagacgctaacagtgctggatttccaggagattctggaggcggcgagcgcgagaaatgccaaccggtatttcgcaagcagttggcgctacgcgtcggtttacggaccgcatcagagcctgcgcacccatttgagcgtcgagttcacagtgcggacacctgcctttgatacgtcaaagcgtcagctcggctatctgatcgatcgactggcggatcgaacgggcaaccccttcgccttccaatgtgtctccgtggaagagaccctcgcggaaaaggtcctcgcgtttctgcgccgttttgccgaacaccgcgcaaaggtacgcgagaactgggacgaagcgctggtgcgacatatctacgacacctggcgtattgtgtctgtcgacccggccgccgctgaccgcgcagcgacccacttcaaggatctcgtcgaatttgatcgtggtgaatttcggctgcatgaggcgttcgtcaccgaccccgcgacgtgcatgaagagcgcgctcggcgaaatcgagcacgacgcccaaacgatcagcgaatatgccgacaagctcattccgttgatttatggcaaggacaagccaaccttcaacgaggcgttcggtgtgttcaaggacgttgccaacaaattgctcggcacactttag

SEQ ID NO: 262 - DNA, 957 bp, Burkholderia pseudomallei 14
atgaaaacaattacaaccgaccaacgggagttgatcgacgccctgctcgctgaaaaagacgtcggtcgaatttcggcagccattctcgagaaggatatccatgtcacagatgccttacgggcattgtcgaccctggcgcacgaacacgtcacgctggtcttctgtggtggcaccaacctctcgaaggcacacggcatcattgagcggatgtcggaagacgttgacctcaaaatcgtgctgtctccttcgcacggtctgagcgacagcgcgttaaagaagcatctttccgcattgaaaaagaaggtggccgagacgctaacagtgctggatttccaggagattctggaggcggcgagcgcgagaaatgccaaccggtatttcgcaagcagttggcgctacgcgtcggtttacggaccgcatcagagcctgcgcacccatttgagcgtcgagttcacagtgcggacacctgcctttgatacgtcaaagcgtcagctcggctatctgatcgatcgactggcggatcgaacgggcaaccccttcgccttccaatgtgtctccgtggaagagaccctcgcggaaaaggtcctcgcgtttctgcgccgttttgccgaacaccgcgcaaaggtacgcgagaactgggacgaagcgctggtgcgacatatctacgacacctggcgtattgtgtctgtcgacccggccgccgctgaccgcgcagcgacccacttcaaggatctcgtcgaatttgatcgtggtgaatttcggctgcatgaggcgttcgtcaccgaccccgcgacgtgcatgaagagcgcgctcggcgaaatcgagcacgacgcccaaacgatcagcgaatatgccgacaagctcattccgttgatttatggcaaggacaagccaaccttcaacgaggcgttcggtgtgttcaaggacgttgccaacaaattgctcggcacactttag

SEQ ID NO: 263 - DNA, 957 bp, Burkholderia pseudomallei 9; identical to SEQ ID NO: 262

SEQ ID NO: 264 - DNA, 957 bp, Burkholderia pseudomallei B7210
atgaaaacaattacaaccgaccaacgggagttgatcgacgccctgctcgctgaaaaagacgtcggtcgaatttcggcagccattctcgagaaggatatccatgtcacagatgccttacgggcattgtcgaccctggcgcacgaacacgtcacgctggtcttctgtggtggcaccaacctctcgaaggcacacggcatcattgagcggatgtcggaagacgttgacctcaaaatcgtgctgtctccttcgcacggtctgagcgacagcgcgttaaagaagcatctttccgcattgaaaaagaaggtggccgagacgctaacagtgctggatttccaggagattctggaggcggcgagcgcgagaaatgccaaccggtatttcgcaagcagttggcgctacgcatcggtttacggaccgcatcagagcctgcgcacccatttgagcgtcgagttcacagtgcggacacctgcctttgatacgtcaaagcgtcagctcggctatctgatcgatcgactggcggatcgaacgggcaaccccttcgccttccaatgtgtctccgtggaagagaccctcgcggaaaaggtcctcgcgtttctgcgccgttttgccgaacaccgcgcaaaggtacgcgagaactgggacgaagcgctggtgcgacatatctacgacacctggcgtattgtgtctgtcgacccggccgccgctgaccgcgcagcgacccacttcaaggatctcgtcgaatttgatcgtggtgaatttcggctgcatgaggcgttcgtcaccgaccccgcgacgtgcatgaagagcgcgctcggcgaaatcgagcacgacgcccaaacgatcagcgaatatgccgacaagctcattccgttgatttatggcaaggacaagccaaccttcaacgaggcgttcggtgtgttcaaggacgttgccaacaaattgctcggcacactttag

SEQ ID NO: 265 - DNA, 750 bp, Burkholderia pseudomallei Pakistan 9
atgtcggaagacgttgacctcaaaatcgtgctgtctccttcgcacggtctgagcgacagcgcgttaaagaagcatctttccgcattgaaaaagaaggtggccgagacgctaacagtgctggatttccaggagattctggaggcggcgagcgcgagaaatgccaaccggtatttcgcaagcagttggcgctacgcgtcggtttacggaccgcatcagagcctgcgcacccatttgagcgtcgagttcacagtgcggacacctgcctttgatacgtcaaagcgtcagctcggctatctgatcgatcgactggcggatcgaacgggcaaccccttcgccttccaatgtgtctccgtggaagagaccctcgcggaaaaggtcctcgcgtttctgcgccgttttgccgaacaccgcgcaaaggtacgcgagaactgggacgaagcgctggtgcgacatatctacgacacctggcgtattgtgtctgtcgacccggccgccgctgaccgcgcagcgacccacttcaaggatctcgtcgaatttgatcgtggtgaatttcggctgcatgaggcgttcgtcaccgaccccgcgacgtgcatgaagagcgcgctcggcgaaatcgagcacgacgcccaaacgatcagcgaatatgccgacaagctcattccgttgatttatggcaaggacaagccaaccttcaacgaggcgttcggtgtgttcaaggacgttgccaacaaattgctcggcacactttag

SEQ ID NO: 266 - DNA, 948 bp, Chlorobium limicola DSM 245
atgagaacgattacagcgcatgaacgtaacctgattctggatgttaccggtgaaggactgacacccttgccggccgctgcactggaaaaagatgtactggtcaccaaggtacttgagaagcttgcagatattgatgttgatgggatacaattgattttttgtgggggaacctgcctgtccaaagcacatggattgatcgggagaatgtcggaagatattgatttcaaagttgttgttccgccaggactgtcccggagccagaacagcctccggttaagtcagttcaaaaagcatctcgttgctgttctcgctaccgaaggttttgtagttcctgaaaacgaagtgcttgcccgggatgagaacaattatttcgctctgaatatccgctatgagagccgctttgaggtcgttgccagccttcgccctgaaatcaaacttgaattgagcgcaaggcctctgttgttgcccatgcaactgttgtcggtgcgaagcattctcgatattcttgttaatcctccaattgaaggaatcagaatcaactgtcttggtgtgcaggaatccattggagaaaaaacactctcttttctcaggagaactgcagaagctctttccggcagagtcagtaaagactatgatgaccgattgattcgtcatgtctatgatgtgacggtgatcaatcgtcgtttacctgatctgatatccggactggccggtgaggtttttgacaagatggtagactccgatgccgaaaggtttggcagacagtttccggaatttcggctgaatcctgttgtggaaatgagcaaatcggttgaataccttgagaacgatgagagttttgcagcagaatatgacaggtttgtcactgacctggtctacggtgagcaggtggcgtttgaggaggcaaaacgggagtttatcgaatttgcaagaagattgttgtcataa

SEQ ID NO: 267 - DNA, 354 bp, delta proteobacterium sp. MLMS-1
atgcgtgctggccgaaaccgcgccgactatgatgaccgtctggttcgtcatctctacgatgtgagggtcatcgcgcgtggccgctacgggttggtcaacgcactgccgcatgagcattttgcagccatggtggctggcgatgctgcccaataccgcaatcaatatccggagttcgagcaagatccggtcggacagatgcgccttgtactggacgccttgcaccacgaggcggatgccttcgagcgtgattaccttcagttcgttgacgagttggtgttcggggagcctgttagctttgccgaggctcgaacggtgttcgttgaactggcgaatcgcctgctcagtcaactgtag

SEQ ID NO: 268 - DNA, 954 bp, Desulfatibacillum alkenivorans AK 01
atggaaggtatatctcttttgaaaaagtcagttgataaaactgttattcagaatatttccttagagttaggtcttgatccgtcgtttatcgagaaggattggtacgccgtgcaactccttgtccttctatctgatttcaaaagcgataaagaggtgaaaattgtattttcgggcggaaccagcctctccaaaggctatggtctgataaaacgattttccgaggatttggattttatactgactattcctgtggggagctctttgtccgctgggcaaaggaaagcctttcgcaaggaactggtcttagcaatacaaagggatgagcgctttaatattgacgaagataaaatccagcgcggcgacagccatcgtttcttcaaaatacctattcaatacgacaggatttatgatgccgcatccctaagaccgcatcttcagttagagatgtcttttaaggaacttaatcggccttttgaacgccggagtatacgttcaatggcgtctgaaatggcaaaatcagacccggagcttgaaattgactgcgtctcggctatagagacggcaggcgacaaattaagtgcattaacgtggcgtatcctcgttcgagacagggcggatgagaaagatgaccccacaatcatacgacatcttcatgaccttgctgcgctggagaatatgattttagacgcatcagatgattttgtatcctcagctaaaaaatctttggaacaagataaaaatcaaaggggcggcgatattattgcgaatatgtctgttattgacagactggcgaacacattaaaaattctgaaagaggatgatttgtacaaaaaagagtatacgatgtttgtaacaagcatgtcctatgcgcccgaggatgaactgacaggatttgagggagcggttcatgcgcttgaaagaataattcatcattataatgcattatccgagtaa

SEQ ID NO: 269 - DNA, 741 bp, Escherichia coli 83972
atgcctgaattaacatcattatttcctgacgttgccgatgcactggatattgaatctgtcgctatcgtcgaaaaagattattttgtggttgatcttttaagattattaaaagaaataaaaccagaaacacatactctcgtgtttgcaggaggtaccgcattatcaaaagcaggtatctcgctaaacagaatgtcagaagatattgatataaagctcgtgccaacagagaactttatgcaaaatggcagagacaagagaagaaaaattcgcaaggaaatcgtgcaaataatcacggatgttattcataattctgacattttcagcttggataatgaaaacgcccgtataacacgtgatgagtatcgttataacgaaatctcggtacgttatccccagacatttgcacaagtcccctgtcttcgtccatttattaagctggagttgatggaaagcactctgctggaacatccggaaagcagagatatttattcccttgtcacggagttaacgggtaaaggtacacctgtaacagcattcccctgtgccaccattttatccactcaggctgaaaagctcatctccatgatgcgaagaacagcagcacatcttcgtaatcccgaacaacaggatgatgagtttctggtacgtcacatttacgacaactactgcattgtcagggaaaaaggtgtgaatgttcctgtattgaaaaattttgttcagatatgtattcagctatggtaa

SEQ ID NO: 270 - DNA, 741 bp, Escherichia coli ABU 83972; identical to SEQ ID NO: 269

SEQ ID NO: 271 - DNA, 741 bp, Escherichia coli FVEC1302; identical to SEQ ID NO: 269

SEQ ID NO: 272 - DNA, 741 bp, Escherichia coli FVEC1412; identical to SEQ ID NO: 269

SEQ ID NO: 273 - DNA, 948 bp, Escherichia coli MS 119-7
atggatgatttaaccactcttttttctgaagtggctgacgcgcttggtattgagtctgtcgcaattgtggaaaaagatcactatatcgttgagcttttgcaattgcttaaacctctggtgttcgatactcatcaattggtgtttgccggaggaaccgctctggcaaaatcaggtgtcgcacttaatcgcatgtcggaagatgtggatatcaaactggtgcctaaggatgcatttcaggcactttcccgcactcagcgaaaaaatacccgtaaagaaattgttcaggcagtttccagtgcaatagcttcatcgggtgtgttcaattttgatgatgattacccaaaagtgacgcgggatgaatatcgttataatgacatacctgttcgttatccacagcgagtagtgcaggcaccttgtttgcgtccttttatccggctggaactgatggaagcgaagttactggagccttctgaattacgggatattcattcactggtaacagggatcacgggaaaagcggctattgtttcagcgtttccatgcgcaactatcattagcacacaggcagaaaagctggtggcgatgttacgtcgtactgcggcagttgtgcgagatgttgagcgatttgatgatgcatcgctggtacgtcatatctacgatacaaactgtattgttgagacgagtcatgttgatatgagtctgctcgttgattttgttcaacaaactattgagcaggacattcagcgttacggcaaccagtacccgcagttttgcgcgtctccagttgatgagctaaaaatgggactggatgagttggcgaacaatcctctctaccagatgcgctatcagcagtttgtttcgccaatggtgtatggagagcgaaagatcacatgggatgaggcttactccaggtttaggagcttagcgctagccatcctgaatgcttga

SEQ ID NO: 274 - DNA, 741 bp, Escherichia coli MS 198-1; identical to SEQ ID NO: 269

SEQ ID NO: 275 - DNA, 741 bp, Escherichia coli MS 45-1; identical to SEQ ID NO: 269

SEQ ID NO: 276 - DNA, 918 bp, Escherichia coli MS 69-1
atgcctgaattaacatcattatttcctgacgttgccgatgcactggatattgaatctgtcgctatcgtcgaaaaagattattttgtggttgatcttttaagattattaaaagaaataaaaccagaaacacatactctcgtgtttgcaggaggtaccgcattatcaaaagcaggtatctcgctaaacagaatgtcagaagatattgatataaagctcgtgccaacagagaactttatgcaaaatggcagagacaagagaagaaaaattcgcaaggaaatcgtgcaaataatcacggatgttattcataattctgacattttcagcttggataatgaaaacgcccgtataacacgtgatgagtatcgttataacgaaatctcggtacgttatccccagacatttgcacaagtcccctgtcttcgtccatttattaagctggagttgatggaaagcactctgctggaacatccggaaagcagagatatttattcccttgtcacggagttaacgggtaaaggtacacctgtaacagcattcccctgtgccaccattttatccactcaggctgaaaagctcatctccatgatgcgaagaacagcagcacatcttcgtaatcccgaacaacaggatgatgagtttctggtacgtcacatttacgacaactactgcattgtcagggaaaaaggtgtgaatgttcctgtattgaaaaattttgttcagatatgtattcacgctatggtaaccagtacccacaattttgtagctcaccagttgatgaacttaagaaagggctggatgcactccgggattatcctgtacacaaattgcgctttcaacgatttgttaaaccgatggtatttggtaatacacagattaactgggaagaagcctattccagtttcagacaaacagcgctaa

SEQ ID NO: 277 - DNA, 948 bp, Escherichia coli MS 69-1
atggatgatttaaccactcttttttctgaagtggctgacgcgcttggtattgagtctgtcgcaattgtggaaaaagatcactatatcgttgagcttttgcaattgcttaaacctctggtgttcgatactcatcaattggtgtttgccggaggaaccgctctggcaaaatcaggtgtcgcacttaatcgcatgtcggaagatgtggatatcaaactggtgcctaaggatgcatttcaggcactttcccgcactcagcgaaaaaatacccgtaaagaaattgttcaggcagtttccagtgcaatagcttcatcgggtgtgttcaattttgatgatgattacccaaaagtgacgcgggatgaatatcgttataatgacatacctgttcgttatccacagcgagtggtgcaggcaccttgtttgcgtccttttatccggctggaattgatggaagcgaagttactggagccttctgaattacgggatattcattcactggtaacagggatcacgggaaaagcggctattgtttcagcgtttccatgcgcaactatcattagcacacaggctgaaaagctggtggcgatgttacgtcgtactgcggcagttgtgcgagatgttgagcgatttgatgatgcatcgctggtacgtcatatctacgatacaaactgtattgttgagacgagtcatgttgatatgagtctgctcgttgattttgttcaacaaactattgagcaggacattcagcgttacggcaaccagtacccgcagttttgcgcgtctccagttgatgagctaaaaatgggactggatgagttggcgaacaatcctctctaccagatgcgctatcagcagtttgtttcgccaatggtgtatggagagcgaaagatcacatgggatgaggtttactccaggtttaggagcttagcgctagccatcctgaatgcttga

SEQ ID NO: 278 - DNA, 741 bp, Escherichia coli UMN026; identical to SEQ ID NO: 269

SEQ ID NO: 279 - DNA, 918 bp, Escherichia coli CFT073; identical to SEQ ID NO: 276

SEQ ID NO: 280 - DNA, 948 bp, Escherichia coli W
atggatgatttaaccactcttttttctgaagtggctgacgcgcttggtattgagtctgtcgcaattgtggaaaaagatcactatatcgttgagcttttgcaattgcttaaacctctggtgttcgatactcatcaattggtgtttgccggaggaaccgctctggcaaaatcaggtgtcgcacttaatcgcatgtcggaagatgtggatatcaaactggtgcctaaggatgcatttcaggcactttcccgcactcagcgaaaaaatacccgtaaagaaattgttcaggcagtttccagtgcaatagcttcatcgggtgtgttcaattttgatgatgattacccaaaagtgacgcgggatgaatatcgttataatgacatacctgttcgttatccacagcgagtggtgcaggcaccttgtttgcgtccttttatccggctggaactgatggaagcgaagttactggagccttctgaattacgggatattcattcactggtaacagggagcacgggaaaagcggctattgtttcagcgtttccatgcgcaactatcattagcacacaggctgaaaagctggtggcgatgttacgtcgtactgcggcagttgtgcgagatgttgagcgatttgatgatgcatcgctggtacgtcatatctacgatacaaactgtattgttgagacgagtcatgttgatatgagtctgctcgttgattttgttcaacaaactattgagcaggacattcagcgttacggcaaccagtacccgcagttttgtgcgtctccagttgatgagctaaaaatgggactggatgagttggcgaacaatcctctctaccagatgcgctatcagcagtttgtttcgccaatggtgtatggagagcgaaagatcacatgggatgaggcttactccaggtttaggagcttagcgctagccatcctgaatgcttga

SEQ ID NO: 281 - DNA, 948 bp, Escherichia coli W, ATCC 9739; identical to SEQ ID NO: 280

SEQ ID NO: 282 - DNA, 741 bp, Escherichia sp. 1 1 43
atgcctgaattaacatcattatttcctgacgttgccgatgcactggatattgaatctgtcgctatcgtcgaaaaagattattttgtggttgatcttttaagattattaaaagaaataaaaccagaaacacatactctcgtgtttgcaggaggtaccacattatcaaaagcaggtatctcgctaaacagaatgtcagaagatattgatataaagctcgtgccaacagagaactttatgcaaaatggcagagacaagagaagaaaaattcgcaaggaaatcgtgcaaataatcacggatgttattcataattctgacattttcagcttggataatgaaaacgcccgtataacacgtgatgagtatcgttataacgaaatctcggtacgttatccccagacatttgcacaagtcccctgtcttcgtccatttattaagctggagttgatggaaagcactctgctggaacatccggaaagcagagatatttattcccttgtcacggagttaacgggtaaaggtacacctgtaacagcattcccctgtgccaccattttatccactcaggctgaaaagctcatctccatgatgcgaagaacagcagcacatcttcgtaatcccgaacaacaggatgatgagtttctggtacgtcacatttacgacaactactgcattgtcagggaaaaaggtgtgaatgttcctgtattgaaaaattttgttcagatatgtattcagctatggtaa

SEQ ID NO: 283 - DNA, 933 bp, Legionella drancourtii LLAP12
ttgctgaataaaattaaagaaaccagtgattttttagatttacatgaatctattatcgaaaaagattattacgtcacccagttgatacaaaccctttctggtatcgaaaatgaatatttccgattagtcttttgtggtggcacttgcctggccaaagcgcacagagtcgttcggcgtatgtctgaggatgtggattttaaaattcagcgcaaatcaaccacggatgattttagcaaatcgcatatgctaaaagagttgaaaacttttcggctggagcttcaatccaaattttcaattccgaacttaacggccagtgaacctgtagtccgtaatgagggcaaatattcacgggttcaatttactttcccttctgtctttacacttaacgatactctaagaccccatatactatttgaatttactctatcaaatatttgttgtgatgtggtgatacgctctgtaatgactttaatggaagaaactttccctgatttgagcctattccctaaaagccagacccattgtgttgctgttcatgaaacagcaattgaaaaatgggtaggcttaacgcgacgcatcattgccattgagcggggaagtcaccacgatgatcgatctttgattcgtcacgtttatgatcttaatgctatcgaattagctgaaccgatccccgatgattttttgatgctggcaaaagacattgttctaaccgatgcacaacagtttaaaaatcagaatcctgaatacgcagctaaccccgcagaggaaattaaccgatcgctcgatctcctgcgcaccaagcctatctggcgagagcgctattatgattttattgaaaacatggtcttcaatcctgatttagctgctgattatgataaagctatcaatgtgattgcggatttgagcaaaagagtgatttccttcttacactaa

SEQ ID NO: 284 - DNA, 924 bp, Legionella pneumophila Corby
atgccaggtgaattaaacgaacagcaaattcgccaaactgctattatcttaggattgcctgcagattttattcgcaaagattatttcgttacaaaagcaattcgtttattagttggaatatctaatgattattttgagttggtatttcaagggggtactagtctttctaaaggttatggagtgattagtagactctcggaggatatcgatttccgagtaattcctaagcctgcttgtctcagtttaggtaaagatgcaagacgacgagagttgcgattattccggcgtgcattggttgaatcattaatcaatgccggctttaatgttgaaccgcaggatgttaaggtcttttatgaaggacgatatatgagtattcgtgcttcatttgatggtgctcaaggcattgtttacttgaagcctcatattgccattgattgttttcttggtacgttggagttagatcctgaaattcgcaacatttcctcaatggttaaagtgactttgggcgatgcagagtgtgatcaccagtattttccagtgccttgcgttgcattagatgaaactgcagcggaaaaatgggtagcattgtcacgccgaatcgtagatgcaaatgaaaccgcgagagattccgataagcacttagtcaggcatttgtatgatcttcatcaattgcagcaacaaaattgccttacagaaaattattaccttgtactggaaaaggtcttagaaaaagagcaggagatgtttggctgtgaatcttctgatagcgtatatgagaaatcaatatcagcattacattaccttcgctcagataaaaagtgggaagagcattggcgattttttctggagcaaatggtttatcagttagaaaaacctggttttgagcaagctatagcaacggttgaaaaattaagctcaagatag

SEQ ID NO: 285 - DNA, 948 bp, Legionella pneumophila Lens
atgctcgatagctctatgtttcaatatattgaaaccactgcaaatactttagacttgcctgaatctgttattgaaaaggattattatgtcactcaggtaattcaatccctttctaaaatagaaaacgaatacttccgtttggtcttttgtggtggtacttgcttggctaaagcgcataaagtcgtgcagcgtatgtctgaggatgtagattttaaaattcagcgtaaatctactacagatggttttagtaaatctcatctgttgaaagaacttaaggcttttcggcttcagcttcaatcaaactttgcaattcctaatcttacagcaagtgagccagtggtgcgtaatgagggaaagtattcacgggttgaatttttttatccttcagagtttactcgtaatgcgactttaagaccccatatactctttgaatttactttatcaaatattcgttgtgatattgtaacacgctctgtaaaaactctgatggaagacacatttcccagtttaagcttatttcctcaaagccaaacccattgcgttgctgtgcatgaaacggctattgagaaatgggtgggtttaacaaggcgcatcatagcgattgaacgaggatatcattatgatgatccatcattgattcgccacgtttacgatcttaatgctattgaatcggccgaacctattactgacgattttttaatgctggctaaggaggttatcctaaccgatgcacagcaatttaaaaatcaaaatcctgaatatgcagccaacccagtagaggaaattaatcgctcgcttgatctactgcgcgccaaacctttatggcgagagcgctatcaagattttattgaaaatatggtgtttaatcccagcctagctactgattatgataaagccatcaatgtgattgcggatctcagcaaaaaagtcgtttcctacttacactaa

SEQ ID NO: 286 - DNA, 927 bp, Legionella pneumophila Paris
atgccaggtgaattaaatgaacagcaaattcgtcaaactgccattattttaggattgcccgcagattttattcgcaaagattatttcgttacaaaagcaattcgtttattagttggaatatctaatgattattttgagttggtatttcaagggggtactagtctttctaaaggttatggagtgattagcagactctcggaggatatcgatttccgagtaatttctaagcctgcttgtctcaatttaggtaaagatgcaagacgacgagagttgcgattatttcggcgtgcattggttgaatcgttaatcaatgccggcttttatatacaaccacaggatgttaaggtcttttatgaaggacgatatatgagtattcgtgcttcatttgatggtgcccaaagcattgtatatttaaagccccatattgccattgattgttttcttggtacgttggagttagagcctgaaattcgtaatatttcctcaatggttaaggtgactttgggtgatacagaatgtgatcaccagtattttccagttccttgtgttgcattagatgagacagcagcggaaaaatgggtggcattgtcacgtcggattgtagatgcaaataaaaccgtgcgcgactcagataagcacttagtcaggcatttgtatgatcttcatcaattgcagcaacaaaattgccttaaaggaaattattaccttgtattggaaaaggtgttagaaaaagaacaggagatgtttggcggtgaatcttctgttagcgtatatgagaaatcaatatcagcattacattaccttcgttcagataaaaagtgggaagagcattggcaattttttctggaacaaatggtttatcagttagaaaaacctagttttgagcaagctatagcaacggtggaaaaattaaactcaaggagataa

SEQ ID NO: 287 - DNA, 1068 bp, Methylovorus SIP3 4
atgaaaagtataaatgattcagaaagaaatttaatcaattcaatttataatgaattgcaaccaaacataaatatttcagcattagaaaaagatatacatattactgaaataataaaagaattatctcaacttcaatttgaaaattttcatttagttttttgtggtggcacttgcttatcaaaagctcatggtattttagaaagaatgtcagaggatgttgattttaaattagtcttaaaaaaggatgttgcagaatacagtaaaaatgagctcaatcacaaactaagtgaagttaagcatattcttaaagataaattaataagtcttaattatatatctttagctgatacagagagtacagccaattcaattattaaagctcatgatagcaatcaatacatagtatttaatattccatatcaaaataaattcccatcttctacagttttaagaccacacattcaaattgagttaaattacactaaactacaattacctatgaaattgtaccaagtgggttatatttacaaagacttaatcaaaaatacagatataaaatttcaagtgagatgtgtttctattgaagaagcattttgcgaaaaattaattgcatttccaagaagatactcccatgcaatagctaataataatttagataactttgaccaagctctagttagacatttatatgatgtacatcaaataaaacataaatatcctgtaatagataaaaacgaaaccttaattacaggattaattaaaacattgatacaaaatgatgctattgaatttagtaatcaacatcaacagtttattgctgatccaattggagaattaaacaaagcaatggaatcagctttaacttcacaaacaattagaaaaaactataatgacttcttagaacatatggtatatcaagataatgctaagaagcctacatttgaagctgcaatcaatacttttcaaattgctttgaataatgccattaaacacataccgaagattcaagttgaaatacctattaaacaagtgattaagcctaacaagataaaaacattaaaactttaa

SEQ ID NO: 288 - DNA, 900 bp, Chlorobium luteolum DSM 273
atgtcacgtaatcaactgctgccaaaaaaatcagccattgagcgtgctgccggcctactcgtcacgactgatgaagccttcattgaaaaagattggcatgtcgttcgagcgcttcgattgctgaatggcctgcaaagtccaggattgcagctggcttttggtggggggacatcattggccaaagcaggtctgatcaagcggttttccgaggatgtggatttcaaagccacaatacaaccggcagggcgcacacagtatcgagcaacgcgtaaaacaataattgagactctgctcgatgaaggattttcgcttctcgcggaaccaatggtgcgcgatgagagtagatttttttcgttggaacttgattatggggcaacattctcgaccagccgtcgcttacgaaaacacatccgggtagaggttcgctttgtcccgcccaaaatacccgttgtgtttcaaccggttcaatctcttctggggcttactgaacaacagcccgccgaaatcggctcaatgccgtatgtccatccggtcgaaatagctgccgataaactcagtgcgctatcatggaggctgcttgatgacgatgaaagccaggataaaaccctcatacggcatgttcatgacatggcggcactggaacccatgattacttcgaacggggcatttcaaaaccttgttcgacaagccatgacggatgatttgaatcgcagtcatattcctttagtgcaacggcttcgtcgggttatgacagcgctcaagacagctgtttggaaaaaagcctatcaatcgttcgtgcaggatatgtcattcgctcgtgaggatgaaatcattgcttacgaaacggcactgaatgcctgtgagcgattgattgatctggttgagcgcaaacggacataa

SEQ ID NO: 289 - DNA, 891 bp, Pelodictyon phaeoclathratiforme BU 1
atgccgattaatcaagttctaccaacaaaaacggccattgaacgtgctgctggtatactcgttacaactgacgaagcctttattgagaaagattggcatgtggttcgagcgcttacattgcttaacggtcttcacatccaagggttacaattggcttttggcggtggaacatcgttagcaaaagcaggacttatcaagcgcttttctgaagatgttgattttaaagccaccataacccctgccgggcacaagtattatcgtgaaactcgcaagaaaataattgctgctcttgaagatggaggattggttctggtcgccaaaccgatggtacgcgatggaagcagattcttttcacttgaactggattatggtgcaacatttatgcggaaccaacgattgagaacacatatccgtgttgaggtgcgttttgtagcgccacaaatgcctgttgtgttcaagccagtgcagtcgctgttaagatttacggaagggcagcccgccgaaattggctctatgccatatatcgatccggtcgaaatcgcagcggacaagttaagtgcgctttcgtggagattgttggacgaagaggaacgccaagataaaaccctgatacggcacgttcatgatctggcagcacttgaaacgttgattgcatcgaacgtcaagtttccagaccttgttcgccaatccattgctggcgattacaatcgcagtgatattcctcaagaacagcggcttcgtggcgttatgacaaatttgcaaaatgccgtatggaaagaagcctatcaatcgttcgtgcaggatatgtcttttgctcgggatgatgaaatcattccatatgaatcagcgcttgatgcgtgtgagcgtttggtttatctggttgatcgctaa

SEQ ID NO: 290 - DNA, 942 bp, Photobacterium sp. SKA34
atgaataaactgaaacagcagtttcttgaggtttccgatgctttagtgcttggaaaccccgccatcattgaaaaagattattgggttgtggcactgttagcgcaacttgaaaaactcactatagattctcatcaactggtcttttctggcggtactgcattggcaaaatccaatgtgaagatcatgcgtatgtctgaagatgtcgatatcaagctgatccctaatgccgactttcatacattaagcagaagtaagaaaaaaaccgttcgtaaatcattgcttgagactcttgaaaaagcgattgaagaatcaaataccttttcgattgaagacaaacaagcatgggacgaataccgctatgtggaatatgacttaaaatatccacaacagtttagtcaggcaccttgtttacgccccattatcaaacttgaattgatggaaaccattccattacaagaaacagagcagcgaagcatacaatccttagtagcggaactttaccgaactaaaaaagaagttaaagcctttgcttgtgtatctgttcacgccaccttagctgaaaagatcatttcaatgcttcgtcgtaccatgctggctaagcgtgatgaaaatcgtaaagacgatcaaaccttagtgcgtcatatctacgatgtttactgcatagacgcaacacaacaaattgatattgaatcactatcactgctatttaacgcagtattacaagaagatatcactcgctttggtaatcaacatgatgaatttgtaaataatccatctaaagagctacaaagtggcttattagaattagaagctaatccactttatcgccaacgctttgaagcttttgtcactccgatggtttttaaccaacaaccccatgattttgatacatgctttgcctcatttaaacgcattgcagcatcgttaattgaaaaaatttaa

SEQ ID NO: 291 - DNA, 951 bp, Photorhabdus asymbiotica
atggatgatttaacaaagctattcccggacgttgccgatgctctaggcattgaatcagttgcaattgtagagaaagatcattacatcgttgagttattgcgattgctccagcctctgtcctttgatacgcatcagctggtttttgccggtggaacagcattgtcaaaagcgggtatatctttgaacaggatgtcggaggacgtggacattaagcttgttcctgtcgccggtttttcccagcaatattccagaggccagcgtaaagacattcgtaagggtattattcagaccattatcgaaacgattacagcctcaggtacgtttcgcatggatgaagggtatccaaaggttactcgtgatgaatatcgctataatgaaatttcggtgcgctacccacaggaatatgcacaaattccctgcttaaggccatttattaaactggaactgatggaaacgggtttgcttgaggctgcggaaaaccgtgttattagctcattggtaatggatctaacaaagaagggtgaagtagtgagggcttttccctgcgcaactatcgccagcacgcaggctgaaaagctgatttcgatgatgcgcagaacggctgcaagtatgagtgatgtggaacgtgtagtagatgaatcattggtgcgtcatatctacgacaatttttgtattgttagagaaaaaggtgctgatgttcctgttttaaagcaattcgtgcaggaatgcattgagcaggatattgaacgttacggtgaccagtatcctgaattctgcgagtcgcctgttgaagaactaaaaatggggctggaagaacttgagagcaatcctgtttataaggaacgctatctgcggttcgtcacaccaatggtattcggtgaaagccacgtttcatgggaagatgcctatacctgcttccgcaaaacgacattggatgtgtttgatgcatag

SEQ ID NO: 292 - DNA, 963 bp, Photorhabdus luminescens
atggatgatttatcaggtttatttgcagatgttgccgatgtactaggtatcggtactatttctattgtggaaaaagattactatgttgttgaactgcttcgtctgctacagcctttagcgtttgatacccataaactggtatttgctggtggaacagcgttggcaaaagccggaatttcacttgatcggatgtcggaagatgtggatatcaaactggttccacagcctgaatttttggtgggtgttcagtactcccgatctcagcgcaaaaatatcagaaaggatattgttcagacgatatcagcgactattgcagcatctggttttttggggattgacgatagcaaccctaagatcacacgggatgaatatcgctacaatgatatttcggtccgctatccccaacgtgttgtacaggttccctacctcaggccatttatcaaactggagttgatggagtctgatttgctgcaagcggcagaacggcgcgatattcgttcatttgtcacgcaactaacaggaaaaggtcgggcggttgaagcgttcccctgcacgacgattatcagcactcaagctgaaaagctggtagctatgctgagacggactgctgtgtttatgcgtaatattgatagaaaggatgacgagtcactggttcgtcatctgcatgataactactgcattgtgaatgcaataggagtggatatccgtcaacttgctggttttgtacaacaaactattgaacaggatattcagcgctatggccgccagtatcctcagtttcagatttcgtcgattaatgaactgagagctggattggaagagttgggaagtaatcccatctatcagcaacgttatcaacaacttgtgatcccaatggtctttgaacatagtagaataccttgggcagaagcttacgattgtttccggcagacggctttatctgttctgaatgagctgaactaa

SEQ ID NO: 293 - DNA, 903 bp, Pseudoalteromonas haloplanktis TAC125
atgggtaaccctgctattgttgaaaaagattattatgttgttgcattactaaaactactttctgaattgtcttttgatacgcacttattggttttttctggtggtaccgcattaacaaagtcgggcattaaaactcatcgaatgtctgaagacattgatattaaaatcatacctacagatgtgtttgctaatatttcaaaaacacaaaaaagaaaggctaggaaagagttacatcttcaattacttaatgccattagtctgcacaactctttttcggtagaaaaccgccctactatttatgatgaatatcgttatcaacaaattgatatacgttatcctcaagcacattcaaaagttccatgcctaaggccgtttattaagttagagctgatagagaccttgctttatgatcaagtagtgagtagagatatatgttctttaatgaatgaggtcactcaaaagcctcctgaagttgcgctaatggggttttcgagtattaagagtacacaagcggaaaagctagtctctatgttgaggcgaacagcaagttttgcgcgcgataatataagagatgatgatcctgcattaatacgccatatttatgatacgtattatattcaacaagctgggcttgcgagtgcttctgacgtaatgtctttggtaagtaaagttattgcggaagacttaacgcgttactcaaaccaacacgctgaatttatgaaaagtccgattgctgaactgaagtttggcttaagcttactacaaaccaatacattatatgaagaacgctttaaccaatatgtagtacctatggtttatggcaataatagccttaattggcagcaagcatttgatgtatttaagttatattgcaatcaagtgttaaataacataaagctttag

SEQ ID NO: 294 - DNA, 990 bp, Rhodospirillum centenum SW
ttgagcgatccgaggtatgatctcggagctgtacaggatttcttcggcttctccggcgtcagtgtcgtcgagaaggacctggagattgtcaaagtcctgaaaatattctcagaactcaagacagacggtatccggttcgtcttcgccgggggaacctgccttgcccgtgcgcatggcaggatcaagcgcatgtccgaggacctggacatcaagctcgttctgtctcccgggcttgcggccgccggtgcgaccaggcagaggaaggtgctgagcgccctgaaggaggccctggttcaggagttcggcagggtcggcctccatctcgaccacacgggagccgaggcggacgaaccgcccctcctcgcgcggaacgaaaacaggcatgtctcgtaccgcctcacctatgaccgcgccacgaaggatgcctccatcctcgattcccggatcaggatcgagacggtcgtttcgatactgcgccgggaggcggaactccggccggtgtcgtcactcgccgctgaggcctacggccaccctgccgaggtggacggcattgcctgcgtctccgtcgccgaaaccgccgcggagaagatcgtatcgctgacgcgacggatcgcagccagactggagggagatgccgggcggttcgacaaccggatcatccggcacgtctacgacctgcacatgatccgcgattccatcgatcccggcgatgtgggcagcatagcacgcgaaatcgccggacaggatgcggtgcagttccggaaccagcaccccggttacgccgacgatcccgaagaagccacgcgccgggcgttggacgcacttgtcagagatcccgagcatggacggcagtacgacgccttcatgacggacatagtctacggagacaagatcggcttcgacgtcgccatgcggacagtcgccgaaatcgccgccgccatgtgggaatgggatgcggtgaacacaccgggatcggggcggggagcatga

SEQ ID NO: 295 - DNA, 942 bp, Shewanella baltica OS155
atgaaaaaactgaaacaacagttcttagaggtttccgatgcattagcgctcgggaaccccgccataattgaaaaagattattgggtggttgctctactttcagagcttgaacagctaacgtttgaaactcatcaaatggtgttttccggcggcaccgcacttgctaagtccaatgtcaaaatacttcgaatgtctgaagacgtggacataaagctgatccccacgccgcaatttcaacaccttagtcgtggcaggaaaaaacagtaccgtaaagcattagcagtacaaattgaaacagcgcttattgcatctaacaaattttctatcgaagctagattagttcaggatgaatatcgctatgtggaatatgagcttaaatatccgcaacaatttagccaggctccttgtctacgcccaatcatcaagttagaactgatggaaaccattccactgcttgcgctggaaacgcggggcattcaatcgttagtcgcagagctttataagctgccacaagaagtgaacgtattcatctgcgtatcagtaaataccaccttggtagagaaagtgctttccatgttacgccgcacaatgtctgttaagcgtgatgcagcccgaaacgatgacgtcaccttagttagacatatttacgacgtacactgtattcatgcagcacaggcccttgataatgaattacttgcgcccctttttctcgccatattagcagaagatattgctcgctttggcaaccaacatgccgaattcgtcatggacccagctaatgagttacgccttggcttacaggagatagaaagcaacccactcttcaggcaacgctttaatgattttgttaaacccatggtgtttaactcgcaatcacccaattttgatacgtgctttatgtcctttaaacatattgcgacctcactcattctgactatttag

SEQ ID NO: 296 - DNA, 942 bp, Shewanella sp. ANA-3
atgaaaaaactgaaacaacagttcttagaggtttccgatgcattagcgctcggaaaccccgccattattgaaaaagattattgggtggttgctctactttctgagcttgaacagttaacgtttgaaactcatcaaatggtgttttccggcggcaccgcactggctaagtccaatgttaaaatacttagaatgtctgaagacgtggacataaagctgatccccacgccgcaatttcaacaccttagtcgcggcaggaagaaacagtaccgaaaagcgttagcagtaaaaattgaaacagcgattattgcatcgaacacattttctatcgaagctagattagttcaggatgaatatcgctatgtggaatatgagcttaaatatccgcaacaatttagccaggctccttgtctacgcccaatcatcaagttagaactgatggaaaccattccactgcttgcgctggaaacgcggggcatccaatcgttagtcgcagagctttataagctgccacaagaagtgaacggattcatctgcgtatcagtaaataccaccttggtagagaaagtgctttccatgttacgccgcacaatgtctgttaagcgtgatgcagcccgaagcgatgacgtcactttagttaggcatatttacgacgtacactgtattcatgcagcacaggcccttgataatgaattacttgcgcccctttttcgcgccatattagcagaagatattgctcgctttggcaaccaacatgccgaattcgtcatggacccagccaatgagttacgccttggcttacaggagatagaaagcaacccactcttcaggcaacgctttaatgattttgttaaacccatggtgtttaactcgcaaccccccaattttgatacgtgctttatgtcctttaaacatattgcgacctcactcattctgactatttag

SEQ ID NO: 297 - DNA, 603 bp, Synechocystis sp. PCC6803
atgtctagcaccctggcaatcacagaaattatccaggcgatcgccgctgagttcgttgttgatgaatgctttatcgagaaagactggtacgccatgcggattattggagtattgagccaaattcaagatcccacatttcaattagtcttttctgggggaaccagtctttctaagggctttggtttaattcaacgtttttctgaagatctggattttaaggttaaaatcatcaacaatcacccgccttctaaaaatcggcaacaaaaacaaagaaaagcttttcgggacaagattttagaaaatctagaacaatatcaaacagattggcaagtagatctaaatgctttacagaaggggaatgaatcaaaattttttaaagtcccaattcgctatcagcccctttttcaggtgtctaattccctacgtccccatgtacagttggaagtcacatttgaatctcccgcactggagccagagctaaaagatcttcagtcctttgtcggaaaagctctcaaacaacaaccagaggcaattaacttcccctgtgttaatccaattgaaacagcagcagataagctcagtgctttggtctggcggatttaa

SEQ ID NO: 298 - DNA, 774 bp, Verminephrobacter eiseniae EF01-2
atgtccgaggatgtggactacaagctcgtccccactcctgagacgatggtgctctccaacggcaagaggcgagccgccctgggcgacttcgccaaggccgcgatcgacgcgctgcaagccggcaggttcggccaaggttcggtggaacgcaggtcgcgcaacgccaacgcctacacgcgcctggacgtgtcctacgagtcggccttctccaagcctgcggcgctgcgcgggcatctgctcgtcgagttcaaccacagcccgctgcgtctggagcccgacaagcgcctggtgggcctgctgctcgacaagttggctctcggcgcctacaccgacccgttcgaggtcgagtgcatcgccctgcaggaagcattgacggaaaaactcgtgagctttccgcgccgactctcgatgctgctggccaggcattccgatcctgcccgggcgctcgggtgcgaggccgatggggattcctcgcttgtgcgccacctctacgacgcgcgccggctgctgcaagtccaccccgagctcgccgaggacggtgcgggcctggccaaactggtggacgctgccgtccggcaggacatggccgccttcgccaaccaacacccggagttcgtcgccgatcccggcctcgagctcttgctggccatgaagttcgccaaggcgagcccggatctcgctgcccaattcgacgctttcgtatcagaccagactcagttcacgctggcgggctgctcctggagagcgccagcgcaccgaatcggtcgatggtga

SEQ ID NO: 299 - DNA, 942 bp, Vibrio harveyi ATCC BAA-1116
atgaatacactaaaacaacaattccttgaggtttccgatgcgcttgagctcggaaacccagccatcattgaaaaagattactgggtcgtgactttactggctgagctagcgaaagtttctcctgagcatcatcaaatggtgttttctggcggcactgcgttggcgaaatcaaacgttaaaattctaagaatgtcggaagatgtggatataaaactcatccccaacccagcatttgatgaactgagtcgagcgaaaaagaaaaccgcgagaaaggcatgtgttaacgagattgaacaggcactcacccagtcagggctatttaacgttgaaacgcgttctgtgcgagatgagtaccgctacgtcgagtttgaacttaaatacccgcagcagtttagtcaagcgccctgcctgcgccccatcatcaagttagagttaatcgaaaccattccattactggatgtggagtcgcgcagcattcaatctctggtagcagagttgtaccaacaaccacaagaagtgagtgcatttgattgcgtctctatccatgccacattggttgaaaaaattatttcaatgctgcgccgtaccatgtcggtaaaacgcaatacggagcgaagcgatgatgttgctttagttcgccatatttacgatgttcactgcataacaaagctcgcaatgccagaactcaacgagatagatggcctattcaaagcggtattggcagaagatattgcccgctttggcaatcaacatgccgagtttgttgccaaccccaaacaagagctacaacttggccttaaagagcttgaggaaaatgcaatattccgccaacgatttcaggacttcgtcacgccaatggtgtttaacaccgaaccccatgattttgatacctgctttgcctcatttaaacgcattgcagcatcgctaattgaaaaaatttaa

SEQ ID NO: 300 - DNA, 942 bp, Vibrio tapetis CECT4600; CIP104856; B1090 plasmid pVT1
atgaaaaaactaaaacaacaattccttgaggtttccgatgctttagcgctaggaaacccagccattattgaaaaagattactgggttgttgctctgcttgctgagctagaaaaacttacctttgaaactcaccaattggtttttgcaggtggtacggcattagccaaatctaatgtcaaaatcctacggatgtcagaagacgttgatattaaactgatcccaagtaaagagtttgatgcgttgagtcgtggtaaaaagaaaaccgcacgtaaaatgcttatcgagcaaatagagcaggtgattgcgcgatctcagcaatttacagttgaaagccgacttgttcgtgatgaataccgttatgtggagtatgaacttaaatatcctcaacaattcaaccaagctccatgcttgcgaccaatcatcaaattagagctgatggaaactattccgcttctagaagtagaagaccgaggaattcaatcgttagttgcagagctttataagcaaccacaagaggtcagcgcattcgcttgtgtttctgtttacgcaacattagtggagaaagtactttctatgttacgtcgtactatgttggttaagcgtgacaccgaacgtaaagatgatgtcacgttggtccgtcatatctacgacgttcattgcattgatacagcgcagacgctagatattgagtcactaacctcattatttctcacagtattgaaagaagatatcgaccgctttggtaaccagcatgctgagtttgtcgctgcccctattaaggagctacgccttggcttacaagagctagaagacaacccgattttccgccaacgctttcaagactttgttacgccaatggtgtttaacaccgaaccccatgattttgatacctgctttgcctcatttaaacgcatcgctgaatcattgattaaaacaatttga

SEQ ID NO: 301 - DNA, 399 bp, Vibrio vulnificus CMCP6
atgaacgcactaaaacaacaatttcttgaggtttccgacgcgcttgagctcggaaatcctgccatcattgaaaaagatttctgggtcgtcgccttacttgccgagctagcaaaagtttctcctgaatatcatcaaatggtcttttccggcggcacggcgttggcgaaatcaaacgttaaaattctaagaatgtcggaagatgtggatataaaactcatccccaaccaagcgtttgatgaactgagtcgagcaaaaaagaaaggcgttagaaaggcatgggttaacgagattgaacaggcgatcattcattcagaacgatttaccgttgaaacgcgatctgtgcgagatgagtaccgttacgttgagtttgaactcagatatccgcaacagtttagttaa

SEQ ID NO: 302 - DNA, 942 bp, Vibrio vulnificus M06-24/O
atgaacgcactaaaacaacaatttcttgaggtttccgacgcgcttgagctcggaaaccctgccatcattgaaaaagatttctgggtcgttgccttacttgccgagctagcaaaagtttctcctgaatatcatcaaatggtcttttccggtggcacggcgttggcgaaatcaaacgttaaaattctacgaatgtcggaagatgtggatataaaactcatccccaaccaagcgtttgatgaactgagtcgtgcaaaaaagaaaggcgttagaaaggcatgggttaacgagattgaacaggcgatcactcattcagaacgatttaccgttgaaacgcgatctgtgcgagatgagtaccgttacgttgaatttgaactcagatatccgcaacagtttagtcaagttccctgtcttcgtcccatcattaagttagagttaatcgaaaccattccattactggatgtggagtcgcgcagcattcaatcactggttgcagagttgtaccaacaaccgcacgaagtgagttcatttgattgcgtctctgtctatgccacgttggttgaaaaaatcatttcgatgctgcgccgtaccatgtcggtaaaacgcaatacggagcgaagcgatgatgttgctctagttcgccatatctacgatgtgcattgcataacaaagctcacaatgtctgaactcaactcgattgacggcctattcaaagcggtcttggaagaagatattgcccgctttggcaatcaacatgcagagtttgttgccaaccctaaacaagagctacaacttggcctcaaagagcttgaggaaaatcccattttccgccaacgttttcaggactttgtcacaccaatggtgtttaacactgagccccatgattttgatacctgctttgcctcattcaagcgaattgccgcgtcgctaattgaaaaaatctaa

SEQ ID NO: 303 - DNA, 954 bp, Vibrionales sp. SWAT-3
atggaaaaactaaaacaacaattccttgaggtttccgatgcgcttgagctcggaaacccagccattattgaaaaagattactgggtcgtcgccttacttagcgaattagcgaaggtgtcgcctgtgtatcatcaaatggttttttctggggggactgcgctagccaagtcaaacgttaaaatcctgagaatgtcagaagatgtggatataaagctcattccccatcaagaatttggtgagctgagtcgcggccaaaagaaagccgcccgtaagacatgcattcacgagattgaaatggcgatcactcaaacagagcgatttaccgttgagtcgcgtctcgttcgtgatgaatatcgctatgtcgcgtttgaactcagatacccgcagcagtttagccaagcgccatgtcttcgccccatcattaaacttgagttaatagagacgatccccttactcgatgtagaaccacggccgatccaatcattggtaacggaactgtatcgacagccacaagaagtaaaagcgtttgattgcgtctctattcaagcgaccttggtggagaaagtgatttcaatgttgcgccgtaccatgtcagtaaagcgcgatacgcaacgtaaggacgatgccacgcttgtacgccacatctatgatgtttactgcattctaaagaccgaagcacaattagaaaacttcgaccttacagcaatgacagcgttatttaacacggtattgaaggaagatatcgatcgctttggtaatcaacacactgagtttgttgctaaccctaaacaagagctacagctcgggctaaaagaacttgaagataacccagtttttcgccagcgctttcaggactttgttacccctatggtgtttaacaccgagcctcatgattttgatacctgcttcgcctcgtttaaacgcattgcgcagtcgttaattaaaacaatctaa

SEQ ID NO: 304 - DNA, 963 bp, Yersinia aldovae ATCC 35236
atgatttttgcagatgttgccgatgccttggggatcggtgcaacatctatcgttgaaaaagattattatgttattgagttacttcgcctattacagcctttgatatttgagacacatcaacttgtgtttgctggaggaacatctctggcgaaatcaggtattaaattaaatcggatgtctgaggatgtagatataaaacttatccccaattcggattttcttgatgataaccagttctcgcgttcacaacgtaaaaatgcgagaaaggaaattatcgaaaaaatatcagatattattattgtatcagagctatttaagttcgataagagctatccaagaatagctcgggatgaatatcgatataatgatattcaaatccaataccctcaagagtttactcaagtcccttgtcttagacctttcatcaagctggaattaatggaatcagatttgttagaaccggctgagttgagaaatattagttcttttgtctacgagttggcaggaaaagggagcgaaatatctgcatttccttgcacaacaattatcagcacccaagctgaaaagatagttgccatgatgaggcgtacggctgcatttatgagaaatgtagaccgcaaagatgacgaatcgttggttcgccatatttacgataattatcgcattgtcgatgccttgggtttaaatatttgtcagctatcagtttttgtgcaacagacgattcaactagatattgagcgttatggatgccagcatccgcaattggaagcaaatgctatagatgaacttaaagcgggattagacgaaattggtagtaacccctattttaaagagcgctatgggcagtttgtggttccaatggtatttgagaatagcagagttgaatgggaagaggtttatcactgttttcgtcagacggcattggaaactttgaaatgtttagatggctcattaactaagtag

SEQ ID NO: 305 - DNA, 996 bp, Yersinia enterocolitica 8081
gtgcatgtaacagatgcattgcgtgtattagctaacttgaatgtagtgcatgaggcacagttaaaaggatttgaccctagaagtaaaaaattacctgttgagccagtaaatatagagcttcctgtccgattagtgtttgctggcggtacttgcttatcgaaagcttataacttgattagtcggatgtcagaagatattgatataaaagtcattcttccagaggttccgaacacctataaattaaaaaatgaatgctcatctgataaagcaagactgaaagatattcataaaaaactgacaacaaagctagaagaactaggtttctaccttactgataaagaaggtgaaaaccctgaaattaatgataggcaccgtcattataatgttgatttaagctatcaagggaatttcagtagcggtgtttctaaccctctgcgtagctgtataaaagtagaattaataaatcgtcccattaatttatctactgagaagttaaagattaattatctttatcaacaattagtaaatggtaaaagctaccctgattttgatatcgaatgtatcaacatatccgagactcttgccgaaaaggtcttatctcttctaagacgatttgcaatgtattgtgctggcgtgaagcaagccgaatttgatgaggcgctagtacggcatatttatgatgtatggcgcatatacacaataaaacccaaagcgattaatgctgctgctagtatgttcgggcactcagtaaaaactgatatggaagaatattcacagcaatttcaggcattcgttgatggcccgtatagtgtcctgagtaaaagtcttgatgtcataaaaaatactaaagatgggcagggtaaatggttgaaccatttatacataacgaggcttagcccactggtttattcgcaggaaccacactcctatgaagaggcgttggcaagttttgtcgaggtagctaaccacttactccgggccttagctgaaaagtga

SEQ ID NO: 306 - DNA, 948 bp, Escherichia coli H591; identical to SEQ ID NO: 273

SEQ ID NO: 307 - DNA, 1983 bp, Nitrobacter hamburgensis X14
atgcacggaatcgaaaagctcaacctgaacgacccggaaacccaaagcgccgatgtggtcgccgagaatatcgatgccctgcgctcgctgtttccggaagcgttcgaggaagggaagattgatttcgaggtgctgaagcaattgctcggcggcgcggttgacgagcgcgacgagaaatacggactgaactggcacggcaagcgcaaggcacggcagatcgcgctgacgccgtccaccggcacgctgttaccgtgtcccgacgaaagtgtcgattgggatacgacgcagaacttagtgatagagggcgacaacctcgaagtcctgaagcttctacaaaagagctacgccggcaaggtgaagctcatctacatcgacccgccatacaataccgggaaggaatttatttaccccgaccgctttcaggacaacctggacacctacttaaaatacacaggtcaaaaaggggaggatggccttaagactacgagcaacactgaaaatgacggcaggtttcatacgaactggctgaatatgatatatcctcgcttaaagcttgcgaggacaatgctcgctgacgacggggcgatattcatttccatcgatgataacgaaaaggccaatcttaaagagatatgtgatgaaatatttggtgaagataattttctcacggcgataattgtccaatctaacaagcgtggacaaacatacaaagagatagcgaagtgtcatgaatatatccttgtctattacaaaacagagaacggcgctctcggcgaactcgataaggatggcgatgccctcccttatgctgacgaacatggcggatacgatctttgggaactacggaatcgaaatccaaaattcggacgccacaaccggccaaatctgtattttccaatctacgtgaatcctaactctgtcggggctaatgggcttgcaagcattagcttgacgaaaagcgacgaatactgtcgggaggcattgccaaagaacagcgagggcgcggacagttgctggagatggagttcaaagaaagttcaaactgatggcatagatgctactccgatcactgtttttgccaaacagagacgagacggcgaatggaacatttacgagaagtcccgcaagagcacgaccaaagccaaaagtatttggagcgatactgctgttataagtgagcagggaacggttgaggccggaaaattagggatgagcggggttctcgattttccgaagccaatagaactcatccggcgttgcgtatttcttggcacaaacgaagatgatcttgtgatggacttttttgccggatcgggaaccaccgcccacgctgtgatgctccaatcggctcaagatggtttgtctagaagatggatatcggtgcagcttccagaaccgacatatgagtacaaggatggggagaaggttgcgaaaccgcaaaataaaatcgcttttgaaaatggacacgaaacgatcgccgatatttgcaaggaacggattcgtcgctcggcaaacaaattgaaagaggaatatccgggaaataatgccgatcttggtttcagggtctttaagctcgcgcagtcaaatatccgcgcgtgggaaccggagccgtccgacattgaaggtacgctccttgccaacgcagaacacctcgcacaaggtcgctccgaacaagacgttctccatgagctattgctcaagcttggtctcgacctctgcgtcccaatcgagaagaagcagatcgccgggaaagccgtccattccatcggcggcggcgcgctgatcgtctgcctcgctgacggactgaccaaggacgtggtggaggcgcttgccaacggcattgtcgcgtggcgcaaggcactcgccccggccgtcgatacccgtgtcgtgttcaaggattccggctttgccgacgacgtggccaagaccaacatggccgccattctgaatcagaacggcattctcgacgtgcgtagtctctga

SEQ ID NO: 308 - DNA, 1836 bp, Syntrophomonas wolfei Goettingen
atgaacaaacttgatggtaagaccatggatttagttcaacacaacattgatgaactcaagaagcttttccccgaggtcataaccgaagggaaaattgattttgaccggcttcggctcctgctcggtgatgaagttgatactggcaaagagaaatatgagttcacctggccgggtaagagcgactgtattcggttgtcccagcagcaatccacgggaacactacgccctgataaagaatcaagtaaggattgggataccaccaaaaacctttacatagaaggtgataacctggaggtattgcggctattgcagaaggcttatcatcggaaagtaaagatgatatacatagacccgccttataatactgggaatgattttatctataaagatgattataaggataatgtgaaaagctataaggaaaaaacggaacaatcaatgaaagcaaaccccgctacggcaggacgttatcattcagaatggttaaatatgatgtatcctagattaagattggctaagaatttattaagtgatgatggagctattttcataagcattgatgacactgagttggataacctaaaaaagatttgtaatgaggttttcggagaagagaattttattgcttgcatagcttggcataagaattatgcatctgctaacgattcaaaggggttttctagtgttctagattatatacttgtttacagaaaaagcgaaaattttgttcgtaatttgttacccaggacagataaacaaaattcgttatataaatatgacagtaatgatggatatggtccatggcgcccagataatttatcggtaaagacttactcaaaagaatatgattttacgattataaacccaacaacgggggttgaatataatcctcccaaaggaaggtgttgggtcactaataagaacactatagataagtggattaaagaagggagagtgttttttgggcaaacgggtaacggagcgccacaacttaagcgttatttaaatgaagtacaacaaggagtagttccgattacatattggtcttatgatgaatgtgggcataatgatgaagccagaaaggaaatcaaacaactttttagtgaacctccttttgatactcctaaacctactcgccttattaaacaaatattaaatattagtacaaacaaagactccatagttttagattttttttcaggatcttccaccacagcccatgctgtgatgaaactcaactctcaagacgatggtaaccgcaagtttgtaatggtacaattaccagaaccttgcaacgaagactctgaagcttacaaagctggtttcccaaacatctgtgaaatcggcaaagaacgtattcgccgcgccggtgaaaacttaaaagaagaatacaaggacaaagaaggcattgaaaacctggatataggctttaaggtattcaagctggatacttcaaatctcaaggcatgggacccggatgttgaagaactggaaggaacccttaaaggcatggttgaccccattaaagaagaccgtacccaggaggatatgctgtatgagattatgctgatatacggcatagacctgaccataccgctggaagaaattcagataaaaggcaagactgcttattccgttggcttgggctatatgattgtctgtctggaagatggtctaacccttgacgttattgaagctattggcgctatgaaacaatccggccaggaaatagcccgggtagttttccgggactccggttttgccgatgataatgtcaaaactaatgccgtgcagctattaaagaaattcggcattgaagacttccggaccatatag

SEQ ID NO: 309 - DNA, 1881 bp, Pelobacter propionicus DSM 2379
atggaaaaattgaacggccagtccgctgatgtcgtcgcggataatatcgaccaactgaaagctcttttccccgaagctctcaccgaggggaaaattgattttgacaccttgaaacagcttcttggtggcgacatagatgaacgagaagagaaatacggtctgaactggcatggaaaacgtcgtgctcggcaattggcgcttactccgtcaacaggaactcttcgccctagcccggaagagagtgtggattgggataccacacagaacctgatgattgaaggtgataacctggaagtgctaaagctcctgcagaagagctatgccggcaaggtaaagctgatctacatcgacccgccctacaacacaggcaatgattttgtgtatccagacaacttccaggacaacataaagaactatttggaattaactggccaagtagaggggggcgcaaagatcagtagtaataccgaagccagcggccgctttcacacggattggctgaatatggtgtatccacgattgaaactggcaagaaatctattaagcgaagatggagttctctttatttcaataaattatcgtgaattagcacatgttttgcggttgtgtgatgaaatatttggagaagaaaattttgttggtaatgtgacatggaaagctcgggtaaagccagtcaatattggcgaagctaaataccggcctcaaggcgaaacagagtatgttgttatttatcaaaaaagcgataaagagggcaaatttcaacctctatatactgggggtgtgcgaagttaccctcatgaaatcaacggtcgtaagtatcggttgacgacaattctgaaatccaatagaggggctaattttaggaatacaatgtcttttgaaattgatggatatgctcctcccgacggtcaacgttggcaaggaggagaagaagaaattaaacgtttaaatatagaaggttatcttgaatttcgggatggaacaccttttaaacgttattatgaggacgaagagggtgctgaacatgatcctttttactgcttcatggaatcagactggtcatcaacttcagaagctgggaaagcagagctaaacgagatccttggtaacgatcatggttttgacactgtcaaaccgactcgattgctaaagacactcatccaatcaataacaaaccctggtaataacgaaatagttgtagatttttttgcaggttctggaactactggacacgccgtcatggctcaaaattcagcagacggtggaaatcgccgctacgtacttgtccaactgcccgaacctctcgacccggaaaacaaagatcagaaaaccgccgccaatttctgcgaccagatcggcaagcctcgcacaattgccgaactaacaaaagaacgcctaagacgagccgctaaaaaagtcaaagacgataacactctttttgctggggacctcggtttccgcgtattcaagcttgattcttccaacattcgagcctgggagccaaaccgtgacgacctggagcaaaccctccttgatcacgcggagcatattgtttccggtcgttccgaacaggacatcctttacgaactgctcctgaaactgggcctcgacctgactgttcccattgaacagaaaccgattgccggtaaaaccgtgcacagcattggtgctggagcattactggtgtgcctgtcggacaccatcgatcgcgatgccattgagccgttggctcagggaatcgtggcatggcacaacgagctcaaacctgccgtggatacccgactggtcttcagggacagcgcctttgccgacgacgtggccaagacgaacctcaccgccatcctccagcagcaaggccttgatgatgtgaggagcctgtga

SEQ ID NO: 310 - DNA, 2007 bp, Acidovorax avenae citrulli AAC00-1
atgacgaactcgaatatgcagaaaatcgtcgccacggcgcccgagacgcagtccgccgacttggtggccggcaacatcgcccagctcaaggccttgtttcccgagcttgtcaccgaaggctccaagggcgtcgccatcaacttggacgtcctcaaggccctggtgggcgacgccaaggtcaccgatgctgaagagaagtatggtctgaactggcacggcaagcgccgggcgcgccaactggccttgacgcccagcaccggcacgctgcgtccttgcccagaagagagcgtggactgggacagcactcagaacctgatgatcgagggtgacaacctggaagtgctgaagctgctccagaagagctatgccggcaaggtcaagctcatctacatcgacccgccgtacaacacgggcaaggatttcgtgtacccagacaacttccagaacggtattcaaaactacttggagttgaccgggcagacggagagtggtgtaaaggtgtccagcaacaccgaggccagcggtcgctttcataccgactggcttaatatgatgtatccccgcttgaagctggccaggcaactattgaaagaagatggggctatttttgtctctattgacgacatagaactgccccggcttaaaattgcgctcgacgagctatttggtgaagataatcttattgcgcaatttgtctggcgctccgacggaaatttcgacaatcaggcaaaggtaaaggtctgtcatgaatatattgtggcatatgccaagtctgcgccgaacttcgcgcaccctcctgttgtcgatccaagcacgcctacggacagcaagatttttcgcccacagattcgaaatacgatagtgaaaaatgggccgaaaaatcctccttcggagattttattgcctgctggttttcctgccgattttgacgatggggtaatcgaagggcgaacagagggttggccgatttataagggcgccgcagttatcagaggcggtcgccttatagcgccagctttagttgaaagtggctggagctccaaggatttgctgcttgaatttgtcgccaatgggtgccttcccatcttcgacggcaaaggccagtcaacctcttttgtcatatccaggacaggagcgattgaggttatcaaagaacgcacggacacaaaaagccatgtcatatctgtactgactggcttcggcggaactcaaaaggctacctctcagctggaagagctaggcgcttttttcaatggctacccaaaacctcttgagttgattcgctacctaaccaagatggttccagggaacgatggaatcttcttggatttcttcgcgggttcagcgccacttggacatgtaatctatgagcaaaatgcggaagatgaaggtacgcggcgatttgtattagttcagttgcccgagcagctcagcccagattcagatgttcaaaaggccgctgtcgcatactgcgacaaattgggcaagccaaggacggtggccgaattgaccaaagaacgtttgcgccgcgcggcaaagaagttttcagctaataagggagaggcaactggggacaacggttttcgcgtcttcaagttggacacttcaaacgtgaaggggtggacaactcaagtccccgacctaaatcaagcgctactggagcaccaagagcacctgttgccgaacagaaccgagcaggacctgctctacgaactcctgctcaagctcggcctcgacctctgcgtccccatccagcagcagatgatcgccagcaagtccgtccacgcggtgggcgccggtgtgctgctggcctgcctggccgagggcataaccgctgccgaggtggagacgctggctgaaggcatcgtacagtggcaccagcaactcgcgccggtcggcgacaccacgtgcgtattccgcgatagcgctttcgcggacgatgtggcgaagaccaacatggcagccatcttgcagcagcatggcatccagaatgtgcggagcctctaa

SEQ ID NO: 311 - DNA, 1833 bp, Clostridium thermocellum ATCC 27405
atgatagaaacaactcttacgggaaaaaccccggacataggggaagaaaatatcaagaagttaatgaccatgtttcctgaagttgttacagagggaaaggtagattttgaaaagctgaagcaacttttaggtgaatatgtagatgatagtaacgaacgctataatttcacctggaacggtaaagggcgagccttgcgtttatcccaaacaccttcactgggaacgttaagaccatgtaaagaagaaagtaaaaactgggatacaacccagaacctttacatagaaggcgataacctagaggtattgaagcttttgcaaaagagctactatggcaagattaaaatgatttacatagacccgccttacaacacggggaaagactttgtatatagggatgatttccatgatagtcttgaaaactataagagaattacagggcaagtagatggcaatggcaaagcaataagcacaaatactgaaaccagtggtcgataccacaccgactggctgaatatgatgtacccaaggcttaggcttgcaaggaatttactttcagatgatggtgttatttttattagtattgatgataatgaggtagataacttaaagaagatttgtaatgagatttttggagaagataattttattgctaactgtgtaaggaaacgccgggatagtcaagctaatttatctcagaatatctccccaatccatgagtatgtgcttatctacgcaaagcgatttggtaatatccttaacaaagttacaccttccctggatatgggaagttataagaatccagataatgatccccgtggtccatacacaacaatgccttgtacgaatgttggaggagcggtttattctatagttacaccaacaggcaaaacaataaccgatgaatggcgctttaagaaagaaacatttgagaaattgctgttagataatagaattgtttttccacgtaatggagaaggaaaaccacgctataagatatttttatcagaaaaaatggctgaaggagttttagcaaatacatggttagacaaaatcgcctcaaatcaagaaggaacacgtgaaataaaggaactgtttgggggattgttatttaacaatcctaagccaacaggtttgttgaagtttttattagagttgggatcaagcaaagattctataatcctcgacttcttctctggatctgccactacagcccacgccgtaatgcagcttaatgctgaagatggtggcaaccgtagatttattatggtacagctcccagagccaacggatgaaaatagcgaagcttataaggccggatatatgaatatttctgagataggcaaagagcgtatccgccgtgcaggagaaaaaatcaaagaggaatataaagataaagggaatatagaaaaccttgatatcggctttaaggtgttcaagctcgatacttcaaatatcagaaaatggcagccggattatgataatttagagcaatctttaatggattatgtagataactttgtggaaggcaggacggaacttgatgttgtttatgagataatgctcaaatacggtcttgacctgacttatccagttgatgagtttacaattgccggtaagaaagtctattctattggctatggcatgctgatgatttgccttgataatgaaattacaacagaggttgctaagggtattttgacaaaaataaaagaattatcacctgaaagcagcagagttgtatttaaggataatggatttaagacagacagtaacaagaccaatatcaaggaaatacttaaatccggcggaattgaagaatttataactatatag

SEQ ID NO: 312 - DNA, 1986 bp, Delftia acidovorans SPH-1
atggaaaaactcacggcagccagccccgaagcccagtccgccgacttggtggcggcaaatatcgaacagctcaaggccctgttcccggaattgattaccgaaggcgcggacggcgtggcggtgaatgtggacgtgctcaaggcgttggtgggtgatgccagcgtgaccgacgccgatgagaagtacggcctcaactggcacggcaaacgccgcgcgcggcaactggcgctgacgcccagcaccggcaccttgcgcccctgcccggaagacagcgtggactgggagaccacccagaacctgatgatcgagggcgacaaccttgaagtgctcaagctgctgcaaaagagctatgccggcaaggttaagctgatttatatcgacccgccgtacaacaccggcaaggattttgtgtacccggacaattttcaggacaacatcaagaactatctggaactgaccggacaggtagaaggtgggcagagaattagcagcaataccgaggccagcgggcggtttcataccgactggctgaatatgatgtatccacgacttaagctggcaaaaaatcttcttctcgatagtggattaataattatctccattgactcttctgaagccactaacttgcggctaattatggacgaagtttttggtcaagagaacttcatcggcttactgccgactatcatgaatctgaaaggcaataacgatgccttcgctttcgcggatactcatgaatttacagttgtttatgctcggaataaagaaaaatgtgtggtttttcaacttccagtgtcagaggaatcgctagatgattggctggaagatgagcgtggcctctacaagcgcgctgacactttaaggcggacagggcaggatgcatcgagggagcgccgtcctaacgggtggtttccagtctttattgacgaaaagggtgaagtctacgcgacgcttgatgatgagcctcgctcaggttcagatttaactctatggccagtttcagaggcaggcgaagagctctcttggacgtggagcaaaaagaaaataaacgatgaaaactttaacttgattgttgttgaaggtaggtcaggaaagaatatctacaaaaaacaacgagccactctcggcgacctcccaaccagcaagcccaaatcgattctctacaagcctgagtacagtagtagtaatggaacggccgaaatttcatcgttgctgggaagcaatgtgttcgatagccctccaaaacctcgctcattaattcgtgactttgtaacaattggtacgtctcctcaggacatcattcttgatttctttgctggaactggaacaactggtcatgcagtaatggcacagaatttcttagatgaaggaaaccgtagatttattcttgttcaactcccccagtatctcgatccggaggataaggggcagaaaaatgcagccgaattctgcgaccagatcaccaagcctcgttctatcgcagaactcactaaagagcgcttacgccgcgcaggcaccaagattaaggctgaaagctctggctggcagggcgacaccggcttccgcgtcttcaagctcgacacctccaatatccgcgtctggaatcccaaaccagacgatctggaagccacactattcgaccatcaggatcatctgctcgaaggtcgcagcgaggctgatgtgctttacgaactgctgctcaagttggggctggatctgtgtgtgcccatcgaacagcgcaatatcgaaggccttcacgtccatgccattggcggcggcgtgctgctggcgtgcctggctgagaccatcacccgcgaacaggtagagccgctcgcccagggcatcatcggctggcacaaggcgttggcccctgccggtgacaccacctgcgtgttccgcgacagcgcctttgccgatgacgtggccaaaaccaatctcgcagccattctggagcaacacggcatccagaacgtgcgcagcttgtaa

SEQ ID NO: 313 - DNA, 1914 bp, Natranaerobius thermophilus JW NM WN LF
atgaaaaaatttaacggtgaaagtaaagacatagtagctgaaaatatttctaaactcaaggaactttttcctgaagtggaaagtgagggtaaaatagattttgaaaggttgcaagaaatattaggggagtatattgaagacaaagaagaaaaatatagattcgaatggaacggtaaatctaaagctattaaattatcacaaacgccttctactggaacacttaggccctgcaaagaagaaagtaaaaattgggatgaaactgaaaatctgtttattgaaggagataatcttgaagtattaaagttgcttcagaagacttatcacagtagtattaagatgatttatatagacccaccttacaatacaggtggagactttgtttatgaagatgattttcaagataacttaaataattatcttaaaataacaggtcaaattaatgaagaaggaaagaaaaatagtactaatacagaaaatggtggaagatttcatactaaatggttgaatatgatgtatccaaggctgaaattagcaagaaacttacttaacgatcaaggagtaatatttatttccattgacgataacgaatcaggtaacctatggaaagtgtgtaatgagatctttggcgagacaaactttgttgctgaaataactgtcatagtaaaaacagaaggacgtaggtatggtttttttgcaaaatcacatgagaaaatctatgtttatgctaagaacattgataacttagctctaaatgagattgatatcaaaggtaaaaaatttacttatagagatgaatttggaggctttaacattaaagaactgagaaatcaaaacactagagcttttaattctagtaacagaccaaatttaagatatccattctatgttaatactgataatgtagatgagaatggatttatggaagtaagtgttgactatcaagaaggatgggaagaggtttatccaatgataaccaatggtttgaaaagtgtttggagatgggggaaggaatctgctaggcagcaagaaaataaaaatttagtagcaagaagaggtcgtgatggtataatccgaatatatcagaaatatcgcaaattaactgaaatacccaaaacagtatggaaagataaggagataatttctattaaaggaacaaaagaggtacaagaattattaggaagtggaatttttgattttcccaagcctgttaagttattgtcagatattattaccatagcaactgatcaagattctattatattagactttttttcaggggccgctactactgctcacgctacaatcaaaaaaaatgctgaagatggtggcacccgaaaatatataatggtgcaactacctgagaagtcagacgaaaaatcagaagcatacaaggctggttataaaaatatttccgagataggcaaagaacgcatacgccgagcaggagaaaaaatccttgatgaaaacaaagataaagaaggtatagaaaacttagatacaggttttaaagtgttcaaattagattcatcaaaccttaaagaatggaaccctgattatgacaacttagaaatgactcttgaagacatggtagagaactttgttgatggaagaactgaagaagatgtggtatatgaaattatgcttaaatatggcattgatttaaccttccctatagaaactaccgagattgatggcaaaaaggtttataatatcggttttggtgctttatttgtttgtttagatgatgaaataacattaaatgttgtaaagagtatagctaaactaaaagaagacattgatccagaaatcacaagagtagtatttaaagacaacggttttcagagtgatgctgctaaaactaatgcaatagaaatacttaaacgacatggtatagaagaaataatgagcatctag

SEQ ID NO: 314 - DNA, 1932 bp, Pelodictyon phaeoclathratiforme BU 1
atgaccgaacacgaagaggcgaccatcaagccgttaaccgcaaatgaccctgaagcccaatccgccgatattctggcgggcaatattgagcagttgaaaacgctcttccctgaagcgtttacggaagggaagattgattttgaggtgctccgccaactgctcggtggcacagtagaagagcgggaggagaagtacgggctcaactggcacggcaaacgtaaagcccggcagcttgcccttaccccatccaccggcaccctgcgcccctgcccggaggagagtgtggattgggagaccacaaaaaatcttatgattgagggcgataaccttgaagtgctcaaactgttgcagaagagctactccggcaaggtgaagctcatctacattgatccaccatacaacaccggcaaggattttgtctaccccgataacttccaggacaacatcaaaaattatctcgaactcactggccagattgagggtggccggaaaatcagcagtaacactgaggccagcggccggtttcataccgactggctcaacatgatgtatccaaggttgaagctggcgaggaatttgctgagagaagatggggtgatttttatcagtattgatgatggtgagcttgataaccttagaaagttatgcgctgaagtttttggtgacgaaaattttgtagttcaaattatatggcgtaaacgaagcactcctccaaacgacaaaattataggagcaaaccatgactacattctctgtttcgcaaaaaacgctatttcagtaaaacttcagcatagagaacgatcggcggatcaaattgcccgatataaaaatcctgacaatcatgccaagggcccatgggccccgggtgatctcatggccaacattaagggaggacgatttgttaaatcattgaacttcccaatagtcaatccacaaacaggagaggagcattttccggggaacaacgggaattggcgattttcaagggagactattgctacccttcttgcgaataatgagatttactttggtgagaatggacgaggaaagccaaagttaaaacgtttcctgtgcgaagtgaaagagggggtaacctacccatcaatttgggattttgttccactcaataccagtggctctaatgaaatgggtgcaatattcggaaatccgaccatcttcgaaagcccaaaaccagttggattaatacaagagctcgtcgctctcggttgtgagcctaatggagttgtattggatttttttgctggttccggtaccactggtcatgctttgatggcccagaatgttattgatggaggaaatagacgctatattcttgttcaacttcccgaacagctatacttggaaaataatgaacaaagggtttccggcgactactgcgatcaaataggcaaacctcgtaccatagtcgaactcacaaaagagcgcctccgccgtgcggcccggaaaatcaaggatgagaacccacttttccccggtgactttggtttccgcgtcttcaagcttgattcaagcaacatcaatacctgggaaccggatcgcgacaaccttgagcttacccttcttaactccattgaacacctaaaaggagatcgcaccgaggcggacattttctatgagttgctcctcaaacttggccttgacctctgtgtccctatcgagaaacggacgtttgcaggcaaagaggttcactccgtcggcggtggtgtgttgcttgtctgccttgctactcatatcacccctgatgaggttgagcctctggctcaaggcattgttgcatggcacaaggagcttgctccggcaggagagacgacctctgttttccgcgatagtgcctttgctgatgatgttgcaaagaccaaccttgcagccattcttcagcagcatggcctcgaaatcataaggagcttgtag

SEQ ID NO: 315 - DNA, 1956 bp, Acidimicrobium ferrooxidans DSM 10331
atgaagaaactgacgcccgccgaccccgaagcccgttccgacgacctggtggcggagaacgtcgccaagctcaaggcgttgttccctgagctcatcaccgagggacccaacggcgcggcggtcaacgttgacgtgctcaagcagctcgtgggtgatgccaccgtcaccgactgcgatgaaaagtacggcctcaactggcacggcaaacgccaggctcgacagctcgcgctcacgccctcgaccgggacgctgcgcccggcgcccgaagacagcgtggactgggacaccacgcagaacctcgtgattgaaggcgacaacctcgaagtgctcaagctcctgcaaaagagctacgcgggcaaggtgaagctcatctacatcgacccgccgtacaacacggggaaggacttcgtgtatccggacaacttccaggacagcatcaagaactacctcgagctgacggggcaggtggagggcgggcggaagatcagcagcaacaccgaagccagcgggcggtttcataccgactggttgaacatgatgtatccgaggctgaagctggcgaggaacctattgcgggaagatggagtgctctttatcagcattgacgatggggaaatcggacacctccgcactctgtgtgacgaagtgttcggtgcggaaaacttctgcggcgttatcaagcgtcgcgcggcaaggaagaccgctttcctgaggaagcgaatgaccgacatgtgcgattacgttgtcgcatacgttcgctcagatgccgccgccccacttagtgcgggtcaagtatccgatgggacacgccccgtgttcaacgaaggcaacacagtaagcgtgcgagtgctacgttccggtgctattgccaagtgtggcgatggaacgtacaatgcgggcacctacgcggcccgcagcctctcgtttgaattgcttgacgaccttaaggttacggatgggagagtcgcgagggatgtgcgcatcaggggtccgtggagaatcaatcaagaaacccttgataggacgctctttgtaacgcgcaacttagggctccgtcgaacaatgctccctgaggagctagatcaagcaaagttactgaacgaccttcttgacgataatacgtgctacaacgaaaaggggtctgaagagcttcagcaacttttcgaggcaacggtcttcaacaatccaaagccgcgggggttaatcgagtacttggcatcagcagctggggtgaaggagaaagaacttgtcctggatttcttcgccggctccggaaccaccggccatgcggtcatggcacagaacgccgccgacggcggcaaccgtcgctatatccttgtccaactcccggagcctgtcgacccagagaacaaggaacagaaggtcgccgcagacttctgcgacaagctcggaaagccgcgcaacatcgctgagctgaccaaggaacgtctccgccgtgccgccaggaagatccaggatgagaacccgcagtttgcgggcgacctcggttttcgcgtgttcaagctggacacatccaacatccgcgcctggaaccccaagcctgatgaccttgaggcggagctgtttgcgcaccaggatcacattgtcgaaggccgcagcgaggcggacatcctttacgaactgctgctcaagcttggcctcgatctgtgcgtgccgatacaggagaaagaagtcaagagtcaggggacagaagggaagaaatacacggtttatgccgtaggctatggcgtgctgatcgcttgcctgtccgaggagattgcggtcgacgacgtggaggcgcttggccagggcatcgtcgggtggcgcaaggaactcgccccggcgggcgagaccacctgcgtcttccgggacagcgcctttgccgacgacgaggccaagacgaacctcgccgccatcctcaaccagaacggcatcgctaacgtgcggagcttgtga

SEQ ID NO: 316 - DNA, 1194 bp, Maricaulis maris MCS10
atgctcgctgtcgttgactgcgtcggccacggatcgaaccagcatgaagtcacggctacgggtgaccttttcgagatgcttggggatcagccacgtaagttggtgcgcggcagttcagacgagcgctttgatgccatctacgtccatgtaaccgaaacagacgatgtgatcgccgacacaggcaagctgtcctggtacgactcaagagccaatcagccgcaccgcggcccagagtggcggctctactaccaagcgaacgatattacacgagcaatgaagccgggggaccagcttttcattgtagtgctgcctgaccggacaatcgggttcttggcgtgcgacagggacagttcttttcaaggtctggtcgaggctatattcagggttcagcattcgaaatccgaacaaatggttattattccggtcagcccggacacatcctcaccagcagattatttcaccttccagctactcgacgcgctcggcatcgagcctgacatccctcctgatttcgatgctgcttctgttgtcgcgcaattcaagggcacctttccgccaaccgcgacattctcgacattggcacgcgaaacactgcccggcctcgaccctcgcgatgacccggacaaggtgttgctggcctggatcgatcgcgaagaagcgatgttccgggcgttggaacgcgggattgtcggcgatcgcctgatgttgggctttctggattcccgaggagagcccgatgtcgacgcattcctgaagttctcgctatcagttcaaaaccgcaggaagtcgcgcgccggacacgcgctgatgaatcacttcagtaaaatcctacgcgcgttcgaaattcctttcacgcccgaagcaaccacggagaagaagggcgctgccgacttcctgtttccgagcgaagccgcatacgccgatccaggttttccttcggcaaacttgcggatggttgccgccaagacctcctgcaaggatcgctggcggcaagttttggcggaagcggatcggatcaaaccgaaacacctcctgaccctgcagccgaaaatctctttggcccagaccaccgaaatgacggatcagggcatcattctcaccctgccatctccaatccattcatcgttccaggatgatcagcgggccagcctgctgacggtagcggaccttctgcaggaactcgcttcactctga

SEQ ID NO: 317 - DNA, 1236 bp, Halorhodospira halophila SL1
gtgatcgactcgatttcggaacttttcgaaggggcggcggcgaaatggctcagcgccgtagacgccgaaccggacagatcgaaccagcatgagatcggaggcctgccaagcgccggattcaggagccatctcggcgaaccctcgaagaacgatgtcgcccggtttccagccacaatggcttaccttggggaccatgagcctccggaaatcgtccgcgataccgtgtcttggtacgactgccggtggaaacaggcgcaccgctccccagagtaccggctctattaccgcagcaattcggtaacgctgcggctcagtgccggtgatctgatggtgatcgcgaaggcccgtgacggtagtctgctcatcgttttcgcgccggcggagtcggatgtcgaggcccaggtacgccaagtgttcgggttcggcgagatggggcagcgcttccaggccgccagaatgcctccatcctctcttacgctgccactgaaactgctgctggaagacgtcggcgtagaagccttcgaaccggacgatgcggcggacgatctcgaacttgtcctgaaccgtttcccagagcgttttccctcgaccgcagaattctccgcgcttgcgcgtgaggtcactcagggcgatcccgtaggcgagccggatcggacactcttggcatggatggaacgggaggaagcgctcttccgggcctatgagcgcgagatcgttcaggaacgcctcgaacgggggttcgccggcgatgtcgacgaattcataaggttctcactaagcgtccacaatcggcggaaatcccgggtcggtcatgccttcgagaaccatctgactgaactgtttgagcggcacggcctgcgtttcgaaaaagggggggtgaaccgggtcacggagaacaaatcaaaacctgacttcctgtttcccggcttcaccgagtatcacgatccgcagtttccgaattcccgcctgttcctccttggtgcaaagaccacctgcaaggaacgatggcggcaggtcctcgccgagggcgaacgactcaaacggaaacacctcgcgacgctcgagcctgggataagtcgtacccacaccgacgaaatgtcggcgcacggcctccagcttgtggtgccactacccatccatgcgacatattcggaaacacagcgtatgaaaatcatgggaatccaggattttatcagccatgtcaggcccaaggtattcaagactcggccaggctga

SEQ ID NO: 318 - DNA, 1236 bp, Rhodobacter sphaeroides ATCC 17029
atgcgttacggctctctctcggatcatttcaccgggatcgtcgccaagcgcctttcaacggtcgaggcggatacggcgcggtcgaatcagcacgagttcaatggtacgaacgagctgcgccggctgctgggcggcgagcgcatcgagcgcaggccgtcgcgcttcatctggctcggcggcgagaacgaggggattaccgacgacgcgccagtcacatggtacgacgctcgggagcgccatccgacgcgatcggaatggcggctctatttccaagcaaacgccgtgaccgaggtcgcgcaggccggtgaccttctggtcgtggcccgccgcccgagcggcgatctgatgttcattgtcgcaccgcagagttccactctcgagaaccagatcgcctggctcttcgggctggatcacggacttggcgccggcttccgctacgagggtttcgagggagccggcgatcgcggcctcgacttcgtcagcaattatgttcttgaagagatcggcatcgagcccgaggtgccggaggccgatcggctggatgaaatcgtcggccggttcggggcgcagttccccagctcgcggacattctccgcgctggcccggcagaacctgcccgaagtcgatccacgcgacgatgccgatgcagctctgctcgcatggatcgagttcgaggaggcccttttccggcgcttggagcgccatatcgttgccgcgcgcttggaggttggcttcctcacggatggcacggccgatgtcgacggctttctgcagttctcactgtcggtacagaaccgcagaaaaagccgcatgggcctgtcgctcgagaaccatgtcgaggagatgttgacggtactgggcctcagatacgcacggggagcgcggaccgaggggaattcgaagccggatttcctgttccccggcgtcgccgagtacgccgatccgggctacagcgctgaccgcctgtccatgctgggagtgaagtccacgctcaaggatcgctggcgccaggtgcttgcagaagccgcacgcatcgaccgcaagcacctgctgacgctggagcccggcatctccacccaccagacgaacgagatgatccgtcactccctgcagctcgtcgtgccacggggcctgcatacgacctacacaccggaacaggctgggtggctcatgaccgttcgcggtttcctcaatctggtggcagcacgggaagctgcacgaccctatcgcgaatga

SEQ ID NO: 319 - DNA, 1239 bp, Acidiphilium cryptum JF-5
atggcgctgactgatcttgtgggctggatggacgagtacggcgtccccggcgctgtctggttcgccaagcggctggcagccaacgataccctggcaaccggagcccatggagcggggccctatattccaaaggagttcctgttcagcgttttcccggacctcaaccacccagaggaggagaatccggactgctggttcgacctgtacatcgactctcacgcggaccgccggaggatccgggcgatctggtacaacaacaggcttcgtggagggacgaggaacgaagcccgactgacgaatttcggcggtggccggtcagcacttctggatccggacagtaccggtgccctggccgtgtttgccttcctccctcacgggccgggcaggcagatggaatgtcatgtctgggtctgcgatcagggggcggaggcagatcttcttgaagagcgcattggtccggtagagccgaaggctcctgtggtctggcagccgggcgaaatcgcccgcgacctgttcatgcacacggatgcaggaccggggtcgtgccggctcctgcccggtgaaattcctcctgcctggctgaccaggttcccgacgggcgaggaaattatcagggagacggtcaaacgacgccagcgaaacggtctggagcccgaccggcttctcatgcgccgccgtgaatgcgaatttgagatatttctcagcgtcgaggaggccgtctatctcccacgtatcaggcaaggcttctccgcgatcggcgattttctctcgcttgcccagacaatcctgcagagccggaagacccgttcaggcacttcgctggaactgcatgtccgcgagatcatgaccgaggaaggtctgctggctgatacctccttcacctaccggccagtaatcgagaacggcaagcggccggatttcctgttcccgtccaaggccgcctacgacaatccggcgtttccggcagagcggttgcgcatgctggccgcgaaaacgacctgcaaggaccgctggcggcaggtgctcaacgaggccgacaggatcgcaaccaagcacctcctcaccctccaggaaggggtttcggaggggcagttccgggaaatgagcgaggccggcgtccgtctggtggtgcctgctgaactccaccgttcctatccggcgagtgtccggccgcatcttgtcacgttcgagaacttcattggtgacgtgagaccgctgtccgccattcaggggccatag

SEQ ID NO: 320 - DNA, 1215 bp, Serratia proteamaculans 568
gtgtctgattttcaaaattggttaacggaaaaatcatcggataattggtacatacatatcaaaaggctctcggcaaatgataccggagctagtggtggccatcaatctggtgtttatcttcctaataattcagcaaattttcttttcccgtcaattaaccgaattgatgaagaaaatccatcagtaggtcttacagcaaaaataatttcccatgaagtcaatgactctcaggtaagagctgtatattacaacagtaaactaagaaaccttaacccaaagggccgtaatgaaactcgtattacctgctggggtggacaaaaaagcccggtacagaaccaaaataataccggtgctatagctatatttgctttctatacgcctgaaaacttgaaagactgtggccttgttgaagcatgggtatgctgtactgttgaagaagaagatttactcgaagcaattattggcgaagtgcttcctgggacggcgcgatctggtccatcagctcagatattaggcggtttcgctattgatgatagtgattggaaatctcataattactcaatacctgacccatggaaagtaacgttccctagtggtagtgatattatcgagtatcttccaaatatctttaaattcaaaggtgacactccagataaattgttactagaacgacgcgagaaagagtattcattgttccggcaaattgaagaaattcatgttctagataaaataaagaaaggtttcaattctgtagaagaattcattgaacttgcgaattcagttagtaatcgtcgaaaatcccgttcaggaaaatcacttgagatgcatcttgagaaaatatttcttgcgaatggacttacaacgtttactacgcaaagtattactgagggtaaaaaaaagcctgattttcttttcccatccggaattgaatatcataacccagcataccccgcagaaaatctaaggatgttagcagttaaaacaacctgtaaggatcggtggagacaggcgattaatgaagcaaacaggattaacaatatacacttatttactctacaagaaggtgtttctgccaatcaatttcaagaaatgaaagatgccggagttacacttgttgttcctgagcctttgcacaaaaaataccctgaaaaaatcagaagtgaattagtttcattgagtgatttcattagcgagactttagccatatatacataa

SEQ ID NO: 321 - DNA, 1395 bp, Pseudomonas putida GB 1
atggcaaagatgaaacactcgacggcttttgtacccgatctcttcactgaaccagaggccgaggcctcggattttctgacttccctcctggacaagagcgattcgctctatgtcaagaagctgtcagtgaacgatcgggactgggctcgtttgtcgaacaagcgtcaggctggaatttacgtgccttcgaccgagagggacggaaacttctttccgccgctggcgacaaaggagcgcgacaaggctgaggctgctgagattcgcgaaacctattttgagatcgaatggcctaccgtcgggcaagtaaagcgggctaggcttgtccactacacgagcaagggggaggagactcatctcaccggtctaccgaagccaccgtttcgcgacgctcctcctgcctctttactcgttgtagggaagagcggcggacggtacaaggctttggtcgtcgactctgagagcgatgaatatgaagtcgtccacgacgttctttctctgcctcccgacttccactcggaaatattcatcacgaccgtggtccgacgggagcgggaggagaagaccgtctcgttcatcgaagaagtcgttagggcatttttcgatggaaccttccctgaactcgcttctcgatacggcgcgatgccgacgacctcggaattggctgccgctgctcgtaatcgttatctgggtgagaacaggttgaggagcttggatccatatgccatgtgcaagcccggcgacgctctgcgggctatcagtcgtggactcgaatacgaaattttcaaggactatcagatcaaagctaggtccatcgatttggctcggatgattctaggggatgatcctagtaaggcgagcctcgaaagagtcctgcgggccgtcgtgctcgacttccctaagatcgacgctctgttgctctctgctgcacagcagaggaagtcccgcgccggctattccttcgagcatcacatcgacgcgatgttggcagacgccggggtcccgtttgagaagcaggttgtgctcgaagctaggaagcgtccagactttatcctaccgagtaaggctatgtacgagagctctactcgccagcactgcgaggcacttgttctaagcgcgaagactactcttcgcgagcgatggaaacaggtcaaaggggagatgagagactgcgatctctacctcgccactgtggatgagagtatagctgtgaacgcgatcaaagatatggcctctcagggcatcagactcgttgtccccgagagcctgaagagctcagataccactgaatacaaagctcaggacagtgtgctctcattcaaggactttttcgaaaatgacatcgctgcgagaagaaagctctggattgccaacggcatcttcgcgaccggggtgtga

SEQ ID NO: 322 - DNA, 1212 bp, Geobacter lovleyi SZ
atgaatcacggtcatctttcgcagtatttttcagcagtcgcctgtaagcctttatccgcagtagaagcagacttgtgccgaagtcaccagcacgaattgaacggagttgaagccctgattaagatgtttggccgtgcaacggaaaagcatacttttcaggcttcctttatgtatctgtgcgaccatgacgatgagccggttgtggcagacggctatgtcacttggtatgattcacgactcaaaaatacgactcgcactgaacacaggctttattttccgacaactgcagtatccatgtgcgctgccgaaggtgatcttcttattattggcaagagaaccgacaattccgtaatgattattattgcggaagccgagtcaactattgctagtcaggtatcgtggttattcgggttcggggttgatgttcatccgggattttcagttcggagcgaactggaatgcgaacagaacagaattgaatttgcgtcccgtattatccttgaacatattggtgttcaagtcgaagaggttgcggaaaactatcttgacgaaatgcttcgcctgtttggtggcaaattccccaacaccagagacttttcagaatatgcacgcgcttctttgattgatattgacccgcgtgatggtgcagacgccgcacttatggcattcgtggaaagggaggaaattcttttccgtactcttgaacgccatataataggcgaccggttacaggtaggctttgtcgatgatgttgacggattcgttacttattcactctcggtacagaatcggcgtaaaagtcgggccggatcttcccttgaaaatcatctggaagtaatttttaatgcacaaggcatccagtacaccagaacgccagttactgaaaacaatgaaaagcctgatttcattttccctgacataatccactaccgagatccggattttgacgtgtcaaaacttaccatgcttggagttaaaagcacttgtaaagaccgttggcgtcagattctttctgaagccgatcgaattaagtctaaacacctgcttacccttgaaccaggtataagtgagaaccagacaaaccagatgaaaagaagcaaccttcaacttgttgtaccatctgcattgcagagaacttacaaaactgaacagcagacgtggctattgacgtttgacgactttatccggctattgagaatacgacaatcatag

SEQ ID NO: 323 - DNA, 1539 bp, Pseudomonas syringae pv B728a
atgatcttgcacacgaatgactaccttgagtattacctgacgttggtcggatggctcataaacggcggcatctggaacatgatcgaggacagcggactcttcgcagcgccctttgccgccattgtcatcagcgaatggctcagagcccgcggtgagggagctgatgagggcaacaagggcgtcctctcgttggcccgagtagaaaaccggttctacacggcaatcctagtcatcatcctggcttgcatgcctctggtaaacgtcagcattgataccatccagttcgaccgaagccgctcagagcaatgccaatactcaatacccaatccgactgatacaggctgggaaacatccttcagtacgctgaacggtaaaagcgccacagtgcccgtctggtggctgtttgtgcatgcgatgtccaaggcagcaactgcggcctcagtcgcagctattccctgtggagtggatttgcaacaggtccggatggacgtcaacaaggcccgcatcaacgatccgctgcttgcccaggaggtcgctgacttcacgaacgattgctacgcacgtgcgcgcgcaaagctgttcatgacccagcctaccctcagcaatgatcaactcaacgacgtcaactggatcggttcacacttcttcctgcaaacatccggctattacagcgatggtttctctgggttcaggtcacacactccccgaaccaaatggccctatgacgcaacccgggacgcgggcctgccacaaaccactggtggtggtgggtttcctacatgcactcaatggtggtcggatggaagcgtcgggctcagagccaggctgctggaacaggtcagtccagatctgctgagcaagcttgctcagtgggcaaaattcatgacccagaccgaagtgagcgactcggtcattcgcgatctggtctctcctaggaagcagcaactgacccagggtcaggtttattcagactatggcggtcaagtcggtggctctgtgctaaatgactttacacgcattgcagctacagctggtcaggcggcaggatctcttgtgatgtatccagccatggacagtgtaaggcaagcagcgcccatggtgatggccttcctaaagatggctctcatcatttgcattccgtttgtactggtgatcgggatgtttgatctgaaggtcgtgatgacgattacttttgctgcgttcgctttgatctttgtcgacttctggttccagttggcccgctgggtagatagcacgattctcgatgccctttatggtaacgggatcggcagcaatgtcccccactccaatttcgacccagtgttcggggccagcaatgcccaaggagacttactgctggactttgtgatgggcgcaatgtttatagcgcttccgggattttgggtagtggcgctgggctggagtgggatgcaacttggttcactcatgacagggcttaccatcggcaccaacggggctaaagatgcaggaggtaaaggcgctgatgtagcaatgggaatcgcgaaggggaggatttaa

SEQ ID NO: 324 - DNA, 1518 bp, Burkholderia xenovorans LB400
atgacgcttttcacgaccgactacctggagtactacctcaccctcgtgtcctggatcgtcaacaacggcatctgggccgtgctggtgtccagcggggtgtttgcgctgccctttgtggcgatcgtcatccaggaatggctcaaggccagagcggagggcgccgacgaaggcaacaagggcgtgctctcggcggcgcgcatcgagaaccgagtatttgtggccatcgtggtcgtgatgttcgccggcattccgttcatcgacgtcgacctcagcactatccagtacgacagctcgcgctcggcgcagtgccaggtcagcgtgccacagcctgcgcaaactggctggtcgcagtccttcagcaccatcaacaaccagtcggcgaaggttccggtctggtgggcgttcatgcacgcgctttcgcgcgccgtcacgagcgcttcggtggctgcgatcccgtgcggcacagatctgaggcagatgcgtatggagatcgatgcgacccgtatcgacgacccggtgctggctcaggaagtggcggatttctctcgggactgctatggaccggcgcgcgccaagctgttcatgcagcgcccggatctcgatgagcagcagatgcacgacgtgacctggatcggctcgcgctttttcacggacacaggtggctactacgacagctaccgctccagtacggcgcgagaggcatggccctatgacgacacccgcgatgctgggctcgcgcaggttaccaatggtggcggctacccgacctgcaagcagtggtggtccgacggcagtaacggactgcgcgcgcggctgctggggcaagtggacccgagcctgctgaatcgcctggcgggctgggctggattcctgagccgggccgaggtggacgactccgtgatccgcgccatcgcgtcaccgcggcagcagaaattgaaccaaggcagcgtctatacggactacggcggtcagatcgacaagacgttgcccaatgtcgtcaaccgtgccaccagcgatgttggcttggcggttggggctctcgccgccttcccggcaatggacgtagtgcgccaagcactgcccatggtgctcgcgctgctcaagatggcgctcgtgatctgcattccgctagtgctggtcgttggcacctatgacctgaagatggtcgtcaccgtcagcaccgtccagttcgcgctgttcttcacggacttctggtttcagctcgcacgctggatcgacagcaccatcctcgatgcgctctacgggtggggctttggctggaaccggccgcataccaacttcgacccgctggtggggctgaacaatgccttcggcgacatgcttttgatgttcgtcaccggcacgatgttcttggtcctgccgactttctgggtggcagctcttgggtgggtcggagtaaaagccggggtaatcgctcagaacctggctgtcggttccaaggaagcacgcgatagcgcgggatcaggcgtgaacaaggttaccggcaaggtgctttga

SEQ ID NO: 325 - DNA, 1548 bp, Cupriavidus metallidurans CH34 uid250
atgactctgttcacgaccgactacctggagtattaccttacgctggtgtcctggatcgtcaacaacggcatctgggccgtgctggtatccagcggcgtcttcgcgctgcctttcgtggcgatcatcgtgcaggagtggttgaaggcccgtgcagaaggcgccgacgagggcaataaaggcgtgctgagcgccgcccgcatcgagaaccgggtcttcgtcgccatcgtggtggtgatgttcgcgggcatcccgttcatcgacgtggacctcaacaccatccagtacgacagctcgcgctcggcgcaatgccaggtcagtgtgccgcagccctcgaataccggctggtcgcaatctttcagcaccatcaacaaccagtcggcgaaggtgccggtgtggtgggcgttcatgcacgcgctctcgcgcgccgtcacgggcgcttcagtggcagcgatcccgtgcggcacggacctgcggcagatgcgcatggagatcgacgcgactcgcattgacgacccagtgttggctcaggaagtagcggatttctcgcgggattgctatggggctgcgcgggcgaaattgttcatgcagcggcctcaactcgatgagcagcagctgcacgacgtaacctggatcggctcacgcttcttcacggacacgaacggctactacgacacataccgttccagcaccccgcgcgaggactggccctatgacagcacgcgcgacgcagggcttgcgcaggtggccagcggcggcggctatccgacctgcaggcaatggtgggccgatggcagcaatggactgcgggcacgcttgctgggtcaggtggacccgagcctgctcaatcgcctggcgggctgggctggcttcctgagccgtgccgaggtggacgattcggtgatccgcgcgatcgcgtcaccgcgacagcagaagctgaaccaaggcagcgtctatacggactacggtggccagatcgaaatgaccgacccaaacatcatcacccgggcggcggccgacgtaggactggcggtaggctcgctgggctacttcccctccatggatgcaatgcgccaggctcttccgatggtgctggcgctcttgaagatggcgctggttgtctgcattccggtggtgctcatggttagcacctacaacctgaaaacactcgtgacggtcagcgtggtgcagtttgcgctgttcttcgtggatttctggttccaactcgcgcgctggatcgacagcaccattctggacgcgctctacggatggggctggggatggaaccggccgcatacgaatttcgatccggtcatgggcctcaacaatgccttcggagacatgctgttgaatttcgtcatggcgacgatgttcatcgtgctgcccttgttctgggtaaccgccttgggatgggcgggctacgccgtggggggcatgttgcaagggcttgctgctggtacggcaggcgccaaagcggccggcggcaaagccgccgacatggcctttggcggcgctatgaagtgggcatcgacacccagcaagaggaagtag

SEQ ID NO: 326 - DNA, 1518 bp, Acidovorax sp. JS42
atgacgcttttcacgaccgactacctggagtactacctgacgctggtgtcctggatcgtcaacaacggcatctgggcggtgctggtatccagcggggtattcgcgctgcctttcgtcgccatcatcgtgcaggagtggttgaaggcccgtgcggaaggtgccgacgagggcaataaaggcgtgctgagcgccgcccgcatcgagaaccgggtcttcgtcgccatcgtggtggtgatgttcgccggcattccgttcatcgacgtggacctgaacaccatccagtacgacagctcgcgctcggcccagtgccaggtcagcgtgccgcagcccacggataccggctggtcgcagtccttcagcaccatcaacaaccagtcggcgaaggtgcccgtctggtgggcgttcatgcatgcactctcgcgcgccgtcacgagcgcctcggtggcggcgatcccgtgtggcacggacctgcggcagatgcgcatggagatcgacgccacgcgcatcgatgacccggtgctggctcaggaagtagcggatttctcgcgggattgctatgggcctgcacgggccaaattgttcatgcagcgccctcagctcgatgagcagcagatgcacgacgtgacctggatcggatcgcggttcttcaccgacacgaacggctactacgacacgtaccgttccagcacgccgcgcgatgactggccctatgacagcaaccgcgacgccgggctggctcaggtatccagtggcggtggctacccgacctgcaggcaatggtgggctgatggcagcaatggcctgcgggcacgcctgctgggacaggtggacccgagcctgctcaatcggctggcgggctgggccgggttcctgagccgggccgaggtggacgactcggtgatccgcaccatcgcgtcgccgaggcagcagaagttgaaccagggcagcgtctatacggactacggcggccagatcgacaagaccttgccgaacatcgtgacgcgggccacgggagacgttgggatggcagtcggcgcgcttgcggcatttcccgccatggacgttgtgagacaggccctgcccatggtgctcgccttgctcaagatggcgctggtcatctgcatcccgctcgtgctggttgtgggcacctatgacctgaagacggtcgtcacggtcagcgtcgtgcagttcgcgctgttcttcacggacttctggtttcagcttgcgcgctggatcgattcgacgatcctggacgcactttatggctgggggttcggctggaaccggccgcacaccaatttcgacccgttggtaggactgaacaacgccttcggtgacatgctcctgatgttcgtcacgggcacgatgtttctggtcctgccgacgttttgggtcgctgccttggggtgggtcggagttaaggctggggtgattgctcagaaccttgctgtcggctccaaggaagcgcgtgatagcgccgggtcaggtgcaaacaaggtagccggcaaggttctgtga

SEQ ID NO: 327 - DNA, 1524 bp, Acidovorax sp. JS42
atgacgcttttcacgaccgactacctggagtactacctcaccctcgtgtcctggatcgtcaacaacggcatctgggccgtactggtgtccagcggtgtgttcgcgctgccgttcgtcgccatcgtcgtgcaggaatggctgaaggcccgcgcagaaggcgctgacgaaggtaacaagggtgtgctctcggccgcgcgcatcgagaaccgggtcttcgtcgccatcgtggtggtgatgttcgccggcattccgttcatcgacgtggacctgaacaccatccagtacgacagctcgcgctcggcccagtgccaggtcagcgtgccgcagcccgcggagaccggctggtcgcagtctttcagcaccatcaacaaccagtcggcgaaggtgccggtctggtgggccttcatgcacgcgctttcgcgtgccgtcacgagcgcctcggtggctgcgatcccgtgcggcactgacctgcggcagatgcggatggagatcgacgcgacccgtatcgacgacccggtgctggcccaggaagtagcggatttctcgcgggattgctatgggcctgcacgggccaaattgttcatgcagcgccctcagctcgatgagcagcagatgcacgacgtgacctggatcggatcgcggttcttcacggacacgggtggctactacgacagttaccgctccagcacggcgcgcgaagcatggccctatgacgacacccgcgatgcggggctcgcgcaggtagccaatggcggcggctacccgacttgcaggcagtggtggtcagacggcagcaacggcctgcgcgcgcggctgctggggcaagtggacccgagcctgctgaatcgcctggcgggctgggccgggttcctgagccgggccgaggtggacgattcggtgatccgcgccatcgcgtcaccgcggcagcagaaattgaaccagggcagcgtctatacggactacggcggtcagatcgacaagtccttaccgaacatcgtcacccgtgccgcgggcgatgtggggatgacagtcggggcgatcgccgcattccccgccatggatgtagtacgccaggccgtaccgatggtgctcgccctgctcaagatggcgctggtcatctgcatcccgctcgtgctgctcgtgggcacctacgacctcaagacagtcgttaccgtcagcgtcgtgcagttcgcgctgttcttcacggatttctggttccaactcgcccgctggatcgacagcaccatcctcgatgcgctctatgggtggggcttcgggtggaaccggccgcataccaacttcgatccgctggtggggctgaacaacgccttcggcgacatgctcatgatgttcgtcatgggcacgatgttcatcgtgctgcctacgttctggatcatggcgctggcttgggcgggcgttcgcgccggcaacgtcctgcaaggcctcgccggggcgaccgctgatgccaaggccgccggcgggaaaggcggaagtatcgcgatcaatgcagtggcgaagaagtga

SEQ ID NO: 328 - DNA, 1524 bp, Acidovorax sp. JS42
atgacgctctacaccacggactacttggagtattacctgaccctggtggcttgggtggtcaacaacggcatctggagcatcctcgtggccagcggcgtgttcgcgctgccgttcgtggccatcgtgatccaggaatggctcaaggcccgcagcgaaggtgcggacgagggcaacaagggcgtgctgtcgtcgatgcgcatcgagaaccgggtgtgggtggcgatcgtggtcatcatgttcgccggcatcccgttcatcccggtggatctcgccacgatcaggttcgacaccacgcgctccgcgcaatgccaggtcagtgtcccgctgcccaacgacacgggctggtccaacgtctacacggcgctcaacgaccagagcgcgctggtgccggtgtggtggttcttcatgcacgcgctgtcgaaagccgtgacgggctccgcggtggcggcgattccctgcggcacggacctgcgtcagattcgcatggatgtggatgccacgcgcatcgacgatccggtgctggcacaggaggtcgccgacttcacgcacgactgctacgggccgtcgcgcgccaagctgttcatgaaccggccgacgctctccgacgagcaaatgaacgacgtcacctggatcgggtcgagttacttcctcgacacgcccggcttctatgacacctatcgcgccaagaccccacgcacggcctggccctacgacgcgacccgcgatgcagggttggcacaggtggacagcggcggcggctatccgtcctgccggcagtggtgggccgatggcggccagggactgcgcagccggctgctggcacaggtcgacccggacctactgacccgcatcgggcgctgggcgggcttcctgtcgcagagcgaggtcaatgactcggtgatccgcgccgtggtctcaccgcgacagcagaagatgaaccagggcgccgtctacaccgactacggtggccagatcgacaagacgctgccgaacgttgtcacgcgcggcgcaagcgacctggggttgaccgtcggctcgctggccttctttcccgcgatggacgtggtgcgccaggcgctgccgatggtgctgacgatgctcaagatggcgctcgtcatctgcatcccgctggtgctgctgatcggcacctacgacctgaagacggtggtgacggtgagctgcgtccagttcgcgctgttcttcgtggacttctggttccagctcgcgcgctggatcgacagcacgatcctggacgcgctctacggctgggggtttggcgcggacaggccgcacacgaacttcgatccgttgatcggtttgaacaacgcctttggcgacatgctccttaacttcgtcatggcgatgatgttcatcgtgctaccgggtttctgggtagctgcgctcgcgtgggttggtgtccgcgtaggcaacatttcgcagatgctctcagcagccaccgatggcgccaaatctgcgggaggcaaaggcgctgaccttgcaatcaaagcagcgaaggcgaagtag

SEQ ID NO: 329 - DNA, 1524 bp, Methylibium petroleiphilum PM1
atgacgctctacaccacggactacttggagtattacctgaccctggtggcttgggtggtcaacaacggcatctggagcatcctcgtggccagcggcgtgttcgcgctgccgttcgtggccatcgtgatccaggaatggctcaaggcccgcagcgaaggtgcggacgagggcaacaagggtgtgctgtcgacgatgcgcatcgagaaccgggtgtgggtggcgatcgtggtcatcatgttcgcgggcatcccgttcatcccggtggatctcgccacgatcaggttcgacaccacgcgctccgcgcaatgccaggtcaacgtcccgctgcccaacgacacgggctggtccaacgtctacacggcgctcaacgaccagagcgcgctggtgccggtgtggtggttcttcatgcacgcgctgtcgaaagccgtgacgggctccgcggtggcggcgattccctgcggcacggacctgcgtcagattcgcatggatgtggatgccacgcgcatcgacgatccggtgctggcacaggaggtcgccgacttcacgcacgactgctacgggccgtcgcgcgccaagctgttcatgaaccggccgacgctctccgacgagcagatgaacgacgtcacctggatcgggtcgagttacttcctcgacacgcccggcttctatgacacctatcgcgccaagaccccacgcacggcctggccctacgacgcgacccgcgatgcggggttggcacaggtggacagcggcggcggctatccgtcctgccggcagtggtgggccgatggtggccaggggctgcgcagccggctgctggcacaggtcgacccggacctgctgacccgcatcgggcgctgggtgggcttcctgtcgcagcgcgaggtcaatgactcggtgatccgcgccgtcgtctcaccgcggcagcagaagatgaaccagggcgccgtctacaccgactacggcggccagatcgacaagacgctgtcgaacatcgtcacgcgcggcgcgagcgacctggggctgaccgtcggctcgctgggcttctttccggcgatggacgtggtgcgccaggcgctgccgatggtgctgaccatgctcaagatggcgctcgtcatctgcatcccgctggtgctgctgatcggcacctacgacctgaagacggtggtgacggtgagctgcgtccagttcgcgctgttcttcgtggacttctggttccagctcgcacgctggatcgacagcacgatcttggatgcgctctacggctgggggtttggcgcggacaggccgcacacgaacttcgatccgttgatcggtttgaacaacgcctttggcgacatgttgctgaacttcgtcatggcgatgatgttcatcgtgctaccgggtttctgggtagctgcgctcgcgtgggttggtgtccgcgtaggcagcatttcgcagatgctctcagcagccaccgatggcgccaaatctgcgggaggcaaaggcgctgaccttgcaatcaaagcagcgaaggcgaagtag

SEQ ID NO: 330 - DNA, 1524 bp, Parvibaculum lavamentivorans DS-1
atgacgctttttacgaccgactacctggagtactacctcaccctagtctcctggatcgtccataacggaatctgggccgtgctggtgtccagcggggtattcgcgttgcctttcgtggcgatcatcgtgcaggaatggctcaaggcacgcgcggaaggcgcggacgagggcaacaagggcgtgctgtcggctgcgcgcattgagaaccgggtgttcgtcgccatcgtggtggtgatgttcgctggcattccgttcatcgacgtggacctcaacaccatccagtacgacagctcgcgctcggcgcagtgccaggtcagcgtgccgcagcctaccggcacgggctggtcgcagtccttctcgacgctcaacaaccagagcgccaagctgccggtgtggtgggccttcatgcacgcgctctcgcgtgcggtcacgggagcttccgtggcggcgatcccttgcggcactgatttgcggcagatgcggatggagatcgacgccacgcgcatcgacgacccggttttggctcaggaggtcgcggatttcacgcacgactgctacgggccggcccgcgccaagctgttcatgcagcgcccgaacctcgatgaggcgcagatgcacgacgtgacctggattggctcccgctttttcacggacacggccggctactacgacaactatcggtcgagcacgccacgcgatgactggccttacgacagtgaccgtgatgctgggctggcccaagtgtccagcggcggtggctatccgacctgcaggcaatggtgggccgacggcagcaatggcttgcgcgcgcggctgttgggccaagtggacccaaatctgctcacgcgggtggcgggctgggccgggtttctgagccgcgccgaggtggacgactccgtgatccgcaccatcgcttcaccgagacagcagaaactgaaccaggggagcgtctatacggactacggtggccagatcgacaagaccttgccgaacgtcatcacgcgcgcggccggcgacgtaggaatggcagtcgggggaatcgcagcgttccctgccatggacgtcgttcgccaggcgctgcccatggtgctcgccttgctcaagatggcgctggtcatctgcatcccgctcgtgctggtcattggcacctatgacctgaagacggtcgttaccgtcagcgtcgtgcaattcgcgctgttcttcgtggatttttggttccagctcgcacgctggatcgacagcactatcctcgacgcgctctatgggtggggctggggctggaaccggccgcacaacaactttgatccactggtcgggttgaacaatgcgttcggcgacatgctcctgaacttcgtcatgggcacaatgttcatcgtaatgcccaccttctgggtcatggccttggcttgggcaggcgttcgcgccggcaacgtccttcaaggcctcgctggagccacgggagatgccaaggctgcagggggtaaaggaggaggtattgcgctcaacgccgtgtcgaaaaagtga

SEQ ID NO: 331 - DNA, 1524 bp, Serratia proteamaculans 568
atgatgaccaacagctatctggagtatttcctgacgctgctcggctggttgattaacaacggtctgtgggagctgctggtcagtacggggctgtttgtgctgccgctgctgttcaaggtggcggccatctggctgaaggtccgggaggaaggtgaggatgagggcaacaaagggatgctgtccctgccgcgcatcgagaatctgctctacggcgcgttttttgtgatgcttacctgctgcctgccgctgatgaatgtcagcctggataccatcaaatatgacagcagtcgggcagcaacctgcggtacctggacacccaaaaagccggatgaaacgggttacgccaacatcatgtcgagcatgaacggccagacggcgaaggtgccggtgtggtggttggtggtgcataagctgtcgaaggggatcacgtcggcggcagtggccaccattccgtgccggccggatctgcggcaggtccgttttgaggtccagcacagtcgggtcaacaacccggcactggcaaaggagctgcaggacttcactaacgactgctatgcgctggcgctgtatacctggcagaaccgcgaccagggacagacgaccgacaaggccacgctgcgtgatatcgagtggctggggtcgaaaacctttctgaatggcggctactacaacaacctgcagtcgaaaacgccgcgcgccagtttcccgtggaatgaggcgagggacagcggccggccaaacaccggacggggcggatacccgacctgcagtgagtggtggtcagccggcgagaagagccttgaagtcaggttagtgaaacaggtcgacccgggcgtgatgctgcggatgtccgctgcgctgaagatgatgggacaatctgacgcggattataaagaagcggtggtgcgtcgcctggtcagcccggataacctgactatctcccagggcggacgggcgtatgccggctacggcggcaacgcggacttcaccttggacaactcggttaaccgtattgcctcgatgggtggaaccgcactggggagcctggcggcgtatccggcttttgatgcgatgcgtcaggcgctgccgatggtgcaggcggtactgttgatggcggtgtatatcatggtgccgctcatcctggcctttgcggcctacgagtataagacggtgatcacggtgacattcgtggtgtttgccctgaacttcctgacgttctggtgggaattggcgcgttggctggatagctggctgctggaggcgctttacgactcggatacacacagtcgatggaacgtggccgggttccagaacagtacggacgacgtgatcatgaacttggtgatggggtgtatgtttatcgtattgccaatagtctggatgggggcactgtcatgggccggtgtgaacgtaggtcatgccattgcttctgcggtaaatagcggtacagaaacagctaaaaatacagggggaaaatttggagacacagctgggaatattatagcaggtaaagcaactcagtga

SEQ ID NO: 332 - DNA, 1524 bp, Delftia acidovorans SPH-1
atgacgcttttcaccaccgactacttggagtactacctgacgctggtgtcgtggatcgtccataacggcatctgggccgtgctggtggcgagcggtgtattcgcgttgcctttcattgccatcatcgtgcaggagtggctgaaggcccgcgcggaaggcgccgacgaaggcaacaagggcgtgctctcggctgcgcgcatcgagaaccgggtcttcgtcgccatcgtggtggtgatgttcgccggcatcccattcatcgacgtggatctcaacaccatccgctacgacagctcgcgctcggcccaatgccaggtcagcgtgccgcagcccaccgataccggctggtcgcagtccttcagcactatcaacaaccagtcggcgaaggtgcccgtctggtgggcctttatgcacacactctcgcgagcagtgaccggtgcctctgtggcggcgattccctgcggcaccgacttgcggcagatgcgcatggagatcgacgcgacccgcatcgacaacccggtgctggctcaggaagtggcggatttctcgcgcgactgctacggaccggcgcgcgccaaactcttcatgcagcgcccgaacctcgatgaggcgcagatgcacgacgtgacctggatcggctcgcgcttcttcactgacacgggcggctactacgacacctaccgctccagcacaccacgcgatgactggccttacgacagcaaccgtgatgctgggcttgcgcaggtggccagcggtggcggctatccgtcctgcaggcagtggtgggccgatggcagcaatggcctgcgtgcacgcctgctggggcaggtaaacccaagcctgctgaatcgcctggcgggctgggccggattcctgacccgtgccgatgtggacgactcggtgatccgcaccatcgcctcgccgaggcagcagaaactgaaccagggcagcgtctatacggactacggcggtcagatcgacaagaccctgccgaacatcgtaacgcgggccacgggcgacgtcggcatggctttcggcgcgattgccgcgtttcccgccatggacgtggtgcgccaggcgctgcctatggtgctcgccttgctcaagatggcgctggtcatctgcatcccgctggtgctggtcgtgggcacctacgacctgaagaccgtcgttaccgtgagcgtcgtgcagttcgcgctattcttcgtcgatttctggttccagctcgcgcgctggatcgacagcaccatcctcgatgcgctctacggctggggcttcggctggaaccggccacacagcaacttcgacccgctggtggggctgaacaacgcctttggcgacatgctcctgatgttcgtcacgggaacgatgtttattgtgctgcctacgttctggatcatggccctggcttgggcgggcgttcgcgccggtaacgtcttacaaggcctggctggagctaccggagatgccaaggccgctggcggaaagggaggaagtaccgcaatcagcgcggtgccgaagaagtga

SEQ ID NO: 333 - DNA, 1521 bp, Thauera sp. MZ1T
atgacgctctacaccacggactacctggagtattacctgaccctggtggcctgggtggtcaacaacggcatctggagcattctcgtggccagcggcgtgttcgcgctgccgttcgtggccatcgtgatccaggagtggctcaaggcccgcagcgaaggtgcggacgaaggcaacaagggcgtgctgtcgtcgatgcgcatcgagaaccgggtgtgggtggcgatcgtggtcatcatgttcgccggcatcccgttcatcccggtggatctcgccacgatcaggtttgacaccacgcgctccgcgcaatgccaggtcagtgtcccgctgcccaacgacacgggctggtccaacgtctacacggcgctcaacgaccagagcgcgctggtgccggtgtggtggttcttcatgcacgcgctgtcgaaagccgtgacgggctccgcggtggcggcgattccctgcggcacggacctgcgtcagattcgcatggatgtggatgccacgcgcatcgacgatccggtgctggcacaggaggtcgccgacttcacgcacgactgctacgggccgtcgcgcgccaagctgttcatgaaccggccgacgctctccgacgagcagatgaacgacgtcacctggatcgggtcgagttacttcctcgacacgcccggcttctatgacacctatcgcgccaagaccccacgcacggcctggccctacgacgcgacccgcgatgcggggctggcacaggtggacagcggcggcggctatccgtcctgccggcagtggtgggccgatggcggccagggactgcgcagccggctgctggcacaggtcgacccggacctgctgacccgcatcgggcgctgggtgggcttcctgtcgcagcgcgaggtcaatgactcggtgatccgcgccgtcgtctcaccgcggcagcagaagatgaaccagggcgccgtctacaccgactacggcggccagatcgacaagacgctgccgaacatcgtcacgcgcggcgcgagcgacctgggtctgaccgtcggttcgctgggcttctttccggcgatggacgtggtgcgccaggcgctgccgatggtgctgtcgctgctcaagatggcactcgtcatctgcatcccgctggtgctgctcttcggcacctacgagctgaaggccctggtcgcggtgagctgcgtggagttcgcgctgttcttcgtggatttctggttccagctcgcgcgctggctcgacagcacgatcctcaatgcgctctatggctgggggttcggcgcgagccggccgcactcgaacttcgatcccttgatcggtctgaacaacgccttcggggacatgctgctgaacttcgtcatggcgacaatgttcctcgtactgccgagcttgtgggttaccgcactgggctgggtaggtgttcgtgctggcggcatgcttcaaggtttggcaaacgggaccagggacgcagggcaagcgggtggcaagggatcgaatctattgatcagcgctgccaaaaagtag

SEQ ID NO: 334 - DNA, 1521 bp, Thioalkalivibrio HL EbGR7
atgaccctctacaccacggactatcttgagtattacctgacactggttgcctggatcatcaacaacggcatctggaatgtgctggtggccagcggcatcttcgcgctgccgttcctcgccatcgtcgtgcaggaatggctcaaggcccgtgcggaaggcgcggacgaagggaacaagggcgtgctctcgtccatgcgcatcgagaaccgcgtgtgggtggcgattgtggtcatcctgttcgccggcattcccttcattccccttgacctgagcaccatccagttcgatcgcacgcgctcgacccaatgccaggtcaatgtgccgctgccctcggaaacgaactggtccacttcgttcacgacgatgaacaaccagagtgcccatgtgccggtctggtggttcttcatgcactcgctgtcgaaggccgtcaccagcgccgccgtggcggcgatcccctgcggcacggacctgcggcagatgcgcatggagatcgacagcacgcgcatcgccgacccggtgctggcccaggaagtcgccgacttcacgcacgactgctacgggccggcccgcgccaggctgttcatgagccggccgacactcagcgaggagcagatgaacgacgtgacctggatcggttcgcgcttcttcctggacacggccggcttctacgatacgtatcgctcgcgcggaccacgcgacgcctggccctatgacgacacgcgcgacgccggcctcgccgaagtctccactggcggcggctatccgacctgtcggcagtggtgggcggacagcggcgatgggctgcgcgatcgcctgctggcccaggttgatccgggcctgctgtcccggctcggccaatgggccggtttcctgagccaggcccaggccgacgatgccgtgattcgtgccatcgcttcaccacggcaacaggtcatgaaccagggacacgtctacaccgactacggtggtcagatcggtatgacgctccccaacgtcgccacccgcgtcgtatcggatgtggggctgacggtaggatcactcggaatgtttccggccatggatgtggtgcgtcaggcgttgcccatgatcctgtcgttcctgaagatggcgatggtcatctgcattccgctggtgctgatcttcggcacctacgacttgcgaacggtggtgacggtgactgccgtgcagttctcgctgttcttcgtcgatttctggttccagctcgcccgctggatcgattccacgatcttgaacgcgctctacggctggcactcgccgcacagcaacttcaatccgctgatgggtttgaacaacgccttcggcgatatgttgttgaacttcgtgatggcgacgatgttcatcatcctgccgggcttctgggtcgttgcattgacgtgggccggggtcaggacggggaacattctcggggggttcatcaccggcacgacggatgcgaagtcggcgggcagtagcggctcgcgcctcgccatggcggcggcgacgaaaggcgctgcgaagtaa

SEQ ID NO: 335 - DNA, 1566 bp, Azotobacter vinelandii DJ
atgaccgtcacgctctacaccaacgactacctggagtattacctgacgctggtcggctggctggtcaacaacgggatctggaacctgatttccgacaccggcctgttcgccgtgccgttcatcgtcatcgtcgcccgcgaatggctgaaggtccgccaggaaggcgccgacgagggcaacaagggcgtcctctcgctcgcccggatcgagacgcacctctatgtcggctacatggtcgtctccctcgccggtataccggccgtccacgtcggcctcgacaccctccagttcgaccaggagcgcgcccagcaatgccagaccaccgtgccggcgccggccgacaccggctggagcacgaccttcagcagcctggccggcaagagcgcccaggtgccgatctggtgggccttcatgcacgcgctgtccaagggcatcaccagcggcgcggtagcggcgatcccctgcgggacggaccttcgccagatgcgcatggaggtcgacgcgacgcggatcgccaaccccctgctcgcccaggaagtggccgacttcagccacgactgcttcggcccctctcgggccaggctcttcatgcggcagccggacctcggcgcaatggccaacgatgcgaaggccctgcaggacctgaactggatcggcagccgcttcttcctggacaccgccggctactacgacaccgactattccaagacacccagggcggcctggccctacgacgccaagcgcgacgtcgggctgccccaggtcaccggaggcggcggctatccgacgtgcaagcagtggtggtccgacagcgggaaaggcctgcgggcccgcctgcaggcccaggtcgccccggatctactgacccggttccagggctgggcgaactggctgtctcaggaggaagtcaccgatgcggtgattcgggaactcgtctcgcccaatcggcaactcgctggagcagtttattcggattacggcggacgggctggtgagggacaaacgatctcgcatgccctgaccagaacgctcggcaccatcggtatcatcaccggcgccaccgaatacttccctggtgtggacatcgttcggcaagggctgcccatggtgttggcgttcctgaagatggcgatggtcatctgcctgcccatggtgctgctcatcggcgcctaccaactgcaagtggccatgacgatgagcgtgatctatttcgcgatcatgttcgtcgacttctggttcgaactggctcgctgggtcgatagcacgattctcgatgctctatatggttcgggattgcagagcttgaccttcgacccgcttataggcatgcaaaacgaatcacagagcattctgctcaactacgtgataggcgcgatgttcattatccttcctatgttctgggttggggcgctgggctgggccggcatccaggcaggcaaggtattggaaggactgtcagacggaactaaagccgctcaaaatgccgggactaaaggttttggagttgtaaacgacacgtacagcggagctaaaagcggcttcaacaaaggaaagaaaggagactaa

SEQ ID NO: 336 - DNA, 1518 bp, Ralstonia pickettii 12D
atgacgctcaacacaacggactacctggagtattacctgaccctggtcgggtggatcgtcagcaacggcatctggaacatcctcgtggccagcggcgtgttcgcgttgccgttcgtggtcatcgtggttcaggaatggctgcgcgcgcgggccgagggcgccgacgagggcaacaagggggtgctgtcctcgatgcgcatcgagaaccgcgtgtgggtggcgatcgtcgtcatcctgttcgccggcattcccttcattccagtcgacctcagcaccatcaagttcgacacgacgcgctccgcgcaatgccaggtcagtgtcccgcagcccaccgacacgggatggtcgaacgcctacaccacgctcaacaaccagagcgcgctggtgccggtgtggtggttcttcatgcacgccatctcgaaggcggtgacgggcggcgcggtggcggccatcccctgcgggacggatctgcgtcagatgcgcatggacgtggatgccacgcgcatcgacgacccggtgctggcccaggaggtcggcgacttcgtgcatgactgctacggcccctcgcgcgccaagctgttcatgtctcggcccgcactctccgacgagcagatgaacgacgtgacctggatcggttcgagctacttcctgaacaacgcgggcttctacgacacctaccactccaacacgccgcgcacggcctggccctacgacgcgacgcgcgatgcagggctggcccaggtggacagcggcgggggctaccccacgtgccggcagtggtggtcggacggcggcagcggcttgcgcgcgcgcctgctggcccaggtcgatcccgacctgctgacgcgcatcggccgctgggcgggcttcctgtcgcaggccgaggtgaacgactcggtgatccgcgccgtggtctcgccgcggcagcagaagatgaaccagggttcggtctacaccgactacggcggccagatcgagaagacgctgcccaacgtcgtgacgcgcggcgccggcgacctggggatgaccatgggctcgctgggcttcttcccggcgatggacgtggtgcgccaggcgctgccgatggtgctgtcgctgctcaagatggcgctggtgatctgcatcccgctggtgctggtcttcggcacctacgagctgaaggcgctggtcgcggtgagctgcgtgcagttcgcgctgttcttcgtggacttctggttccagctcgcgcgctggctggattccaccatcctcgatgcgctctacggctgggggttcggcgcgaaccggccgcacagcaacttcgatccgctgatcggcctgaacaacgccttcggcgacatgctgctgaacttcgtcatggcgacgatgttcatcgtgctgcctaccttctgggtggctgcgctgggctgggtaggcgtgcgcgcgggaacggcaattcaagggctggcggcaggaaccagggatgcccaagctgctggcggcaggggtgcgggtgtcgctatgaaagcagcgaagtaa

SEQ ID NO: 337 - DNA, 1524 bp, Dickeya zeae Ech1591
atgacgcttttcaccaccgattacctggagtattacctgactctggtgagctggatcgtccacaacggtatttgggcggtattggtttccagcggcgtgtttgtcctccccttcgtggccatcatcatcgacgagtggctgagagcccgtaccgaaggcgctgatgagggcaacaagggcgtgctgtcatcaatgcgcattgagaaccgggtatgggtggcaattgttgtggtgatgttcgcaggcattccgttcatcgatgtcgacctcaacacgatcagatacgaccaggcgcgttcggcacagtgccggatcagcgtaccgcagcccgaagacactggctggtcaaaatccttcagcaccctcaacaaccagagcgccaaagtgccagtctggtgggccttcatgcatgcactctcacgtgcgatcaccagtgcctcggtatcagctatcccatgcggcaccgacctgcggcaaatgagaatggagatcaatgctacccgtattgatgacccagtactggctcaggaaatagcagactttacccacgattgctacggccccgcacgcgccaagctgttcatgactcgtcccaatcttgacaagacacaaatgcacgatgtgacctggatcggctcgacctattttgtcagtacagcaggcttctacgacacctatcacgccaggacaccgcgtgagggttgggcctacgacagccatcgtgacgccggactggctcaggtgccaagtggtgctggctacccgagttgccgccagtggtggagcgatggaggaaacggcttgcgtgcacgtctgttggcacaggtcgatcccagcttactcaatcgcatcgccggctgggccgggttcctcagccgcacggaggtagatgactcggttatcaggacgattgcctcccctcaccaacagaaactcaaccaaggtagtgtctacacggattacggcggtcaaatcgataaaaccttaccgaatatcgttactcgcgctgcgggtgacatcggcatgacagtgggaggactcgccgcattcccggcattggacgtgatgcgccagggactgccgatggtgcttgcattactgaagatggcgctggtgatctgtatccctcttgtacttctggtaggcacttacaacctgaagacaacgataacggtcagcgtcgtgcagtttgcgctgttctttgcagatttttggtttcaactggcacgatggattgacagcaccatcctcgatgcactttacgggtggggttggggctggaatcggccgcacggcaacgtcgatccgatggcaggtttgagtaacactttcggcgacatgctgctgaacttcgtcatgggcacgatgttcattgtattacccacattctggataatggctttggcttgggcaggcgtccgcgccggtaatgttcttcaagggttcgctggagctacagctgatgccaaagcagcaggagcaaaaggaggtgacatggttcttaaatccgtatcgaaaaaataa

SEQ ID NO: 338 - DNA, 825 bp, Methanosarcina barkeri fusaro
atggcatggtccctctatcgtgtgagtttacgtcttctttctccagttcatatcggatggaaaaaaacagataatttacagcagacacggccttatgttcctgccaaaactatgtggggtgcattgactgcaaggctagctagagattctggaagttttaactatgaagaagttggaaatgaagtagcagaaaatctaagattcagttatttttaccctacaataataaataatgaaattggtaaagtccctactaagattgatatttttccgtgggaaaatattgatgatttttcctggaagtacctgaatagttcccaaaatactgctctaaatcaaaaaacagcagaagaaggttcactccacgagaccgaaaacatctcccataaaacgcgtaatggagattccgtttatctattaggttatattttcgaaaaagaaggatttgacttaaaatggaaagagtcattgaaaaaaatccagattggaggggaacgtgggtatggatggggaaacatggaaattatagagatatccaaactcttagaaaaaatcatttttgatggatacgctgtaaatttaagtggcgaccatccaattataaatgtcattaaagaaaataaatatgtattagcgcatgtcattacgaaaaatttgaatttaaatggtttggtagaaccttttgttggtagagagacatcgaaaaataaatattttggtggaaaatattcaaatgctgagatttgctggatgcctggaagcactgtaattaaaaatgaggaattcgaaattctacctacaggattatggagaatatgcatttaa

SEQ ID NO: 339 - DNA, 834 bp, Roseiflexus sp. RS-1
atgaactggatcgggtatcgcgttgtttttcgtttgcactcaccgttgcacatcggctggcgcaaggttggcaatgtgcaggtcactcgcccctacctcaccggtcgctccttctggggggcgctgaccgaacgcctggcgcgtgatacagcggcgcaaaagggacagaaggcaaccacctcgaacgattatcacgagagcggtcatcaagtgaacgaatacctggcgttcacctacttttacccggcgctacaatcgggcaatgactatcaggtggtctggccgtgggatgatgaacgcacctttcgccgacgtttcctgagcagttatcaatctactgcgctggtttatccggagcattcagccgccgaagggtcactgcacgagatagagtttctctcgccccacacgctcgataccgccgatccagtttacctgatcgggtatgtgtttgcgcacaaagattgttcgcttccctggcacgacgcactgacacgtctgcaattcggcggcgaacgcggctacggctggggtaagacagaattggtgagtcttgagaagacagacgatgccttcagttgcaccgttgattgtagcggtcgtcgccctgttataaccgttccgcaagacaaacgcctgctcgcccacacgaagccggatcagataatgatcgcaggcgaggtcgagccgctggtagggcgcgagtggcataccaacagcggcgcaggcgcctccataacccattttggggtcgtctatgcgccgggcggcatagcaacgaatgaacattgtttcgcggtcgaatcgtttggtctgtggcagaagcaaccatga

SEQ ID NO: 340 - DNA, 828 bp, Roseiflexus castenholzii DSM 13941
atgacctggcaggtctatcacgtgatcgtgcgcctccgttcaccgttgcacatcggctaccgcaaagtgggcaacgtccaacgcacccgtccctacgtcaccggccgggcgctgtggggcgcgctgaccatgcgcctgacccgcgatgccactgccccggccaccggctctcatgcctaccagcagatcggcgatgaggtgcatcaacagcttgcgttcacctatttctacccggcgctgcaatcgggcaatgactatcaggtcgtctggccctgggacaacgaaactctgttccgccctcgctttctcagtagctatcaaagcactgccttagcctacccgcagcatgcagccgctgagggcatgcttcacgaagtcgaatacatctcacctcacacgctggataccggtcagccggtctacttgcagggctacatctttgccaaaacagactgtacgctggcttggcaatcggcgctcgaacgcctgcacatcggcggcgagcgcgggtatgggtggggagccaccgaattagtacaaatttctccgtgtgaggacgatcaactttttggcggtgtcgcacagtttcagcaaagtaataacagtttcacgatttccttaccaaaagacgggcgtttgctcgcgcacaccaaagccgacaacgcagccattattggcaacctcgaaccgttggtcgggcgcgaatggcggtctcatggtggcgccggtcagcacatcgcgttcaccggtgtctgctttagccccggcagcgtggtcgccacagcacagtgctttacggtaaaagagtttggggtgtgggaagcgtga

SEQ ID NO: 341 - DNA, 897 bp, Thermotoga RQ2
atgaaagaggaaaaatggattctctactctctagttttccagttgaaatcaccattgcatattggataccataaaatcatgcacctcacacggacgagattatatgttcctgcaaggactttatggggcgctatgacggtaaaacttgtgcagaaaacagggagaaatgattataaaaaagctgggcaatttctgagagaaaagatgagattcggatatttctacttttcaaacggcaaagaacttttccttcctcattacaccgaagagggtttgaaactcggtcgaatgtgtctgtacgaatttgagaagaaatatatccgctctatatcaacaaccgccatagatgcaaattctttatctgcggaagaagaaaccctacatcaccttgaatacataaattatcgaaacacagaagattcttcacctctatttctcgaagggttgatgtggataaaaatcgatggtcaccctaaagaagatgactttttattcacatatgaagatgttcaggtaaagctctcagaattattgcagtctctgcaaataggtggtgaaaggaaatatggatttggagaaacagaactggtgaaattggaaagattggatgatacagatctcaggtcaaaaggattttgcggtagctggcttgagagtgatgagtcagtaaaagtgacgatcttgcaagggaatttcatttgggcacatgcgaaatacgagccgaatttgaacatgaaaggcgagatagagatttttatgggaagagaatgggatgacaaaaaaggatccggaaggaacattgtaactcatggtctttgttggatgccgggatccgttgtggaagaacaagcaacgttcgaaataactccttcgggaatatgggaagtatacaaatag

SEQ ID NO: 342 - DNA, 804 bp, Chlorobium limicola DSM 245
atgacctggcaaaaatatgagctcgtttttcggatgcttgcccctttgcacattggctaccgtactgcaggcaacctgatgcaaacccgcagttacgtgccgggaagagttttgtgggctgccctgaccacccgcttgacccgcgatgaagagaatggcacagatggcctgcgttacatagaaatcggtcagcaggtacaagatcatttccgatttacctatctttatccggccacacaaaacggcaatggatacaaaacctactacccttgggaaaaggatttcgattatctctttctgaacagttacgccagtacatccttgaactacgcaagtcaatcggctgaagaagcgatgcttcacgaaacagagttcatcgcgcctcacacgcgtacaggccagtctgtttaccttgttggcaatgtatacaccaaaacgaacttgcctacaccactggaaaattggcctaaggcactcgaaaaactccagttgggagctgaacgaggttatgggtggggtcgagtacggactgtctcttgtgatagtcagggtgaacgcttttacaatgaaccagttgccgagttattcgacggccatattacagcccacttgaaagcggaaaaggtcagcggtattgtcggccctgttgaaccgttgattggctgggagcgtaacaatgatataaacagaaaaagcaactggaggttaaccgaggaggcaatcatttgctacgtgcctggagccaaggttacagtggacggtaattatattattggtccgaatggagtctgtggaataaattga

SEQ ID NO: 343 - DNA, 864 bp, Prosthecochloris aestuarii DSM 271
atgactgcctggaaagtcttccatgtcatttttcgtctgaacgctccaatacatatcggctgcggaaaatcaggcaaccttcaacgcacgtatccgtttgtcacagggcgtgtattctggggagcgttaaccgcacgaatcacaagaaacaatcccgaagccctgcaacagcatgggcatagagcgtaccggttgattggcgaacagattcatcgggaaataacctatacatatttttatccggctgttaaaagcagcctcgactttgaggttcggtggccatgggaagatggttttgctgcccgtcatatcaggacatatgcctctacagccctcacctatcctgaacagcaggcagaagaagcctccctgcacgaaatagaatatctttcaccagtcacatgtgacactgtcgaacaggtgtatctaagaggatatgtatttgtgaaagaatcgtcgactcttgaatggcaaaaggctcttggacagcttcagttcggaggagaacgatgttatggctggggcgatgttgaaacgatactgaacgatgaacaaacagcaacccctgagctgttcgacggacatgcaaaattcatggatgatgatttaccggtgatcagattatccgactcatcagcaaatcatcttctcgctcatacagaagccaactgttgtcaggcacatggtcaaacggaaccgctcgtcggacgagaatggcgatccgacaacgatgtaaaccgttatgcaggtcagcatattgcttttaacgcattttgcttcagaccagggagcacggtcgcatccctgccctgccagtttcagattggcaaatatggcatctggaaaactaagtctccacactaa

SEQ ID NO: 344 - DNA, 924 bp, Chloroflexus aggregans DSM 9485
atgagctggaagctgtatcggtgggtctggcgcttggaagcaccgctccacatcggcgtcacccctgccggtctcttgaaccgcacgcgcctttacatcccggcgcgcaacatctgggcggcgttgaccgaagaacttgcccgccgttcttcttctgcatctttccccgactacgcaggcaccggtcggcaagtacaggaggcaatgcgtttttcctacctctatccggcagagcaggtcaacggtaagtggcaggcttggctgccccagtacaaacaaaacgggaacgaatcagggttaatctggtgtcgcgaagatggtggcaaatctctccccgaccgtcagttccgccagcgtatccttattactcgcccaagcaccgcaattgatccctctgccgatagcgccgccgaggccaccctccgcgaactggaatgcatcagcccatggtggcgtcaggtgaacggacaggactctgcccatgccgtggcaatggttgggtatgtattatgccaagacgatcaattgcaccaagatgtcatggcgattgacgaaatcttcgtcggcggagatgtgcgttacgggttgggccatttgcgaagatacgaccaacctaatgaggagcagcacctctttggtaaccaggtcaatttgcagccccccgacgcccagtccgccgacccccagtcccgcgccccccagtccgccgccccccagtccgccgaccccatcgtgaaaacgcaacgggtcttggcgcacacccttcccaacgggaacgtgtcgttcatcggacgttggacctgcatcggcggatgggataagggaagtatgatgtcggcgcacagtgcttgggaaccgggatcgttcaccgagactatgcacagctttgccatccagaaagagggatggtggcaacgtcagtag

SEQ ID NO: 345 - DNA, 834 bp, Chloroflexus aggregans DSM 9485
atgacctggcaggtctatcacgtgatcttgcgcctccgttcaccgttgcacatcggctaccgcaaagtgggcaacgtccagcgcacccgcccctacgtcaccggccgggcgctgtggggcgcgctgaccatgcgcctgacccgcgatgccataccgcaggatgccccggccaccaactctcatgcctatcagcagaccggcgatcaggtgcatcaacagcttgcgttcacctatttctacccggcgctgaaatcgggcaatgactatcaggtcgtatggccctgggagaacgaaacgctgttccgccgtcgctttctcagtagctatcaaagcactgccttagcctacccgcagcatgcagccgccgagggcatgctgcacgaagtcgaatacatctcacctcacacgctggataccggtcagccggtctacttgcagggctacatctttgccaaaacagactgtacgctggcttggcaatcggcgctcaaacgcctgcacatcggcggcgagcgcgggtatggatggggcagcatggcatcgaaggtttggcctatcaatgacaagtatctcttcgataactcaatcacctacgacgtaaacggcgatcgtcccaaaatccgcgtgcctgcgggtgggcgcttattggctcatacccgcgccgcaaacctatcgctgaacggcaacctcgaaccgttggtcgggcgcgaatggggatctaatggtggcgccggtcagcacatcgcgttcaccggtgtctgctttagccccggcagcgtggtcgccgaagaacggtgctttacggtaaaagagtttggggtgtgggaagcgtga

SEQ ID NO: 346 - DNA, 3507 bp, Anabaena variabilis ATCC 29413
atgaacaaagccttatctgattattttagcctcaaacgtcgttattctcgttctattaaccttgagcgagactttgataagattgagtccttgcagggttatattttgactgaaaggtcagtagatgcaactaaacgaatattagctggactaactggaaaatccgagaatcgtgcttggactataacaagtgtttacgggactggaaaatctgcgtttgctcactttttcgtttccttatgcgctcctttaaacagccaatcacaccaagttgcgcttgaaattgtaatcaaaacatttggttctgatagttctgaatattcagcaatccaaaacaccttacctacccaaggtttattcagggcagtagttactgcacaacgagaaccattaagtaatactattgttcgagctttagagcgaggtgctgaaactttttggtcgcgccagcagattaataaaattaaagtagcaagaaaactagtagaccttggggcgcaggttgcagatggaaaaattatagacagtaaagaaatacctagtttaattagagaagtcgctaattctgcttctacaggaattgtcctagttattgatgagttaggtaaaaatcttgagtttgctgttcaaaatcaaggtgcagaagatttatatttattacaacagttagcagaactgccaaaagataaagactatcaaatctatataataggtttgttacaccaagcatttgcagattatagtgaaagactagcttccatacaacgtaatgaatggtcaaagatccaaggtagatttgaggatattccgttcaaagattctccaacacaaatgatgaggttaattgggaaagcaattgaccaatcaaaagccataaatcatcaaggaataattgctgaacaaacgaaaaaatggatagaaaatctaccagatgaaataaaggatgattatacacatgagattttagcagatacttatcctttgcatcctattacagcattagtaatgccaatgctatgtacaagatatgctcaaaatgatcgttctctatttacttttttgacaagtgatgaaccatattcttttaagagttttttgaaagaaactcctattgataatataagtttaccagttttaaaattagatagagtttatgattacttcattgaagcagttggttctggattaggctcacgtccaaatcttcaacgttggatagaaatcaaaaatttgattgatgatgctaaaggtaaagacattgatagcttacgagtattaaaaactattggaattttaaatcttgttactactacaggtgcaatgagagcaactcgtactttagtaacaatggcaatgtgtgataatatcttagataaaaataagaaccattgggaaggagtgattgaaaatcttcttcaaaaggggattattacatatcgtcgtcaattagatgaattacgaatttggcaaggttcagactttaatgttgacattgaattaacaaattatttagaaagagaacgttctcctttagttaatctcatctctgatattcgtcctcttaaacctatagttgctcaacgtcatagttatcaaacaggtactttacgttactttgaaaggtgttatgtagacggcttgaaagatttgactaaattatattgttccagtaatgattgtgatggtttaatagcttattgggtagatgaagtagagccaacgcatatcccagcaagtacagccgatggtaagccattgattgtacttaatccatcaagattagacatattgcggattagagctagagaatttgcagcgttaaagaaaattcaaactactgctgctgagttgcaaagtgatggtgttgcaagacaggaagtacgataccgtttaacacaagcagaaaagttattggatgaaactattactcaaactttcgatgtagcaacaaataatatatgttggtttagaggtaagaaagaaaaagtcaattacattacggatttcaatgccaaattatcagatatatgcgatgaaatttatcatctaggtttaaaacttaggaatgaattgataaatagacgtgagttgacttctcaaggtgctaaagctcggagagaactaatcgaagcaatgttagaaaagcaagatcgtgaaaggctttgcttagaagggtttgggcctgaagttgctatgtattattctgtacttagtgaaacgggtattcatcgtcaagagaatggagactggggactttattcaccttatgataaatctggtatatctacaatttggcacgcaataaatgatttttgtttgcaggctaaagacaaaatacaaaatttagataagctctacaaaattttggaagctcctccatatggtgtaaagcgtggggttattccagtactgatagcagcagttttgctgtatcacgttgaagatgtgggcgtttataaagatggtacatttattccagttttaggttctgagcatttcgagttattgctaaaagaaccatcccggtttggtgttaaatactttgaagtcatgggactgcgatcgcaagtctttagagagcttgagttaattttacgtcagcagaatattactaaagcaagaggcgtacgaaactcaactttactagtggttgtaaagcctttatttcaatttgttaaaaagctgccatcatacactattaaaacaaaacgtttaagtaatgaagcattggcagttttgcaaaacttacagaaagcacaagaaccagacgaacttttatttacttcattacctttagcgtgtgggcttaatccgattgtagctggtgaagaggatgatggtacggtagcaaaaactctgcgaaaaaagcttgttgcatcactgcacgaaattcaaacagcttatgaccgtctgcttagtgagtgccaatcccttctgtatgctgctttttcagtacgtagtggtgaagaaaaattacgagaagatttgagggttagggctagttatttgagtggccaagtgttagaacgtcgagttagaagctttgtacaagcagcagtagatgaaaatgctaccgacacagagtggttagaagcattattaatgatcgttgctgacaagcctgctgaatcttggacagatgaagatgccacaaattttgaactaaagctttccgatcttgctcgacggttcaaaaatcttgaagctttgcaaaaagattctcaaactcgaacttcggaaggctttgaagcacgtaaaataactgttacacgtccagacggacaagaaactcattcattagtctggtttgataatgaaaatcaacttcaaattgatagtgtatttgaagaaattttggcaatcttgaaaaaatatgataacccgcaattacaccaagctgttgttgctaagttgacagagcgtgtgctaagtgtatcatttaatgataacaattctcaagttagagctaaacgtaaagagcgagaacatgaacaaaaaaccagttag

SEQ ID NO: 347 - DNA, 3417 bp, Shewanella frigidimarina NCIMB 400
atggcactaaaaatgactgaatcactcataactatcaaccagcgttataaaagctcaacccgtattgatggtgatagcgaagatttacggtcctttattgacgattttattcttcatggtactgccgttaatgtgcttgatactgtcagtcgcgaatacgacgctaatgcacaaagggtatataccattacagggccttatggttcaggtaaatctaccgtcgcgttatttttatcatgtttattatctactgatactaagttacgcgagtacgctacggcaaagttacaatcatcgcctgtccttttgtctgaattcaagaaaagatttgctatcaacattggttggaaaacggttaaacatgtttgtggtttagagtcacctgcaaacagtattttacaaagtttgtatattgcacttggtataacgcacgatgtgaatataattgcagacttaactgacgatgaatgtctttctgaaattaaactggctctgtcttcaacgcaaagtaatgatgatggtgtattaattttactcgatgaaatgggcaaggctttagattaccaatcacgcgctaataaggacttacatttattccaagcattagctgacgtagttcaacaagctaatcgccctgtattgatgataggtttcttacatcaagctttttctgattacgctaaaaataaagatgctaaaactcagcaagaatggagtaaagttcaggggcgctatcgagatcttagttttaatccatcaattgacgaatcattaatcctcgttggtgactcgataacacgatcagctgaaatttccgtaaaaatagaaagcaagtatgcaaagttagtcaatgtcgtcagcagtactttcgctaatcaaaatcggaatgttggtgcgttaaccgatactctgccacttgaccctattgtcagtttacttttaggccctgtttcaagacgccgcttctcacaaaatgagcgtagcttattcggttttcttgcatcacatgaaaagtatggttttcgtgagttcctagaagataactatacacaacctcaagatgacttggttttatacaggccagaaatgtattgggattaccttcaccataatttgcatcacttaattgttacatcgcatgatagtaaggcttggttggaaggttgtgatgctatatatcgcgcagaacaaaaagcagaaggtagtgagctacatgtttctataactaaggttatttcattactgacgatatttggttttcatcatcaattacatgctaaaaaagattttttaaaaaaatactttgtaaatcgtggttataaaaatactgaaatagctaaagcgttagatgatttacaaacatggactgtcattatttaccgacagaaacatgatgctttgtttgtattccaaggtagtgatatcgatatcaacacattgataagtgagcgtgttgaagctgttagtcaaggtgttgattggactagcgtttgtgacttgccgcaaaatatattagcgacggcacactatcacaaaacaggaacaatgcgatgggcaacaactaagctcatcaataaagtcgaaaaatcgttacttgaacagctctgtactgagccgaaaacaggcgaagctttccttacttttgttttatcggtatcacccgatgtgacagaaaagtttaaagaaattgcatcaaacttaagccattgcgttatcggtgagtatggcgattttagcattttacaaacagctgcaattgagctgatagcacttaaacaaatccttaaagatgagcagaaaatcacacatgacttgatcgccaagaacgagttagaaaaccgcatcatctttgctcaacaaaatgtagaaaaagaactgcaacacatctacaaaaatgcacagtggacgcattggaataacccattaccgccctcatctcctcttacttcattggcgtctgtgattgcagaagaaatctatcacaaagcaccaattgtaattaatgaattagttaaccgctctaaaccttctggtagtgcaaacagtgccattcgtaaattgatgaatgcaatgtttgtaaatggcgataaaaaagatttaggtttcgatgaaactagcttcccaccagagaaaggcttatatctatcgtgcttaaagagcaaaggttggcataattatactcctgagggttatttattccccaaaacatggagtaaagaaaccaaagatgccaatccaaagatgcatgcactttggcaagatggttttacttttattaaagagaactcaaccacagcacatgtttccatcgcacagttatatgaacgttggatgttgccaccttttggcttaacaaccggactttgtcgtatctatggactagcgttgttaaaatcactagagggacaaattgccttttatgattgggattctacaaatcagtttatttttattcctgaattagatgaggaactggttaataaaatctataagcatccacatgaagctgcggtacgatattttgaaatatctgatattcagagtcatttgttagaaaatttagctcaagctacaatcggaaatgctaagactgacagtgctattttgaatatagcaaaacacattgttggaatagttcataagctaccatcttgggttaaaaaaaccagcggcgagagctttagcggcagccaacaaaatggcttaactaaagaagcaagagactttagaaataaagtcattggcgctagcgatccctttaagcttatcttagaagatttacctgctgtatttggttttgataaaaatgaccccgttttagaagatcaattgggttataagctgagaacggcaattgaagatttaagtgctcaaaatgatattttatataatggattcaaacaaataatcattgatacattaggtgaagaatttaataaaaatctcaaaacacgttgcgaatttgttgagagcatagctaagcgacctaatgtcaaagagcttgctaaacgaataggccaatgcattaataacccgagtaaatttgaatttgttattaatcttgcaacgggtgcacctgagcgtaattggaccgataaacatcttcgtaacggcttagatgaattgcaaaacttatgtgttcaatttagacgtattgaatcatttggtaatttacaaactaaaggtagttcaaaacctttggcattcatcactacgaatagtgaaggtaagcatcaagaatttggtggttttatacagtacgatttagaaatggatagcgacgttttacaagtggtagaaaaaataaagtcgtctttctctgatttatctaaagagaaacaattggccgctttaactaacttgctaacaaatttgatggaacaaagtgaaagcggaacagaggttgttaatgactga

SEQ ID NO: 348 - DNA, 3336 bp, Polaromonas naphthalenivorans CJ2
atgactgaggcaaaaaccaaattaagcgacattgttcgcattgctcggcactatcagcgctccatccgcattgacattgactatgggcgatctgacgcgttaaatggatatatctgccatggcacagctgttggtgttctcgacagcatgtgcaagcaactgacctccacgaaccaacgtgcgttcacttggactggacctttcggcggggggaaatcgtcattggcggttgctctcgcgagcgccgtcggcccaagcaagtcattgcgcatgcgtgctcgcgaggtcctatgccttgaaaaactacccctgttcgatgaggcttttccctttaaaaagggctggctcgcgattcccattgtcggaaagcgcacgagcatcgtgcaagagctttcaaaaggaatgcgagcggctctcggcctgggaagcgaagaaaaaaaaacctctccgaccgccctcatcgaggacttatgtgaagcggctgagtcaaagcaacatgacggcgtcctgatcatcatcgatgaaatgggaaagtttcttgaggctgccgcgttgggggtcggcgatgacgtttacttcttccaggaattggccgaggcatcagcgcgctcggcgggcaagatcgtcgtcgtaggcattctccatcagtcgttcagtcaatacgcgacgcgcctcggtatcgacacccgcgatgactggaccaaggtccaaggccgatacgctgatattccgctggtagctgcgagcgatgaagtagtcgagctgatcggacgggcaattgaggtcgacaagcggccgccctggatgtttgatgcgtcgaaggcaattgctgattcaattcgaacgcgccgccccgccgtaggctctgatttcgcgaacagcctcaatgcttgctggcctctacatcccgccatggccgctctcctcggccccatatctaaaaggcaattcggacaaaacgagcgtagcacttttggttttctagcatcagttgagccgttcggcttccgctcctatttggaaaacacgccgttgccagaggcgtcttggtataggccagacaactactgggattacctgcgtgctaacttggagccagcgatcctcgcctcgacagacgggcatcgttgggcgcaggctgtcgaagctgtcgagcgcaccgaagcgaaaacaagcgaatcgatctacctgattttaatcaagagcattgcgatcatcgatttatttcgaaacggatcaggcctggcggcagaagagagtgttctggtgtcagtgctttatgaccgctccaaacgaaaagttgaagaggcattgcagcaactctcggactggaaggtaatcctctacaaaaagcacatcagcgcctggtcggttttcgaaggcagcgattttgacatcgagtcggcgatttcgcaagcaagaggcgcgctcccgggcgtggattttgcgctgttgactagccttaccaatctttatccgatcatcgcgaaacgtcactatcaccatactggcacgatgcggtggatgaccatggccctgtgcagactggaagatgctgagcggatcacgaccaacttcaagccacagaagggtgagttcggtcaatttttgctcgcactgcctggccgcacagctgagctcacatcggctgtgcgccacagccatgaaatatcgcggatcgctccatggcccatggtcgtcggagtaccgccgaatcacgtgcgcatcgaagattttggagccgaacttctcgccttgcagcacgtccaatcccgtcatgaactcagcggtgaccaagtagcgcgacgtgaggttcaagccaggctttcatccgtcagagccaaccttgaagagcaactcagggcggctgtttcaaaagccacttggacagcagcagatcttgagccggtggaaggaagccgtctctcccacatggcctccaacttggccgacgtcgtctatgagtacgcgccggagttgtggagtgagttgatcaatcgcgacagcccatcaagcaacagtgtcaaaggccgccgtgatttgttgtatcgcatgctcacccatgaagaggagccgtccttgggcatggagggtttcccagctgagcgcggactctacgagacgcttctcaaagcgactggcttgcatcggaaggacatcaacggcatgtggggttttatgccccccactaagaaagactcaccaacgttcgtgaaactctgggatgagaccaagaaaaagttcgcagacattaatgcgcgcgtcaaagcatctgaaatccacgagatgtgggccgctccgccttttggcgttagaaacggaatggttccggtaattttcaccgcattcctgctcgcccacaaaggaaacgtcgccgtctataaggacggcattttcatcgcgcgaatgactgacgctgacattgacgaatacctgcaagacgaaaagcgattctcgcttcgctggatcgtcatcgatgccgaaaagacggggatcctcgcgggtatatcggagatattggctcaggttggcgctgcttcaggagccaaagaccctttagaggccgcacgtggcttggtggcgctggttgttggcttgcccatgtggagccagagaacccaccgcataagccacgaggctcgcttgatcagggatacgctcttgaaggcgcacgatccacacaaggttcttttcattgatctcgcggcgattttggaaagttctggaggcgattcctatgtgaatgctctgcgaggtccgattgtggaaatttcaggcgcatatgacgcgctattaaaggaaatagagacttctttgcttgaagcgcttgacgctccggctgatcggctcgaccgtctccaagcaagggcgttcgcggttgaaggcgtgacgggcgatttgcgccaggacgctttcgcagctcgactctccaaacacgacggcaccaaagaaagcatggaaggaattttgagcttggctgcgaacaagccgccgcgcgattggaatgaccgggacatcgacgcagcccagcttgaacttgctcaggcagctctgcggttcaggcaagccgaagctttcgtctcggtcaaaggccgaaagcccaccagcgaagcgttcgcggtggtcatgggcgcgggtgccgaaaccatcaccgtgtcccgcgcgttctcgttgtcggatcggcaccgggaaaccgtggaagccatggccgacaagctggcattggaattgaagtcaggcggcatggacaccaacgtacttctagcggtcttggcccgcgcgggcatgaggctcactgtcgatgacgacacacaaaaggagaaatcgcatggctga

SEQ ID NO: 349 - DNA, 3333 bp, Methylibium petroleiphilum PM1
atgtccgatgaacagctagttccacggccactgtcggaggtcgtctcgatatctcggcagttcctgcgctccatccgcctcgacgccgatttcggtcgggaagacgcgttgtccggctacgtctgccaagggacggctcgatcactcctggagagcatggcccggcaactggtgtcgacgcggcaacgggccttcacgtggaccggaccgtacggcggcggaaagtcgtccctggcgctgatgctgtgctctctggtcggcccgaacccgcgactgcgtgcgcgtgctcgcgacatcctcgacctcccggccgacagcccggtgagcaaagcctttgaggcgcgaggcgagggctggctcgtggtcccggtggtcggcaagcgtgcaagcgtcgttcaagaactgcacactgccctgaacaaggcgcgaggaggcggccgtcgaaagcaaggtgagcttgtcaccgaactggtcgcggccgcggaagcgcaccgccaaggcgtgctggtcgtggtcgacgaactcggcaagttcctcgaggcttctgcacagggcgccggcgacgacatctacttctttcaagaacttgccgaggcggcaagccgcaccgccggcaagctcgtggtggtgggcatcctccatcaagccttcgatgcgtacgcgacgcgactgggccgcgacgcgcgagacgactgggcaaaggtgcaagggcgcttcgtcgacatcccactggttgctgcctccgacgaggtgatcgaactgatcgggcaggcgatcgacgtcaatccgtcagtcgatagatccctgctgatgcattgcgtcgaacccgtagcttcggccatccggacacggcgccccggcacgccggcaagcctcgctaagagcctggccaagtgctggccgcttcatcctgtgacggcatcgctgctgggtccgatctcgaagcgcaagttcggccaaaacgagcgcagcaccttcggcttcctcgcgtcgcgcgagcccaatggctttgcagagttcatcgagggccagccagcggactggaggtccatctacgagccggcgcgctactgggactacctgcgtgccaacctggaaccggccatccttgcgtcaccggacggccaccgttgggctgcggcggccgacgccgtcgaacgcgccgaagccaagggcgaggccatccatgttgcggcaaccaagaccgtcgcgttgatcgagatgttccgcaatggctccggtctcgtcgcggacgagtcagtcctccgagtctcggttcacgcccgcaactacggggaagtgagcaaggcgctgcacgacctggtgcagtggaagatcctgatcgagcgtcgccacctcggggcgtacggtgtgttcgccggaagcgacttcgacatcgagggggccatctcgcatgcgagaggtgagatcggcggtccgtcgttggagcacgtgtccgcgctgagcgatctgcaaccggtcttggccaaacgcttctatgcgcagacaggtaccatgcattggttcactcggcgcatcgtgcgactggccgacctgcctcacacgctggagcacttccggcaggacaagggcagcgccggcgcgttccttctctgccttcccgatgtcgacacgagcgaacgcaccgccgagcgtcaagtgagatcggccagcgccgagaacccgaccgtgcaggcgttgctaggaacaccggcgaatgccgctcggatatcggagctcgcgctcgagctggcggcagtcgagcgcgtgatgaagacgcggcccgagctcgaaggggatgcggtggcgcgacgggagcttggtgggcgtctcgcagccgtccgtggcgctctggaggacgaactcgccgatgcgttcgtcctgtcgaagtggtactggaagggagagcggaccggcgccgacaagcacagctcgctctcgtcgatcgcatcagacgtcgccaaggacgtctaccgcaaggcgccgacgatcttcagcgaactgctgaatcgcgaggatccatcgagcaactcgaacaaagctcgtaaggatctgatgtaccagatgatccgcggcggtgcccgcgagaacctcggctacacaggctatcccgcggacgctggcctctactacacgatcttgcaggccaccggcgtgcaccgcagagacgagaaacgcggctggggcttctacgagccctatgtgacgaaccctcggctcgagggcatgtggcaaatgtggacggctgctcgtgagcgcgttgcgcagccggcccacgagacgacggcttccgatctgtatgcctactggggtgcaccaccctacggcgtgcgtgcgggggtcatgccggtgctggcgcttgccttttacctggcataccggtccgaactcgcgatgtacgttgacggtgtgttcacgccggacctcagcgaggcggtgatcgacgactggctgcaggatccacaacggattcgcttccagtacgttgcggcgtccaaggaccaggaaagcctggtcaaggcgatcgcagccagtgtctcggaacagtccaacgtcaccattccggcggcaccactggacgcggcgcgcgcgctcgttggtctggtgacgtccctgccaggctggactaagcgaacgctcacggtatcgccagccgcgcaagatgtccgcgcgatgcttctcaaggcgagcgacccgcacaaggttctgttcgccgatctaccgacgctgctcaaggccgactcaccgagcgagttggtgctgcgccttcgcgctgtcaccaatgagctgtcgactgcctatcaatcgatgttggcgcgcgtccgtgagcacgtgttgaaggcgctcgaccatcaggaccggcctcttgaatcgctcaaccatcgcgcgatcaacgtcaagggcatcacgggtgagttccgactggatgcgtttgcagcccgcctggaagtgttcgacgacaccgaccaggctgtggaggggatcatcagcctcgcggtcagcaagccgtcggcgcagtgggtcgaccgcgacatcgatgctgcgctgcttcaactcggctcctgggccatcgatttccgtcgggccgaagccatggcgccgttgcgaggccgcccatcgacgcggcgcgtcatcggtgtcgtgttcggcgccggcaagggtcaggacgcaaccggctctgtcgacgtcgcggagagcgacattcccgcgatagaccagctcgtgaaagagctgctagccaccgtccaacgtgagcgacgggagattgttctggccgctctggcagaagcgggagcaatgttggtcaagctaggaatgaaggagaaggcgtga

SEQ ID NO: 350 - DNA, 3216 bp, Flavobacterium johnsoniae UW101
atggcaattaaattcagtacatccactaatatcattcgtgatacggatagggaattgacttatattcctactcctaatgctattaggataagtaaccagataagtaatgattttaaacaaggaacaaggtcatttaacataatcggatcatacgggacaggaaaaagttcttttctttgggcggtggagcagaccctcaaaaaaaacaaagcatattttggtttgaacttgcttgcagatccaaaaattgatttcataaaaattattggagaatatcagtctctaaaacaatctttctgtgattttttgcagatcaagaatgataaggatgcagtagagaatatattctctgaaatttttaatcgctattaccaattaggtaataaaagcccgcttctttttgtggttatagatgagtttgggaaatttttggaatatgcgtcccaaaatgatcctgaaaaagagctgtattttattcagcaactagcagaatttactaataattcagatcataacatcgttctattgacaactgtgcaccaaaattttgatgcctatgccattaatctcgattcagcacaaagacaagagtggaccaaagtgaaagggcggttcaaggagattacttttaatgaaccggtcgaacagctgctgtatcttgcctctgaacatatcgaggagaaacaatctgcagttaagaaggaaaagaatgtaaatgatatagtaaatctgctgactcaatctaaggccttcaacatcaatgaggattatgtgaaggaaatagcaaaaaaattatatccccttgatgccatttctgcttacgtgttgaccctatcattacagaagtatggacagaacgagcgttctttgttttcatttttggaatcaacggatcatacaggcttataccagcacagtatactgagtgacagtttttattccgtatcagaggtgtatgattttttgatgcacaattatttttcctttctgaattcaagatacaatcctgatttcggagcatggaaatctattagaacatctttggaaaaagcgggaacgttattcgatcataatctgtcagattatgaaaaaataattaaaacaataggcttgctgtccattaatgctcagtcaggctcatttattaaccgcgattttttggtggcttacgctgaaagaagtctgaatatttcaaatgcgctgaaaataatcgaaaatttagaattaaagaaaattgttctttaccgaaattacaataaccgttatattcttttcgaaggcaccgatcttgacatccctacagcactgtatgaggcaggaaacaagattgatgatattaccgatgtagtgacactgcttaataaaaattattcgctgccacccgtattagcaaaaagggcaatgtttgagacaggaacacctcgtctgtttgaatataaaatatcctcacatccaatttcattaaaaccggaaggagaagtggacggctttatcaacttgatctttaatgagtcggatatccttacagatatcgaaaaggtatcgtttgagaatcaggaagcgattttgtactgttactatttaaactcaaaagagattaaagatctgctattcgagattgagaagaccagaaaagttatagaggaaaatcctgatgacaaggtcgctgtaaccgaacttaaaaatattgtcctgcatcagcgaaatttgctaaaccataagatacaaaatagtcttttcggcgagaaagcttctgttatatggatcttttctggacagaagaaagaaataaaatcacaaaaggaatttaattctttcctttcacaaatctgtaaaacagtttactccaaaacgccttattttaataatgaacttgtaaacaaacatagaatatcaacatctatacatacagctaaaaggaattattatagagctttggccaatgactgggatattcctcagcttggcttttctgctgataaatttccgccagagaaaaccatatatctttctttattggaaaataacgggattcagctgtgtaatgataactcttcaaatttggtgcagccgcacgacgaaaatggatttcacagtttatggcaagcttctgttgaatttttggatagtgccaaagccagcaaaagaagaatttcggatttcatcgaagtcctaagtaataagcccttcaagttgaagcaaggttttattgatttttgggttccatcttttctatttataaagagagatgaatatgccttgttcaacgagaagatatatacgccgacaattaatgaggatattttggaactgattgcaaaggttccaaaagattttgaagtgaaatcatttgcgctagaaggtgttaaactggatatctttaacagctatcgtaaatttttaaatattgattcaaataataatggcagcgcgcagacctttattgaaacgatcaagccttttctagtattttatagggcactgccggactattcaaaggaaaccaagcgtttgtccaaagaaagtctggcaatcagagaagcaatagcgaactcgaaggatcccgagcagtctttctttgaagattttcctactgcattaggctattcggtttccaaaatacagaaggacaggtcagaattgcagcactttatcattcagcttcaggactcaatcaaagaaattcgaaattgttttgatgaattggtaaaccgatttgaatcatttcttcaagacaaatattttgaccaaccgctagcttttgaggattatcaagcaaaatttcaaaaaagatataagaatctacatcgtcatttgcttttaaattcacagaaatcctttgttcagcgtttagattctcaaattgaagataaaaaggcgtggctcaattctttagcccaatctctgatgggcaaatcgcttgagaaatttaaagacgaggacgaacttttgctttatgacaaattttcagatatgattttaagcctggacagtctgaatcgtatttcaatggtcaagttcaatgaagaaaaagaaattgccatcgatttgcagataaattcatttggagaaggcatgaccaataagatcatccgactgcctaagggcaagaccaaagatgtgaatgtcttggaagaaaaaataaaagagatgttgtcgaaagataaaagtattgatttggccgctgtaactgccgttttaaaaagcctattataa

SEQ ID NO: 351 - DNA, 3468 bp, Sphingomonas wittichii RW1
atgcctaagtcccccgtcgcaatcgccagcctgtttcatgttcctggacgcttcgtgcgctcggtccagctcgagcgcgattttgcggatcccgcggcgcttgacgattatatcgcgaccccggcaatcgcacaggcgttcgcgcgcatcaccgagggcctgcgcccggcgtcgggtcgccgcgcctggcgcatcactggtgactatggcgtgggcaaatcgtcctttgcactggtcgtcgcccagatgcttgcccgccgaaacgacgagaatgtcgcgcgtatcggccgaggcctgggatgggacgcggcgggcgacaatgttccccgcttttggtcaatccttctaaccggtagccgcggccccatcgtgccgaacctggcgcgtgcgatcagcgatgcggtggaggcgcgccgacccgcgcgcgggaaagtgccacgcgctcacagtgcaataatgacggaggcggcagcggtagcccagtccggtgacgccggcgcgctcgaggcactggttgcgagttttcgggcgctggcggctgagcagggcgagggcgtcctcctcgttatcgacgagctcggcaagtttctcgaacatgtcgcacagaatgacggcaaccaggatgtgttcatcctccagcggctcgctgaagcagcatcgcgcagcggcaagcagccttttgtgctggtgaccatgctgcatcagggtttccatgcctatgcggaaaaactgcccatggcctcgcgcaatgaatgggagaaggtcgcgggccggttcgaggaaatcgttttcgatcagccgctcgcccatatggcggcgctggtggcaggtgcgcttcgcgtcgaaaccgctaagctcccggccccgctccgttcggccgcctcgggcatcgcttcggcgactgccgacatgggatggctggcagggggcacggtgagcgccgcggacctggatatcacccgtctctatccgttgcatccgacgatcctgccggtgcttgtgcgattttttgcccgcttcggtcagcacgagcggtcgctgttcggctttctcctgtcgaatgagccgttcggtctgcagagcttttccgcccagtctgtggcggccgactgctggtatcggctcgacgacctctatgattacgtgcgggcgtgctttggccatcggcttgccggtgcgagctaccggtcgcactggctccggatcgttgagacgatcgattcagtggtcgatgcatccgcactggaactgcgtcttctcaaggcgattgctctgctcaacctgatcgatgcggaggatcttctgcccacggacagggctcttgcggctgccttttcgcctgcgtgcgaggccgaggtgggcaaggctctgtcatcgctgcaggcccagggcgccatcttccgtcgaggtatcgccggcggttatcgcctctggccgaatgccagcgtcaacctggaagttgcgctcgaaaccgcagcgcgctccgtcggcgagatccggtctgttgctggcgccctgatcccgcatttgtcgactgacccgatcatggctcgccgacactatctcgagaccggcactttgcgctatttcgagatcggcttctgcgctgcggaagatcttggcgaagctctgtgccgcgaacataaggccgacggcttgctgttcgttgcgctggctgatgatcaggcgggggccgatcaggctgcgaccgtcgcatactcgaaggcggctgccgagcggtccgatatcgtcctctgtataccgccgccggtcgcgggattggccggtgagttgcgcgatctgtcgctctggacctgggtggcgcaaaatacccccgagcttgcggaggacacgtttgcagccgccgaagtggcgcgccaggtcgccgccgcgcggcgtgctctgctgacgcgtgccgagcagctgatcgggatgcgccatgcgagcctgggttcgcagtgcatctggaagggtgccgatgtccctggcgccagtcgtcgtcgcggcatgtcgtcggcgttgtcggctatctgcgacgaactgttcggcaaggccccccggatcaccaacgagcttctcaatcgtaatgcgctcagcacacctgccgcagcggcgcgtatgcggctcatcgagcggctctaccagtcggcagaggcgcccgacctgggaatggacccggacaaggcgcccccggagaagtcgatctacctctccgttctcaaggcgggcggcattcacgtcgcgacggacgaggggtttggcgtgacgctgccttcgtcggatgatccgctccagctggcgccagccctggaagaactgcgcacgcgtatcgaagctggacagggcgaccgtgttggcgtggtcgaccttttccagcatctgcgtcggccgccctacggcgtccgggatggcgtcgcaccgctcctgctggcgatcttgctgcggaccaatgcgcatgagctcgccgtctatgagcatggtacgttcctgcacagatttggcccatcggatttccagcggctgataaaaggcccgcactatttcgagatccagcactgccgcgtctctggtgttcgtctggaggtcttcgacgcgctggtatcgactttcgccaaggaggtgcagggcaagtcggtcgatctgctcgacgtcgtgcggccgctttgccaattcgccgcacagttgccgccttacagccagaaatcgactggcctcagtcctgctgcgctgggtgttcgtgacgcgctgctgaccgcgcgggagccgatcacccttctcttccgcgatttgccggtcgcctgtggttttgccgcattcgaggaggggttgggaggcgacaccgtgcgcgccttcgcgtcgcgccttcaggatgcgatcgacgagctgcgccagacctatgacgcgttgttgcagcggatcatggaccggattgcagcggcgctcgaccagaccgagggctttgatcgtgtgacgctggcgtcgcgagcctcccgcgtatccctggtggcgcgtgagccgcgcctgcgtactttcgccctgcgcctgcgagacccggggctttcggataccgcttgggccgaggcgcttgcgagctatgtcgtggcgaagccgccttcgaagtggctcgcggcggacgaggcgcgttttgctgaagaggctgggactcttgccgagcatttccgcaagaccgaagcggcagcgttcgcccacgccgacatggcgccacaagccgatgcggtgcgcgtgaacctgacccggggcgacggcgaggatctggtgtgcatcgtcgagccgggcgaagatgaggatcttcgccagcaggcagagctgctcagcggtcgcctccccaaggatgcccagctgcgccgccgcctgctggctgatctcatgtggcgggaattgcaggctgaagccggagaagcgaaggtcagcaaaccgacaggcgcgacccggcgaggtgccgcatga

SEQ ID NO: 352 - DNA, 3234 bp, Alteromonas macleodii  Deep ecotype
atgataacgataaagcaaaattataaaagttctacaaggattgacggcttagtagatccaaagcaatttatagacaatattgttttgcatggtacagcgttgagtacgttggatacgttaggaaaggaagtaaacaacactaatcagcgttgcttcaccctaaccggaacatatggaacgggtaaatctacgtttgctctatttatgtcgctattattgtctgcagataaaaaagtgagaagcctagctagtaaaaagctgctagcagcacaagctgatagtactttcattaaagacttcaaggtaaaaaaaggctggaaagttgtaaaacatgtatgtggcttgggcgctcctgcagagggtttagcaaatagtgttttaagtaccttacaaggtaacgtggcaccgtctggcgaagacgataatttctatgtcgagcttattaaatccgcactaaactcgcaagatgaagacgctgatggtgttttgattttactagatgagatgggtaaagccctagattatcaatctcgagaaaacaaagacctgcacttctttcaagagttagcagacgctattgagaaaagtaataaaccagtggtcctaataggctttcttcatcagtcatttgctgaatatgcacgctctatgacatctcatattcagcgggagtggggtaaagtacaaggtcgctatagagatattgcttattcgccgtcaattgatgagtcgttaattctcatcggtgaaacagtaaaagcggataatgatttaaagcaaagaatagaacgtaagtatgctcgtttagttgatgtcgtagccaaatatttggggcgagaaaagaatatcactaactcgttaaaaaacgcattacctatcgatccggtggtgagtctactattagggcctatatccaaacgctcattttcacaaaatgagaggagcctttttggtttcttagcgtctagtgagaagcttagttttaaccaatttattaataccttttatgccgatgatgaatcatcagaagcgctgaaactttataacgccaatcttttttggcagtaccttactactaatctagatcacattatttcatcgagccgagatggcaaaatatggctagaagccaaagatgcgctatacagagcttctctagatggtgaagagctacacgaagcgataacgaaaacagtcgcattaatcacgatgtttggttatcaatatcaattgtttgcttcgcgagagttcttaataagttacttcgagcagcttggctacaaagctaaaaatgtaaccaatgcactagaagaattagaaagctggaaagttctgatatatcgcgacctacatcaggcactgactatatttcaaggcagtgatattgacgttaacgaaattattacctcgacagtagatgccatcaaagatggtgtcgattgggtttcggaagttagctcaactaaacacatattagcttcggcgcattatcatcgaaagggcacgcttagatgggctgatgtccaattgataaatgagcgtagtgttaatttaatagcatcgaaggcaaaaagctctgcggagaacgctgcgtttgtaaacttttacgttcctacgtcaaaggccgccttagaattactaaaaaaagtagctgcaaagcagtcgcaagtagtttttagcgaaagtatagcgccagagaatttaagaacgcttgcaatcgaacaaattgcgttaagaaatataaaagagactaataaaaccttagtgcatgacaaaattgcgagagaagaagtagagagcaggcttcaggctaatgagcgtgcactggagaatgaattagatttattattcaataaatcgcaatggcactatgaagggcgccaatattctgatgttagtcttagcacgatagtttcagctttagctgatgagatctacagtgagtcacctgtaataattaacgagctagtcaatagaaataagccttcaggtagtgcaaacgcagcaattaagaagcttgtattggcaatggccgagaactacggcgaagaattacttggcttcccaagcgacacctttccagctgaaaaggggctctacttttcttgcttagcaaactttggaattcattgcgcaatcgataatggctggggttacccaactgagattgaaaatagcgacgtagataaccttttccgaaaaactcacgaaacgttaatagctgatactaacgctcctgtctggttatcagaaatagatgaatattgggctgctgcaccttacgggctgacaaaaggaattcgcgcaatttggctaatggcttttgtgatgaagcatatgaaagactacgctttctacgataaaaatgacgctactggcgaaattatttttattacgcaacccgatgatgaatttgctttgaagctaattcagaaaccacataatgtagcagttcaggctatacacatagatcaagagaaaaccgcttacctcaataaggtcgcggaagcattagacagcgtaacgaaccacgaacacgactattctaaggacgttacgccactaaacgtagcagaaggactggtaactttttactcttcgttatccagttacacagttgctacaaagaacgtaactaaaaaggctaggaagtttctagaaataacgaaaaaggcgtctgaccccaatgcttacttattcaaggctttacctgaattattagaaactgacttagatagtatttctgtacaggacgttgaagatattttacgtactcttaagaacgcacatggtgagctgctcagtaacttcaaaaaaacaactgaaaaagcgctgggaaatgatttaatcgcaaaaagtacctgcaccgcggtagttgattttactgatgatcataagctcaagtcttttgcacagcgtttaagcgagagaaaagaaaacgataaccgatgggtttcaaacttgatatcgttgctatcatctaaatcggaaaggaattgggatgaccttgccattaaacgtgcacaagtagcactgccagaattagttgagaaatttaagattgcagcgcatcgcgcaaagtttagtggtttagacttcgctgagattgaaaaagaattcaatgaacagatacaagggattacaagttcacttgaagggttagacagtgagaagaagaaaacgctattagttgcgcttctcgatgagttagaaaatggagctgtaaaaagttga

SEQ ID NO: 353 - DNA, 2655 bp, Thauera sp. MZ1T
atgaacgctcacaacaccaagaaactctccgagctcgttcggattcgccggcaataccaacgctccatccgtctggacgccgatctcgggcgcatggacgcgctcgacggctacgtatgccacaagacagccgctgatgtgcttgacgccatggcgaagcaaatcagcgggagtaatcaacgggccttcacgtggaccggcccgtttggaggcggcaaatcttcgctcgccattgctctggcgtcagctctcggtcccgacaaagaccttcgggcaaaagctcgggacgtcttgcgcttggactcccatccgaatttcgacgaagccctccccgtaagacgcggctggctcgttcttccggttgtcggccggcgagggttcgtctccgaggaaatctcgaagacgctcaatcacgcgctcggatcaaacacggcccccggctcggctgcggaagtcgtcgtggatctgtgctcggcggcggccgacgagcgatacgacggcgtcttgctcgtcatcgacgaaatgggcaagttcctcgaagccgcggtcctcggcctcggcgacgacgtctacttctttcaggacctggctgaatcggcggcccgagcccaaggcaagatcgtcgtggtcggcgttctgcatcaatccttccggcagtatgcctcccgcttggggagcgagtcccgcgacgactgggcgaaggtccaaggccgctacgcggacatccctttggtcgcggcaagcgacgaggttgtggagctgatcggccgcgcggtcgaaacggacgcccgtcccaaatccaatcgagccgacgccagagccatcgcctcctcgatggcggctcggcggcccgccatcggcgtggaagccttcgccgaaagcttggacgcatgctggccgttgcaccccgcgatggcggccctcctcggcccggtatcccgtcggcaatttggccagaacgaacgcagcacctttggcttcctcggatccgtggagcctcacgggtttcgctcctttctcaaagagcagaccctatccgacgaatgccgataccgcccggaccattactgggattacctccgggtcaaccttgaaccggcgattctttcctcgcccgacggccatcgctgggcgcaggctgcggacgccgttgagcggactgaggcgcatcacagtcctcttcactccgccctgatcaagaacatcgccgtaatcgacctgcttcgcagcgcctccggcttggccgccgactctaatgttttgcgctcgcttttcccggagacgctcggcaaggaagttgacgcggcgttggagcagctttcaaagtggcgcgtcgcgatctacaaaaaacatctcggcgcttggtcgattttcgaaggcagcgacttcgacatcgaaaaagccttggcccaagccaagtcgacccttccgggcatcgacttctcggtcttgacgagtctcgccaacctctaccctgcgatcgccaagcggcactatcacaagaccgggacgctccgttggatggatgtagctttgtgccgcctcgaagacgccgaagggattgcctccaacttcactcctaagaaaggcgagttcggcctcttcttgttggcgcttccgtccaaggacgtccggctggaggccgcagttgacgcctgcgaaaagatcgcccgcagccgcccttggccggtggtcgtcggcatcccgccaaactacgcccggatcgaagagcttagcttggagctagtttgcttgcagtccgtgcaaggccggccggagctcgaaggcgaccaaatcgggaagcgcgaagttaccgcccgaatttcagccgcacgctcggccctggaagaacagcttcgctctgccgtgacccgagcgatctggaccgtagcagaacgaacctaccggcccggaacaccgatcgcccgctgcgcctcggatctggcggacgacctttaccgggactcacctcgcctttggagcgagctgatcaaccgcgacgccccttcgagcgcgagcgtcaaagcccgacgcgacttgattcatgcgatgctggaaaccgagcatctggaaaacctcggatttgaagccttcccggcggagcgcgggctctatgagtccctgttgaaagggacagggctgcatcgcaaggacgagggctcggatgcttggcgctttcagccgccggatgagcggcgcggagcgaccctaatccgcttgtgggacgaaacccgcaaactgttctccgacgcctccaaacgcgtggaggccgttcaaatcgacaagctgtgggccggcgagccttttggaattcgctcgggggtcaggcccatcctgatgacggcgttccttttggctcacaagggaaacctcgcggtttacaaggacggcatgttcatccccagcttgaacgacgccgacctcgacgagtatttgcaggacgagaagcgcttttcattccgttgggtggtcgtcgacgacgagaagacccgaatcctctccgggatctcgaatcttctggcgtcaatcggcgccgcggctccggccagcgatccgttggaagcggccaaaggcttggtcgccttggttttccgccttcccaattggacgaagcgaactgcgaccctatcgcccgaagcccgggaagtggggtag

SEQ ID NO: 354 - DNA, 2931 bp, Methylobacterium nodulans ORS 2060
atgagcaaggcccgaagcttcttccgggcagtgaaccttgaatccgacatcgaggtccctgacaggctttcccactaccaaccgacaacccggtcccttcccattatcgaggcggtgcttggccgcgatccgacgctcgtcatcgcggcctatggcagcggcaagtcgctcgctgcgggggtgggagcgctgatcgcgatcaatgacccacgctcccgcgacgccgtcaaatgtatcctcccgaaggtgcagcgcgttgacccggaggctcaccagagattatcgcagcgtttcgccgcgcgcggccaagggcgcgccatcatcttgtccggccacatcgcagacctcgcgcgcgagattggctcggcgctcggcgcacccgagaaactctcgacgctggagcgggtgctgaactgggcgtctgcaaatctcccaagcgcggcgcatctcgcgatagtctgggacgagttcggacgccacctcgaaagccttgtcgccgaaggccgctcccgcgagctggacttcgttcagcgcctcgcagagtgggcagcgcgcgcggaggcgcctaccgcgagcctcaccctactctcgcaccagaacctgttggcctacgcgggcggtctcaaccagacgtcgcgcaatgagtggcgcaagatcgaggggcgcttccggacgctgcggttcgtcgaggacagccgagaactctaccggctcctcgtcgaccgcatcggtgagcgccgcgaaagcgggacgccgccgctggattcccggctgaaaggggctgtcgtccagcgcgcgatggaggcaggttggttcgatggcgcggccgacgtcaacgaggtggcagacctcgtcgagggggcctggccgctctcggccggcgcgctgcaaagtctgccgcgcttagcggcgaggataggccagaacgaacggagcctattctcgtttgtcgaagaggttgatctgtcacgccccgtcggcttcgaggagctctaccgggggttctcggacgcgatgcgttccgatgttggcgccggcggcgctcacaagcgctggattgagacggagagcgcgagggccaaggccgagagcgacgtcgagcgcgaggcgctcgccgcggcatgcctgctgcaactcgggacggatggcgaacgccgcaaactgtcccgcgctgcattggaggtggcggttgcgtcgcgaggcatcccgctcgcggaggccgcgtcggcaatcaacgcgctgatcgggcgaaagctgctcctgcaccggtgcgtcgtcgacgatgtgtcagtgtggcacggcattgacgtggacgtcgccagccgcctggcggaggagcgcgcgaagcgcgccgacgcgttcgacgccgtagccttcctcgcggagcgccgtcccgcgccgatcgtgcgcgcgacgcggcacaacatcgaatacggaacggcccgctacctctgtgggcgctacctcctttcggaggaggtggagctgcaggcggagggatccgccccggatgccgcaccggtgggaccgtggggcgatgtgctctacgtcctcgctgaatccgaagtcgagatcgccaaagcgcggggcgctgcactggcgtccccccgcgagcgaacgctctacgtcatcccttcgcggccgctgcgggtggttgacgccgcgctggaggtcgcttgtctcgaggcccttagggccgacgacaatctgttagcggaggacccgcttgtctcggttgagatcgacgaactgctgtcagtcgcgcgccgccaactcgatctcgccgtgcaccggctgacgagcgaccgtccgacagacgcgaagtggtactacgccggcgccgaactcccagtcacaggcgagcggcctgcaacgatcgtcgcctcggaaatgatgggtgcctggtatccgaagacgccgctcatcgcgaacgaccaacttatgcggcagcgcgtctcgaagcagatgaacaccgcacgcgtgcgcctcctgatgcgtatgacggagtcggcgaagaagccctggatgggctacggccgagacgatacgtccgtcgaggcatcggtgtaccgtacggtgctcgccaacaccggcctccacagggagggtcccgccggcttgtgggggttcgcggaacccgagaaggtgcaggatccgggtctgaagctggcttggacgacggcgaagtcgttctttcaggagccgtccgccgaaccgaagaagttgtcagggctcgtcgcggtgctgaccggtccgccaatcggcgcgccctcgggcgtgatccccgtgatagtgatggcagggtaccaggctttcgcgcgatgcgtgtcgctgcgctccgacggcgcctacgtcgccgatatcctcggcttcgacgcgaaccgcatgttcgccgaccccgagcgccacgaggtggaggtgcacgaggccgacgacgggacgctgctgtacctcgacgaactcgcctacgtgttcgcgcacgccaagaatgatgaggaggtcgaggccctgcgctttgcgcacgacgcgttcgcccaatggtgggccggcctgcccaacggagcgcggcgctcgcatcgcctgtcacagggcgcacaggcgctcctgcgtgcagccgctgaggcatccgatcccgctgccttcttcctgcgcgtgctgcccgacctgttcggcggcgggcgccgcgacttcgacgccgtcgtagcggtggtggaggccgcgcgtgatgagatcgacggactagtggaaggctacctggacgaggcggtgcgcgtcctcggcgaggcgttccggatcggaaacgacaatgccgtacaggggatgcagtcctgggtcgcctgcctcgacgtggactcactcctgactcgcaacgacctgcgcctgaccgacaaggcgatcctcagagtccgttgggaaagggtcatttcatag

SEQ ID NO: 355 - DNA, 3579 bp, Actinosynnema mirum DSM 43827
gtgaccgtcgccgccccgtcgccgccctctagggacacccgcacagccatcccggagttccccgccggcattgcgctggtcggctcccagatgcgctccaccaaccttgagcgcgacgtccgtgatgccctgcagtcgccctacatcggtgcccgggccgtggacgtactggagcgaatcaccagcgcaatcgccgacctgcgacgcacccgcgcctggtcgttcaccggtccttacggctccggcaagtcaaccctgtccaatttgatcgacgccttgctcggccacgatgactcgcggcgcgacgaagcggagcgcattctcaccggcacaagtcccgccctggcgcaacgtctcgccgcagcacgtgcggagcggactaacacgggcttcctcggagccgtggcaacggcacgacgtgaacccctcgtctccaccctggcacgggcgttggagaccgcagcctccaggcgatggggcaagcgtgcccccaaggccattgcgtcggctctcgctaactgctcccatcccgcgaccaccggagcaaagcaaatcatggccgcgatcacggccatgaccgccgagcaaccactgttgttgatcatcgacgagttcggtaaaacgctcgaacacctcgccgggcacagcgagttcgccagtcccgagcacgacctgtttctccttcaagaacttgccgagcactgcgccggccccaacgggctacccgtgtacttgctaaccctgcagcatttgtcctttttggactatgcgtcccggacaagcgacctagagacccgcgagtgggccaagatccagggacgattcgaagacatcaccttccttccgcaccacggcgactccctgcaactgctacgccgacggctcgaccactctgccgtcagtccggccggcaaagcgctgatccaggtgtgtgcggatgctgcagcccgtgaatggaaagaacatggcctaaacatcctcgccgagctcgacagcaaggatttcgccgacctctatccactgcacccgctgaccgcgatcgccgcacccatcctcgccgctcagatcggccagcacgaccgcagcctgtcaggattcctcaacagtggcgagcccaacactgtccgcgacgccctgaccgcccactcccggaccgacgctgaacgcgccagcaccgtacgacttccacagctgtacgattacttcctcaatgccggtcgcacctccctgctcgcatccccgaacgcgagccgctggatcgaaatcgacgcacgcatcagggacgccaatgggcttccagactctgaccaggacttgctgaaaaccattggtgtgctgaacctgatcgacgccgatggcgccctcagtgccaccaacgaaatgatccatttcgctctgcgtgacccagatgatctcgtcgacgcagccgcgtacgccgccctggaagaacagattgccgatctcgttcggcgaggcttcctcgtctaccgcgaattcagcggtgagtaccgcttgtggcagggcaccgacgtcgacatcgacgggcggctcaaggagatcaccagtcatctcgacgaagcgtcggtgattcagcggttgagcgcctatgtcccctcttcagttgtcgcgggccgccacagccaggtgactgggatgctgcgcgtgttcgttaccgccgtcagcggaccggagacgagccacgtcgacgcgcccgacgagatgaccgaaccggccgacggtctcgtggtcttccacctcggcacttcgacgaagcgacccgtcgtggactcgacactgcccgtcgtgttcggtacaaccctcaaccctgacatcgtgctcagcgcggccacgcatctcgttgcactcaaagagctccagcagcaggcgctcgatcatgtagcactcagggaagtcacggatcgtgccgtccaggccgaagccacattccgagagatcttccaagcggcgttctacccaccggcgactgacgccacctggagtacgtggcatgcaggcctgcctgcagatcaagatcccaacaccgcccaactgatggcgcgcagcctgagcggcctcgtgtcacaggtgtgtgacgaggtctactcgcagacgccacatatccgcaacgagatgcttggccggcatgcgctcaccagccaggccgcccgagcacgcagcgatctcctcgacgcgatgttgacttcctcgggtaagcaggaccttggcttccccaccgacaaatatggtcctgagcgtgccatgtatcgcggcgtgctggcctatctcggcctgcaccggcagaacggcgcagttcaggcggaacagaccagcgacagccttttcccgtacggcttctcggcaccaggcgacaaagatccggagaggtacgccaagccggtgtgggaggcgctgcagcaggccctcaccgaggcaaccgaacgtacctcgctcgatcatgtcgttcgcgtcgtgatgagcccgccgttcggtgtgaaggccggtgtctggcccctgctcgtcgttaccgcactgctgatcaggaggcacgatgtagcgctgttcgaggaagggacgtaccttccgcggctgacccaagacatcgtcgaacgtctggagaaggtaccgagccgcttccaggtcaagtacacgccggtcagctccgggcagcgcgccagtgttgtcaagaagctcctggtatcactcaaggttgagcccgcgcgatcgcaggcgttgcgcaacccagacatgctgtcggtcacccgtgcgctgctggaacgcgtcatggttctcaacaagtacgcacgacagaccaagcagatctcgtccgacgcactcgccgtgcgtaaggcgctggtcggatcccaagatccggacgatttgctcttcaaggcccttcccaaagcactcggtcgtgggccaatcggtccggctgcccgagcggacgctgcggccgttgatgagtacgtcaccaggctgaccgcggctgtcgacgagatcgctgccatcgacagcaaactccgcgccaaggttgttgagaccctggcacacgagttccgtcttcccagcgagttgcacgaactgcgttccactcttgccgcacgcctccgtggcttcgccgacgttgcactgagtgcggagctgaagggcttcgtcgactttgtactcagtgacagtttgtccgacgaggactggcttgacccgatcgttgttcgcctgaccaacagcgctctcggtgactgggatgatcgtgaagccgcgatgttcccccgccgcgcacgcgagatggccgcagcactggatcgagtcggtcacctgcaccgcacgaccgatgcaagcgctcaggaagaaaacctagaggcgcagctgttgaccttgacggacaaggcaggtgtcgagcagcgcacactgatctacatgcccgcgcgcagccgcgcaaaggccgagaacctcgcggcagacgccttgaagagggccgagaaggcactcgggcccgacggcgcgcggatcttgctcgccgcactcgcacagcgagtggccgaggcgacgaccgtcgcaccagagacgaaggagcaggcatga

SEQ ID NO: 356 - DNA, 600 bp, Mesoplasma florum L1
atgaaaaaagtattagtaattaattcaagtgtttctcaattaaacaattcagattcattagcaatgtcaaacatgtttattgaagaatataaaaaaatgaatccaaatgatgaaatcattaatctagatttaaatgagactaaaatgtcacaaaaaacattaacaagaaataatatcgctgaatatttcaatcaagaagattcatttgattttatagaacaattaaaatcagttgacaaaatagttttaaatttttcaatggttaactgaggtataccagctatattaaaaaactatatagatcatataacaattgcaaaccttacttttacatataagggctcaacagatggtaatgcaatagggttactttcaaatatacaggatgttcaaattttagcaacaaaaggtggaactggaactccaaactcagcatttacagaatatgtaaaaaacatttgagaatttttaggtgctaaggtaaaaagcgaaatcatcattaacgaaatgatggatataccaccttatgcagaacaatctccaattgagaatttagaaaaagtaaaagaacaaattttaaaagctgctaaaaacttttaa

SEQ ID NO: 357 - DNA, 621 bp, Burkholderia 383
atgagccgcatcctgttgatcacctccagcccccgcagcaccgacagcctgtccacgcgcttcgcgcacgacctcgcgcgacaactcgcggcgcgcgacgcagccggcgccgtcacgctgcgcgacctatccaacgatccgctgccgcatatcgatgacgcatacatcgtcggccgcatgctgccgtcggacgcgcgcagcgcggagcaggcgcaagccgtcgagctggcgcaagcgctcgtcgacgaactgcgcgccgccgacatcgtcgtgatcggctccgcgatgaccaacttcggcccgtccacgcagctgcgcgcgtggttcgaccgcgtgatctggccgcaggtcacgtttcgctatggcgaaagcggcgtcgccggcacgctggaaggcaagcaggtctatctggtgaccgccagcggcggcatcttttcggaaggcccgtatgcgcccttcgactaccagtccggttatctgaagcatctgctcggcttcatcgggatgaccgacatccgcgaagtgcgcgtggaaggcaccgtgttgggtgccgaggcggtgcaggcggcgatcgcgaaagccgggcaggaactgcaggcgctggtggaacaggccggttga

SEQ ID NO: 358 - DNA, 609 bp, Rhodopseudomonas palustris BisB18
atgaaactgctccatatcgactccagcgtgctcgggccgcattcggtcagccgccaggtctccgccgccatcgtcgcccggctgcgcgaggtcaatcctggcgcggcggtcacctatcgcgaccttggcgccagcccgcttgcgcacctgtccggcgcgcatctggcggtcgcccaaggtgcggtgcccgcgccggagctgcaggacgatctcgccgctggagcggccgtgctggaggaattcctggccgccgataccgtggtgatcggcgcgccgatgtacaacttcaccatcccgacccagctcaaggcctggatcgaccgcatcctggtggccggcaagactttcagttacagcggcggcacggtgcagggcctggcggccggcaagcgggtgatcatcgcgatatcgcgcggcgggttttacggccccgatacgccgatggcggtcggcgaacacctggaaagctatctgcgcttcgtgttcggatttatcggaattaccgagccggacatcatcgcggcggacggcatcaaattcagcccggaacatcgcgaaaaggcgatcgcatcggcgctgtcggccgtcaccgccctgcgcgcggcctga

SEQ ID NO: 359 - DNA, 549 bp, Paracoccus denitrificans PD1222
gtgaccatcctgcatatcgacagcagcatcaccggcgagaacagcgtcagccgcatcgtcagccaggcgatcatcgaccggctggccgaggcgcagcccggcatccccgtcattcgccgcgatcttgccagcgcgccgctgccgcacctgacgctggatgcgcttggcgacacttcggtgctggacgagttcctggccgccgatacggtggtgatcggcgcgccgatgtataacttcaccctgcccagccagctcaaggcatggatcgaccgcatcgtcgttgccggcaagaccttccgctataccgccgaagggccggaggggctggccaagggcaagcgcgtgatcgtcgccctggcgcgcggcggtttttacagcgacgaggccaggatcgcgctggagcatctggaaagctatctgcgctcggtctttgccttcatcggcatcgaggccgaattcgtgatggccgatggcgtgagcatcggtcccgaacagcgccaggccgccatcgaccaggcgcttggccagacccggcagcttgccgcctga

SEQ ID NO: 360 - DNA, 597 bp, Sphingomonas wittichii RW1
atggatagtcccctcatgaaactcctccacctcgattcctcgatccagggcgatgcctcggccagccggcacctgtcggcggcggtggtcgaccgcctccaggcgctgcatccggcgctcgacatcgcctatcgcgacctcgccgccgatccgctaccgcacatcgtgccggccggcttcgccacccccgaggccgccgctttgctcgaccagttcctcgcggccgacatattggtgatcggcgcgccgatgtacaatttcggcctgccgagccagctcaaggcctggttcgaccatatcctcgtcgccggcaggaccttccgctacaccgaggccggcgccgaaggcctggccggcggcaagcgcgcgatcgtcgcgctgtcgcgcggcggcttctattcggagggccaccccggcgccgccttcgaacatgcccagagccatatcggcgggatgctcggcttcatcggcatccagcccgaattcgtcgtcgcggagggcgtcgccttcggccccgagcagcgcgccgccgcgatcgccgccgccgaggcgcatatcgccacgctcgaacccgtcgcgctgcggaccgccgcctga

SEQ ID NO: 361 - DNA, 612 bp, Methylobacterium extorquens PA1
atgaagctccttcacgtcgacggcagcatcctggggccgcattccgtcagccggaccgtctccgccgccatcgtggaccgcttgcgggcgcagcatcccggtctcgacgtcatctaccgcgacctcgccgggacgccgttgccgcacctctcgggcgcggtcctcgccggggcgcagcccaacgccacgaatacgcccgacgtgcagcacgacgtcgaacttggccggcaggtgctggaggagtttctggcagccgaaatcgtggtgatcggcgcgccgctctataatttcaccctgtcgagccagctcaaagcctggatcgaccgcatcctcgtggcgggtgtcaccttccgctacgggccgtccggggccgagggcctcgccggcggcaagcgggttatcgccgtcgtctcgcgcggcggcctctacgggccgggcacgcccgccgcggcggccgagcacgcggagacctatctgcgcacggtgctcgccttcatcggcatcaccgcgccggaggtcatcgtcgccgagggcattgccctgggcccggaggcccgcgagcgggctctggccggcgccctcgacgccgcggcggctctcaaggccgcctga

SEQ ID NO: 362 - DNA, 612 bp, Methylobacterium populi BJ001
atgaagctccttcacgtcgacggcagcatcctggggccgcattccgtcagccggaccgtctcggcggccatcgtggaccgcctgcgggcgcagcatcccgatctcgacgtcgcctaccgcgatctcgcccagacgccgctgccgcatctctccggcgcggtcctcgccggggcgcagcccaacgcgacgaacgcgcccgatgtgcagcacgacgtcgatctcggccggcaggcgctggacgaattcctcgcggccgatgtcgtggtgatcggcgcgccgctctacaatttcaccctgtcgagccagctcaaggcctggatcgaccgcatcctcgtggcgggcgtcaccttccgctacgggccgtccggggccgagggcctcgcgggcggcaagcgcgtcatcgccgtcgtctcgcgcggcggcctttacgggccgggcacgcccgccgctgcggccgagcacgcggaaacgtacttgcgcacggtgctcgccttcatcggcatcaccgcgccggagatcatcgtcgccgagggcatcgcccttggcccagaggcccgcgagcgggctctggccggcgcactcgacgccgcggcggcgctgaaggccgcctga

SEQ ID NO: 363 - DNA, 606 bp, Gluconacetobacter diazotrophicus PAl 5 JGI
atgaaactcctgcatctcgacgccagcatcctgcccgaggacagttcggtcagccgcacgctgtccgccgccgtcgtggcgcatgtccgggccttgcagccggacctgaccgtgacgcggcgcgacctggtggcccacccgctgtcgcacatgacgctggccaacctgccacccgaccacccggcctcggtccccggcaacgaggtcgagcgcgccgagagccaggccgtgctggaggagttcctgaccgccgatatcgtggtcatcggcgcgccgatgtataatttcaccatccccacgcagctcaagagctggctcgaccgcgtcctggtcccgggccggaccttcaaatacggccccgagggcgtgaagggtctggtggaaggaaagcgcgtgatcgtggcgctgtcgcgcggcagcttctacggccaggaaacgccctacgccacggcggaacacacggaaacctacctgcgcaccgcgctgggcttcatcggcatcgccaccccggaggtcatcgtggccgaaggcgtcagccgtggagaagaccagcgcgccgccgccatcgaagccgcccaccaaacggtcgcggcactgcgcgtctga

SEQ ID NO: 364 - DNA, 615 bp, Methylocella silvestris BL2
atgaaacttctgcacatcgattccagcatcctcggcgatcattccgtcagccgccagttgaccgcagccatcatcgcgaggctgcaagaagtcacgcctgacctcgacgtctcgcatcgcgatctcgccgcaaatccgctgtcgcatctgtccggcgcgctcctcgccgcaagcgcgcccggcgcgcccgcgccagatccctcgacgcaggccgccctcggcgagagcgccgcgattctggcggagtttcttgccgccgacatcgtcgtcgtcggcgcgccaatgtataatttcgcgatttcgagccagctcaaagcctggatcgacaggctggtgattgccggcaagacgtttcgctatgccgatggcgcggttgaaggattggccggcggccggcgcttgatcatcgcctcctcgcgcggcggcgttttcgaggcgggcgcggccgccgctgcgctcgactaccaggagacttatctgcgcgcgattttcggcttcatcggcatcgcggatgtcgaaatcatccgggccgagggcctcgcttttggcgaagacgcccgcgccttggcgatcaaacaggcgggagacgcaattttgcggcttgaggccgcctga

SEQ ID NO: 365 - DNA, 612 bp, Methylobacterium chloromethanicum CM4
atgaagctccttcacgtcgacggcagcatcctggggccgcattccgtcagccggaccgtctccgccgccatcgtggaccgcctgcgggcgcagcatcccggcctcgaggtcatctaccgcgacctcgccgggacgccgctgccgcacctctcgggcgcggtcctcgccggggcgcagcccaacgccacgaatacgcccgacgtgcagcacgacgtcgaactcggccggcaggtgctggaggagtttctggcagccgacatcgtggtgatcggcgccccactctataatttcaccctgtcgagccagctcaaagcctggatcgaccgcatcctcgtggcaggtgtcaccttccgctacgggccgaccggggccgagggcctcgccggcggcaagcgggttatcgccgtcgtctcgcgcggcggcctctacgggccgggcacgcccgccgcggcggccgagcacgcggagacctatctgcgcacggtgctcgccttcatcggcatcaccgcgccggagatcatcgtcgccgagggcatcgccctgggcgcggaggcccgcgagcgggctctggccggcgccctcgacgccgcggcggctctcaaggccgcctga

SEQ ID NO: 366 - DNA, 621 bp, Agrobacterium vitis S4
atgaccatgaaacttctgcatctcgattccagcgtgcttggcccctattccgtcagccgcgacctgtcggcgtcgattgtgaagacactcagcgaaaagaccgctggcctcgacgtcacctaccgcgatctggccgccaatccgcttccgcatctctccggcctgacgctggcggctgccatgggcaattacgatgccagcaatgacgaagccaccaaggccgatctggcgctgggcggcgaagtgctggaacagttcctcacctccgacgtggtcgttatcggcgtcggcttctacaatttcggcattccgagccagctcaaggcctggatcgatcgcatcagcgttgccggcaagaccttcaaatacggcgctaccggtcctgaaggcctgtgcggcggcaagcgggtgatcgttgccatctcgcgcggcggcatctacagccagggccctgcggctccgcttgaacatgccgaaacctatctgaagggcgtcttcaccttcctcggcatcaccgatctggaattcgttgtcgccgaaggcgtcaacatgggcgaagaagccaaggccgctgccgtcaagggcgccaaggattcgatcgcgaccctgaaggccgcttga

SEQ ID NO: 367 - DNA, 669 bp, Catenulispora acidiphila DSM 44928
atggccacgttgctgcgcatcgacgcctcgctgttccccgatgaggccagcgcctcccggtctgtcacctcggccttcaccgacgcctggcgcgcggcccatcccgacggcaccgtcgtccaccgcgacctcgccgccgacccgctgccgcacctggacgtgctcaccgtctccgccggcttcgccgacccgtccgcgcacagcgaggcccaggccgccgcgcacgccgcccggctggcgctgatcgaggaggccgaagccgccgacgcgatcgtgatcggcgcgccgatgtacaacttcgggctcgcctccgggctgaaggcgtggctcgaccacgtcatcctgaacggccgcacctccggtgagggcgcgcgctccctggccggcaagcccgtggtggtcgtcgcctcgcgcggcggctcctacgagcccgggacgccgcgcgagggcatggagtacgtgaagaactacctcggcagcgtcctgtccgagcacctgggcatcacgccggagttcatcaccatccagctcacgctcgcctcggccgtcccggcgatggccgacctgatcccgctggccgagcagtcgcgcgccgaagcgctggagcaggccgacgccaaggcccgcgagctcgcggcgcagctgtcaggggagccggtcgcagcctga

SEQ ID NO: 368 - DNA, 1143 bp, Thermobifida fusca YX
gtgaagttccgggtcgaacgcgacgtgctcgcagacgccgtcgcctggaccgctcgtactctgccggtccgtccgtcggtgcccgtcctcgctggaatgctgctggacgccgacgacgtggacggacaccagcggctcaccctgtccagcttcgactacgaggtctccgcccaggtatcggtcgacgtcgatatcgacgaaccgggacggatcctcgtgtcgggcaagctgctcgccgagatcgtgcgcaaccttcctccacagactgtggaagtcagcactgacggggccaaagtcgtcgtctcctgcggcagcgcgaagttcacgatcctcaccctccctgtggaggactacccgaccctccccgccatgccggcgctgaccggatccgtgctcagcgacaccttcgctgctgccgtcagccaggtggccgtcgccgccggacgcgacgacaccctgcccatgctcaccggggtgcgcatcgagatcgaaggctccaccgtgaccctcgtctccaccgaccgctaccggctggcggtccgggaactcacctggacccccgaggaccccaacgtgtccgcggtcgccctcgtccccgccaaaaccctcgccgacaccgccaagtcgctcaccggcggcgcccagatctccatcgccctgtccaccgcggagaacggcggcgaaggcatgatcggcttcgaaggcggcggccgacgcaccaccacccggctcctggaaggggagttccccaagtaccggaaactcctcccggagtccttcaactcggtggcagaagtccagaagaacgagttcatcgaagccgtcaaacgcgtctcgctggtcgcggaacgcaacacgccgctgcggctgtccttcaccagcgaccgcctggtgctcgaagccggcaccggagaagaagcccaggctgtggaggaactcagcgccaccctggaaggcgacgacatccagatcgccttcaactccaccttcctgctcgacgggctcaacgcgatcgaatcagacgtggcccacctgcagttcacgacctccaccaaaccggccatcatcaccggcaagcccgcagacgacggcaccgcctcggactaccggtacctgatcatgcctgtgcggatctccaactga

SEQ ID NO: 369 - DNA, 1197 bp, Mycobacterium MCS
atggacgtggtgccgacgacggcgggtcacaccgacctgaagttccgcctggtgcgagaggacttcgccgacgcagtggcctgggtggcccgcaatctgccgacccgtccgaccgtccccgtgctggccggcgtgctgctcaccggcgacgacgacgggctgacgatctccggattcgactacgaggtttcggccgaggtgcgtgtcgtggccgaaatcgcttctccgggaagcgttctggtgtcgggacggctgttgtccgatatcaccaaggcgctgcccgccaaacccgtcgacgtcagcgtcgagggcacccgcgtctcgctgacctgcgggagcgcccgcttctcgctgccgaccatggccgtcgaggactaccccgcgctgccgacgctgccggacgagaccggggtgatcggcgccgacctgttcgccgaagccatcggccaggtcgcggtggccgccggccgcgacgacacgctgccgatgctcaccggcatccgcgtcgagatcacaggcgagagtgtggttttggcggcaaccgaccggttccgcctggcggtgcgcgagttgacctggtcgacgagctcgcccgacgtcgaggccgcggtgctggtaccggccaagaccctcgccgaggcggccaaggccggcaccgacgggaccgatgtgcacctggcgctgggcgccggatccgcggtcggcaaagagggcctgctggggattcgcagcgagggcaagcgcagcaccacccgcctgctcgacgcggaattcccgaagttccgccaactgctgcccagtgagcacaccgcggtcgcgacgatcggcgtcgccgaactcaccgaggcgatcaagcgtgtcgcgctggtggccgaccgcggcgcccaggtgcggatggaattcgccgacgacgtgttgcggttgtccgccggcgccgacgacgtcggacgcgccgaggaggacctggccgtcgcgttctccggtgagccgctcaccatcgccttcaacccgacatatctcaccgacggcctcggctcgctgcattccgagcgggtgacgttcggcttcacgacgcccagccggcccgcggtcctccgcccggcgggcgacgaggacaccggcggtggcgccggaccgttcccggccctgcagaccgattacgtttacctgttgatgccggtacggcttcccggctga

SEQ ID NO: 370 - DNA, 1125 bp, Arthrobacter FB24
gtgaagttcagagtcgaacgggacgtcctggcagaagccgtcacatggaccgcccggtcgttgtctccgcggcctccggttccggtgctttccgggctcctcctcaaggccgaagcaggcaccgtcagcctctcgagctttgactacgaaacgtcggcccgccttgaaataccggcagacatcagcgttgaaggcaccattctggtttcgggccgcctgctcgcggacatctgccgcagcctgccatctgccccggttgacgtcgagaccgacggcaacaaagtcacgctcacctgccgccgcagtagcttccacctggccaccatgcccgaagccgaatacccgccgctgccggcgttgcccaccatcagcggaaccgtcccgggcgattcctttgcgcaggctgtctcccaggtgatcatcgccgcgagcaaggacgacaccctgccgatcctcactggcgtccggatggaaatcgaagacgacctcatcaccctgctggccacagaccgctaccgtctggccatgcgcgaggtaccttggaaacctgtcaccccgggaatctccaccagcgccctggtcaaggccaaaaccctgaacgaagttgcaaaaacgcttggcaacagcggtgacatcaacctcgccctggccgacgacgacagccggctcatcggcttcgaaagcggcggacgcaccaccacgtccctccttgtggatggcgactaccccaagatccgttcactgttcccggatgccaccccgatccacgccaccgtgcagactcaggaactggtcgaggctgtccggcgcgtctccctggtcgccgaacggaacacgcctgtccgcctggccttcaccgacggccagctccacttggacgccggcaccggcgaagatgcgcaggcttcggaagaacttgaggcccagctgacgggcgacgaaatcacggttgcgttcaacccgcactacctgattgagggcctgagcgtcatcgaaaccaagttcgtgcgcttttccttcaccacggcacccaagcccgccatgatcacggcgcaggtcgacgccgacggcgaagaccaggacgactaccgttacctggtcatgccggtgcgcctgcccaactag

SEQ ID NO: 371 - DNA, 1227 bp, Nocardioides JS614
atgcagagcccagaacgtgcacttctcccacccccgttcaacccccgctcaaccctcgctccaccgagccgacccgaaggaaccatcgtgaagttccgcgtcgagcgcgacgtgctcgccgatgccgtcgcctgggctgcccgcagcctcccggtccgtcccagcgtccccgtcctcgccggcctgctcgtcgaggcgagcgacgacggcctggtgctctccaccttcgactacgagacctccgcccgggccaccctgacggccgaggtgagcgacgaggggcaggccctggtcagtggccgactgctcgccgacatctgccggagcctgcccgcgaagcccgtcgagatggtcctcgacggggcccgggtgtcgctgacctgtggctcggcgcggttcagcctgcagacgatgccggttgacgactacccgtccctgccgagcatgcccgcggcgaccggcaccgtgcagagcgaggcctttgcacacgccgtcgcccaggccgtgacggcggcgggtcgcgacgacatgctgcccgtgctcaccggcgtgcggatcgagatcgacggctcgaccatctcgctgctcgccaccgaccggttccgcctctcccaccgggagctggagtggagtccgcggaccccggacgagtcggcggccgccctggtcccggcacgggtcctcggcgacaccgccaagtccctgaccgggggcggcgaggtcacgatcgcgctggcgaccaccggctccggcgagggcatcatcggcttcgagggccatggtcccggcggactgcgtcggaccacgacccggctgctcgacggcgagttcccgaaggtccgcagcctgttcccgaacgagcaccagaccacggcgctggtcgacaaggccgcgctcgtcgagtcggtgaagcgggtggcgctggtcgccgagcgcaacaccgcggtccagctcgccttcagcgacggcgtactgaccctcgacgccgggtcgggcgacgaggcccaggcctcggagtcgatcgaggcgaccatcgacggtgaggacatcaccacgggcttcaacccgcagttcctgctcgacggcctgaccgccatcgaccagccggtggtcgagctcgccttcacccaggcctccaagccggtggtgatcagcggcgcggtcgacggcgacgacaccgactcgtcattccgctacctgctgatgccgcgccgcctgctctcctag

SEQ ID NO: 372 - DNA, 1197 bp, Mycobacterium KMS; identical to SEQ ID NO: 369

SEQ ID NO: 373 - DNA, 1197 bp, Mycobacterium vanbaalenii PYR-1
atgaacgtgccgacaacggctggtctgacggatctgaagttccggctcactcgtgaggacttcgccgacgcagttgcgtgggtggcacgtaatctgccgtctcgcccgaccgtcccggtgctggcaggtgtgctgctcaccggttccgacgagggtctgaccatctccggattcgattacgaggtctccgcggaggtgcagattcctgccgaaatagcttctcctggaagcgttttggtatctgggcggcttctctccgacattgtccgggcattgccggccaagcccgtcgacgtcagtgtggagggcaccagggtgtccttgacctgtggcagcgccaggttctcgctgcctacgatgccggtcgaggattacccgacgctgccgacgctgcccgacgaaaccggggtggtgtcgtcggatctgttcgccgaggccatcggccaggtcgcggtggccgccggccgcgacgacacgttgccgatgctcacaggtatccgcgtcgagatctccggtgagaaggtcgttttggcggccactgaccggttccggctggcggtgcgtgaattgacgtggtcgacgggcgccgccggggtcgaggctgcggtcctcgttccggccaagacgttggccgaggcggccaaggccggtaccgacggcaacgaagtgcatctggcgctgggagccggtccgagtgtcggcaaggagggactgctcggcattcgtagcaagggcaagcgcagcaccacccggctgctggatgccgagttcccgaagttccgccagctgctgcccaccgagcacaccgcgatcgccaccatcggagtcgccgagctcaccgaggcgatcaagcgtgttgcgttggtggccgaccgcggcgcgcaggtacggatggagttcgccgacggtgtgctgcggctgtccgccggagccgacgatgtcgggcgcgccgaggaggatctgcccgtcgagttctccggcgatccgctgaccatcgcattcaacccgacgtatctgaccgacgggctgagctcgctgcacgccgagcgcgtgacattcggcttcaccaccccgagtcgccccgcggtgttgcggccggcggcagaagacgacggcggcgccggaggtagcgggccgttcccggccgctcaaaccgactacgtctacctgttgatgccggttcgccttcccggctga

SEQ ID NO: 374 - DNA, 1197 bp, Mycobacterium JLS
atggacgtggtgccgacgacggcgggtcacaccgacctgaagttccgcctggtgcgagaggacttcgccgacgcagtggcctgggtggcccgcaatctgccgacccgtccgaccgtccccgtgctggccggcgtgctgctcaccggcgacgacgacgggctgacgatctccggattcgactacgaggtttcggccgaggtgcgtgtcgcggccgaaatcgcttctccgggaagcgttctggtgtcgggacggctgttgtccgatatcaccaaggcgctgcccgccaaacccgtcgacgtcagcgtcgagggcacccgcgtctcgctgacctgcgggagcgcccgcttctcgctgccgaccatggccgtcgaggactaccccgcgctgccgacgctgcccgacgagaccggggtgatcggcgccgacctgttcgccgaagccatcggccaggtcgcggtggccgccggccgcgacgacacgctgccgatgctcaccggcatccgcgttgagatcaccggtgagagtgtggttttggcggcaaccgaccggttccgcctggcggtgcgcgagttgacctggtcgacgagctcgcccgacgtcgaggccgcggtgctggtaccggccaagaccctcgccgaggcggccaaggccggcaccgacgggaccgatgtgcacctggcgctgggcgccggatccgcggtcggcaaagagggcctgctggggattcgcagcgagggcaagcgcagcaccacccgcctgctcgacgcggaattcccgaagttccgccaactgctgcccagtgagcacaccgcggtcgcgacgatcggcgtcgccgaactcaccgaggcgatcaagcgtgtcgcgctggtggccgaccgcggcgcccaggtgcggatggaattcgccgacgacgtgttgcggttgtccgccggcgccgacgacgtcggccgcgccgaggaggacctggccgtcgcgttctccggtgagccgctcaccatcgccttcaacccgacgtatctcaccgacggcctcggctcgctgcattccgagcgggtgacgttcggcttcacgacgcccagccggcccgcggtcctccgcccggcgggcgacgaggacaccggcggtggcgccggcccgttcccggccctgcagaccgattacgtttacctgttgatgccggtacggcttcccggctga

SEQ ID NO: 375 - DNA, 1197 bp, Mycobacterium gilvum PYR-GCK
atgaacgtggcgacaacggctggtctgtcggatctgaaattccggctgactcgcgaagacttcgccgacgctgtcgcatgggtcgcgcgcaacctgccctcccgacccaccgtccccgtcctggccggtgtgctgctgaccggatccgacgagggcctcaccgtgtcgggattcgactacgaggtctcggccgaggtgcagatccccgccgaaatcgcttctccgggaagcgttctcgtgtcagggcggttgctctccgacatcgtgcggtcgttgccggccaagccggtggacgtcagcgtcgaaggcactcgcgtgtcgttgacctgcggaagcgcccgcttctcgctgcccaccatggccgtcgaggactaccccaccctgcccaccctgcctgacgagacgggcgtcgtctcggccgatctgttcgccgaggcgatcggccaggtcgcggtcgccgcaggccgcgacgacacgctgccgatgctgacagggatccgggtcgagatctccggcgagaaagtcgttttggccgccaccgacagattccgcctcgcggtgcgcgagctgacctggtcggcgggcgccgccggggtggaagccgcggtgctggttccggcgaagacactcgccgaggccgccaaagccggaacagacggcaccgaagtgcatctggccctcggacagggtcccaccgtcggcaaggaaggtctgctcggcatccgcagcaagggcaagcgcagcaccacccgcctgctcgatgcggagttcccgaagttccgccagctgctgcccaccgaacacaccgccatcgcgaccatcggtgtcgccgagctgaccgaagccatcaagcgcgtggcgctggtcgccgaccgcggtgcgcaggtccggatggaattcgccgacgatgtgctgcgtctttcggccggcgccgacgacgtcggtcgcgccgaggaagatcttcccgtgcagttctccggggacccgctgaccatcgctttcaacccgtcctacctgaccgacggtctggggtcgctgcacgccgagcgggtgacgttcggcttcaccacccccagccgtccggcggttctgcgtccggccggtgatgatgacgggagcgccgcaggtagcggtccgtacccggcagcccagaccgactacgtgtatctgttgatgccggtgcgccttccgggctga

SEQ ID NO: 376 - DNA, 1134 bp, Salinispora tropica CNB-440
atgaagttccgagtagagcgcgacgcgctcgccgaggccgtggcctggaccgcgaaaagcctgccgaaccggccgtcggtgccggtgctcgccggtgtgctgctgcgggtcaccgacggcaacctgcaggtctccggcttcgactacgaggtctccagccaggtgaccgtcgaggtgcagggggacgccgacggcgccaccctggtctccggccggctcctcgccgagatcaccaaggcgctgccggcgaaaccggtcgacatcgcggcggtcggcgctcatctcgaactcgtctgcggcagcgcccgcttcactctgcccaccatgccggtcgaggactaccccaccctcccggagatgccggtcagcgctggcaccatcgacgccgccgcgttcgccgccgccgttgcccaggtagccgtggcagccggccgggacgagaccctgccgatgatgaccggcgtccggctggagctctccggcggcacgttggccatgctcgccaccgatcgctaccgcctcgccctgcgcgagatcgagtggaacccggaagacccggagatcagcctcaacgcgctggtaccggcccgcacgctgcatgacaccgccaaggccctggggccgctcggcggtcaggtaaccatggcgctctcccagggagcggcgggtgagggcatgatcggttttgtcggcggcccccgccgcaccaccagccgactgcttgacggcgccaactacccgccggtgcgctccctcttccccgccacccagaacgcgcaggcccaggtcccggtcagcgcgctcatcgaggtcgtcaagcgggtcgcgctcgtcgccgaacgcaccactccggtgctgctgagcttcagcgacgacggactggtggtcgaggccggtggcaccgaggaggcgcgcgccagcgaggcgatggaggccaccttcagcggtgatccgctgaccatcggcttcaacccccagtacctgatcgacggtctctcgaacatggggacccagttcgccgttctgtcgttcgtcgacgccttcaagccggcggtgatttctcccgtcggcgaggatggcgaggtcgtgcccgggtatcgctacctcatcatgccgatccgcgtttcccgctga

SEQ ID NO: 377 - DNA, 1134 bp, Salinispora arenicola CNS-205
atgaagttccgagtagagcgcgacgcgctcgccgaggccgtggcctggaccgcgaagagcctgccgagccggccgtcggtgccggtgctcgcgggggtgctgctgcgggtctccgacgcgaacctgcaggtctccggcttcgactatgaggtctccagtcaggtgaccgtcgaggtgcagggggatgctgacggcgccgccctggtctccggccggctactcgccgagatcaccaaggccctgccggcgaaaccggtcgacatcgcggcggtcggcgctcacctcgaactggtctgtggcagcgcccggttcactctgcccaccatgccggtggaggactatccgaccctgccggagatgccggtcagcaccggcaccgtcgacgccgccgcgttcgccgccgccgtcgcccaggtggccgtggcggccggccgggacgagacgctgccgatgatgaccggtgtccggctcgagttgtccggcggcacgctggccatgctcgccaccgaccgctaccggctcgccctgcgcgagatggagtggaacccggacgacccggagatcaccctcaacgccctggtgccggcccgcacgctgcacgacaccgccaaggccctggggtcgctcggcggccaggtgaccatggcgctctcccagggcgcggccggcgagggcatgattggtttcgccggaggcacccgccgcaccaccagccggctactcgacggcgccaactacccgccggtccgttctctcttccccgccacgcacaacgcgcaggcccaggtgccggtcagcgcgctcatcgaggtcgtcaagcgggttgcgctggtcgccgaacgcaccactccggtcctgctgagcttcagcggcgacggattggtggtcgaggccggcggcaccgaggaagcccgggccagcgaagcgatggaggccaccttcaccggtgatccgctgactgtcggcttcaacccccagtatctgatcgatggtctctcgaacatggggacccagtccgccgtgctgtcgttcgtcgacgccttcaaaccggcagtgatttccccggtcggtgaggatggcgaggtcgtgcccgggtaccgctacctcatcatgccgatccgcgtctcacgctga

SEQ ID NO: 378 - DNA, 1125 bp, Arthrobacter chlorophenolicus A6
gtgaagttcagagtcgatcgggacgtcctggcagaagccgttacctggacagcccgctcgttgtctccgcggccgccagtgcctgtcctctccggccttctcctcaaggcggaagccggaaccgtcagcctttcgagtttcgattacgagacgtcagcgcgcctcgagatcactgccgacatccgtgacgaaggcaccatcctggtctccggccgccttcttgcggatatctgccgcagcctgccttcggccccggtcgacgtcgaaaccgacggcaacaaggtcaccctcacctgccgccgaagcagcttccacctcgccaccatgcccgaggccgaatacccgcctcttcccgcacttcccgccatcagcggcaccgttcccggtgatgcgtttgcccaggccgtttcccaggtgatcattgccgccagcaaggacgacaccctgcccatcctcaccggggtgcgcatggaaatcgaggacgacctcatcaccctcctggctaccgaccgctaccggctcgcgatgcgcgaggtaccgtggaagcccgtcactcccggcgtctccaccagtgcgctggtcaaggccaaaacactcaacgaagtagccaaaacgctgggcaacagtggcgacatcagcctggcactgtccgatgacgacacccgcctgattggctttgaaagtggagggcgcaccaccacgtccctgctggtggacggcgattacccgaagatccggtcgcttttcccggaatccacgcccatccacgccacggtccaaacccaggaactcgtggaagcagtccgccgtgtgtcgctggtggctgaacgcaacactccggtccgcctggcgtttactgccggtctgctaaacctggatgccggcaccggcgaagacgcccaggcgtccgaggaactcgaagcgcagctgtccggagacgacatcaccgtggcgttcaaccctcactacctggtggaaggcctcagcgtgatcgaaaccaagttcgtgaggttctccttcacctcggcgcccaagcctgccatgatcaccgcccaggctgacgctgacggcgaggaccaggatgattatcgctacctggtgatgccagttcggctccccaactag

SEQ ID NO: 379 - DNA, 1137 bp, Actinosynnema mirum DSM 43827
atgaagatccgcgtcgagcgcgacggtctggccgacgccgtcgcctgggtcgcccgcagcctgccgtccaggccgcccgtcccggtcctcggcggcgtcctgctcgacgcgggtgcggaggacggctccggcgacgcgctgaccgtctccggcttcgactacgaggtctccgcccagtgcggcgtcccggccaccatctccgacggcggcaaggccctcgtctccggcaagctcctggccgacatcaccaaggcgctgccgaaccaccccgtcgagatcaacgtcgacggcgcccggatgaccatcacctgcggcagcgccaagttcagcctgccgaccatgccggtcgaggactacccggcgctgccgtccatgccgcagctcgcgggcgagctccccggcgaggtcttcggcgaggccgtcgcccaggtcgccgtcgcggcgggcaaggacgacacgctcccgatgctcaccggcgtccggctggagatcgccgacggcaagctcgtcctcgtcgccaccgaccggttccggctggccatgcgcgagttcgagtggacccccgacgagacgctcggcgacgtcgccgtcctcgtcccggccaagacgctcaacgactccgcgaagacgctcggcgcgtccggcgcgaagatcgagctgtccctcgccgccaacgacggcctcctcggcctgtccggcaacggccgccgcaccaccacccggctgctcgacgcggacttccccaagtaccgccagctgctgcccagcgagcactccgccgccgcgatcatcagcgtcgacaccctggtccaggcgatcaagcgcgtgtccctggtggccgagcgcggcacgcaggtcaggctggagttcggcgacgccggcctcaagctctcggccggtggggacgacgaggggagcgccgaggaggagctgcccgtcgactaccagggcgacccggtgacgatcgcgttcaacccgacgtacctcctggagggcctccaggccgtgcgcaccccgagggcgcacttgtcgttcaccacacccagcaggccggcactgctcaagcccgtgaacgaggatggggaggtggcggagggctacgtgtacctgctcatgcccgtccgcctgcccggctga

SEQ ID NO: 380 - DNA, 1137 bp, Beutenbergia cavernae DSM 12333
gtgaagttcagggttgaccgagacgtcctggccgacgcggtgacgtggaccgcccggacgttgcccacccggccctccatcccggtgctcgccggcgtgcggatcgaggcagatccgcagggcgcgctccgcttgtcgagcttcgactacgaggtctccgcgctgtcggagatcgcggcggacgtccccgacgccggcacggtgctcgtctccggccggctcctcgccgagatctcgcgggcgctgcccggcaagccggtggacgtcgagctggacggcacgcgggtcgtgctgacgtgcgggtccagccggttcacgttgctgacgatgccgctcgacgactacccgtcgctgccggcgatgccgccggcgtccggcaccgtcgacgccggcacgctggccgaggccgtggcgcaggtgacgatcgccgcgagccgcgacgagacgctcccgctgctcacgggtgtgcgcgtggagatcgagggcgacaagctcacgctcctcgcaaccgaccggtaccggctcgcgatgcgcgaactttcctggaacccggcgtccccgggcctggaggcgacggcgctcgtgcgggcacggaccctctccgaggtcgcgaagtcgctcacgagcgccggcgcggtgagcatctcgctgccgaacggcgacggcaaggatctcgtcgggttcgaggccggcggccgccggacgacgtcgctgctggtcgagggtgactacccgcccgtgcggcggctgttcccggaggccacgacgtcgcacgccgtcgcgtccaccaacgagctcgtcgaggcggcgcggcgcgtgtcgctcgtcgccgagcgcaacacaccgatccgcctgaccttcagcgagggccaggtcgtgctcgaggccggccagggtgacgacgcgcaggcgtccgaggccatcgagtcgacgctgaccggcgagccgatcacgacggcgttcaaccccgggtacctgctcgacgggctcggcgtcgtggggacggagttcacgcgcctgtcgttcacgcacggcacgaagccggccgtgctcaccgggcagccgaagctcgaggacgacgacgccgaccgggacgtgttccgctacctgatccaacccatccgtttcgcgagctga

SEQ ID NO: 381 - DNA, 1137 bp, Kytococcus sedentarius DSM 20547
atggagttccaggttcagcgagatgtgttgtccgaggcggtcgcatgggtcgtgcgcggcctgaccaaccgtccgcccgtcccggtgctcgccggtgtgcggctcgtcgcggacccggccggcacgctgaccctctccgccttcgactacgaggtctccggcgaggtcaccgtggaggccgacgtcgtgaccggtggcgaggccctggtcctgggtcgcctgttgtcggagatctcccggtccctgccggacaagccggtccgcatccagcaggacgggggcaagctgcaggtgacctgtggctccagccgcttcgccctgctggagatgccgctggcggactacccctccctgcccacctcgcccgaggccagcggcaccgtcgacggcgctctgttcaccaaggccgtcgcgcaggtctccgtcgcggccgaccgcagcgatgcactccccatcctcaccggggtgcacgtggagttcgatggcgagcgcatcacgatgctggcgaccgaccggtaccgcatggcccgtcgggagctgacctggacgccccgcgacccctccgcccaccacgtggcactggtgccctcccgcaccctgtcggacaccgccaagagcctgggcgccgtcgggtcggtggacattgccctgggggacgaggcaggcgggaagggcctcatcggcttcgctgccggacagcgccacagcacgacgcgccttctcgatggcgagtacccgaaggtctcgagcatcttccccaccacgagcgacgtggacgcggtcatggagaccagtgccctggtggaggccatcaagcgcgtgtcgctggtggccgagcgcaccaccccggttcgcctgcgtttcacgcccgggtcggtcgccatcgaggcgggcaccggtgacgacgcccaggcctccgaggccgtcgagtgcaccctggacggcgacgagatcgacgtggccttcaaccccggcttcctgctggacggcctgggtgcgctgggcacccccttcgcccgcatgtccttcacccagccgggcaagcccgcgctgctgaccgggcaggccgaggccgacggcgaggcggacgacgccttcagctacgtgatcatgccggtgcgctttcccggcgcctga

SEQ ID NO: 382 - DNA, 1191 bp, Catenulispora acidiphila DSM 44928
gtgaagttccgggtggagcgcgacgtcctttccgaggccgtggcatggactgcgcggtccctgcccagccgcccggcggccccggtcctggccgggctggtcttcgaggccgtggagggagaaggcggcgaggaccacggctcggtcacgctgtccggcttcgactacgaggtctcctcccgggcccagatcggtgccgacgtcaccgagccgggccggatcctgatccacggcaagctgctggcggacatcgccaagtcgctgccgaaccgccccgtggagttctccaccgagggctcgaaagttctcctcagctgtggatccagccgcttcaccctgcagaccctgccggtggaggactacccggcgctgccgaccatgccgaccgcgaccggcgccgtcaccgcctccggcctggccggggcggtctcccaggtggccatcgccgccgggcgcgacgacaccatcccgatgctcaccggcatccgcgtggagatcgagggcgagaagatcaccctggtcgccaccgaccggttccggctggccgtccgcgagctccagtggaagccggagcaggacgacatgtccgcgaccgcgctgatcccctccaaggtcctgtcggacaccgcgaaggcgctcaccggcggcgactgggtctccctggcgctgtccggcggcgacgccggcgagggtctgatcggtttcgagtccggcgaaggtacctccggcaaggccaagggctcgcggcggatgacgtcccgcctgctgtccggggagttcgtgaagtaccgctcgctgttcccgaacgagtacaacatcaccgcgaccgtcgagaccgcgccgttcctggaggccgccaagcgcgtgtccctggtggccgaccgcacctcgccgatcaagctggccttcacccagggcgaggtcaccctggaggccggcgcgggcgacgaggcgcaggcctccgaggccatggacgcggtcctggacggcgaggacatcagcgtctcgttcaatcccagcttcctgctcgacggcctgcaggtgatcgacacccagtacgcgcagctgtcgttcaccgtcgcctccaagcccgcggtgctcatgggccgcccggcgctggacgccccggcgcaggaggaattccgttacctgatgatgccgctccgagttcctggtcagtccgcgggctga

SEQ ID NO: 383 - DNA, 1140 bp, Saccharomonospora viridis DSM 43017
atgaagatccgcgtcgaacgcgatgggcttgccgaggccgtcgcatgggtggcccggagtctgccgtcgaggccgcccgttcccgtgcttggtggggtcctcctcgacgcaggcggtgactccggcgacggcgcggacactttgaccatctccggcttcgactacgaggtctcggccacggccggtgttccttcgaccatcgccgaaggtggccgcacgctggtgtcgggtcgcttgctcgccgacatcaccaaggcgttgcccgcccagcccgtggacatctccgtcgagggcgctcgggtgtccatcacctgcggaaacgccaagttcagcctgcccaccatgccggtcgaggactaccccgagttgcccgcccagcccgaactggcgggcgaggtcgcgggtgacgcgttcgcccaggccgtggcccaggtggccgtcgcagcgggcaaggacgacacgctgccgatgctcaccggcatgcgtgtcgagatcaccggcagcacactcaccctcgtcgccacggaccggttccgcctcgccatgcgcgagttcagctggcagcccgccgagggcataaccgattcggcggtgctcgtccccgcccgtaccctcgcggacgccgccaagtcgctcggctccgccggcacgacggtgcagatcggtctggcgggcggcgacggattgctggggctgtccggtggtggcaagttcacgaccacgcggttgatcgacgccgagttcccgccgtaccggcagctgctgccgtccgactactcctcgcgcgcgattctgcacgtacccgcgctcaccgaggcgatcaaacgggtgtcgctcgtcgccgaacggggcactcaggtcaggttggagttcgaggacggttcgctgcggttggcggccggaggtgacgacgaaggcagtgcggaggaggaactccccgtcgactacgagggggaaccggtgaccatcgcgttcaacccctcttacctcgccgacggcctcggcgctctgcacgccgaacgggccgaactgacgttcacgacacccaaccggcccgcgttgatcaagcccgccgatgacaacggcgaagtcgtgcccggctatctctacctgttgatgccggtgcggcttcctggctga

SEQ ID NO: 384 - DNA, 1227 bp, Nakamurella multipartita DSM 44233
atgaagttccgcgtcgcccgcgacgatctcgccgacgccgtcgcctgggtcgccaagtcgttgccggctcgtccgccggttccggtgctcggcgggatcctgctcgaggtcagcggctcgaccctgaccgtggccggcttcgactacgaggtctccacccgggccaccctcaccgtggacaccctggacgaactagaaccggacgcccccggcggcccggccggcaccgaccgggtgctggtctccggccggctgctcgccgagatcacccgctccctgccggccaagccggtcgacctggccgtgctcggccccaaggtcagcatcgtggccgggtccgcccggttcaccctgccgaccatgccggtcgaggactacccgccgttgccgcagatgccggccgcctccggcaccgtggacagcgccgaattcgccgaggccgtcgcccagaccgcgatcgccgccggtcgcgacgacaccctgccgatgctgaccgggatccgggtcgagatcgacggcgaccggttgaccctggccgccaccgaccggttccggctggccgtgcgtgagctgggctggcacccggaccaggagaacctctcgaccgccgtgctggtaccggcccgcaccctggccgacgcggccaagacgctgggcggagccaagcaggtgacggtcgcgctcggcgaggggctgctcggcctggacgccggcgatcggcgtaccaccgtgcgcctgctggacgtcgagttcgtcaagtaccgctcgctgctgccgacctcgcacaccaccaccgtcgaggtgccggtcgcggccctcggcgagtcgatcaagcgggtcgccctggtcaccgaccgcggtcatcacctacggctgcaggtcggcgaaggggcgctgacgctgaccgccggcggcgacgacgagggtcgcgccgaggaagacctgccggccgaggtggacggcgaggaactgctcatcgcgttcaacccgtcgtacctgctggacggcctgggcgtggtgcacgccgacacggtccggctctcgttcaccaccccggcccgcccggcgctgctggtgccgatcgtcaaatcggacgagccggccgaatcagccgaggccgcggccgaggccgcggcgacgccggacatcgacgccgatggggtcggctccgacgaggacactccggcctatcgctacctggtgatgcccgcccgcctgcccggctga

SEQ ID NO: 385 - DNA, 861 bp, Escherichia coli BL21 (DE3)
atgatcgctattactggtgccactggccaacttggtcactatgttattaaatccttgatgaaaacggttcctgccagccaaatagtggctatcgttcgtaatccggcaaaagcccaggcactgacagcacaaggcattaccgtgcgtcaggctgactacggcgatgaagccgcactgacatctgcacttcagggagtggaaaaactactgctgatctcttccagcgaagtgggtcaacgtgccccgcagcatcgtaatgttattaatgccgcaaagacggctggcgtgaaatttatcgcttataccagtctgcttcacgcggataaatctccgctcggcctcgccgatgagcacatcgagacggagaaaatgttggctgattctggcatcgtttacaccctgctgcgcaacggctggtacaccgaaaactatctcgccagcgccccggcagcactggagcacggcgtatttatcggtgccgcgggcgatggcaaaattgcctcggcaacgcgggcagattatgcggcagctgcggcacgcgtgattagcgaagccggtcacgaaggcaaggtttacgagctggcgggcgatagtgcctggacgttgacacagttagcggcagagctgaccaaacagagcggcaaacaggttacctatcaaaatctgagcgaaaccgatttcgctgcggcgctgaaaagcgttggcctgcctgacggactggcggatatgctggcggattctgacgttggcgcatcgaaaggcggtctgtttgatgacagcaaaacgctgagcaaattgattggccgcccaacgacaacgttagccgaaagcgtaagccatctttttaatgttaataaatag

SEQ ID NO: 386 - DNA, 867 bp, Ralstonia solanacearum
atggaaatcggtgtcagcggtgcgagcgggcagctcggcaaggcagtcttggcggaactggcggcgcgcggagccggccatcgcgtggtcggaatctcgcgcacgccggagcgcgttccggcgcccgcgcaagggcggctcggcgactacgaccgcgccgagacactcctgcaggcctaccgcggccttgatcgcctgctgctgatcccgagcgccgatctgggcccgggcgtgcgcggccggcagttcacggcggcgatcgacgcggcggtccgggcgggcgtgaagcacattgtgatggtgtcgacggcgggcacgcgcgagctggccgagccggcgctcggcgcggcctactgggtgggcgagcagcgcctggtgaagacggcgccgcgatggacgatcctgcgcatgaattactacgccgagtcgtttgcccagcaagcgccgatgttcctcggctcggggatcctgccggggctgggcgaaaaccgcgtcgccttcgtttctcgggacgacgtggcggccgcggcggcggggatcctgctcggcgaagggcatgccggcgccatctacaacgcgaccgggccggtggcgctgagcggtgcgcagcgggcggccctggtggccgaactgtcgggcaagccgctgcgtttcgccgtgtccgatgaggcgccgctgcgccaggggctggcgcaggcgggccttcccggcggcttcgtcgacgccgtgatcgacctcgagaagagcttcgtcgccggcgcgttcgatgtcgtcacgggcgatgtggcgcgcctggccggacgcgagccgcgcgcgctgcggacgctgctggccgacagcctgcgcccggccgtggcggatgcctag

SEQ ID NO: 387 - DNA, 858 bp, Pseudomonas syringae tomato DC3000
atgatcgttgtcaccggtgccactggccagcttggccgtctcgtcattgaacaactgctggcgcgtgtccctgccgagcagatcgttgccgcagtccgcagcccggaaaaggccactgacctttcggcaaaaggcgttcaggttcgtcacgccgactattcgcagcctgcaacgctggacagcgcgtttgccggtgccgacaaggtgctgctgatttcatccagcgaaataggccagcgcttttctcagcataaagcggtcattgatgcggccaagcgctccggggtcaaactgctcgcctacaccagcgttctgcatgccgaggcctcgacgctgggcctggccaaagagcatgtcgaaaccgaagcttacctgcgcgccagcggcctgccgttcgccctgttgcgcaatggctggtacaccgagaactacaccgccggggtgcctggggcgctggcacatggcgccgtgatgggctgcgccgatgagggccgtatcagctcggcttcgcgccttgattacgctgaagctgcggcggtgctgctgacctccggagaggatcaaagcggtcgcgtgtacgaactggcaggtgacgagtcctacaccctcgcagaatttgcggctgagctttcaaagcaggccggcaagaccctgccctacgtcaacctgacgcaagccgagtttgaagcggcattgattcaggcaggtctgcccgattttgtcgcccgcttgctggccgattccgatgcggcagccgccaagggcgcgctgttcgatgacagccgtcagttgagcaaactgatcggccgccctgccacaccgctgtcagcaaccatcgccgaggcagtgcggggctga

SEQ ID NO: 388 - DNA, 858 bp, Pseudomonas syringae pv B728a
atgatcgttgtcaccggtgccaccggccagcttggccgcctcgtcattgaacagttgctcagccgcgtacccgcttcgcaaatcattgccgcggtgcgcagtccggaaaaagccgccgatctgtccaggcagggcattcaggttcgtcaggccgactattcacagcctgcgacactggacagcgcatttgccggcgccgacaaggtgctgctgatttcgtccagcgaagtgggccagcgtttgccgcagcacaaggcggtaatcgatgcagccaaacgtgccggggtccagctgctggcctacaccagtgttctgcatgccgacacctcggcgctgagcctggccaaagagcaccgcgaaaccgaagattacctgcgcgccagtggcctgcccttcgccttgctgcgcaatggctggtacaccgagaactacacggcgggcattcccggcgcgctggcgcatggcgcggtcatgggcagtgccgatgagggccgtatcagctctgcttcacgtctggattacgccgaagcggccgctgtgctgctgacttcggaaacgacacaagccggtaaagtctatgaactggcaggcgatgagtcctacacgctgtccgaatttgcggcgcagttgtctacgcagagcggcaagtccctgccttacgtcaacctgccacaggccgaattcgaggccgcgcttatccaggcaggcctgccggacttcgtggcccagttgctggccgattccgatgccgctgctgccaagggcgccctgttcgatgacagtcgccagttgagcgcgctgatcggccgcccgaccaccccgctctcggcaaccatcgccgagacactgaaaggctga

SEQ ID NO: 389 - DNA, 885 bp, Rhodopseudomonas palustris HaA2
atgtcttccccccgttttctcgtcaccggcgccaacggccaactcggccgtcgcgtcatcgatacccttctcgggaccatatcggccccgcagatcagcgccctggtccgcggtgccgacgccgccgccgcgctgtcggcccgcggcattcaggcccatgtcggcgattacggccgcccggagacgctcgcgccggccctcgccggggtcgatcgggtgctgctgatctcatccagcgagatcggtcggcgcacgccgcagcatcgcaacgtgatcgcggccgcccgcgaggccggggtccagttcctcgcctacaccagcctgctgcatgccgacatctcgccgctcggcctcgccgaagagcatcgccagaccgaagcagcgctccgcgagtccggcgtgccgttcgcgctgctgcgcaacggctggtacaccgagaattatgccgcctcgatccccgccgcgctggcgcacagcgcgctgctcggcagcgccggcgacggacggatttcatcggcatcgcgggccgactatgcggcggcggccgccgcggtgctgaccgcggacacgccggccgccaaccaagtctacgaactcgccggcgatgaggcctacacgctgaccgagttcgccgccgagatcgcgcggcagtccggcaaggccgtcgcctaccgcgatctgcccgaggccgactacaaggccgcgctgctcggcgccggcctgccggagccgtttgcggcactgctggccgactccgacgccggcgccgccaaggacgcgctgttcgacgacagccgcaccctcagccgcctgatcggccgcccgaccacgccgtatgccgaaacgataggcgacacgttgaaggcatcaaggcctgagcgctag

SEQ ID NO: 390 - DNA, 891 bp, Rhodoferax ferrireducens T118
atgacttccaccttgctcgtcaccggcgcatccggtcacctgggccaacgcgtgattcatcacctgctggagacgctgaaagtggccccgcaacgcatcatcgccaccacccgcaagcccgaaaccctcaaagacctggctgccaagggcatcaccgtgcgcggcgccgactttgacgacgcagcctcgctgcgcagtgcttttgcgggggcggatcgcctgctgcttatcagcaccgacgcgctggaccgccccggccgccgcttggcgcagcagcaagccgccgtcgctgcagcgcagcaagccggtgtggcgcatgtggtctacacctccatgccgctgcctgaaaattcgcccctgttgattgctcctgaccacgccggcaccgagaaagcgctggccagcagcgcgctcaagggctggacgctgctgcgcaaccactggtattttgaaaacctgttcatgtggctgccgtcagccttggccagcggccagtggtacagcgcggccgagcaaggcaaggtggcccacatcgcgcgcgacgacctggcacgtgctgctgccgccgcattgctcaaagacaccggcaagaacacctacaccctgagcggcgccgaggcattcaccaccgagcaaatcgcccaacaggtgtcgcaagccacgggcaaaccgctgcaagtggtgcctgtgccgctggcgggcctgattcagggcatggtgagcgcgggcttccccgagccactggcggcagtgtttgcctcgttcgacaccaacaccgccgcaggccgcgtggccgaggtcacgggtgacttccagaagctcaccggagttgcgccgcagccatttgccggctggttaagcgccaacgccgctgcattggctgcgttataa

SEQ ID NO: 391 - DNA, 843 bp, Paracoccus denitrificans PD1222
atgaccgtcgccgtcaccggagccaccggccagcttggccgcctgaccatcgcccggctgaaaaccctgctgcccgcaggcgaaatcgtcgcgctggcccgcaatcccgaaaaggccgccgacctgggcgtcgaggcccgcgccttcgactacgaccggcccgaaacgctggccaccgccctgcagggcgtggaccggctgctgctgatctcgtcgagcgaggtcggcaagcgcgccgcccagcatcgcgccgtgatcgaggctgccaaggccgccggtgtcgggcagatcgtctataccagcctgctgcatgccgaccgctcgccgctgtcgctggccgaggaacatgtggcgaccgaggccatgctggccgcatcgggcattccccacgccatcctgcgcaatggctggtatgccgagaaccataccggcgcgatccctgcggcactggcgcatggcgcgctgatcggcgcggcgggcgagggtcggatctcggccgccgcgcgcgcggattacgccaaggcggctgcatcggtgctggcggatggtggccatgccggccagacctatgaactggccggcgatgacggctggaccctggccgagcttgccgccgagctttcggcgcaaagcggcaaggcgatcccctatcgcaacctgtcgcaacaggattacgcggctgcgctgacgggcgcgggcctgcccgaggggctggccggggcgatcgcaagctgggatacgggtgccgcgcaaggcgcgctgttcgacgacagccgcacgctgtcgcgcctgatcggccgtccgaccgcgaccctggccgaagtggtgcgcgccgcgctctag

SEQ ID NO: 392 - DNA, 858 bp, Nocardioides JS614
atgtcgatcgtcatcaccggagccaccggccacctcggccgcctcgtcgtcgaggcgctgctcgcgcggggagcggaggggatcgtggccaccggccggtccgtcgagcggctcgccgacctcgccgaccggggcgtgcgggtcgagcgactcgacttcgacgacgtccccgagtccgtggactggctgggcgcgggcgacgtgctgctgctggtctccggcagcgaggtggggcagcggctcccgcagcaccgcgcggtcgtcgacctcgcggtccgcgccggcgtacgccggatcgcgtacacgagcgcgcccgctgccgacgacaccacgctcgccgtcgcgcccgagcacgcggccaccgaggcgatgatccgcgagagcgggctgccgttcacgttcctgcgcaacggctggtacaccgagaactacctgcccaccttcgcgcaggcgcgggagagcgggctggtcatcgggagcgctggtgagggccgcgtggcgagcgcgccgcgctcggacttcgccgaggccgcggcggtcgtgctcaccaccgacggccacgagggcgcggtctacgagctcttcggcgacgccgcctggacctacggcgagctcgcggcgaccttcgcggacgtgctcggccgcgaggtgacctaccgctcgctcaccccggaggcgcatcgggaggccctgctggccgccggtctcgacgaggggaccgccggcttcgtggtcgccctcgaccaggacatcgccgccgggctgctcggcctctcgaccgggcacctcgcgaagctgctcggccggcccacggtgccgctgcgcgacacggtcagcacctgggccgcccaggactga

SEQ ID NO: 393 - DNA, 867 bp, Acidovorax avenae citrulli AAC00-1
atgatcgccatcaccggagcctccggccagctcggccgcctcgccatcgacgcgctgctgcgcaacgctcccgccggggacatcgtggcgctggtgcgcaccccggccaaggtgcaggacctcgccgaacgcggggtcgtggtgcggcaggccgactatgccgatcctgccggttgggacgcggccctgcagggcgtgcgccggctgctgctgatctccggcagcgaagtcgggcaacgggtggcgcagcaccgcaccgtcatcgatgccgcgcgacgcgcgggcgtggaactgctggcctacaccagcgtgctgcgcgcggacacctcggccctggagctggcccgcgagcaccgggacaccgaagcgctgctgcgggaatccggcgtgccccacgtgctgctgcgcaacggctggtacaccgagaactacctggccggggtgggtgccgcgctgcagcacggcgtgctgctgggcagcgcaggcgaaggccgcatcgcatcggcagcgcgggcggactatgccgaagcggccgccgcggtgctgcaggcaccggaccaggccggcaaggtgcatgaactggcgggcgacagtgcgtacacgctggcggaactggctgcggaaatctcccgcgcgtcggggcggtccatcccctaccgcgaccttcccgaagcggaatacgccagggtcctggaaggtgcgggcctgcccgcggcgttcgccgcgatcctggcgcagtccgatgccgcggcggcgcagggagcgctcttcgacggcggcggccagctggcacggctcatcggccggccgaccacgccctggcagggccaggcggacgaagccgtccgcgccgccatgccgggctga

SEQ ID NO: 394 - DNA, 855 bp, Polaromonas naphthalenivorans CJ2
atgatcgttgttactggagcgtctggccagcttggccgtctcgtcattgaagcgttgctgcaaaccgttcctgcgtcgcaggtcgtggccgctgtgcgcaatccggcaaaggccggcgacctcgccgcgcgcggtgtgcaggtccgccaggccgattactcccagccggccacgctggatgcggctttcaagggggccgacaagctgctgctgatttcctccagcgaggtaggccagcgcgccgcacagcaccgcgccgtgatcgaagccgcccagcgtgcgggcgtcaagctggtggcctataccagcatcctgcacgctgacgcatcgccgttggggctggcggcggaacatcaggaaactgaagccttgctccgtgcatcaggactgccttttgtcttgctgcgcaacggctggtacaccgaaaactatgcgggcggcattccggcggcgctggcgcatggcgtcgtgctgggcagcgcgggcgcgggccgcattgcctcggccgctcgcgccgactatgcggccgccgccgccgccgtgctgacgcaggcagaccaggccgggcgcatctacgaactggctggcgacggcagctacacactggccgaattcgctgcggaaatcgcccgccagtcgggcaaggcggtggtttaccaagacctgccggaggctgactacaaagccgcgctgctcagcgtcggcttgcccgaggggctggccggcctgctggccgattccgacgtgggagcgtccaggggcgggctgtttgatgacagccatcaactgagccagctcatcggccgcccgaccacgccgctggcggcgagcgtcagcgcagcccttgcggcttga

SEQ ID NO: 395 - DNA, 849 bp, Enterobacter sp. 638
atgatcgcgattaccggcgctaccggccagcttggccaacatgttatcgaaaatctgctgaaaaccgttcctgcccatcagattgtggctattgtgcgtaatccggcaaaagccgatgcgctgatccaacaaggtatcaccgtgcgtcaggcggattacaccgaccagacggcgttcactgaggcgctgaagggcgtggaaaaactgctgctgatttcgtccaacgaagtcggccagcgtgaaccgcagcataagaatgtgatcaatgcggccaaaacggcgggcgtgaaatttatcgcctacaccagcctgctgcatgcggataaatcaccactcggcctggccaatgaacacgtcgcgaccgagaaagcgctggcagattctggtattccgttcgccctgctgcgtaacggctggtataccgagaactatctggcaagcgcaccgcctgccattgaacacggcgtgtttatcggcgctgccggcgacggcaaaattgctgcggccacccgcgcggattatgccgctgcggcggcaaaagtcatcgcagaagacggtcacgcaggcaacgtctacgaactggctggcgacagcgcgtggacgctaagcgagctggcggccgagctgagcaaacagagcggcaaaccggtggtttatcagaacctgaacgaagcagatttcgccgcggcgctgaagggcgtgggattacccgcaggtctggcagatatgctggccgactctgataccggcgcgtcgaaaggcggtctgtttgacgatagccatacgctgagcaaactgattggccgcgccactacgccgctggcggaaagcgtcaaaagcattctgtaa

SEQ ID NO: 396 - DNA, 870 bp, Bradyrhizobium BTAi1
gtgaccggtgccgctggccagctcggccgcgccgtaatccgccacctgctgaccaccttgaaggtgccggccggcagcatcatcgccgcgacgcgcaagccagagcagttgaaggatctggctgcccagggcgtccaggtccgcgcggccgatttcgacgatccgcaatcgctgcctgccgcctttgccggcgttggccgcatgctgctgatcagtacggacaggctcgatcgtcccggttatcgcgccgaacagcatggccgcgccatcgcggcggccgagcaggccggtgtcggccatgtcgtctacacgtcgatgccgaagcccgacaactcaccgttgttgatcgcgcccgaccacgctcgcaccgaggctgcgctgcgcgacagcaagctcgccggctggaccgtgctgcgcaatcactggtacttcgagaacctgttgatgtcgctgccccagatcctcggctccggccgctggttcaccgcggacgagggcggcgcgtcagccgacatcgcgcgggacgacctcgcgcgggccgcggcggtggtgctcgccggcaatttcagcggcaagagggcgttcacgctgagcggtggacaggcgctgaccaaggccgagatcgcgcgcatcctgtccgcggccaccggcaagccgatcgaggtcgtgcaggtgccgctgccgggattgatccagggcatggtcggcgcgggactgccgcagccgctggccgaaatctttgcgtcgttcgacaccaacaccgcgcaaggccgcgtggccgaagtgaccggcgattatcaggcgatcaccggtgtcgcgccgcagagctttgctgattgggtcgaaaagaccaagggcgccttcgcctga

SEQ ID NO: 397 - DNA, 888 bp, Sinorhizobium medicae WSM419
atgtctcaaaaattgctcgttaccggagcgaccggccagtttggcaagctcgtactcgatgcgcttctggaatccggaaaaacgaagccggccgatatcatcgccaccagccgggacaccgccaaattggcaggctatgcggcgcagggtgtcgagacccgtgctgccgatttcgacgatccggcctcgctcgaacgggccttcaccggcgccggccgcatcctcatcatctcgacggatgttctcgaccagccgggcaagcgtctcaagcagcatctcaccgcggtcgaggcagcgaagaaggcctcggtgaaccatatcctctatacttcgatgcccgcgccggaagcatcggtcattcccttcgcaaccgaccatctcggaaccgaagaagccatcaaggcgacgggcgttccttacaccatcctgcgcaatgcctggtacatggagaaccttctcctgtcactgccccgcgcccttgcgacaggacgatggttctcctccgccggcaacggccgcatttcgcacatcagccgtcgcgacctcgccgccgccgccgcttccgcgctccaatcaggctcgacggaaagccgcacctatacgctgacgggagcgcaggcttacacgaccgacgagatcgccgcccttgttaccaaagctaccggcaaagcgctcgacgtcgtccacatttccgacgaagccttggccggaggcctcaagggtgcgggtgtgccggacttcttcattccgatcctggtgtcctttgacgccaatacacgggaggggcatttcgatgtggtgaccgacaacgccattgccatgaccggtcggaaccccacagaactcgcctccttcctcgaaacaaacaaggctgcactcacgcactga

SEQ ID NO: 398 - DNA, 846 bp, Marinomonas MWYL1
atgattttagttactggcgcatctggccaacttggtcgtcttgtcattgcttcattgctagaaaaaacagcagcaagcaacattattgccgcggttcgtaacccagaaaaagtggcagatttggcagaaaagggcgttcaagttcgtcaagctgattacacagaccaagactctcttgttgctgcaatgcaaggtgttgaaaaagtattattaatctcgtcaagcgaagtgggccaacgtactgctcagcacagcaatgtcatccatgcggcgaaacaagcgggcgtttccttgctggcttacaccagtattttaaacgcggacaaatcacctcttattttggcaaaagaacacgtagaaacagaaaatctgttagcggaatctggcgtaccttatgtattactgcgcaatggctggtactcagaaaactacacaatgggcgtagcaggcgcactagagcatggtgttgttggttgtgccgaagatggaaaactgtctactgcagcacgtgcagactatgctgctgcggccgcggccgtactggttaaagatggacaagcgggcaaagtctatgaactggctggcgataatgctttcacgttaagcgtatacgctgctgcgatcagcaaggtatcaggcaaaaccgtcgcttatcaaaacgttcctgaagcggaattcaccaaaatcctggttggcgcaggcttgccagaaggcttcgcagccatccttgcggactcagaagttggcgcatcccaaggagccttgttcagcgacagcaaagatttatcaacgctaattggccgcccaaccacgcaaattgaagacagcattaaagcagcgttgtag

SEQ ID NO: 399 - DNA, 858 bp, Yersinia pseudotuberculosis IP 31758
atgatcgcagtcaccggtgccaccggccaattaggccgcctcgttattaacgtattattaaaaaaagtgcccgcccacgacatcattgcggcagtccgtagccctgataaagccaaggatcttatggcgttaggggtgcaagtgcgtcaagccgattataatcaaccaacaacgctggatagtgcgtttaaaggggttgataaactgctgttaatttcatccagtgaagtaggacaacgtgttgcgcagcatacggcggtgatcaatgcggccaagcgcgcgggtgtcaaacttttggcgtataccagcctgttacatgcggataaatcccctctgggattaggtgaagaacatcgggcaaccgagggattgctacgtgattcaggtctgcccgtcgtattactgcgtaatggctggtataccgaaaattatgcggcaagcatcgctccagccttggcccacggtgcatttatcggtgccgcaggcaatggacgtatcgcttcagccagtcgtgaagattatgctgaagctgccgccacagtactggttcaggaaaatcaagccggtaagatttacgaattggctggcgatgatgcctatacattatccgaattctcggcagaaattactcgccaatccggtaaagcagtcgcctaccaagatttatccgaggcagactttaaacacgccctaatcagtgccggtttacctgacggcttggccggtatgctggcggattcagatgccggtgccgcgcaaggtgggttatttgatgactcccatacattgagtaaacttattggccgcccaaccaccccttatgccaaggtaataacagcaacactggcgacacgttaa

SEQ ID NO: 400 - DNA, 900 bp, Xanthobacter autotrophicus Py2
atgtatctccccgatacatggtttccaatggaaacctatcaggcagcatttcgggagcaggacatgagcgacgcgattctggtgatcggggccacgggcaatgtgggccgccctctggttgaggcgctcaaggcgcggggcgcccgggtcagggccgcctcgcgctccggcaaggcggtggacggggccgagggcgtcgccttcgatatcgccgatcccgccaccttcggcccggcccttgccggggtaaagagcgccttcgtgatgctgcccaccggctccatggaccccaagggccagcttctgccgctgatcgcggccgctgccgcccgcaaggtgaaggtggtgttccagagcgtgcttggcgccgatgcggatgaagccatcccctaccggcaggtggagcgggcgctggaggcgtcaggcacgccctatgtgatcctgcggcccaactggttcgcggacaatttccacaccttctggaagccgggcctcgaccacggcgtcatcgccgtgccggcgggcgcgggcaagtccagcttcatcgacacccgcgacatcgccgaaagcgccgcggcggcgctgacctccgaccggttcgacggccgcgccttcaacctcaccggccccgaggcgctgggctatggggacgcggcggcgatcctcgccccggtcatcggcaggccggtcacctacacccccatcgacgacggcaccttcgtcggcatccttgtgggcgccggcgtgccgcaggactatgcccgcttcctcgcctccatcttcgtgccggtgcgcgagggctggaccgccgccgtcaccacggacgtggagaccctgaccggccacgcgccccggtcgctggaaacctatgcgaaagacaatgcggaccgcctgaaatag

SEQ ID NO: 401 - DNA, 861 bp, Escherichia coli HS
atgatcgctattactggtgccactggccaacttggtcactatgttattgaatccttgatgaaaacggttcctgccagccaaatagtggctatcgttcgtaatccggcaaaagcccaggccctggcagcacaaggcattaccgtgcgtcaggctgactacggcgatgaagccgcactgacatctgcacttcagggagtggaaaaactactgctgatctcttccagcgaagtgggtcaacgtgccccgcagcatcgtaatgttattaatgccgcaaaggcggctggcgtgaaatttatcgcttataccagcctgctacatgcagatacctccccgctcggcctcgccgatgagcacatcgagacggagaaaatgctggctgattctggcatcgtttacaccctgctgcgcaacggctggtacaccgaaaactacctcgccagcgccccggcagcactggaacacggcgtatttatcggtgcggcgggcgatggcaaaatcgcctcagcaacgcgggcagattatgcggcagctgcggcacgcgtgattagcgaagccggtcacgaaggcaaggtttacgaactggcgggcgatagtgcctggacgttgacacagttagcggcagagctgaccaaacagagcggaaaatccgttacctatcaaaatctgagcgaagccgatttcgccgcggcactgaaaagcgtcggactgcccgacggactggcggatatgctggcggattctgacgttggcgcatcgaaaggtggtctgtttgataacagcaaaacgcttagcaaattgattggccgcccaacgacaacgttagccgaaagcgtaagccatctttttaatgttaataactag

SEQ ID NO: 402 - DNA, 861 bp, Escherichia coli E24377A; identical to SEQ ID NO: 401

SEQ ID NO: 403 - DNA, 870 bp, Frankia EAN1pec
atgtccatcgtcgtcaccggagccggcggtcacctcggccggctcgtcgtcgagaacctgctggcccgcggcgtccccgcggggcggatcgtggcgggcacccgcaatgtcgacgcactgtcggcgctggcggagcggggcgtggacgtccgccgcctggacttcgacgacccggcctcgctcgcgacggcgttcaccggggccgagaaggcactgatcgtgtcggggacggacttcggtcgccgggtcgagcagcacgtgggcgcgtcccgggcggcgcgcgacgccggcgcgtccctcgtcgtctacaccagcgcgccgtacgccgacaccaccgacatgctgctggccgaggaccaccgggggaccgaggagggcatccgcgcgctcggcgtcccgttcaccttcctgcgtaacggctggtacttcgagaactacaccgaccagctcccggtctacctccaggtgggcgcggtcgtgggctgcgccggcgagggccgcgtcagcggggccgcccggtcggagtacgccgaggcggccgccgccgtcctgaccggtgaggggcacgagggcgccgtgtacgagctgggcggcgacacgtccttcaccctgccggagctggccgagcagatcgccaagcacaccggccagccgatcgtctaccgcgacgtcacgcagcccgagctggaggccgtcctgaccggcgcgggtctgcccgggcccgtcgcgcgcgtcctcgccgacgcggaccgggcgatcggcgcgggacggctccagatcgacaccggcgacctgagccggctcatcggccatccgaccgtcaacctggcggacgcggtggccgccgccggcgcgcccgcggtgccgtga

SEQ ID NO: 404 - DNA, 858 bp, Yersinia pestis Angola
atgatcgcagtcaccggtgccaccggccaattaggccgcctcgttattaacgtattattaaaaaaagtgcccgcccacgacatcattgcggcagtccgtagccctgataaagccaaggatcttatggcgttaggggtgcaagtgcgtcaagccgattataatcaaccaacaacgctggatagtgcgtttaaaggggttgataaactgctgttaatttcatccagtgaagtaggacaacgtgttgcgcagcatacggcggtgatcaatgcggccaagcgcgcgggtgtcaaacttttggcgtataccagcctgttacatgcggataaatcccctctgggattaggtgaagaacatcgggcaaccgagggattgctacgtgattcaggtctgcccgtcgtattactgcgtaatggctggtataccgaaaattatgcggcaagcatcgctccagccttggcccacggtgcatttatcggtgccgcaggcaatggacgtatcgcttcagccagtcgtgaagattatgctgaagctgccgccacagtactggttcaggaaaatcaagccggtaagatttacgtattggctggcgatgatgcctatacattatccgaattctcggcagaaattactcgccaatccggtaaagcagtcgcctaccaagatttatccgaggcagactttaaacacgccctaatcagtgccggtttacctgacggcttggccggtatgctggcggattcagatgccggtgccgcgcaaggtgggttatttgatgactcccatacattgagtaaacttattggccgcccaaccaccccttatgccaaggtaataacagcaacactggcgacacgttaa

SEQ ID NO: 405 - DNA, 894 bp, Methylobacterium extorquens PA1
atgagcacacccgaaccgcgtcttttcgtgaccggtgccaccggccagctcggccggctggtgatcgaagccttgctgaagcgggtgccggccgacagcatcgtggcgggtgtccgctcgctggagagtgctgcggctgaggacctgcgcgcgcaaggcgtcacgctccgcatggccgactacgcgcgtcccgagacattggtggaagcctttcgcagcatcgaccgcctgctgcttatctcgtccagcgagatcggccagcgcgttgcccagcaccagaacgtcatccaagccgcccggcaatccggcgtgaacctgatcgcctataccagcctgcttcgcgccgacacctcgccactcgccctggcagacgagcatcggcggacggaagacgcgctgaaggcttccggcttgtccttcgccgtgctgcgtaatggctggtacaccgagaactacgcggcctcgatcgcgccggccctggcccatggggtccttctgggcagtgcgggcgagggccggatcgcctccgccgcgcgggcggacttcgccgaggcctccgccgtcgtgctgacgacagacggccatgacggacgcgtctacgaactggcgggggatgacgcctacaccctggacgagttcgcggcagcggtgagcgtgctgtccggccagacggtcgtctaccggaacctaacggaggctgagttcaaggcggccctggtcgccgccggcctgccggaggacttcgcggcgctgctcgccgattcggatatggcggcggcccagggcggactcaacgatacgaaccgccagctgagccggctgatcggccggccgacgaccccctatcggaccacgatcgccggaacgatcagcgggatggcggcccaggactga

SEQ ID NO: 406 - DNA, 861 bp, Escherichia coli C ATCC 8739; identical to SEQ ID NO: 385

SEQ ID NO: 407 - DNA, 858 bp, Yersinia pseudotuberculosis YPIII
atgatcgcagtcaccggtgccaccggccaattaggccgcctcgttattaacgtattattaaaaaaagtgcccgcccacgacatcattgcggcagtccgtagccctgataaagccaaggatcttatggcgttaggggtgcaagtgcgtcaagccgattataatcaaccaacaacgctggataatgcgtttaaaggggttgataaactgctgttaatttcatccagtgaagtaggacaacgtgttgcgcagcatacggcggtgatcaatgcggccaagcgcgcgggtgtcaaacttttggcgtataccagcctgttacatgcggataaatcccctctgggattaggtgaagaacatcgggcaaccgagggattgctacgtgattcaggtctgcccgtcgtattactgcgtaatggctggtataccgaaaattatgcggcaagcatcgctccagccttggcccacggtgcatttatcggtgccgcaggcaatggacgtatcgcttcagccagtcgtgaagattatgctgaagctgccgccacaatactggttcaggaaaatcaagccggtaagatttacgaattggctggcgatgatgcctatacattatccgaattctcggcagaaattactcgccaatccggtaaagcagtcgcctaccaagatttatccgaggcagactttaaacacgccctaatcagtgccggtttacctgacggcttggccggtatgctggcggattcagatgccggtgccgcgcaaggtgggttatttgatgactcccatacattgagtaaacttattggccgcccaaccaccccttatgccaaggtaataacagcaacactggcgacacgttaa

SEQ ID NO: 408 - DNA, 882 bp, Xylella fastidiosa M12
atgacccgaactatttcccgcatccttgtgactggtaccagcggccaacttggcgctttagtgatagaagaattgctaaaaaagatacatgcatctcatttaatcgccgcggcacgtgatccaaaggcattaatggcgtttagtagacgtggtgttgaaacacgcctattggattacacagatcagatcagcatagatgctgcctttcagggggtcgaacgtctgctgctggtgtcctctaatgccattgatcaacgtttggtgcaacaccgcaacgtgattgaagccgcggcacgtgctggtgttggtttgtttgcttacaccagcttgttacatgccgataactcgtcactgttgctggccaaggatcacgtgcaaaccgaagcgttattgaaaggatcgggaataccttacgtcctattgcgtaatggttggtataccgagaactacactgattctataggagcagcgttggttcatggggccgtccttggtagtgctggtacaggccgcattgctgcggctacacgcgccgattatgcggctgcggctgcggctatattggcttctgatgtcgatcaagccggacgtacctatgaattggctggtgacgaggcatttaccatgccagagtatgctgccgagattgcacaacagtctgggaagccggtgatttaccgcgatttacccgaagctgagtacgctgcaatcttgatgcaagtagggttgccggagagctttgctgcaattctggcacagtctgatattggtgcctcccagggcgcactcttcgatgacagtcatcaacttagtactcttatcggacggccgactactccgctacgtgaagtggttgccaaagcactttctgcagtccgctaa

SEQ ID NO: 409 - DNA, 861 bp, Escherichia coli SMS 3 5
atgatcgcaattaccggcgcaaccggccaacttggtcactatgttattgaatccttgatgaaaacggttcctgccagccaaatagtggctatcgttcgtaatccggcaaaagcccaggcactgacagcacaaggcattaccgtgcgtcaggctgattacggcgatgaagccgcactgacatctgcgcttcagggagtggaaaaactactgctgatctcttccagcgaagtgggtcaacgtgccccgcagcatcgtaatgttattaatgccgcaaaggcggctggtgtgaaatttatcgcttataccagtctgcttcacgcggataaatctccgctcggcctcgccgatgagcacattgagacggagaaaatgttggctgattctggcatcgtttacaccctgctgcgcaacggctggtacagcgaaaactacctcgccagcgccccggcagcactgaaacacggcgtatttatcggtgcggcgggcgatggcaaaatcgcctcagcaacgcgggcagattatgcggcagctgcggcacgcgtgattagcgaagcaggtcacgaaggcaaggtttatgaactggcaggtgatagcgcctggacactgacacagttagcggcggaactcaccaaacagagcggcaaacaggttacctatcaaaatctgagtgaagctgatttcgccgcggcactgaaaagcgtcggactgcctgacggactggcggatatgctggcggattctgacgttggcgcatcgaaaggtggtctgtttgataacagcaaaacgcttagcaaattgattggccgcccaacgacaacgttagccgaaagcgtaagccatctttttaatgttaataactag

SEQ ID NO: 410 - DNA, 855 bp, Leptothrix cholodnii SP 6
atgatcgtcatcaccggcgccaccggccagctcggccgtctcgtcatcgaatccctgctcaagaccgtgcccgccagcgagatcgtcgccgccgtgcgcagccccgagaaggcgcaggacctggccgcgcgcggcgtgcgggtgcgccaggccgactacaaccagcccgccacgctcgacgccgcattcaccggcgcacacaagctgctgctgatctcgtcgagcgaagtgggccagcgcgccccgcagcaccgcaccgtgatcgaggcggcgcagcgtgcaggcgtcaagctgatcgcctacaccagcctgctgcacgccgacagctcgccgctggcgctggccggcgaacacgtcgagaccgaagcgatgctgcgcgcctcgggcctgccgttcgtgctgctgcgcaacggctggtacaccgagaactacgccgcctccgtgcccgccgcgctggcgcacggcgtggtgctgggcagcgccgggaacggccgcatcgcctcggccgcccgtgccgactacgccgcggccgcagccgccgtgctgaccgccgacaacccggccggcaaggtctacgagctggccggcgacacgtcgtacacgctggccgaactggccgccgagatcgccgcccaggccgacaagccggtggcctacaacgacatgccgcaagccgctttcgaggccgcgctgctcggcttcggcctgccggccggcctggcatcgctgctggccgactcggacgtaggcgcctccaagggcggcctgttcgatgacagccaccagctcagcgcgctgatcggccggccgacgacaccgatggcatcgacgatcgcgcaggcggtcaagggctga

SEQ ID NO: 411 - DNA, 885 bp, Methylobacterium radiotolerans JCM 2831
atgacgcggaccgattatccgagctacttcgtgaccggcgccacgggccagctcggccgacaggtcatcgcggcgctcctggagcgcatcccggccggcgcggtggtggccggcgcgcgggacatcgagggcgagtcggctcgcagcctgcgaagcctgggcgtcgcggtccgccgggccgactacgccgatccgacgagtctggacgcggcgtttcagggcatccagcgcctcctgctgatctcgtcgagcgagatcggccggcgcgtggcgcagcatcgcaacgtcatcgacagtgccggacggaccggtgtcggtctgatcgcctacacgagcgtcctgcacgccgacacgtcggccctcgccctggccgaggagcatcgccagaccgagcggctgctcgcggattccggcgtgccgttcgtcgtgttgcgcaacggctggtacacggagaactacgccgccggcatcgcgccggcgctcgcccacggcgccgtcctcggctgcgcgggcgacgggcggatcgcctcggccgcgcgggtcgattacgcggcggcggcggcggctgttctcaccgccgaggggcagggcggccgcatctacgagctggcgggcgacgagtcctacacgctgaccgagttcgcggcggcgatcgccgccgcggcaggcagaccggtcgcgtaccgcgatctgccgcaggcggagtaccgggcggcgctcgtggccgccgggataccgtcagacttcgccgcgctgctcgccgactcggacgcggccgcggcccgcggcgcgctagacgacgacacgcgtcagctgagcgcgctgatcggcaggccgacgacgccctacaggtccacggtgcacgacgccgtcgcgcgcctctga

SEQ ID NO: 412 - DNA, 885 bp, Methylobacterium radiotolerans JCM 2831
atgacgctcccatcccacacgcgtctgttcgtgacgggcgccactggccaactcggtggcctcgtcatccaggacctgctccggaccgtgcccgccgcacaggtggtcgccggtgtccgcgatgccggaagcgaaggggctaggaagctggccgggctcggcgtcgaggtccgcacggccgactatgccaagcccgacacgctcgccacggccttcgagggcatcgagcggctgttgctggtctcctccagcgaggtcggtcaacgctcggtccagcaccggaacgtcatcgtcgccgccaaggctgccggtgtccttctaatcgcctacaccagccttctccatgccgacacgtctcccctggccctcgcggaggaacaccgcgccaccgaggcgatgctcgcggcgtccggggtgccccatgtcctgctgcggaacggctggtacaccgagaactatacggcctcgatcccgctcgtgctcgcacacggcgtcttcctcggcagcgcgggggaagggcggatcgcctcggcggcgcgggccgactacgcggctgccgcaagcatcgtgctgaccgccgagaccgaccagggcgggcgcatctacgaattggcaggggacgaagcctacaccctgtccgacttcgccaagctcatatcccaggcctcgggcaagccggtcgcctaccggaacctgcccgagacggatttcaaaaccgctctgatcggcgcagggctaccggacgcctttgccggccttctggccgactcggatgctggcgccgagaagggcgccctcttcgatggcggccaccaactcagtgcgctcatcggtcggccgaccacctcgacctcatccgtgatcgaggcagcacttaagggttga

SEQ ID NO: 413 - DNA, 882 bp, Xylella fastidiosa M23
atgacccgaactatttcccgcatccttgtgactggtaccagcggccaacttggcgctttagtgatagaagaattgctaaaaaagatacatgcatctcatttaatcgccgcggcacgtgatccaaaggcattaatggcgtttagtagacgtggtgttgaaacacgcctattggattacacagatcagatcagcatagaggctgcctttcagggggtcgaacgtctcttgctggtgtcctctaatgtcattgatcaacgtttggtgcaacaccgcaacgtgattgaagccgcggcacgtgctggtgttggtttgtttgcttacaccagcttgttacatgccgataactcgtcattgttgctggccaaggatcacgtgcaaaccgaagcgttattgaaaggatcgggaataccttacgtcctattgcgtaatggttggtataccgagaactacactgattctataggagcagcgttggttcatggggccgtccttggtagtgctggtacaggccgcattgctgcggctacacgcgccgattatgcggctgcggctgcggctatattggcttctgatgtcgatcaagccggacgtacctatgaattggctggtgatgaggcatttaccatgccagagtacgctgccgagattgcacaacagtctgggaagccggtgatttaccgcgatttacccgaagctgagtacgctgcaatcttgatgcaagtagggttgccggagagctttgctgcaattctggcacagtctgatattggtgcctcccagggcgcactcttcgatgacagtcatcaacttagtactcttatcggacggccgactactccgctacgtgaagtggttgccaaagcactttctgcagtccgctaa

SEQ ID NO: 414 - DNA, 861 bp, Xanthomonas oryzae PXO99A
ttgattcttgtcaccggcgccagcggtcagttgggtgcgctggttgtcgaagcgctgctcgggcatgtgcctgcgggccgcatcgtagcaacggctcgggacaccgcgtcactggttgagttcgcaaaacgcgacatcgcggtgcgtcaggcggactacgctatcccgcacagcctgcacacggccttcgctggcgtgggccgggtgttgctggtgtcgtccaatgcggtgggccagcgcgtgccgcaacaccgcaacgtgatcgaggcggccaagcgcgccggggtggagctgctggcgtatacgagcatcctgcatgccgataccagtacgctgtcgctggccgccgagcatgtggccaccgaggcgctgctgcgcgacagcggcgtgccgcacgcgttgctgcgcaatggctggtacaccgagaactacaccggctcgatcgccgccgaagtcgcccacggcgcggtgatcggcagttccggcgaaggcaggatcagcgccgccacgcgcgccgactatgccgcggccgctgcagcggtgctggccgccgatgccccgcaggccggccaggtctacgagctggctggcgataccgctttcacgatggccgagtacgccgccgaagtggcgcagcagtcgggcaagccggtggcctatcaggatctgccggaagccgattacgcggcagcgctggtgcagatcggcctgccggctggcttcgcacaggtgttggcgcagtgctcggcggcctcgcgcggcggcgacctgttcgatgacagccacacgctgagccggctaagtggtcgctccaccaccccgctgcgtgatgcagtggctgcagcgctcgcagcgggctga

SEQ ID NO: 415 - DNA, 861 bp, Shigella boydii CDC 3083 94
atgatcgctattactggtgccactggccaacttggtcactatattattgaatccttgatgaaaacggttcctgccagccaaatagtggctatcgttcgtaatccggcaaaagcccaggctctggcagcacaaggcattaccgtgcgtcaggctgactacggcgatgaagccgcactgacatctgcacttcagggagtggaaaaactactgctgatctcttccagcgaagtgggtcaacgtgccccgcagcatcgtaatgttattaatgccgcaaaggcggctggcgtgagatttatcgcttataccagcctgctacatgcagatacctccccgctcggcctcgccgatgagcacattgagacggagaaaatgttggctgattctggcatcgtttacaccctgctgcgcaacggctggtacagcgaaaactacctcgccagcgccccggcagcactggaacacggcgtatttatcggtgcggcgggcgatggcaaaatcgcctcagcaacgcgggcagattatgcggcagctgcggcacgcgtgattagcgaagccggtcacgaaggcaaggtttacgaactggcgggcgatagtgcctggacgttgacacagttagcgacagagctgaccaaacagagcggcaaacaggttacctatcaaaatctgagcgaagccgatttcgccgcggcactgaaaagcgtcggactgcccgacggactggcggatatgctggcggattctgacgttggcgcatcgaaaggtggtctgtttgataacagcaaaacgcttagcaaattgattggccgcccaacgacaacgttagccgaaagcgtaagccatctttttaatgttaataactag

SEQ ID NO: 416 - DNA, 870 bp, Rhodopseudomonas palustris TIE 1
atgtccgcctcgcgtttcctcatcaccggtgccagcggccagctcggccgcctcgttgtcgacggcttgctcaagtcgctgccgcccgcgcagatcggcgtgctggtccgcagcgagaaagtcgccgccgagttcgccgccaaaggccttcacgtccatatcggcgactacagcaatcccgagacgctcgggcccgcgttcgcaggcgtggagcgtgcccttctgatctcgtccagcgagatcggccagcgtacggcgcagcaccgcaacgccatcgaagctgcgcgcgcggccggggtatcgctgctcgcctacaccagcctgctgcacgccgacacctcgccgctcgggcttgcagaggaacatcgccagaccgaagccgcactcaaggcgtccggcgtgccgcacgccctgctccgcaacggctggtacagcgagaactacaccgcttcgattccggccgcactggcgcacggtgccctgctcggcagcgccggcaatggccggatcgcctccgcagcgcgcgctgactatgccgaggccgcggtccgtgtgctcaccgccgagcagccgcaggccggccggatctacgagctcgcaggagacgacgcttacacgcttgcggagttcgctgccgagctgtcgcagcagtccggcaaagcggtcgcgtatcgcgatctgccgcaggccgagtacgaggctgcactggtcgccgccggcctgcccaagccgttcgccgcgttgctggccgactccgacgccggcgccgccaagggcgcgctgttcgacgacagccgagctttgagcctgttgatcggccgtccgaccacgccgatcgcaacaacgatctcggcagcgctgaaagcctga

SEQ ID NO: 417 - DNA, 858 bp, Geobacter bemidjiensis Bem
atgatcgtcgtcactggagccaccggacagttagggcgcctcgtcatcgcatcgcttctcaaaaaagtaccagcctcccgcatcgtcgccgcggtacggaaccccgacaaggccaaagaccttgccaacctcggcgtccaggttcgccgggccgactacgacctgcccgagagttgggaaagcgcactcgtcgacgccgagaaggtgctactgatctcttccagcgaggttggcaagcgcatcggccagcaccgcaccgtcatcgatgcggccagaagggccggcgtgaaacttctcgcgtacaccagcctgctgcgggccgatagctcccccctcggactcgccgccgagcacgtcgccaccgaaaccatgatccgcgactccggtatctcattcgtcatgctacgtaacggctggtacaccgagaactacgccgccagtatcgctccggcggtcgagcatgggaccttctacggctccgccggcgacggccggatcgcgtcggccgcccgcgccgactacgcagaggccgccgttgccgtgctcaccactgaagcggaggggggacgggtctacgaactggccggtgacacagcctacacactcaacgaattcgccgccgagatttcccgccagtacggcaagccggtcaactacgtcaacctccccgagctcgagtacaagaagctgctcgtttccgttgggcttcctgagccgttcgcagctctcctggccgattccgacagcggcgccgcaaaagggggactcttcgacgatagccgtcaactgagcaccctgatcggcaggccgaccaccgccctggaggcggtgatagcccaaggcaaaaaaggcgcgtga

SEQ ID NO: 418 - DNA, 897 bp, Methylobacterium sp. 4-46
atgtcggcgcacgcgacccatcgcctcttcgtcaccggcgccagcggccagctcggcaccctggtgatcgacgccctgctggcgcggctcgcgccggagcgcgtcgtcgccgggatgcgccggcccgacggcgaggccggcgcgcggctgtcggcccgcggcgtcgccgtgcgggaggccgattacgaccggcccgagaccctggcggcggccttcgcggggatcgaccggctgctcctgatctcgtcgagcgagatcggcaggcgggaggcgcagcaccgggcggtgatcgcggccgcgcgggcggcggggatcggcctcgtcgcctacacgagcgtgctgcgggccgacacctccccgctcgccctcgccggggagcaccggcggaccgaggcggccctcgccgaatccggcctgccctgcgtgatcctgcgcaatggctggtacacggagaactacgcggcctcgatccccgcggccctcgccgagggcgcgctgctgggggcggccggggaggggcccatcgcctcggcggcgcgggcggattacgccgaggccgccgccgcggtgctgagcgccgcggacccggccggcggcgccgacgcgccccgcatccacgaactcgccggcgacggcgcctacacgctcgcggagttcgccgccgagatcgcccggcaggcgcggcgtcccgtcgcctaccgggacctgacggaggccgcgttcaaggacgccctgctcggggccgggctgccggagccggtcgcggcgctgctggcccagtcggacgcggcggccgcgcggggcgcgctcttcgacgacggacgggcgctcagccggctcatcggccggccgacgacgcccgccgccgtcacggtcgccgcagcgctgcggcgttga

SEQ ID NO: 419 - DNA, 861 bp, Escherichia coli O157 H7 EC4115
atgatcgctattactggtgccactggccaacttggtcagtatgttattgaatccttgatgaaaacggttcctgccagccaaatagtggctatcgttcgtaatccggcaaaagcccaggcactgacagcacaaggcattaccgtgcgtcaggctgactacggcgatgaagccgcactgacatctgcacttcagggagtggaaaaactactgctgatctcttccagcgaagtgggtcaacgtgccccgcagcatcgtaatgttattaatgccgcaaagacggctggcgtgaaatttatcgcttataccagcctgcttcacgcggataaatctccgctcggcctcgccgatgagcacatcgagacggagaaaatgctggctgattctggcatcgtttacaccctactgcgcaacggctggtacaccgaaaactacctcgccagcgccccggcagcactggaacacggcgtatttatcggtgcggcgggcgatggcaaaatcgcctcagcaacgcgggcagattatgcggcagctgcggcacgcgtgattagcgaagccggtcacgaaggcaaggtttacgaactggcgggcgatagtgcctggacgttgacacagttagcggcagagctgaccaaacagagcggcaaacaggttacctatcaaaatctgagcgaagccgatttcgccgcggcactgaaaagcgtcggactgcccgacggactggcggatatgctggcggattctgacgttggcgcatcgaaaggcggtctgtttgatgacagcaaaacacttagcaaattgattggccacccaacgacaacgttagccgaaagcgtaagccatctttttaatgttaataactag

SEQ ID NO: 420 - DNA, 909 bp, Rhizobium leguminosarum bv  trifolii WSM2304
atgagcgaaaccatcctggtcaccggcgctgccggacagctcggccagcgcgtcatccatcacctcatcgagacctacaaggtcgcccccggcacgattgtcacggcgacgcgaagcccggaaaagcttgctgaactcgcaaacaagggcgtcgtcacccgcaaggccgatttcgatgacgcggcaggcctcgagaaggcgttcgccggcgtcgaccgcctgctgatcatcagcaccgatgcgctggatacccccggcaaacgcctcgcccagcacaaggcggccgttgccgctgccgccaaggctggcgtcaagcacatcgcctatacctcgatgccgtcaccggacgattcgctcgtcaccttcgcgccggatcatctcggcagcgaaaacgccatcaaggcgagcggcctcgcctacacgatcatccgcgacgcctggtatcacgacaattacctgcacagcatgccgcacaacctgcagggcggcaaatggtacagcgccaccggcgacggcaaggtctcgaccatctcgcgtgacgactgcgccctggcgatcgccgccgcccttgcctccggcacatcggacagcgccacctacacgctgaccggcgcggcgtcgctcaacaaccgccagatcgccgccatcgccgccgaagccgccggcaagccgctcgaagtggtcgacgtcaatgatgagcagctcggccagggcatgcgcggcgccggcctccccggcttcgtcgccgacatgctggtttccgccgacgccaacatccgcgccggcaagttcgacatcgtcaccgaggatttcaccaagctgacgggcaaacagccgcaatcgctgaaggatttcttcgtggcgcataaggctgctttgacggcggctggaaacgccggaggccactga

SEQ ID NO: 421 - DNA, 885 bp, Rhizobium leguminosarum bv  trifolii WSM2304
atgtccgacacacttctcgtcaccggcgccgccggccacctcggccgccttgtgctcgacaacctcctggcatccggcacggagccttcgcgcatcatcgccgtcagccgcgacacggccaagctcgccgattatgccgccaagggtgtgcagacccgcaaggccgacttcgaggacagcgcatcgctcgacgctgcctttgctggggccgaccgcatcctgatcatctcgacggatgcactggacgaggccggcaagcgcctgcgccagcatctggccgccgtagccgccgccaagaaggcaggcgccaagcatatcctctacacctcgatgccgaacccggaaacatcggtcatcccgtttgcgccggatcacctcggcaccgaaaacgccatcaaggcgaccggcattccctacacgatcctgcgcaacggctggtacatggaaaacctgtttctgtcgctcccgcatgcgctgtcaaccggccagtggtttaccagcacgggcgaaggccggctcgcccatatctcgcgcgccgacatcgccgcagcgaccgcggcggcccttgccgcaacctccagtgaaagcgttacctacaccctaactggggcaaagagccttaatacggccgagatcgcgagcttggtcaccaccgccaccggcaagccgctgcaggtcattcagatcaccgacgaacagcttgcaggcggcctcgaggccgctggcctgccgggcttcatgatcccggtcatcgtttctttcgataccaacacccgggaagatcatatcagccttgtcacggacgacgccgtgaccctgtccggcaagccgctgacgacgctttcgagcttcctcgacaccaacaaagcagctctcgccggctaa

SEQ ID NO: 422 - DNA, 894 bp, Methylobacterium chloromethanicum CM4
atgagcacatccgaaccgcgtcttttcgtgaccggtgccaccggccagctcggccggctggtgatcgaagccttgctgaagcgggtgccggccgacagcatcgtggcgggtgtccgctcgctggagagtgctgcggctgaggacctgcgcgcgcaaggcgtcacgctccgtgtggccgactacgcgcgtcccgagacattggcggaagcctttcgcggcatcgaccgcctgctcctcatctcgtccagcgagatcggccagcgcgttgcccagcaccagaacgtcatccaagccgcccggcaatccggcgtgagcctgatcgcctataccagcctgcttcgcgccgacacctcgccactcgccctggcagacgagcatcggcggacggaagacgcgctgaaggcttccggcctgtccttcgccgtgctgcgcaatggctggtacaccgagaactacgcagcctcgatcgcgccggccctggcccacggggtacttctgggcagtgcgggcgagggccggatcgcctccgccgcgcgggcggacttcgccgaagccgccgccgtcgtgctgacgacagacggccatgacggacgcgtctacgaactggcgggggatgacgcctacaccctggacgagttcgcggcagcggtgagcgtgctgtccggccagacggtcgtctaccggaacctgacggaggctgcgttcaaggcggccctggtcgccgccggcctgccggaggacttcgcggcgctgctcgccgattcggacatggcagcggcccagggcggactcaacgatacgaaccgccagttgagcgggcttatcggccgaccgacgaccccctatcgcaccacaatcgccggaacgatcagcgggatggcggcccaaggctga

SEQ ID NO: 423 - DNA, 867 bp, Arthrobacter chlorophenolicus A6
atgagcatcgtcgttaccggagccaccggacagctgggccgccacgtcctcgaagcactgctggagcgcaacgttcctgccggtgacatcgtggccgccggacgttccgtggacaagctggcagatttcgccgccaagggcgtccgcgtcgtttccgttgactactccgacgccgactccgtggctgctgccctcaagggtgccacccgcatcctgctgatctcgggcagtgaagtgggccagcgggtggagcagcaccgcaccgtgatcgaggccgccaaggctgagggcggcgtggaactgcttgcctacaccagcatcgccaacgcggacaccaccggcatgaagctggcggacgagcacaaggcaacggaggaactcctgcgcgaatcaggcgttccgttcgccctcctgcgcaacggctggtacctggagaactacacggagcagctgcccgggacccttgcgcagggtgccatcgccggcagcgcgggtgacggcaaggtcagcggtgcgtcgcggcaggattacgcccaggcggccgcagcagtgctggtggccgacggccaggccggcaaggtctacgagctcggcggcgaccacgccttcagcatggccgacctcgccgcggaaatcaccgcggccacgggcactgacatcagctacaacaacatgcccagcggcaattatgcaggcctcctggcacaggtgggtgtaccgcaggcgtttgcggagatcctggcagactcggacctgggcatcgcccggggcgacctcctggtcaccaccggcgatctgcagaagctgatcggacgccccacgacgtccctcgccgaggcggtccggtccgccgcggcctcggcctag

SEQ ID NO: 424 - DNA, 873 bp, Anaeromyxobacter dehalogenans 2CP 1
gtgatcgccatcaccgccgcctccggaaagctcggccaccaggccgtcgaggccctgctgaagcgcgtccccgccgcaacgctggtggcgctggtccgccaccctgcgcgggcggccgatctcgccgccctcgggctccaggttcgcgagggcgactacgaccggccggccacgctcgacacggcgctcgcgggcgtggagaagctgctcttcatctccggcagcgaggtcggccggcgcgtgccgcagcaccaggcggtcgtcgacgccgcccggcgcgcgggggtcgggctggtggcgtacaccagcatcctgcacgcggacacctccggcgtgatgctcgccgtcgagcaccgcgagaccgaggccatgctccgcgcctccggcgtgccgcacgtgctgctccggaacggctggtacctcgagaactacaccgagcacctggggccggccctcgcgcacggcgccatcgccggggcggcccgcgacggccggatcgccggcgccgcgcgcgccgactacgcggaggccgcggccgccgtgctgaccggcgagggccacgagggccgcgcgtacgagctggcgggcacgcccttcacgatggccgacctcgcggcggaggtctcgcgccaggccggcaagccggtcgcctaccgcgacctcccacccgcggactaccgcgcggtgctggtcggcgcgggcatcccgggaccgtacgccgacgcgctggtggacgcggacctgggcgtcgcccggggcgagctcgacgacgcgagcggcgacctggagcggctcatcgggcgacccagcacgccgctcgcgaccgcggtggcggcggcgctcgccgcgctcggcgcgcggccacgcgcctga

SEQ ID NO: 425 - DNA, 876 bp, Agrobacterium vitis S4
atgaccaaaatactgattaccggagcatccggaaagcttggaagacttgtcatcaaccatttgctggaaagccagcatgttgccgctgctgatatcgtcgctgccagccgcaacccgtctggtctggcggatcttgccgcaaaaggcatcgaaacacgtcaggccgactttaccgatccggcatcgcttgaccaggccttttccggcattgaccggctgctgatcatttccaccgatgccatcggttcgcgcgtcgagcagcacaaggcagcggttgccgccgccgccaatgccaaggtcggccggattttctacacatccatgccaaatccggagacatccaagatcctgtttgctcccgaacatgcgcagaccgaacaggccatcaaggcttccggccttgcctatacgattttgcgcaacaactggtacatggaaaatctattcatgacgctgccatcggcgctggccagcggccagtggcatacatccgccggagagggcaagaccgcctatatcgcccgagaagacattgcccgcgccattgccagcgccctggccaagccagtggccgaaaacatcgtctatacgctcagcggcagccgcgcctatagcaacagagagattgccgccctggccgaaaaagccacgggcaagccgcttgccgtggtcgacatcaccgaccagcagttggaagacggcatggtcgctgccggcattcccaaacccgtagcgccggtgttcgcttcaatcgatacggccatccgcgccggtgacctggatgtgataactgatgatgcgcaaagcttgtcgggccatccattgctgtcgctagaggccttcatcgaagcaaacaaggcctccctcatcggctga

SEQ ID NO: 426 - DNA, 816 bp, Actinosynnema mirum DSM 43827
atgaccacgctgatcaccggggccaccggccacctgggcgccctcatcgccgaccacgtcctcacccgcatcccggcctcggagctggccgtctcgacccgctcgccggagaaggccgaggcgctctccgctcgcggggtcgacgtgcgcaaggccgacttcgacgacgccgagtccctgcgcgcggcgttcgcgggcgtggaccggctcgtgctggtgtcggcggacgggccggaccggatcgcccagcacacccgcgtggtcgaggccgccaaggccgcgggtgtctcgttcatcgcctacacgagcgtggtggacgccgacacgtccacgctctccctcgcccccgaccacgcggcgaccgagcgggtcatccgcgagtccgggatcgcgttcgcgttcctgcgcaacggcatgtaccacgagaactacacccaggcgctgggccacggggtcgtcgcgcacgccgccggtgacggccgcaacgccagcgcctcccgccacgacctggccgaggccgccgcggtcgtcgtcaccggcgagggccacgagggcaaggtctacgagctgaccgggccgagcgcgtggacgttcgccgagctggccgcgctggcgggcgacgaggcgaagccggtgacggcgcaggagcggatcgccgggctggtcgggttcgggctgcccgacttcgtggcggagctgctgaccgacatcgaggtcaacatcgggcggggcgcgctggagcgcgtcaccgacgacctgccgaccctgctgggccgcccggccaccccgatcgccgaggcggtcgcgaaccgctga

SEQ ID NO: 427 - DNA, 906 bp, Rhizobium leguminosarum bv  trifolii WSM1325
atgagcgaaaccatcctggtcaccggcgctgctgggcagctcggacagcgtgtcatccatcacctcatcgagacctacaagatcgcccccggcagcattgtcgcggcaacgcgcagccccgaaaagctctccgaactcgaaaagaagggtgtggtcacccgcaaggccgatttcgatgacgcggccggtctggaggaggctttcgccggcgtcgaccggttgctgatcatcagcaccgatgcgctcgacacccccggcaagcgccttgcccagcaccagggtgccgtcgcggcggcagtcaaagcaggcgtcaagcacatcgcctacacctcgatgccggcgccggacaattcgctcgtcaccttcgcgcccgatcatctcggcagcgaaaacgccatcaagtcaagcggcatcgcccatacgatcatccgcgatgcctggtaccacgacaactatctgcacgggatgccgcacaatctgcagggcggcaaatggtacagcgccaccggcgacggcaagatctccaccatctcgcgtgacgactgcgcgttggcgatcgccgcagcccttgcctccggcacatccgagagcgccacctatacgctgaccggcgcgcaatcgctgaacaaccggcagatcgccgccatcgtctccgacgtcgccggcaagccgctcgcggtcgtcgacgtcaatgatgagcagctcggtcagggtatgctcggcgccggcctccccggttttgtcgccgacatgctggtctctgccgacgccaacacccgcgccggcaagttcgacatcgtcaccgaagacttcaccaagctgaccggcaaacagccgcagccgctgaaggatttcttcgtggagcacaaggcggcgctgacgacttcaggcaatgctgcgcattga

SEQ ID NO: 428 - DNA, 852 bp, Pectobacterium carotovorum PC1
atgattgctattactggtgcatctggccaactgggccgtttagtcattgcacaactgttagagaaggttccggcgggcgacatcgtggcgctggtgcgtgatgtcaataaagttgccgatctgtctgcaaaaggcgtgctggtgaaagcggcggattataatcaacctgaagcgctggcgtccgccttgcaaggtgtggataaagtgctgctgatctcttcaagtgaggttggccagcgtgcggcgcaacaccgcaacgtcattgaagccgcagtgaaagccggcgtgaaactggttgcgtacaccagcctgctgcacgcggataagtcccctctggcgctggcggaagaacaccgtcaaacggaggccttgctgaaggactctggtttaccgcatgtcctgttgcgcaacggctggtataccgaaaactatgcggccagcatccctgcggcgctggaacatggtgtgtttatcggtagcgcgggcgaaggcaaaattacgtctgcaacccgtgaagacttcgccgccgctgcggtcgcggtgctgacgcaggaagggcaggctggcaaggtttacgaactggctggtgatgaaccttatacgctggcggaactggctgctgaaattagcaaacagtcgggtaaatctatcggttatcaaaacctgtctgaagcagagttcaccgctgcactggtttccgctgggctccccgatgttttcgcgcagattattgcggattctgacgtcggtgcatccaaaggtgggctgttcgatggcggtaagcaactgagccgtctgattggtcgcccaacgacgccgctgtcagccgtagtgaaagcaacgctgaagtaa

SEQ ID NO: 429 - DNA, 876 bp, Chitinophaga pinensis DSM 2588
atgggtaaaatactagtgacaggcgtaacaggacatcttggtcgtgccgtattagataaactgctggtaaaagtgccggcatcaaatgtgaaagtcctggttcgcgatgcggccaaagcggaggcattcaaaccactgggcgtagagatcgccataggcagttatgacgacaaagcatccctggtggctgcttttcaggatacagacaaactgtatttcgtatccggcaatgacgtggcgaatcgcggtccgcagcatgaaaacgtagtcaatgctgctattgctgccaaagtaggccatgtagtctacaccagcgtacagcgtaagagcgaatccgcgacttcttcgctggcatttatagcatcaactcacctgttggtagaaaacctgctgaaagcttccggtctgcaatataccattatggagcatggcttatatgctgaggtgattccgatgtttgtaggagacagagtactggaaactggcattatcttccagcctgcaggagccggcaaaacggcttacgcattacgcgaagatatggcagaagccggcgtagccgtactgacaggagaggggcatgaaaaccgtaattatgtgatcacgggttcaaaagcaatctcttatacagacatcgcagcagccattagtgcagctaccggcaaacaggtgacttatgtatctccaactgtggaagcatttaaagaggaactgaccaaagtaggtgtgccggagatgtatattggtttgtttgcaggcttcagtacagctgttaaagagggcgaatttgaagaagtgagcggtgatctggaaaaactgatcggtcgtaagagcggcagtgtagaggcgtatctgaaagagacatacggcaaatag

SEQ ID NO: 430 - DNA, 864 bp, Catenulispora acidiphila DSM 44928
atgaccatcgccatcaccgccgccggcggccacctcggccggctcgtcgtcgaggacctgctggcgcgcggcgtcccggcggggcagatccgcgccatcgtgcgcaccccggagaaggtccaggacttcgccgaccgcggggtgcaggtggtccgaggcgactacgccgacgtccccggcctgaccgaggcgctgcgcggcgccgacaagtgggtcttcatctcctccagcggctccgacgaggaccgcttgagccagcacctgaccgcgatccaggcgggcaaggcggccggcgtgccccacgtcgtctacacctcgatcccgaaggccgagaccaacccgatcagcttcgcctcggtccacaaggagaccgaggccgcgatcaaggagtccggtctgccgcacaccttcctgcggaacaactggtactgggagaacctgaccgcgagcctgccgaacgccatcgagcacggcgcgatcatcggcgccgtcggcgagggcctgaccgcgttcgccgcgcgggccgactacgccgccgcggccgcggtcgtcgccaccaccgagggccacgagggcaagatttacgagctcaccggcgaccgcgcctacagctacgccgagatcgccgccgagatctcgcgccagaccggcaaggagatcgcggccgtgaacctggaccccgaggagtaccggaagacgctggccggcttcggtctgccggacttcctgtccgcgggtctggcccacgcggactcaaagatcgccgagggcgcgctggccgacgtcaccagcgacctcagcaccctgatcggccgcccgaccaccacggtcgccgaggcgatcacggacgcgctcaaggcctga

SEQ ID NO: 431 - DNA, 1101 bp, Clostridium perfringens SM101 uid12521
atgaatgaagaatttctaggggcattatctgaaatagtaaaagagaaaggtatttcagtagaggctttattagaaactatagatgatgctataatagcagcttataagaaaaacttttcaaattcaggaacaactgcacaaaatgtaaaggtaaaacgtgatgagaaatcaggagaaatccatgtttatgctcaaaaagttgttgttgaagaagtttatgatgatgtaacagaaataagtttagaagatgcaaaggctattagtgctatttatcaattagatgatatagtagaaatagaagtaacacctaaaaactttggaagagttgcagcacaacttgctaagcaaatggttatccaaagaataaaagaatctgagagaaatgtaatttactcagaatttgcagaaaaagaatttgacatattacctggtacagtaataagaaaagataaaggtaatgtatttgtagacttaggaaaaatagaaggtgttttaggaccaaatgaacaaatgcctacagaaaaatataacttcaatgaaaaattacaattatacgtagttgaagttaagaaaacatctaaaggtgcttcagttttatgttcaagaacacatccaggtttagttaaaagattatttgaattagaagttccagaaatatatgaaggaatagttgaaataaaaagtatagctagagaagcaggatcaagaactaaaatagctgtttactcaaatgatgaatcagtagatgctatgggagcttgtgttggacctaagggtgttagagttcaaaatatagttaatgaactaaaaaatgaaaaaattgatataataaaatggagtaatactccatctgagtatatagaaaatgctttaagcccagctaaggttgtaagtgtagaagctgatgaagaaactaaatcagctaaggttatagttgatgatagtcaattatcattagctataggtaaagaaggacaaaatgttagattagcagctaaattaactggttggaaaatagacataaagagcaaatctaaagcagaagaattattacaagaagaagatattgttgttaaagaagacactataatagaagaataa

SEQ ID NO: 432 - DNA, 1152 bp, Streptococcus agalactiae 2603
atgagcaaagaaatgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaataa

SEQ ID NO: 433 - DNA, 1107 bp, Bacillus cereus ATCC 10987
atgagcactgagttgttagatgccttgctcgtattagagtcagaaaaaggaattagtaaagatattattattgatgcgattgaagcagcgttaatctctgcttataaacgcaattttaaccaagcacaaaacgttcgtgtgagctttaacccacaagtgggaacaatccaagttttagcacgtaaagacgttgttgataatgtgtttgatccacgtcttgaaatttctgttgaagaagcaagacaaattaatccaaactatcaagatggtgacgtactagaaattgaggtaacgccaaaagatttcggtcgtattgcagcacaaactgcaaaacaagttgtaacacaacgagtgcgtgaagcagagcgtggtgttatttactctgagtttagtgatcgtgaagaagatatcatggttggtatcgtacaacgtcaagatgctcgtttcatctatgtaagcttagggaaagtagaagctttattacctgtaagtgagcaaatgccgaacgaacagtacaaaccacatgatcgtattcgcgtattcattacgaaagtagaaaaaacaacaaaaggaccacaaatttacgtatcacgtacacatcctggtcttttaaaacgtttattcgaaatggaagttcctgaaatttatgatggaacggttgaaattcgttctgtagcacgtgaagcaggagatcgttctaaaatctctgtacatgcagagaacattgatgtggatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgttaaagtgcttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggaattgtaacagaagaagatagcgtagtcgcattcggattcgattcagttgaagacgaaatcgagtag

SEQ ID NO: 434 - DNA, 1119 bp, Listeria monocytogenes 4b F2365
atgagcacagaattattagatgctcttcatgtgttagaacatgataaaggtatttcaagagaggttttagtagaagcaattgaagctgctcttacatccgcgtataaaagaaacttcaaagatgcacaaaacgtacgtgtagatttaaatatggaaaatggttctatccgtgttttagctagaaaagaagcagtagaacaagtatttgattctcgccttgaaatctctatggaagaagcacacaaactgaatccagtatacaaaccaggtgacgtcgtggagcttgaagtaacaccaaaagattttggccgtatcgcagctcaaacagcgaaacaagttgtaacccaacgtgttcgtgaagcggaacgtggcatcatttacgatgaatttatcgatcgcgaagatgatattatgactggtattgttgaacgtcaagattctcgttttatctatgtaaaccttggtaaaatcgaagcaattttgtcccaaaacgagcaaatgccaaacgaaacttatcatgcacatgaccgcatcaaagtatatttaacaaaagtagaaaagacgacaaaagggccgcaaatttttgtatcccgtacacaccctggcttactgaaacgtctttttgaaatggaagtacctgaaatctatgacggcgttgtagaaatcaagtctgttgcacgcgaagcaggagatcgttctaaaatctctgtttacactgcaaatgaagaagtagatccagttggcgcatgtgtaggaccaaaaggcgcacgtgtccaaacgatcgtcaatgaacttaaaggcgaaaaaatcgatatcgttgaatggtcagaagatcctttcacattcgtagccaatgcacttagcccttccaaagtgttagatgttattgtgaacgaagcagaccaagcaacaacggtaatcgtaccagactatcagttatcactagcaattggtaaacgtggtcaaaatgcccgtttagcagcaaaactaactggttggaaaattgatattaaaagtgaaacagttgcaactgaactaggcatctatcctcgtaatgacgtagaagcgccagaagtggaagatgcagagagcgaaacttattcagaagatgaagagtaa

SEQ ID NO: 435 - DNA, 1107 bp, Bacillus anthracis Ames 0581
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaatccaggttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttagggaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaagcaggagatcggtctaaaatctctgtacatgcagagaacattgatgttgatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattcagttgaagacgaaatcgaatag

SEQ ID NO: 436 - DNA, 1107 bp, Bacillus anthracis str Sterne; identical to SEQ ID NO: 435

SEQ ID NO: 437 - DNA, 1107 bp, Bacillus thuringiensis konkukian
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaattcaagttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttagggaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaagcaggagatcgttctaaaatctctgtacatgcagagaacattgatgttgatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattctgttgaagacgaaatcgaatag

SEQ ID NO: 438 - DNA, 1416 bp, Mesoplasma florum L1
atggtaaacggagcacaaatattagaagcattagcttcattagaaagtgaaaaaagcattagcaaagaagttgctattgaaggaattaaagaaggattccaaaaggcttatgaaagattttttgatacagaagctgtagttaaaactgaaattaatgaacaaacaggatcaatcaacttgtttcaagaattaatggtagtagcaacagatgatgaaatcgaagatgattgattagaaattgttttagaagatgctttaaaaatcaataaagaagcaaaagttggagataaagtatacaaaccaattgattttgatgaagaattctcaagagtagctgttggacaagtaagacaaatcttccaacaaaaaattagagctactgaaagagctatgatttatgaaaaatttattcaattagaaggtgaaattgttagaggtaaaatcgttggaatgaacgatcaaggaacttcatacattttagatattgatggagtacatacttcattatgaaaccaaaaaacaatcaacagagaagaatttgttgttaacgaattagttgatgttttattagaagaagttgctagagaaaataaatactcacaattagttgtttcaagagtagcacctaaatttttagctaaattagttgaaaaagaagtaagtgaagttgctcaaggattagttgaagtaatgtcagtttcaagagaaccaggtaaacgtgcaaaaattgctgttttatcacatgatgaagatgtagaaccaattggagctattgttggagttaaaggttcaagaatcaataacatttcaaaagaattaagaggagaaaaaattgatgttgttaaatgagatgatgaaatcattccatttattattaacgcaatggcacctgttaaggttatttctgtaaatgaagttgaaggtgaatttgatatagtagttcctaatcaacaattatcattagctattggtaaaggtggaatggctgctaaattagttgctaacttattaaaacgtcgtattaacatttacagcttagaaaatgctattactgacaacatggatgttttatgaaatggaaacattacagaagaagaagtaaacaacccagactttattaacgaagtaaacaaacgtaaaatcaactctcaaacagttaaaccagaataccacaaaaattcatttagaaatgcacaagcaaataatgaagaagaattaatgagtttccaagctgaagttgaggaagaatacaaccaagttgaagaattaattgaagaaacaaatgcagttgttcaagaaaataaagatttagagtcaattcaatctgaactagaatcatttaatgatattttaaatgatgaagatgaagaagattttgaagaagacgaatacgaagatttatatgatcaagaataa

SEQ ID NO: 439 - DNA, 1107 bp, Bacillus cereus ZK
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaatccaagttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttagggaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaagcaggagatcgttctaaaatctctgtacatgcagagaacattgatgttgatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattctgttgaagacgaaatcgaatag

SEQ ID NO: 440 - DNA, 1476 bp, Dehalococcoides ethenogenes 195
atgaaaagcgactttttgctcgctatcacccagctctcggcagaaaagaatctgccaaaggaagtagtacttgctaccgttgagtcggctttggtatcggcttatcgtaaagagagctttgctccaaaccagaatatcgcggtgaagatagaccagctgactggcaaggtaaaggtcatggccgaaaagctggtagttgaaaaagtgactgacagccgccaggaaatgcgtttgcttgaggccaaacggctgaaagctgatgccaagataggcgaccttatgatggttgaagatactccggctgatgccgggcgtattgctgcccaaactgccaagcaggttatcctgcagcgtctgcatgaagcggaaaatacggctatttttgacgaatatgcctccaaggcgggtgacaccctggtaggcgtggttcagcgtatagagcccaagcagattactgttgatataggccgggtggaagccataatgcccgccagcgaacaggcatacggtgaaaggtatcgggccgggcagcgtataaaggtgtatgtagtggatgtggctaaaacagccaaaggcccggctgttattgtttcgcgttctcaccccggtttggtacggcgtctgtttgaaatggaagtgccggaggtttttaaccagctggtagagataaaggcggttgcccgtgaagccggttcacgctctaaagtagcggtaggcgctttacagccggggattgacccggtgggttgctgtgtgggtttgcggggtatccgcattcagaatattgtcagtgagctgaacggcgaaaagatagatgtggtggcctgggatagtgaaatagctaattttattgccaattcacttagcccggctcaggttacaaaagttattctgaacgaagctgaaaaatctgctattgtggtcatacctgaccgccagctgagtttgggtattggtaaagaaggacagaatgtgcgtctggcggttaagctgaccggctggcggattgatattaagagtgcctctgatgaagaggtggaacgggcggaagaaactgcccgcaagcagggggaaactgaaaagcctgccataaccgaaaaggttattgaaaaacagcctgccgctgcacctgctgccaaggccgaagcagaacctattgagccggtcatgcctgaggctataatagccgaaccggcggtgaaggaaacacctgccaagactgaagccgtgcctgaagaacagggtgtggtggtaccccttaatgtgctggataaagtggctgagggtgatacagtcaaactgcgttttgcagaagatttgctgccccggcgtgaaatagtcatagatgataaaaacaagggtaaaaacaagaaaaagaccgtcaaaggcaaagataccgctgaagatggtatcaagctgaagggcaaaaaacggcggaatgtaacggattatgaatcagaggaaatcgacttctaa

SEQ ID NO: 441 - DNA, 1176 bp, Staphylococcus aureus COL
gtgtcaagtaatgaattattattagctactgagtatttagaaaaagaaaagaagattcctagagcagtattaattgatgctattgaagcagctttaattactgcatacaaaaagaattatgatagtgcaagaaatgtccgtgtggaattaaatatggatcaaggtactttcaaagttatcgctcgtaaagatgttgttgaagaagtatttgacgacagagatgaagtggatttaagtacagcgcttgttaaaaaccctgcatatgaaattggtgatatatacgaagaagatgtaacacctaaagattttggtcgtgtaggtgctcaagcagcgaaacaagcagtaatgcaacgtcttcgtgatgctgaacgtgaaattttatttgaagaatttatagacaaagaagaagacatacttactggaattattgaccgtgttgaccatcgttatgtatatgtgaatttaggtcgtatcgaagctgttttatctgaagcagaaagaagtcctaacgaaaaatatattcctaacgaacgtatcaaagtatatgttaacaaagtggaacaaacgacaaaaggtcctcaaatctatgtttctcgtagccatccaggtttattaaaacgtttatttgaacaagaagttccagaaatttacgatggtactgtaattgttaaatcagtagcacgtgaagctggcgatcgctctaaaattagtgtcttctctgaaaacaatgatatagatgctgttggtgcatgtgttggtgctaaaggcgcacgtgttgaagctgttgttgaagagctaggtggtgaaaaaatcgacatcgttcaatggaatgaagatccaaaagtatttgtaaaaaatgctttaagcccttctcaagttttagaagttattgttgatgaaacaaatcaatctacagtagttgttgttcctgattatcaattgtcattagcgattggtaaaagaggacaaaacgcacgtctagctgctaaattaaccggctggaaaattgatattaaatcagaaacagatgcgcgtgaagcgggtatctatccagtagttgaagctgaaaaagtaactgaagaagatgttgctttagaagatgctgacacaacagaatcaaccgaagaggtaaatgatgtttcagttgaaacaaatgtagagaaagaatctgaataa

SEQ ID NO: 442 - DNA, 1224 bp, Staphylococcus epidermidis RP62A
gtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttcggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaactgatgaagataaaaaagataaaacagaagaagataatgacacagaatcatag

SEQ ID NO: 443 - DNA, 1494 bp, Prochlorococcus marinus NATL2A
atggctcttgttctactcccaggcttaaataacttaattgaagacattagtgaggaaaaaaagcttccatcacaagtcgtcgaagctgctttgagagaagcacttctaaaaggttatgaacgatatcgaagaactctttatttaggtatcagcgaagatccttttgaagaagattatttcagtaactttgatgttggtttagatctagaagaggaggggtatagagttttagccagtaaaataatagttgaggatgtagagagtgatgatcatcaaatagcaatagcagaggttatgcaagttgctgatgatgctcaagttggcgataccgttgtactagatgtgactccagagaaagaagattttggaagaatggctgcggctacaaccaagcaggttttagcccaaaaattgagagatcagcaaagaagaatgattcaagaggaatttgctgacctagaagatccagtgctaactgccagggtcattagatttgaaaggcaatcagtaatcatggcagtaagctctggtttaggtagaccagaagtagaagcagagcttccaagacgagatcaattgccaaatgataattaccgagcaaacgcaacatttaaagtatttcttaaagaagttagtgaaacacctaggagagggcctcaactttttgttagcaggtcaaatgctggattggttgtatatctgtttgagaatgaagttcctgaaattcaagaaggttcagtacgtatagttgctgttgctcgtgaagcaaatcccccttcaagagcagtaggtcccagaacaaaagtagctgttgacagtattgaaagagaggttgaccccgttggagcatgtattggtgcaagaggtgctcgaattcaacaagttgtaaatgaacttcgtggagaaaaaatagatgtaattcgttggtcttcagaccctgttcaatacatctgtaattcattaagtcctgcaagagttgaagtagttagacttgtggatccagaaggtcagcatgctcatgtcttagttcctccagatcaacttagcctcgcaattggtagagaagggcaaaatgtaagacttgctgcaaggcttacaggatggaaaatagatatcaaaaattcacaagaatatgatcaagccactgaagactcggaggttgcggaattaatttctcaaagagaagaagaagaatctttacagagagaagctgagaagagattagaggcagaacagacagctagagctgaggaagatgcacgcctaagagagctataccccctcccagaggatgaagaagactttcaaaatgaggaattgtcaaacatcgatagcaatgaaacagaatctgaatctgattttgaatcttctgaaattgattcaaatatcgatactgatgacgctgaaaccgaagaaagtgatattgatgaaacaatcgaagacacagttactgctaaagataaaataattacagaagaggaaggaacccggtga

SEQ ID NO: 444 - DNA, 1278 bp, Anabaena variabilis ATCC 29413
atgtcaatggttagtttaccaggattaaaagatttaatagaaagtattagtcgtgaacggaatttgccccggttagcggttcaagctgctattagagaagccttacttaagggttatgagcgttatcgtcgcgctcaaaacatcgagcgcaaacagtttgatgaagattattttgataactttgaagtcgaactagatattgacgaggaaggatttcgcgttctttccacaaaatccattgttgaagaagttaataattctgaccatcaaatctccttagatgaagtacagcaagtagctcccgaagcccaattgggagactcagtggtactagatgtcaccccagaccaaggtgaatttgggcgcatggctgccatgcaaaccaagcaagtactggcgcaaaaactgcgggatcaacagcgccagatggtgcaagaagagttccaagacctagaaagcacagttctccaagccagagttttgcgatttgagcgccaatcagtcattctggcagttagcagtacctttggacaaccagaagtagaagccgaattgcccaaacgcgaacaattgcccaacgacaattatcgggcaaatgccacatttaaggtttatctcaaaaaggtttcccaaggtcagcaacgcggcccacagttattagtctcccgtgctgatgcaggtttagtagtttatctatttgccaacgaagtaccagaaattgaagacgaagtggtacggatagttgccgtagccagggaggcaaaccccccttcccgctatgtaggcccaaggactaaaatagcagtagataccctggatcgtgatgtagaccccgtaggggcttgtattggtgctaggggatcacgcattcaggtagtagtcaacgaattacgcggcgaaaaaattgacgtgattcgctggtctccagacccagcaacatacattgctaatgccctcagtccggcgcgagtcgatgaagtgcgcctcatggacccagaaactagacaaactcacgtattagttgcggaagaccaactgagtttggctatcggcaaagaaggacaaaacgtgcgattagctgcccgattgactggctggaaaatagacataaaagataaagccaagtatgaccaagcagccgaagatgctaaatttgtggcggcgcgtgcaaaatatcaactagaggaagatgacatcgaatcagaggagctagactatgaagaaaatcaagaaggagaattagaagacgagtcttttgaccccaacgatgaagagtaa

SEQ ID NO: 445 - DNA, 1458 bp, Synechococcus sp. CC9902
atggctctcgtactgcttcccggtctcaccaatctgatcgatgacatcagtgaagagaagaaactcgctccgcaagttgttgaagcagctttacgggaagccctgctgaagggatacgagcgataccggcgcactctctacatcggcattagcgaagatccttttgatgaggattacttcagcaattttgacgttggtcttgatctcgaagaggagggatatcgagttcttgccagcaaaatcattgttgacgaagttgaaagcgaagatcatcaaattgcccttgcggaggtgatgcaagtagccgaagacgcccaatctggcgacacggtcgtgctcgacgtcacgccagagaaggaagatttcggtcgtatggctgcggccacaaccaaacaagtcctggcccaaaagctgcgggatcagcagcgtcgaatgatccaagaggaatttgccgatctcgaagatcccgtgctcaccgctcgggtgatccgcttcgaacgtcagtcgatcatcatggctgtgagttcaggcctaggcaggcccgaagtggaagcggagctccctcgccgcgaccagctgccgaatgacaactaccgggccaacgccaccttcaaggtgtttttgaaagaggtgagcgaagtaccgcggcgcggtccacagctcttcgtgagccgctccaatgctggcctcgttgtttatctattcgaaaacgaagttccagaaatccaagaaggttccgtccgcatcgtggccgttgcccgtgaagcgaacccaccatcacgatccgttggtccacgcaccaaagtcgctgtcgacagcattgaacgggaagtcgaccctgtcggcgcttgcatcggtgctcgcggatccaggatccaacaggtggtcaacgagctgcgcggtgaaaaaattgatgtcattcgctggtcgcaagatccaggccaatacatcgctaactccctcagtcccgctcgggttgaaatggtgcggctcgttgatcccgctggacaacatgcccacgttttagtaccacccgatcaactcagccttgccattggccgtgaaggtcaaaacgtgcgtttggcggctcgactaacgggctggaaaatcgacataaaaaattcaactgaatacgaccagcccgctgaagatgcagttgttgctgaactgatttctcagagagaagaagaggaagcgcttcagcaagaagcggaggagcgcttagcggtggaacaagccgcaagggcagaagaagatgctcgcctccgggagctctatccactcccagaagatgacgaggactatgtcgaggaagctgaactctccgaagaaccctctgccgaatttgtcgagggagatgccgttattgaagacgtagagggggagacagtcgcccctgaagagacaggcgaggccagtggcgatgccgaaaccaacatgagtgaggacgcccggtga

SEQ ID NO: 446 - DNA, 1446 bp, Synechococcus sp. CC9605
atggctctcgtcctgcttcccggtctcagcaacctgatcgacgacatcagtgaagagaagaagctgccgcctcaggtggtggaagcggccctgcgggaggccctgctgaagggctatgagcgctacaggcgcaccctgtatctcggcatcagcgaagacccctttgatgaggagtacttcagcaactttgacgttggcctcgacctggaggaggagggctacagggttctcgccagcaagatcattgttgatgaggtggagagcgaagaccaccagatcgcgatcgccgaggtgatgcaggtggccgatgacgcccaggtgggcgacacggtggtgctggatgtcacccctgagaaagaggatttcggccgcatggccgccgccaccaccaagcaggtgctggcccagaagctgcgggatcagcagcgccgcatgatccaggaggagttcgctgatctggaggatccggtgctgacggcccgggtgatccgcttcgaacggcagtcggtgatcatggcggtcagctcaggcctgggccgtccggaagtggaggcggagctgccccggcgcgatcagctgcccaacgacaactaccgcgccaatgccaccttcaaggtcttcctgaaagaggtgagcgaagtgccccgccggggaccgcagctgttcgtcagccgctccaatgctgggctggtggtgtatctgttcgagaacgaagttcccgaaatccaggaaggatccgttcggatcgtggccgtggcccgtgaagccaatcccccctcccgttccgtgggcccccgcaccaaggtggccgtcgacagcattgaacgcgaggtggacccggtcggcgcctgcatcggcgcccgcggctcccgcatccaacaggtggtgaacgaactgcgtggagaaaaaatcgacgtgatccgctggtcccaggatccgggccaatacatcgccaattccctcagccccgctcgggtggaaatggtgcgtctggtggatcccgtgggccagcacgcccatgtgctggtgccccccgatcagctgagcctggccatcggccgcgagggccagaacgtgcgtttggccgcccgactcaccggctggaagatcgacatcaagaactccaccgaatacgaccaagaggccgaggatgccgtggtggcggagctgatctcccagcgggaggaagaggaagcgctccagcagcaagccgaggaacggctggccgccgaacaggccgctcgggcggaagaggatgcacgcctgcgggagctgtatccgctgcccgaagacgaagaggagtacggcgaggagcagcccgagcaggagttctctgaggaggagcccgctgaggtggaagccggcaccgagtccgagaccgaagccacggatgcagcggttgaagccgatgcggatgccgatcccgatcaggagcaggtccggtga

SEQ ID NO: 447 - DNA, 1407 bp, Prochlorococcus marinus MIT 9312
atggcattagttattctaccaggtttaaacaatctcattgaggacattagtgaggaaaaaaagttacctcctaatattgtggaactagccttgcgcgaagctttattaaaaggatacgaaaaatatagaaaaactttttacattggagttgttgaagatccatttgatgaagaatattttaataattttgatgttggactagatctagatgaagaaggttatagggtattatcgagtaaaataattgttgaagaggttgagagcgaagatcatcaaatatctctagctgaagttaaacaggtagctgaagatgctcaaataggtgacacagttgttttagacgttactccagaaaaagaggattttggacgaatggctgcttcaacaacaaagcaagtgttagcccaaaaattaagagatcaacaaagaaaaatgatccaggaagaatttgcggatttggaagaccctgttttaactgcaagagttataagatttgaaaggcaatcagtcattatgggagtaagttctggtattggtagacctgaagttgaggccgaacttcccaagagagatcaattacctaatgataattacagagcaaatgcaacttttaaagtatttttgaaagaagttagcgaaatagccagaaaaggaccacaactttttgtcagtagagcaaatgctggtttagtggtttatttatttgaaaatgaagtcccggaaattcaagaaggtacagtaaaaattgttgctgtttcaagagaagcaaaccctccttcaagaggtgttggcccaagaacgaaagtagcagtagacagtgtagaacaagaagtggaccccgtaggagcgtgtattggggctagaggagcgagaattcaacaagtagttaatgaactaagaggagaaaaaattgatgttataaaatggtcatctgatccaatacagtatattttaaactctttaagtcctgcgaaagttgatcaagtaagactagttgacccagcagggcaacatgcccatgtactagttcctcctgatcaattgagtctcgcaattggtagagaaggccaaaatgtaagacttgccgcaagattaactggttggaagattgatgttaaaaactcacatgaatacgatcagaaagctgaagatgcggcagtatctgaattaatcattcaaagggaagatgaagagaatctccagcgagaagctgagctaagattagaagcagaacaagctgagcgcgctgcagaagatgcaagattaagagagctttatccccttccagaagatgatcaagaatatgaagaagaagaacaatacggagaaggagacttatcagataatgaccaattagagactcttcaagatagtgaaattgccgcaaaagaggagagaaagcggtga

SEQ ID NO: 448 - DNA, 1326 bp, Synechococcus elongatus PCC 7942
atgtcaatggtcaccctgcccggcctagagcagctgatctacgccattagcgagcaaaaaaaactgcccgccaatgtcattgaagaagccctcaaagaagccttgctcaagggctacgagcgctatcgccgtacccagcagatgggtgagcagtttgaagaagactacttcgacaacattgacgttgaactcgatgtcgaacaggaaggctttcgggtactggcaaccaaaaccatcgtcaatcaggtcgaaaatcctgaccatcagattgccctcgccgatgttcaggaagtggctccagatgcccaagcaggcgaaatcgtcgttctagatgtcacacccgataaagacgactttgggcgaatggcggctattcagactaagcaagtcctgtcgcaaaaactgcgcgatcaccagcgcaaactgatccaagaagagttccaagatctagaagatccggtcttgatggccaaggtgctgcgcttcgagcgccagtctgtgatcttgggggtcagcagtggtttaggacgtcctgaagtcgaggcagaactgccccgtcgcgaacaactgcccaacgataactaccgggccaacgccaccttccgcgtcttcctcaaggaagtcagtgaagtaccccgtcgtggaccgcagttgattgtctctcgggctaacgccggtctggttgtctacttgttcgaaaacgaagttcctgaaatccaagatggtgtcgtccgcattgtggcggtagcgcgggaagcgaatccgccgactcggcatgttgggccgcgcaccaaaatcgctgtcgataccttggaacgcgaagtcgatccggttggggcttgcatcggggcgcggggatcgcggattcaggtggtcgtcaacgaattgcggggcgaaaaaattgatgtgatccgctggtcgccggatccggccacctatattgccaatgccctcagccctgcccgggttcaggaagtgcgcttggtcgatcccgaaggtcggatcgcccacgttttggtcaacgacgaccaactcagtctcgcgatcggcaaagagggtcagaacgtgcgcctcgcggctcgactgaccggctggaaaatcgacatcaaggacgtggcgctctacgacgcagtcacggaaggtcaacggatttctgaactgattcaagaacgccaagagcgggcggcgattgctgccgaagaagaagcccgtgctgccgccgaagctgctgaactggcggaatgggaggcggaagaggctgctctcgcagccgctgaagctgcggcagaactcgcagctgctgaagctgaggaagagactgtttga

SEQ ID NO: 449 - DNA, 1188 bp, Deinococcus geothermalis DSM 11300
atggcccaacctgaatttaattttgcggacgcgttgcgtgaagtggcgcaggcccgcaacatcaatgagctgcagctgatcgaggcgttcgagcagtcgctcgcccaggcctacagccgcaacgtcgaaccggaccgccgggtggaggtgcaccttgacccggtgagcggcgaactcgaagtgctgattgtgcgcgaggtggtcgagaaggtcgaggacgagaacctccaaatctcactcgcggacgccctcgaactcgaccctggcgtcgagatcggcatggagatggagttcccggtcgaccgtgagaagttctcccggatcgccctccaagccgccaagcaaaccctgacgcaaaagatgcgcgagaccgagcgcaacgtggtctacaacgagtacaaggaccgcgagggccaggtgctcacggcgcaggtcgtccgctccgacaacaaaggcaactggtttgtggagctgggcgcgggtgaggcgattttgccgccccgcgagcagatcccgggtgaaaagctggtgcccggcaaccgtgtcaagatctacctcaaggaagtccgcaagacgcccaaggggccaaccattctggcaagccgtgccgacgagcggctgctggagtacctcctgcggcaggaaattccggaagttgccaacggcatcgtcgagatcaaggcgatcgcgcgcgaggcgggacagcgctccaaggtggcggtctacagccataaccccaacgtggaccccatcggcgcctgtatcgggcaccgtggcaaccgcattcaggctgtgaccggcgagctgggccgcgagcgagtggacgtgatcctgtgggacgcaaatgcgcgcgacttcatccgcaacgccctgtcacctgccaaggtgggcctcatcgaggtccggcccgatacccgtgaggcgaccgtcacggtcacacccgatcagctctcgctggccatcggcaagggcgggcagaacgtgcgcctcgcggccaagctgaccggctttaaaatcgacctgcgcgaaaccgccgccattcaggacctcgacgctgccatgcagcaggcgctgcaggaggagcaggggaacaccgggccaagcagcgctgccgcgtccgccttcgacgcgctcttccgggacagcaagtcggtggcgaccgccagcccggacgacgagcaggagtaa

SEQ ID NO: 450 - DNA, 1089 bp, Moorella thermoacetica ATCC 39073
atgaacagtgagtttatccaggcactacgggacctggagagggaaaagggtattaacgccgatattttactggaggccattgaagcggctttaatctcggcttacaagaagaactttggctccctgcagaatgtcagggtggacatccagcgtgataccggggagattaaggttctggcccagcgccaggtggtagaagaggtaaccgatccccggcaggagatctccctcgaggaagctcgggccatcaacagtaaatatgaactgggggacatagtggagaaagaggttactcccagggattttggccgcatcgctgcccaaacggccaaacaggtggtcgtccagcgcatccgggaagccgagcgcggcttgatttatgaagaatttatcggccgggaaaatgacctcgttacgggtgtagtccagcgccaggagggcaaaaacattatccttgacctgggccgggccgaggcgatcctgcttcccagcgaacagagccccggagagacctaccgccagggcgaacgcctgaaggtctatgtcctggaggtcaggaagactaacaaagggccccagattctcgtgtcccggacccatcccggcttgataaagaggcttttcgagctggaagttccggaaatccacgatggcattgttgaaattaagggagtcgccagggaacctggggcgcgctccaagattgccgttcattcccgggatgaaaaggtggatccggtgggctcctgcgtaggtcccaagggggcacgggtacaggctgtggtccaggagctgcggggcgagaaggtagatatcattaaatggagcgatgacccggctgtttatgtggccaactccttgagcccggcccgggtcctggacgtgactgtcgacgaagaaaataaggtgagccaggtcatcgttcctgataaccagctctccctggccattggtaaggaaggccagaatgcccgcctggcagccaggatcaccggctggaaaatcgatattaaaccggaatccgaagctggcgattgggattcctgggatgccgacctggatcttgacggcacgatagaggaggagtaa

SEQ ID NO: 451 - DNA, 1281 bp, Trichodesmium erythraeum IMS101
atgtcaatggttagtttgcctggacttaaagagttaatcggaaatattagtaaagaacgtaatttaccaaaacaagcagttcagactgctttacgagaagctctattaaaaggatatgaacgctacagacgaactcaacgtgtagatggagtcaacttcacagatgattacttcgaaaattttgaaatagaactggatattgaagaagaaggttatcgagtattagctacaaaaactattgttgaagaagtaacaaatccagatcatcatatagctctccaagaagttttagaagtagcctcagaagctcagttaaatgatacagtattcttggatgtgacacccgaaaaaaatgaatttggtcgcatggctgctatacagactaaacaagtattagctcaaaagctacgagatcaacaacgaaaaatgattcaagaagaatttcaagatttagaaggagaagttctccaagccagagttttgagatttgaaaaacagtcagttatcttagctgtaagtagtggatttggtagactagaagtagaagctgaactgcctaaaaaagaacaactacctaatgataactaccgtgctaatgctacttttaaagtctatttgaagcgagtttgtgaagggtcaactcgtgggcctcaattacttgtgtctagagctgatgccggcttagtggtttatttatttgaaaatgaagtcccagaaattgaagatgaagtcgtaagaattgtggcagttgctagagaggcaaatcccccatctcggcatgttggtcccagaactaaaatagcagttgatactttagaaagggatgtagatccagtgggagcttgcattggtgcaaggggctcaagaattcaggtagttgtgaatgagttgagaggtgaaaaaatagatgtaattcgctggtctccagacccttctatatatatagctaattctcttagtccagctagagtagatgaagttcgtttaattgatccagaggaaaggaggtctcatattttggtgtctgaagaccaacttagtttggctatcggcaaggaaggacaaaatgtgcgtttagctgctcgtttgacagggtggaaaattgatattaaggacacaaatagatatgaccatgctgaagaagatagcaaagttgcggctgaagtctctcatcgtcaagcgttagctgaacaagaagaaaataaaattgaggaatcagaattagaagtaatagaaaatactttcgacaaaaattttaatgaaccagatgattctttttaa

SEQ ID NO: 452 - DNA, 1101 bp, Clostridium perfringens ATCC 13124
atgaatgaagaatttctaggggcattatctgaaatagtaaaagagaaaggtatttcagtagaggctttattagaaactatagatgatgctataatagcagcttataagaaaaacttttcaaattcaggaacaactgcacaaaatgtaaaggtaaaacgtgatgagaaatcaggagaaatccatgtttatgctcaaaaagttgttgttgaagaagtttatgatgatgtaacagaaataagtttagaagatgcaaaggctattagtgctatttatcaattggatgacatagtagaaatagaagtaacacctaaaaactttggaagagttgcagcacaacttgctaagcaaatggttatccaaagaataaaagaatctgagagaaatgtaatttactcagaatttgcagaaaaagaatttgacatattacctggtacagtaataagaaaagacaaaggtaatgtatttgtagacttaggaaaaatagaaggtgttttaggaccaaatgaacaaatgcctacagaaaaatataacttcaatgaaaaattacaattatacgtagttgaagttaagaaaacatctaaaggtgcttcagttttatgttcaagaacacatccaggtttagttaaaagattatttgaattagaagttccagaaatatatgaaggaatagttgaaataaaaagtatagctagagaagctggatcaagaactaaaatagctgtttactcaaatgatgaatcagtagatgctatgggagcttgtgttggacctaagggtgttagagttcaaaatatagttaatgaactaaaaaatgaaaaaattgatataataaaatggagcaatactccatctgagtatatagaaaatgctttgagcccagctaaggttataagtgtagaagctgatgaagaaactaaatcagctaaggttatagtggatgatagtcaattatcattagctataggtaaagaaggacaaaacgttagattagcagctaaattaactggttggaaaatagacataaagagcaaatctaaagcagaagaattattacaagaagaagatattgttgttgaagaagacactataatagaagaataa

SEQ ID NO: 453 - DNA, 1137 bp, Syntrophomonas wolfei Goettingen
atgtctaatgatttagtgcaggcattgaatgatatagagaaagaacgcggtatccctaaaagggcactgattgaagctataaagtcagccttaagcactgcttataagaaaaattttgggattgctcagaatgtaagtgtagagtttaatgagattaatggtgaagtcaaggttttttctcagaagaagataagcgatgaagttaaagatccccggttggagatgtctttggaagaagcccaggaactctaccccgactgtaaagttgaagatctggtctatgttgaggctacaccgtcagatttcgggcgcattgcggcgcagacggccaaacaggtagtaatacagaaactgagagaagcggagagaagcctgatatatgaagaatttttagaaagagaaggcgaaattataaccggtactatccaaaggcttgaatccaaaaccgtttatatcagcctgggtcgaacagaaggaataatgatggcttcagatcaaatctttggggaaagatacgaagttggacagaggattaaggcttatatttatgaagtcaagaacacctccaaagggcctaatatatttgtgtccagatcccatccgtattttctgcgacgtttgtttgaaatggaagtcccggagatttatgatggagtagtagaaatcaagtctatagctcgcgaagcgggagcgagatccaaaatagcggtctattccctggatgataaaattgactcggtgggggcttgtgtaggaccccgaggtttgagggtgcaaaacattgtttccgaattgggtggagaaaaaatagatatcattaaatacgacaaagacccggaaaggtatatttccaatgcgctaagcccttcccgggtggttgcggttaatataaatgagaccgataaaatagctcgggttattgtgcctgattaccagctttcattggctatagggaaagagggacaaaatgcccgcttggccgcaaaacttaccggatggaaagtggacataagaagcgaaagccagatgagtgattactataatgaaatagatgctgagatggatgatgaggtattagaacaggattgggctgaagaaaacaccggggagacgaaaatagatgagcaggattcgtaa

SEQ ID NO: 454 - DNA, 1422 bp, Oenococcus oeni PSU-1
atggcatcagattacagaagagagttgttttctgcgttacaggcattacaagctgagaaaggcatcagccaggaagatgcaattacgtctttaaaagatactttagtgactgcttataagaagaattttgaaggggaaaccaatgtcgaagttgatgtcgatcctgaaaaacaggagtttaatcttttacaaattaaagaggtcattcctgatggagatatgattgacccctattcggaaatttatttgaaagatgcacgagagattaattctgcatacgaagccggtgatcagatcaaattcgaaattaatccgcgtgattttggccgtttggctgctcaatcagggaaaaataaatctactcaaacaattcgtgaaaaagaaaaggaggcaattcacgctcgttacgaaggtttcgagcatgaaattgtgtctgcgagggttgctcgtgaagaccaacgctttttgtgggttaccatgcctgatggtcaagaggcggccatgggagacaaggatcgtatacctggcgaaacctacaagaccggtgatccaatcaaagttttgattaatcgggtcgaggattctgctactcgcggtccacagatctacgtttctcgaacgagtccggaattagttaaacgtttattcgaacaggaagttccggaagtttacgatggcactgtcgtgattgaatcaattgcccgggaagccggtgatcgttcgaaagtggcagttcggacaaccgattccaaccttgaccccattggtactctggttgggactcgtggttcgcgtgttcaggctgttgttaatgaattgcatggcgagaacatggatattgttgaatgggtcgaagacgaagcacagtatatcgccaatgctttgaatccggccgaggtcgtcgacgtaattttcagtccggataacgataatgaagttactgttattgtgcctgattatcagttgagtttggctattggaaaacgtggtcagaatgcacgtttggctgccaagctaactaagtttaaaattgatattaaatcagaaacacaggcggaaaacgacccacagcttcaggctattctcgaagaatccgctaaatatgcagaggaagaagatcaatcggacgaaaccgacgaaacggatgaggctttggaagacgagaccgaatacgccgacgccaatgaatatttttctgaaggcgctgatcaatccgatgcatcagaagaggagaaaacttccgagtccgctgaagaaagtagttcagccgaagaagattcttcaaaagcaaaggctaaaatgactgaagccgaagttaaagaggctcaggacgaatttgccgctgccctaaagaatgttgatttcgatgctattttggaagaaaaagagggcgacgacaacaaaaagagcgacgataaataa

SEQ ID NO: 455 - DNA, 1098 bp, Leuconostoc mesenteroides ATCC 8293
atgagtaaagaattagtggaagcacttaatgctcttgaatcagaacgaggaattgatcgtttagttgttgtcgaagcgcttgaagacgcattgaaagccgcctacaagaagcaatacaataccgctgataatgtcgaagcaacattcgacgataaaaagggcaacattagtattaaacaagtaaagcatgttgttttagatgatgatcttgaagatgaagaaatagagatttctttatccgatgcattggcaatcaatcgagcatatgaagcaggagatgagattcgctttgatgttacgccaaaagattttggtcgtatggcggcacaagctgcaaaacaagtgattgtgcaaaaaatgcgtgaagctggacgacaagctatttataacaagttttctgattatgaagatgaaattataacaggtgaagttgaccgacaagatgcacgattcctatatgtgaacttacctggcaatcaagaagctgtaatggccccaaacgatcaaatgcccaatgagcggtatcacatgggagatcgtattaaggtcttggttaacaaagttgaaaacaatgccaagggaccacaagtctttgtatcacgaacagcagctgatttggttaaacgattgtttgaacaagaggtgccagaagtttatgatggtactgttgaaatcatgtctattgcgcgtgaggctggtgatcgctcaaaaattgccgtttatacgcatgatactgacttagatccagttggggccatggttggtcaacgtggtgcacgtgtacaaagcgttgttaacgaactagctggtgaaaatatggatattgtggagtgggttgaagatgaagcacagtatattgcgaatgctttaaacccttcagaagtaactgatgtcatttttgatccagccaacgaccgtgcggtaacggttattgttccagataatcagttatctctagcaatcgggaaaaagggtcaaaatgctcgcttagcagcacgtttaacgggattcaagattgacattaaatctgaaagtgaagcagcagctagcttagacccaacaccagctgctacagctgctgacgaaaacgaagaataa

SEQ ID NO: 456 - DNA, 1272 bp, Lactobacillus gasseri ATCC 33323
ttgcttctagtcgctttgcagttgaattttagaaaggatgatcaaaaacttatgtctaaagaaatggtggaagcttttgcaaccttagaaaaagaaaaaggcatcaagcaagaaattattgttgatgcaattaaggctgccttagtagctgcatataagaaaaattataatcaagctcaaaatgttgaagttgtttttgatgaaaagaagggtaacttcaaggttaatgcaattaagacagttgttgatgaagttcaagatagtcgtcttgaagtaagtcttaaagatgcacttgaaattaatcgtgcgtatgaagttggcgatgaaattcgctttgaagtaactcctaaagatttcggtcgtttagctgcacaaactgctaagcaagttattatgcaacgtttgcgtgaagctgaaagagaacatattattagtgaatattctcaatataaggatgaaatcgttactggtacggttgaaagacgtgacaatcgctttgtttacgtaaagatcggtaatgttgaagccgtaatgacacataatgatcaattaccaggtgaaaattacaaccctcaagataaagttcgtgttttagtaactagagtagggtcagattcaaaaggagctcaaattacagtttctagaactgcacctgatttagtaaaacgtctctttgaacaagaagttccagaagtttatgatggaaccgttgagattgtatcaattgctcgtgaagctggagacagaactaagattgcagttaagagtaatgatcctgatattgatccagttgggaccttagtaggaccaaagggtactcgtgttcaaaatattgttaatgaattaggcggagaaaatatcgacgttgtaaaatacgaagagaatccatctgattttattgccaacgctttgaatcctgcagaagtaattgcagttcaatttagtggtgatgatgatgacaagaatgccctagtaattgttcctgattaccaattgtctttagctatcggaaaacgtggacagaatgttcgccttgctgctcgtttgacaggttataagattgacattaagccagaatctcaagttgagtttgtcgattctgaaggcgatgacgttgaaacagatcaagatatcgatgatagtaatgtatcaaatgaagaagcaacagaatctactgctgaacaactagaagaagattcaagcgaagattttccaaatggggaagatgttgattcagcattagatgatgatgcagataaagatgaggaatag

SEQ ID NO: 457 - DNA, 1149 bp, Lactococcus lactis cremoris SK11
atgagcaaagaaatgctgaacgcctttgcaatgttagaagagcaaaaaggaattaaatctgagattgctattgaagcgattgagcaagctatcacagcagcttacaagcgtcaatatggtcaagcacaaaatgttaaagttatctttgatgaaaagaaaggaaactttaatgtttattctactcgtgaagtagtagatgaagtttttgatagtcgtctcgaaatttctcttgaagatgctcatgaattaaatcctcattatgaaattggggacaaaatcatgtttgaagaaaaaccaaaagattttgctcgtactgctgcaggggctgctaaacaagtcatcatgcaaaaaatgcgtgaagaagaacgcacaatcatttacaacgaatatagccgttacaaggacgaaattatccaagggactgttgaaaaagttgatgcacgtgccgtttatgtaaatcttggacgtgttgatgcacttttgactaagaaagaccaaattccacaagaaaacttccatgtggatgaccgtgtgaaggtttatgtgactgatgttgtcttgactccaaaaggaactcgtgtctttatttctcgtactgtgcctgatatgctcaaacgcatgtttgaaaaagaaattcctgaagtttttgatggaactgttgaaatcaaatctattgctcgtgatgctggtgaccgtgcgaaggtcatcgttcaaagtcatgatgaaaatgttgatgcgattggtacaatggttggggctaaaggttcacgtattcaaggaattattcgcgaacttgctggcgaaaaaatggatatcattgaatggtcagaagacaaagcaactcttgtagctaatgctttgaaacctgctcgtattgaacaagttttgattactgctgatggttcaagtctggctgttgttgctcgtgaccaattgtcacttgccattggtaaacgcggacaaaatgttcgtcttgctgctcacgtcacaaatagcaagattgatattaaagctgctgacgagtttaacatggacgattatgaatttgttggtgaagctgacgaagaaactccaactcttgaagttgaggaaacaatctcagttgatgaagttgttgaagaaccagtagttagcgaaagtgaagaataa

SEQ ID NO: 458 - DNA, 1176 bp, Streptococcus thermophilus LMD-9
atgctagaagccttccgtgtcttggaagaagaaaaacacattaacaaggaagacatcatcgatgctgtggttgaatcacttaaatcagcttacaagcgtcgttatggtcagtctgaatcagcagttgttgaattcaatgaaaaaacaggtgattttcaagtttttaccgttcgtgaagttgtagatgaagtcttcgatagtcgtttggaaatcagcttgaaagatgcgcttgctattagttcagcttacgaacttggtgacaagattcgctttgaagagtcagtcgacgaatttggtcgtgtcgcagctcaatctgctaaacaaacgattatggaaaaaatgcgtaagcaaatgcgtgagattacttataatgagtataagcaacatgaaggtgaaatcatgcaaggaacagttgaacgctttgaccaacgtttcatttatgttaatcttggaacgctcgaagctcaattgtcacgccaagatcaaattcctggtgaaagttttaagtcacacgacgttatcgatgtttatgtttataaagttgaaaacaatcctaaaggtgttaacgtctttgtgagccgtagccatccagaattcatcaaacgcatcatggaacaagaaattccggaagtatttgatggaactgtagaaatcatgagcgtttcccgtgaagcaggtgatcgtactaaggttgctgttcgcagccataatccgaatgttgatgctattggtactatcgtcggtcgtggtggaagcaacatcaagaaagttgtcagccgtttccacccaacacgtttggatgctaagacaggtattgaggttcctgttgaggaaaatattgatgttattcaatgggtggaagatccagctgaatttatctacaatgctattgcaccagctgaagtggactatgttctcttcgacgaagatgatagcaaacgtgcgacagtagttgtaccagataacaaattgtctcttgcaattggtcgtcgtggacaaaacgttcgtttggcagcgcatttgactggctaccgtattgatatcaagtcagcttctgaatatgaagcactagaagctgagaaagctgaggctgaagtagatgaagttgtcgaagaaatcgttgcagaagctacacctgtagatgtaacaacggaagaagcaccagaagcagaataa

SEQ ID NO: 459 - DNA, 1287 bp, Desulfovibrio vulgaris DP4
atgagcatggaactcaagaaagccatcgaccagataagcaaggacaagggcctcgaacgcgacatgctcgtcgcaacccttgaagaggccgtccgcacatcggtcgttcgcaagtatggcgacgacatcgacgtcgaggtctcgtacaacgacgaaagcggcgagatcgaagtctaccagttcaagatcgtcgtcgccgaactggatgacgaggacgaggacggcaacgcccacatcgtcctcgaagaagcccgcaagcacgaccccagcgtccagatcgacgacgagatgggcttccgcctcaaggtcgaggatctcggccgcatcgccgcccagtccgccaagcaggtcatcatccagcgcatgcgtgacgccgagcaggagctcatctacgacgagttcaaggaccggcgtggcgagatcatcagcggcatcatccagcgccgggacaaggccggctggatcatcaacctcgggcgtaccgaggccctgctccccaaagaggagcagatcccccgcgagcactacaagcgcggcgaccgggttcaggccatcatcatcgaggtacgcaaggaaggacgcgggccgcaggtcatcgtctcgcgctctcaccgcgactacatggcagcgctcttccgccgcgaggttcccgaggtcgacgacggtaccgtgcagatcatgggcgtggcccgcgaccccggcagccgtgccaaggtcgccgtgctctcgcgtgagcgtgacgtcgatcccgtgggcgcgtgtgtcggcattcgcggctcccgcatccagaacgtcgtgcaggagcttcgcggcgaacgcatcgacatcgtggtgtggagccctgaaatcgccacctacgcccgcaatgccctgtctcctgccgtcatttcgcgcatcgtggtcgatgaagaggagaatctcctcgaagtcatcgtgcctgacgaccagctcaccaacgccatcgggcgcaaggggcagaacgtcaagctggccgcgaagctgctgggctggaagatagatatctatacggaaacccggtacaatgaggccaacgccatcgggcgcggcctcgagcagattgccagcgttgccgaaatctccatcgagcaattcgtcacggcgggtttccagtccattgaacgtttgcgggaagcctccgacgaggaactcgccagcgggctcggcatcgatgacaatcgcatcgccgacctgcgtgctgctatcaacttcctcagccctgcgccttccgcctcagacggggacgacgcagacggggagacggaataa

SEQ ID NO: 460 - DNA, 1404 bp, Prochlorococcus marinus MIT 9515
atggcattagtaattctcccaggattgaacaatctaattgaagacattagtgaggaaaaaaaattacctcctcacgttgtggaatcagctttgcgtgaagccttacttaaaggttacgaaaaatacagaagaaccttctacattggagtaaaagaagatccatttgatgaagagtattttagtaattttgatgttggatttgatttagatgaagaaggttatcgaattttatcaagtaaaataattgtagaagaggttgaaagcgaagatcatcagatatctcttaatgaagtaaaacaagtcgcggacgatgctcaaataggtgatactgtcgttttagatgttactcccgaaaaggaagattttggcagaatggctgcctcaaccacgaagcaagtattagctcaaaagttgagagatcagcaaagaaagatgattcaagaagaattcgcagatttagaggatcccgttttaacagcaagagttataagatttgaaagacaatcagtaattatgggtgtcagctcaggaattgggagaccagaagtagaagcagaactgcctaaaagggatcaattgcctaatgataactatagagctaacgcaacattcaaagtatttcttaaagaggttagtgaaattgcgagaaaagggcctcaactttttgtaagcagagccaatgctggtttagtagtttatttatttgaaaatgaggtcccagaaattcaggaaggtacagttaaaattgtagctgtatcgcgagaagcaaaccctccttcaagagctgtcggcccaagaacaaaagttgcagttgatagtattgaaagagaagttgatcccgtcggtgcttgcattggagcaagaggagcaagaattcaacaagtcgttaatgaattaagaggggagaaaattgatgttattaagtggtcagctgatcctatcgaatatatattaaattctttgagtccagctaaagtagaccttgttagactcgtagacccagaaggacaacatgctcatgttttagttcctcctgatcaattaagtcttgcgataggaagagaaggtcaaaatgtgcgtcttgcagcaagattaactggttggaaaatagacgttaaaaactcccatgaatataatcaagaagcggaagacgctgcggttgcagaattaattgttcaaagagaggaagaggagcatctacaaagagaagctgaacagcgattggaggcagagcaagcagaaagagcagcagaagatgcaagattgagggaactttatcctctacctgaagatgatgaagaatatgggagtgaatcatacgaagaagaaaatctttccgaaaatagccaattggaaaatatgaaccctgatgaaataatatctacagaggagaaagcacggtga

SEQ ID NO: 461 - DNA, 1404 bp, Prochlorococcus marinus AS9601
atggcattagttattctcccaggtttaaacaatctcattgaagatattagtgaggaaaaaaagttacctcctaatatcgtggaattagccttacgcgaagctttattaaaaggatatgaaaaatatagaaaaactttttacattggagttaaccaagatccatttgatgaagaatattttagtaattttgatgttggactagatctagatgaagaaggttacaggatattatcaagtaaaattattgtagaagaagttgagagcgaagatcatcaaatatctctagtagaagttaagcaagtcgctgatgatgctcaaataggtgacacagttgttttagacgttactccagaaaaagaggattttgggcgaatggctgcttcaacaacaaagcaagttttagcccaaaagttaagagatcaacaacgaaaaatgatccaggaagaatttgcggatttggaagatcctgttttaacggcaagagttataagatttgaaagacaatcagtcattatgggagttagttcgggtattggtagacctgaagttgaggccgaacttcccaagagagatcaattaccaaatgataattatagagcaaatgcaacttttaaagtatttttgaaagaagttagcgaaattgccagaaaagggccgcaactttttgtaagtagagcaaatgctggtttagtggtttatttatttgaaaatgaagtaccggaaattcaagaaggtacagtgaaaattgttgctgtttcaagagaagccaaccctccttcaagagctgttgggccaagaacaaaagtagctgttgatagtgtcgaagaagaagtggaccctgtaggtgcatgtattggagctagaggagcaagaattcaacaagtagtaaatgaattaaggggtgaaaaaattgatgttattaaatggtcatctaacccaatacagtatattttaaactctttaagtcctgcgaaagtagatcaagtaagacttgtagacccagcagggcaacatgcgcacgtactagttcctcctgatcaattaagtctcgcaattggtagagaaggtcaaaatgtaagacttgccgcaagattaactggttggaagattgacgttaaaaactcacatgaatacgatcaggaagcagaagatgctgcggtctctgaattaattattcaaagggaagatgaagagaatctccagagagaagctgaattaagattagaagcagaacaagctgagcgtgctgcagaagatgcgagattaagagagctttatcctcttcccgaagatgaagaagaatatggagaggaacaatacgaaggagtagaattcacagataatgatccattagagactgttcaagatactgagacatctgccaaagaggagaaaaaacggtga

SEQ ID NO: 462 - DNA, 1455 bp, Prochlorococcus marinus MIT 9303
atggctctcgttctactccccggcctcaacaacctgatcgaagacatcagcgaggagaagaaactccctacccaagtggtggaagcagccctgcgggaggccctcctcaaaggatatgaacgctaccgacgcactctttatctaggtatcagtgaggaccctttcgaagaagagtatttcagcaacttcgatgttggactagagctggacgatgaaggttatcgggtcctggccagcaaaatcatcgttgaagaggtggagagcgaagaccaccaaattgctcttcaagaagtgatgcaagtcgctgaagacgcccagatcggtgacaccgtggtgctcgacgttacccccgagaaggaagacttcggccggatggctgccgccacaaccaagcaggtactggcgcaaaagctacgcgaccagcagcgccgcatgattcaagaggaatttgccgatctagaagatcccgtgctcacagctcgtgtgatccgttttgaacgtcattcggtgatcatggccgtgagttctggtcttgggcgccctgaagtggaggccgagctcccacgccgcgaccagctccccaacgacaattatcgcgccaacgccaccttcaaagtctttctgaaggaagtcagcgaagtgccccgacgagggcctcagttgttcgttagccgctccaacgccggactagtggtttacctgtttgagaacgaggtgcccgaaatccaagaaggctcagtgcgcattgtggccgtagcccgtgaagcaaatcctccgtctcgttccgtgggcccacgcaccaaggtggcagttgacagtattgaacgtgaagtggaccctgtcggcgcctgcatcggtgcccgcggctcacgcattcagcaagtggttaatgaactacgcggcgaaaaaatcgatgtgatccgctggtcacctgacccgggtcaatacattgccaattcccttagccctgctcgcgttgagatggtgcgactggtggatccagaagggcagcatgcccacgtcctagtccccccagatcaactaagcctggccatcggacgagaaggacaaaatgtacgcctagcagctcgtctaaccggatggaaaatcgacatcaaaaactcccaggaatatgaccaggccagtgaggacaccaccgtcgccgagctgatttctcagagagaggaagaagaggctctccaacgcgatgccgaatcccgtttggctgctgaacaagccacccgagcagaagaggatgcacgcctaagagagctttaccccctaccggaagatgaagaagagtacgaccaagaagaacctgctaagacgatggctgaagacgaaaatgcatccgacgccgacggccaacctgacgacttaagcagccaacctgacacctcaagcgaacaactctcaaatgaagaatcagtagaggaagaggacagagcccggtga

SEQ ID NO: 463 - DNA, 1494 bp, Prochlorococcus marinus NATL1A
atggctcttgttctactcccaggcttaaataacttaattgaagacattagtgaggaaaaaaagcttccatcacaagtcgtcgaagctgctttgagagaagcacttctaaaaggttatgaacgatatcgaagaactctttatttaggtatcagcgaagatccttttgaagaagattatttcagcaactttgatgttggtttagatctagaagaggaggggtatagagttttagccagtaaaataatagttgaggaggtagagagtgatgatcatcaaatagcaatagcagaggttatgcaagttgctgatgatgctcaagttggcgataccgttgtactagatgtgactccagagaaagaagattttggaagaatggctgcggctacaaccaagcaggttttagcccaaaaattgagagatcagcaaagaagaatgattcaagaggaatttgctgacctagaagatccagtgctaactgccagggtcattagatttgaaaggcagtcagtaattatggcagtaagctctggtttaggtagaccagaagtagaagcagagcttccaagacgagatcaattgccaaatgataattaccgagcaaacgcgacatttaaagtatttcttaaagaagttagtgaaacgcctaggagaggtccacaactttttgttagcaggtcaaatgctggattggttgtatatctgtttgagaatgaagttcctgaaattcaagaaggttcagtacgtatagttgctgtcgctcgtgaagcaaatccaccttcaagagcagtaggtcccagaacaaaagtagctgttgacagtattgaaagagaggttgaccccgttggagcatgtattggtgctagaggtgctcgaattcaacaagttgtaaatgaacttcgtggagaaaaaattgatgtaattcgttggtcttcagaccctgttcaatacatctgtaattcattaagtcctgcaagagttgaagtagttagacttgtggatccagaaggtcagcatgctcatgtcttagttcctccagatcaacttagcctcgcaattggaagagaagggcaaaatgtaagacttgctgcaaggcttacaggatggaaaatagatatcaaaaattcacaagaatatgatcaagcaactgaagactcggaggttgcggaattaatttctcaaagagaagaagaagaatctttacagagagaagctgagaagagattagaggcagaacagacagctagagctgaggaagatgcacgcctaagagagctttaccccctcccagaggatgaagaagactttcaaaatgaggaattgtcaaacatcgatagcaatgaaacagaatctgaatctgattttgaatcttctgaaattgattcaactatcgatactgatgacactgaaactgaagaaagtgatattgatgaaacaatcgaagacacagttactgctaaagataaaataattacagaagaggaaggaacccggtga

SEQ ID NO: 464 - DNA, 1215 bp, Clostridium thermocellum ATCC 27405
atgagtgcggatttaattcatgcattggaacaattggaaaaagagaagggtattgacaaggatacactgattgaggctattgaggctgctcttatttcagcttacaagagaagctttggctcatctcagaatgtcaaggtgtcgattgatcgtgagactggggattttaaggtttatgccttaaaaaaggttactgccaatcctcaaaatgagttgttggaaatctctattgaaaatgccaaaaaaataaatccggactttgaagaaaatgatattgttgaaatagaggtaacaccaagaaagtttggaaggattgccgctcagactgccaaacaggtggttgtgcagcgtatcagggaagcggaaagaggaattatttataacgagttctcgaataaagagggagaaattgttaccggagttgttcaaaggatagagagaaaaaacgtaattattgaccttggaaaagcggaggctatactggctccttccgaacaaataccgggagaggaatataagtttaatgacagaataaaaacgtatataattgaagtgaaaaagaccaccaaagggcctcaaattttggtatcaaggacacatcccggaattattaaaaggctgtttgaacttgaggtgcctgaaatatacgaaggaattgttgaaataaagagtattgccagagaaccgggttcgagaaccaagattgccgtttattcgaaagatgaaaatgtggacccggtgggagcatgtgtcggtcaaaaaggtaccagagtccaggccgttgttgatgaacttcggggtgaaaaaatagatataataaaatggagcagcaatcctgaagaatatatttccagcagccttagtcccgccaaggttataagggtggacataaatgaagaagaaaagagtgccaaggtcactgttcctgattttcagctttctctggcaataggcaaagagggacagaatgccagacttgctgcaaaactgaccggctggaaaattgatataaagagcgaatcacagcttcgggctgcaattgagcagcaacttttgaattttaacgggagctacagtactgaaaagcaagatacgccaattacaccggatcaactttttaagacaaatgtcgaagaaagcagcaatgatacggtggatgataatgctgaaaacgcagctgacgatgtggtggaagataccatggatgatgtataa

SEQ ID NO: 465 - DNA, 1404 bp, Prochlorococcus marinus MIT 9301
atggcattagttattctcccaggtttaaacaatcttattgaagacattagtgaggaaaaaaaattacctcctaatatcgttgaagcagccttgcgcgaagctttgttaaagggatatgaaaaatatagaagaactttttacattggagttaacgaagatccatttgatgaagagtacttcagtaattttgatgttggactagatctagatgaagagggttacaggatattatctagtaaaataattgttgaagaagtagagagcgaagatcatcaaatatctctaatagaagttaaacaagttgctgatgatgcgcaaataggtgacacagttgtattagatgtcactcctgaaaaagaggattttgggcgaatggctgcttcaacaacaaagcaagttttagcacaaaaattaagggatcaacaacgaaaaatgatccaagaagaatttgcagatttggaggatcctgttttaactgcaagagttatcagatttgaaagacaatcagtgattatgggagttagttcgggaatcggcagacccgaggttgaagcagaacttcccaagagagatcaattaccaaatgataactatagagcaaatgcaactttcaaagtatttttaaaagaagttagcgaaattgctagaaaaggtccacaactttttgtgagtagagctaacgctggtttagtagtttatttatttgaaaatgaagtaccggaaattcaggaaggtacagtaaaaatagttgctgtttcaagagaagcgaatcctccttcaagagctgttgggccaagaacaaaagtagctgttgatagcgtcgaaaatgaggtcgaccctgtaggtgcttgtattggagcgagaggagcaagaatccaacaagtagttaatgaattaagaggagaaaaaattgatgttattaaatggtcatctgacccaatacagtatattttgaactccttaagtccggctaaagtcgatctcgtgagacttgttgaccctgaaggtcaacacgcgcatgtactagttcctcctgatcaattaagtctcgcaattggtagagaaggacaaaatgtaagacttgcggcaagattaactggttggaagattgatgttaaaaactcacatgaatacgatcaggaagcagaagatgctgcagtctctgaattaattatccaaagagaagatgaagagaaactccagcgtgaagctgagcttagattagaagcagaacaagctgagcgtgctgcggaagatgcaagattaagagagctttatccccttcccgaagatgaagaagaatatggagaggaacaatacgaaggagaagaattaacagataatgatccattagagactcttcaagatactgacatatctgccaaagaggagaaaaaacggtga

SEQ ID NO: 466 - DNA, 1155 bp, Desulfotomaculum reducens MI-1
gtgaacagtgagttcttagaagccttgagagatttagaaaaagagaagggtattgcagtggatgtgctgttagaagctattgaagcggccttgttatctgcttataaacggaactttggttcgttacaaaacgcaagggtccatattgatcgagatacaggagattataaagtatattcccagcgtgctgttgtggaggaagttgaagacgatcgggttgaaatttccttagaagatgcaagaaaaattgaccctcggttcaacctggaagatgtggtggaagatgaagtcactcctagaaattttggccgtattgcggcgcagacggctaaacaagttgttgttcagcgaattcgtgaggcggaaagaaatatcatttttgaagaattttctaaccgtgaaggtgatattcttactggtattgtgcaacgaatagagaataaaaatgtttttattgagttgggtaaaacagaggctattttaacaccttctgagcaaataccgaacgaagattatagacacggcgatcggttgaaaacttacatagtggaggttcgcaaaaccacaaaggggccacagattttagtgtccaggactcacccaggtctgctaaagcggttgtttgaactggaggtccctgaacttcaagaaggagttgttgaattaaaatccattgccagggaagccggttatcgatctaaaattgctgtttattcaaaagatgaaaatattgatccagtgggtgcatgtgtgggcccaaaagggatgcgtgtacaaaatattgttactgaattgaacggtgaaaagattgacattataaaatggaaccaggatccatcaaagtatgtagcctcttctctcagcccagctaaagtggtggcagtggaagtttgggaagatgagaaagtagccagagttattgtgcctgattaccaactttccttagccattggaaaagaaggacaaaatgcacgtcttgctgcaaagctgacagggtggaaaattgatataaaaagtgagtcccagatgacagatatttatccagaatatgatgctgaggaaaacgatggattttccacagatgataattatctagaaacctttgaggacgaatacaaacatgttgattcgtccgaagagaaaaatggtgagtaa

SEQ ID NO: 467 - DNA, 1476 bp, Dehalococcoides BAV1
atgaaaagcgactttttgctcgctatcacccagctctcggcagaaaagaatctgccaaaagaagtagtacttgctaccgttgagtcggcattggtatcggcttatcgtaaagagagctttgctccaaaccagaatatcacggtgaagattgaccagcttaccggcaaagtaaaagtcatggccgaaaagcaagtagttgaaaaagtgatagatagccgccaggaaatgcgtttgcttgaggctaaaaggctcaaagctgatgccaagataggcgacttgatgatggttgaagatactccggctgatgccgggcgcattgccgcccagacagccaaacaggttattctccagcgtctgcatgaggctgaaaacaccgctatttttgatgaatatgcctccaaggcgggagatactctggttggtgtggtacagcgtatagaacccaaacaaattacggtggatatcggccgagtagaggctataatgcctgctaatgaacaggcctatggcgaaaggtatcgtgccggacagaggataaaggtttacgtggtggacgtggcaaaaacagccaaagggccttcagttattgtctcacgttctcatcccggtctggtacgccgtttatttgaaatggaagttcctgaagtttttaatcagctggtagagataaaggctgttgcccgcgaggcaggctcacgctctaaagtggctgtaggtgcccttcaacccggaattgacccggtgggttgttgtgtgggtttacgtggtattcgtatccagaatattgtcagcgagttaaacggcgaaaagatagatgtggttgcatggagtagcgaaatagcttcttttattgccaattcactcagccctgcccaggtgaccaaggttatcctgaatgaagctgaaagatctgccattgtggtcatacctgaccgccagcttagtttaggtatcggtaaagagggtcagaatgtacgtctggcagttaagttgactggttggcggattgacataaagagtgcttctgatgaagatgttgaacgggccgaagtggcagcccgccagcaagaagaaatttcaaagtccaaaataactgaaaaagttgttgaaaaacaacctgtaatagcagctgtttcaaagaccgaaaccgtacctgttgaaaaggtgttacctgccgatacaataatagaacctgtggctaaagaaacacctgcgaaggctgaatctgtgcctgaagagcagggtgtggtagtgcctttgaatgtgcttgataaagcggccgggggtgattcggtcaaactgcgttttgccgaagacttgcttcccagacgtgaagttgtcattgatgataagaacaaaagcaagaacaagaaaaaaactgtcaaaggtaaagataccgctgaagatggtatcaagcttaagggcaaaaaacggcggaatgtaacggaatatgaatcagaggaaattgacttctaa

SEQ ID NO: 468 - DNA, 1176 bp, Staphylococcus aureus JH9
gtgtcaagtaatgaattattattagctactgagtatttagaaaaagaaaagaagattcctagagcagtattaattgatgctattgaagcagctttaattactgcatacaaaaagaattatgatagtgcaagaaatgtccgtgtggaattaaatatggatcaaggtactttcaaagttatcgctcgtaaagatgttgttgaagaagtatttgacgacagagatgaagtggatttaagtacagcgcttgttaaaaaccctgcatatgaaattggtgatatatacgaagaagatgtaacacctaaagattttggtcgtgtaggtgctcaagcagcgaaacaagcagtaatgcaacgtcttcgtgatgctgaacgtgaaattttatttgaagaatttatagacaaagaagaagacatacttactggaattattgaccgtgttgaccatcgttatgtatatgtgaatttaggtcgtatcgaagctgttttatctgaagcagaaagaagtcctaacgaaaaatatattcctaacgaacgtatcaaagtatatgttaacaaagtggaacaaacgacaaaaggtcctcaaatctatgtttctcgtagccatccaggtttattaaaacgtttatttgaacaagaagttccagaaatttacgatggtactgtaattgttaaatcagtagcacgtgaagctggcgatcgctctaaaattagtgtcttctctgaaaacaatgatatagatgctgttggtgcatgtgttggtgctaaaggcgcacgtgttgaagctgttgttgaagagctaggtggcgaaaaaatcgacatcgttcaatggaatgaagatccaaaagtatttgtaaaaaatgctttaagcccttctcaagttttagaagttattgttgatgaaacaaatcaatctacagtagttgttgttcctgattatcaattgtcattagcgattggtaaaagaggacaaaacgcacgtctagctgctaaattaaccggctggaaaattgatattaaatcagaaacagatgcgcgtgaagcgggtatctatccagtagttgaagctgaaaaagtaactgaagaagatattgctttagaagatgctgacacaacagaatcaaccgaagaggtaaatgatgtttcagttgaaacaaatgtagagaaagaatctgaataa

SEQ ID NO: 469 - DNA, 1188 bp, Lactobacillus reuteri DSM 20016
gtgagtaagccaaaaattaacactgagatgattggcgcccttgattatcttgaaaaagaaaagggtatcaagaaagagattgttattgaagcgttagaacaagcacttgaatcagcatacaagcaaaattacggtgataagaatgttgaagtagaattcaattcattgactgggaatattaaagtctacgctgtaaaaacaattactgatgatgaagaagcagtcgaagcagatagcaacgaatttatgagtttagctgatgcacggaagcttcctcatggccaagggtatgatattggtgatgaaattcgcgaagaagttactcctcgtgactttggtcggattgctgcccaaactgctaaacaagtggtaatgcaacgtctccgtgaagaagaacggaaaattatttacgacaggtacaagacttatgaaaacgagattatcactggtgaagtttcacgagaagataagcgtttcacatacgttgatttaggagatggcgtagaaggtgctatgggctttagagataagatgcctaatgagcactaccatgtccatgatcggattcaagtatacgtaacgaaagtaaatgacgatcgtcggggaccacaaatctttgttagccggactgctccagaacttttgaagcgattatttgaacgagaagtgcctgaaatcaaggatgggactgtcttaatcgaaaatattgctcgtgaagcaggtgatcgtgctaaggttgcggtatactcaaatgatcctaatgttgatccagttgggacttgcgttggtccacgaggttctcgtgtccaagcaatcgttaatgaacttgatggcgagaatatggatattgtggaatacgttaaggatcccgctaagtttatcgctaatgcgttgaacccagcagaagtacttgatgtaatctttaacgaagagaaggcagcaagcgaaactgaggatagcgaaggagaagaaacgactgaaggacaaacagaacgttcttgcactgtcgttgttccagatagccaattatccttagccattggtaagcggggacaaaatgctcgtctcgctgctcgtttgactaagtacaagattgatatcaagtctgaatctgaaatggctgaaaatgatcaagaatctgaagaagtagctgattcagaagaaaatattgacaataacgaagaataa

SEQ ID NO: 470 - DNA, 1329 bp, Roseiflexus sp. RS-1
atgaaaagcgacttttatgcggcaatctctcagattgcctccgaacgcggtattccaaaggaagccatcgtcgaagtgatggaaaaagcgctggcgactgcctatcgtcggacactgggaccgaacccgccgccaatggagatctcggtccggctcgaccctgtcaccggtatggcgcgtgtctatgccgaaaaacaggtcgtcgacgatgtcttcgatgagcgcttcgagatcgacctggagagcgcgcgcaagatcaagcccgacgtcgaattaggcgagtcggttgtggtcgaggcaacgcccagggatttcgggcggattgccgcacaaacggcgaagcaggtcattcttcagggaatcaaagaagtcgagcgcgagcatatctacggcgagtatatggatcgcgagggcgaactggtgaccgcgacggtgcagcggatagcgaagggcaacgtcatcctcgaaatggggaaagccgaggctattctgccgccgaaagagcaggtcgagaccgatcggtactaccacgggcagcgcctgaaagtctatctgatggaaatccggcgtgaggatcgcggtccgaaattgatcgcgtcgcgtgcgcacaaaaatctgatcacgcgcctgttcgagatggaggtgccggagatttataatggcgcggttgagattaagtcgatagcgcgcgagccgggcatccgcacaaaagtggcagtcgccgcgcgccaggagggaatcgacccggtcggctcttgcgtcggtatgcgcgggatccggatccagaacattgtcaatgaactaaatggcgagaaaatcgatgtggttcagtggtcgtccaatccgaaagagttcattgccaatgcactgtcgccagcgcaggtggttgaggtgcaactgcgcgatgatgaacacgcggcgacggtgattgtgccggataagcaactttcgctggcgatcggcaaagaggggcagaatgtgcgcctggcagcaaaattgaccggatggcgcatcgatatcaagagtgcatcggcgttgctcgatgaagagcgcgctgctgccgaagcacgcgatgctgcggaagccgaggcgctggcgactgaagcagcgctggcgacggcgaaagtcgagacgcgcaaagtctatgccgatggcacgatcgtctatcgcaagcaccgctatggtccgctcggcgatgatctggtcggtgaaacggttcagttgcgcgcgacgccgcagaaactgtacatctatcgcggtgaccgcctcgtggcctcctatattctggttgaagaagacgacgacgaagaggatgaagacgaggagtag

SEQ ID NO: 471 - DNA, 1176 bp, Staphylococcus aureus JH1; identical to SEQ ID NO: 468

SEQ ID NO: 472 - DNA, 1101 bp, Bacillus cereus cytotoxis NVH 391-98
atgagcactgagttgttagatgctttgctcgtattagaatcagaaaaaggtattagcaaagatattattattgatgcgattgaagcagctttaatctctgcttataagcgcaattttaaccaagcacaaaatgttcgagttagctttaatccagaagtagggacaattcaagttttagcacgtaaagatgttgttgataacgtatttgacccacgtcttgaaatttctgtggaagaagcaagacaaattaatccaaactatcaaaatggtgatgtactggaaattgaagtaacgccaaaagattttggacgcattgcggcgcaaactgcaaagcaagttgtcacacaacgtgtacgcgaagcagagcgcggcgttatttattcagaatttagcgatcgtgaagaagacattatggtcggtattgtccaaagacaagatgctcgctttatttatgtaagcttaggaaaagtggaagcacttttaccagtaagtgagcaaatgccaaatgaacaatataaaccacatgatcgcatccgtgtattcattacaaaagtcgaaaaaacgacaaaaggaccacaaatttacgtatcacgtacacatcctggtcttctaaagcgtttatttgaaatggaggttccagagatttatgatggaacagtagagattcgttctgttgcacgtgaagcaggcgatcgttctaaaatctctgtatatgcggagaatattgatgttgacccagttggttcttgcgtaggaccgaaaggacagcgtgtacaacgcattgtagatgaactaaaaggcgaaaaaattgacattgttcgctggtcaaatgatccagtagaatatgttgctaatgcattaagtccatcacaggtcgtatcagtacttgtgaatgaagaagaaaaagcaacaactgttatcgttccagaccatcagctttcgttagcgattggtaagcgtggacaaaacgcgcgtcttgcagcaaaattaacgggctggaaaattgatattaaaagcgagtctgatgcgaaacaacttggtattgtaacagaagaagacaacatgatcgcattcgattcagttgaagacgaaatcgaatag

SEQ ID NO: 473 - DNA, 1329 bp, Roseiflexus castenholzii DSM 13941
atgaaaagcgatttttatgcagcaatctcacagattgcgtccgaacgcggcattcccaaggaagccatcgtcgaggtcatggaaaaggcgctggcgacagcgtatcgccgaacgctcggtcctaacccaccgccaatggagatatcggtccggctggacccgctgacgggcgcggcgcgcgtctattccgaaaaacaggtcgttgacgatgtctacgatgagcgctttgagatcgatctggagagcgcccgcaagatcaagcccgatgtcgaactgggcgagtcggtcgtcgtcgagacgacgccgaaggattttggacgaatcgcagcgcaaacggcgaaacaggttatccttcagggaatcaaggaagtcgagcgcgaacacatctatggcgaatacatggatcgcgagggcgaactggtcacggcgaccgtacagcgcatggcaaagggcaacgtcattctcgaaatgggaaaagccgaagccgtcttgccgccgaaggaacaggtcgagaccgatcgctactaccacgggcagcgcctgaaggtctacctgatggaaatccgccgtgaggaacgcggaccgaaactgatcgcatcgcgcgcgcacaaaaatctgattacgcgcctcttcgagatggaagtgccggagatttataatggcgccgtcgagatcaagtcgatcgcgcgcgagccgggtatccgtaccaaagtagcagtcgcggcgcggcaggagggcatcgatccggttggttcgtgcgtcggtatgcgcggcattcgcattcagaacatcgtcaacgaactgaatggcgaaaagatcgatgttgtgcagtggtcgtcaaatccaaaagagttcattgcgaatgcactgtcgccagcacaggtcgttgaggtgcagttgcgcgacgatgaacacgctgcgacggtcattgtgccggataagcaactctcgctggcgatcggtaaagaagggcagaatgtgcgcctggcggcaaaactgacgggatggcggatcgatatcaagagcgcgtcggcgttgctcgacgaagagcgcgcagcggcggaggcgcgcgatgcggcagaagcggaggcgctggcgactgaggcggcgctggcgacggcaaaggtcgagatgcgcaaagtgtacgccgatggaacgatcgtctatcggaagcatcgctatggtccactcggcgacgacctggtcggcgaaacggtgcaactgcgcgcgacgccgcaaaaactgtacatctatcgcggtgatcgcctggtggcatcgtatatgctcgttggcgacgatgaagaggatgcgatcgagggcgacgagtaa

SEQ ID NO: 474 - DNA, 1335 bp, Herpetosiphon aurantiacus ATCC 23779
atgaaaagtgatttttacgcagctatttcacagattgccgctgaacgtggcattccccgcgagtcggtgcaggatgttgtcgaacaagccttaatttctgcctatcggcgctatttgggcagtaatccaccaccagttgacgttaagattgaattagagccaaatactgggcggattcgggtttacgctgaaaagcaagtcgtcgatgaagtgatggatgatcgcttcgaaatcgatattgaagatgcccgtaacgttcgcgccgatgttgaaattggcgaaacggtttatgtggaaagcacgcccgacgattttgggcggattgccgcccaaaccgccaaacaggtggtattgcaacggatcaaagaagttgaacgcgaccatatctatggcgaatactttgatcgcgaaggcgaaattgtcactgccaccgtgcagcgcaccgccaaaggcaacgtaattttagaagttgggcgagccgaagcgattttgccccaaaaagagcaaattagccacgacaactatcgccatggccaacgcctcaaagtctatttgatggaagctcgccgtgatgatccgcgtggcccgcgcttggtcgcctcgcgcacccacaaagatttgatcaaacgcttatttgaaatggaagtgcccgaaatctacaacggcacggttgaaattaaatcgatcgcccgtgaaccaggtttacgctcgaaagtcgccgtccatgcccgtcaagaaggcatcgatccggttggctcgtgcgtggggatgcgcgggattcggattcaaaatattgtgaatgaactgaacggcgagaaaatcgacgtggtgcaatggggtgctgatatgcgggtatttattgccaacgccctcagcccagcccaagtcgtcgaagttcatcttgatgaaggcgaaaaaacggccacggtggtcgtgccagataaacaattgtcgttggcaattggcaaggagggccaaaacgttcgtttggcagccaaactggttggctggcgcatcgacatcaagagcgcatcttcactcttagaggaagaacgggctgctgctgaagcgcgtgaggctgccgcgtcggaacaaatgctgcaagaagcagcgctctcaaccgccaaagttgaaacccgcaaggtgcgggtcgattccttggtcacctatcaagggcgacaatatggccccttgccagttgaactaattggcgaagaagtagcgttgcgagccgccgcccaaaaactcaatatttatttcaatgacaagctgattgctagctatatcatcgatgatgaggctggtgacagcgacgagacggataccgaggcatag

SEQ ID NO: 475 - DNA, 1416 bp, Prochlorococcus marinus MIT 9211
atggcactagttcttctccctggactcaataacctgatcgacgacataagtgaggagaaaaagctccctgctcaggtcgttgagactgctcttagggaagcactcctaaaaggttatgaaagatatagacgaaccctctatctagggattaatgaaaaccccttcgaagaggaatactttagtaattttgatgttggactggatcttgatgaagaaggttatcgagtattagcaagcaaaatcattgttgacgaagttgagagtgaagatcatcagatcgctttatctgaagtcatgcaagttgctgaagatgctcaaataggagacacagtagttctagatgtaactcctgagaaagaagagtttggaagaatggcagctgcaacaactaagcaagtccttgctcaaaagttgcgagatcaacagcgaagaatgattcaagaagaatttgcagatttagaagatcctgtcctaactgctcgagtaattagattcgaacgtcaatcagtaatcatggcagtcagttcagggctaggcagaccagaagttgaagcggagctccctcgcagagatcaactgccaaacgataattatcgcgcaaatgcaactttcaaagtatttctaaaagaagtaagtgaaacacccaggcgaggtcctcaattatttgttagtagatctaacgctggtttagtagtttatttatttgaaaacgaggtaccagaaatccaagaagggtccgtcaggatagtagctgtggctagagaagctaatcctccaacacgagctgtcggacccagaacaaaagtcgctgttgatagcattgaaagagaagtggacccagtaggcgcatgcataggtgcaagaggatccagaattcagcaagtagttaatgaactgagaggagaaaaaatagatgtgattcgctggtctgcagacccagtccaatacatttctaattcgctcagtcctgcaagagttgaagttgtaaggctcgttgatccagaagggcagcatgcgcatgtcttagtgccccctgatcaacttagtcttgcaattggaagagaaggtcaaaatgttcgattagcagcaagacttactggctggaaaatcgatattaagaattcacaagaatatgaccaagagtctgaagattcagcagttgctgaactgatctctcaaagagaagaagaagaaagtctgcaaagagaagctgaagaaagattggctgcagaacaggctgctagggcagaagaagatgcccgactaagagagctttatcctcttccagaagatgatgaagagaatatagaagaaagtacaactgaattagaagagcttccaataagtgaaaatgaagaagccaaacaaaatgaaggattgagtaatgaacaaagccccgaggatggaccccggtga

SEQ ID NO: 476 - DNA, 1065 bp, Clostridium phytofermentans ISDg
atggaagggaacaaggaactaatagaagcgttgaatcagattgagaaagaaaaggacatcagcaaagaagtcttattagatgcgatggaaaattctttagtagcagcgtgcaaaaatcattttgggaaggcagacaatattaaagtttatattgatcgtacgacaggagctgtcagcgtatttgcggagcgcgttgtagtagaacaggtgcaagatcctgtactcgaaatcagtttggccgaagctacaatgaaattcccaaaaggaaagtatgaattaggtgatatcgttcaggtggaagttactccaaagaactttggacgaattgcagctcaaaaagcgaagcaggtagtggttcaaaaaattcgtgaagaagagcgtaaagttttattcaatcaatactatggaagagaaaaagatattgtaacaggtatcgttcagcgctatgttggaaacaacgtaagcattaaccttggtaaagtagatgctgtacttatggagaatgaacagatcaagggtgagcattttcgtcctacagaccgtataaaactttatgtactagaagtaaaagatactaccaaaggacctaagattacagtttctagaactcatcctgaacttgtaaagagattatttgaagccgaagttactgaggtaaaagaaggaattgtagaaatcaagagcatttcacgtgaagctggagatagaacaaaaatggcagtatccagtaacgaccctaacgtggatccagttggagcttgcgtaggtttaaatggtgctagagtaaatgccattgtgaatgaacttggcggtgaaaaaattgacattgttaactggagtgatgatcctgcagaattaattgagaatgcattaagtccagcaaaggttgtttcagtggatgttagtgaaggcgaaatgagtgcgaaggttattgtaccagattatcagttatctttagcaattggaagacagggacaaaatgctagactcgctgcaagattaaccggatacaaaattgatatcaaaagcgaatcacaggtatatggtagttactacgaggaatag

SEQ ID NO: 477 - DNA, 1107 bp, Bacillus weihenstephanensis KBAB4
atgagcactgagttgttagatgctttgctcgtattagagtcagaaaaaggtattagcaaagatattattattgatgcgattgaagcagcattaatctctgcttataaacgcaattttaaccaagcacaaaacgttcgtgtgagctttaacccagaagtgggaacaattcaagttttagcacgtaaggacgttgtagataatgtgtttgatccacgtcttgaaatctctgtagaagaggcaagacaaattaatccaaactaccaagatggtgacgtactagaaattgaagtaacgccaaaagattttggtcgtattgcagcgcaaactgcaaaacaagttgtaacacaacgagttcgtgaggcggaacgtggtgtaatttattcagaatttagtgatcgtgaagaagacattatggttggtattgtacagcgccaagatgctcgtttcatctatgtaagcttaggtaaagtagaagctttattacctgtaagtgagcaaatgccaaatgagcaatataaaccacatgatcgtattcgcgtatttattacaaaagtagaaaagacaacaaaaggaccacaaatttacgtatcacgtacacatcctggtcttttaaaacgtttattcgaaatggaagttccagaaatttatgatggaactgtagaaattcgctctgtagcacgtgaagcaggcgaccgttctaaaatttctgtatatgcagagaatatcgatgttgatccagtaggttcttgtgtaggaccgaaaggacaacgtgtacaacgcgttgtagatgaactaaaaggtgaaaagattgacatcgttcgctggtcgaatgacccagttgaatatgttgcaaatgctttaagtccatcacaggttgttaaagtacttgtagatgaagcagagaaagcaacaactgttgttgttccagaccaccagctttcattagcgattggtaagcgtggacaaaatgcgcgtcttgcagctaaattaacaggctggaaaattgatattaaaagtgagtctgatgcgaaacaacttggtattgtgacagaagaagatagcgtaatcgcattcggattcgattcagctgaagacgaaatcgaatag

SEQ ID NO: 478 - DNA, 1041 bp, Thermoanaerobacter sp. X514
atgaacgcagaattcatagaagctttaaattctatctgtgaggaaaaaggtatcccaaaagatacaatgtttgaagcaatagaagctgctttagtttctgcttacaagaaaaattatggaacttctcaaaatgttaaaattgtcatggatagagaaacaggagatgttaaagtttatgcacaaaaaacggtagtagaagaggtctacaatgacctactagaaataagtttagaagaagcgagaaaaataaataaaaaataccagataggagatatagttgatatagaagtaactcctaaaaactttggcagaattgcagcacaaaacgcaaaacaagttgtgattcaaaggattagagaagcggaaagaaatgtaatttatgaagagtttttagccaaagaaacagaagtagtaacaggaattgtaaccaaggtagataaaaagaatgtactcattaatttaggtcgagttgaagctatattaagcccggcagaacaaattccaggggaaacttttgcaccaggagacagagttaaggtgtatattgtggaagtaaaaaagactactaaaggacctcagattttaatttctcgttctcatccaggacttgtaaaaagattgtttgaattggaatccccagaaattcaacaaggaatagttgaaatacggagtattgctcgagaagctggttcacggacaaaaatggcggtttttagcagggatgaaaatgtggaccctgtaggagcttgtgttggatataaaggtgcaagagtacaagctgttgtcaatgaactaaaaggagaaaaaatagatatagtcaagtggagttcaaaacctcaagaatttataatgaacgctttaagtccagcaaaggctttgagtatagaaattttagatgaaaaagaaaaagtagcaagagtaattgtacctgattatcaattgtctttagcaattggaaaagaaggacaaaatgcgaggctggcggcaaagctcaccggttggaaaatagacataaaaagcgaatcaatggtaaaaagttaa

SEQ ID NO: 479 - DNA, 1080 bp, Candidatus Desulforudis audaxviator MP104C
atgaatagcgagtttctggcggctttgcgcgacctggagaaagagcgcagcatcagtgtggaagtcctgcttgaagccatcgaggcggcgcttttgtccgcctaccggcgcaatttcgggacttcacacaacgcgcgggtgcaggttgaccgccacaccggagactgcaaggtgtacgccaggcggaccgttgtccaggaagtggaggacccccaggatcagatttcccttgaggaggccagagccattaacccgggctaccaactggaggacacggtagaatcggaaatcacgccgcgcaattttggacgtatcgccgcccaaacggcaaaacaggtggtggtgcagcggattcgggaagcagagcgaaacatggtcttcgaggaatttgccagccgcgagggcgacatcgtcaccggtgtggtgcagcgcatcgagcagcgcaacgtgtacatcgaactgggcaaaaccgaagccgtgcttcccccggcggaacagataccgagagagaactaccggcccggtcaacggctgaagacatatattgtcgaagtgaagaagaccaccaaggggccgttgatcctggtttcccggactcatccgggtctcctgaagcggctgtttgagattgaggttcccgagttgcaccaggggctggtggaactgaaagcggtggcgcgggaggctgggatccggtccaagatcgccgtctattcgaatgatgagggcattgatccggtcggggcttgtgtcggcccgaagggcgcccgggtacaggcgatcgttcaggagttgaacggcgagaaaatcgatgtcgtgaagtggagccccgactcctcgaagtttgtgtccagttccctgagcccggccaaggtgattgcggtggaggtgtgggaggacgaaaagatcgcccgggtgatcgtacccgactaccaactgtcgctggccattgggaaggaaggtcaaaacgcccgcctggccgccaagctgaccggttggaaaatcgacatcaagagcgaatcgcagatggctgaaatttaccgggaatatcttgagcagcagggctacgagcaggtgtga

SEQ ID NO: 480 - DNA, 1143 bp, Natranaerobius thermophilus JW NM WN LF
ttgaatcgagagtttattgaagccatagaggagatagaacgggataaaggcataaacaaagatattttatttgaagctattgaagcggcattgatatcagcttataagagaaactttgattctgataaaaacgtacgggtgcatatggagagagaaactggcgatgttagggtttatcatcaaaaacaagtggtggaagaagtagaaaatcctaaagaacaaattagtttagaagaagctcgcaaaatttcaccaggctacgaggtggatgatctcgtagaagaagaagttacacctaaaaatttcggaagaatcgcggcacaaacagctaaacaggtagtaatccagagaattagggaggcagaacgggaacttatttatgaagaatatgtcgacaaacaagatgatattatcaatggtatcgttcaaagaatcgaacaaaaaaatgtaattatagatttaggcaaggttgaagcaattctaccacctcaagaacagatggacactgatgagtacaatcagggtgatcgaataaaagcttatgtagttgaagttaagaaaaccactaaagaaccccaaattattctttcccgaacacatccaggtcttataaaacgattactggaattagaagttccggaaatctatgatggaactgtggaaattaaagggattgctcgagaggctggttatcggtctaaagtagcagtttattcacgtcatgaagaagtcgaccctgttgggagttgcgtaggtaacaagggaagtagaattcaatcaattgttgatgaacttaaaggtgaaaatattgatgtaattacctggtcatcggatcctgtagtatttattagtaattcgttgagtccatctaaagtccttgaagttaaggtgttagacgaacaagatcaaaaagctagagtagttgttccagatcatcaattatctctagccattggtaaagaagggcaaaatgccaggttagcagcaaaattgactaattggaagatagatatcttgagcgaaagtcagttagctgaaaaaggtgaatcaagtgttgaagtagaagactttgtagaagagtccgcatctccagaagaaccagataatcatggagacgagacaaaagatggcgatgaaggataa

SEQ ID NO: 481 - DNA, 1575 bp, Mycoplasma arthritidis 158L3 1
atgtcagaaagaactgaaggcgaaatcaaaaaagctaaagaaatcttcaaagccattaatgatttaagtaaattaaaaaacttaaatactaatgaagtaattgaactttttaaagatgctgttaaaaaagttattatgtcatatgatgaagatgctgaactagaatttgtcttcgatgaagaaaataacgaattcatcgttattaaccatactaaatatgttgttcaagacccaattaccgctgaagacaaagacatgctatgtcgttgcattgaagtaccactttcgattgctaaagaactaaaatcaactgctaaagaaggcgatgttatttcagaaacaattaactttgaaacttttcaaaagaaagattacattcgcattttgcaatctttcaatcaatcaattagggaattagaaaaaaaagttattgttggtgtttattcacttaaaattggacaaattgttcgtgctaaagtagctactcctacaacgcgaggtattttctttgaacttgaagacggtacaccagcctacatgccttctaatgctaataatcgtaaattaacagctaatttacaaccgggcgatagcattgatgtttacattgacaatgttggcgatgctgataaaaatgttcaagtattagtgtcaactgttgaaagtaagttaattgataaattactatataaagaagtgccagaaattgctaatggtttaattgacatcgttaaaattgcgagaattcctggtgaaagagccaaaattgcaatttcagcaaacgaaaaaactccaattggcgtagaagtagtgggatcggtgctaggtgaaaatggtagtcgaattaataatgttatccaacaactaaaaggcgaaagactagatgtcattgaatattcagcagatattaaaactttcattaaaaatgcaattagtcctgctaaagttattgacattgttgaaaataaagaaaaatgacaagcaaattatccagcttacatcgtggttgtaccaaatcaacacaatactttagctattggcaaaagaggccaaaatgttgtattagcaagtgatcttgttagagcaaaacttgacattttcagtcaagaccaagctgatcttgccaaaattgagtatgacattaacaacggcaatattactcaagccgaacttgacgaacttgctcaaggcaaaagactacaaagtcagttccgtcgtagaactagacaagacactgcatcgcgtgacactattgacatggctgattttgaaaaagaaatggaagaaatcaaagcaagaatgacgagttatgaatcatttgaaagacaattatttaatcaagatgtttcaaatgaagatataagccttgcttttgaaaaagctcaagccgaacttgcatcacttgaaaaagaaattgatgaagatgataaactttattcaaaacaaccagaaaatgttgaagaagattatgccaaaatcactgaaaccaaaatgaaagatttcatcaaagatgctgatttaagtgctggcctagatgatctagatttgagtgatttagatgatgaagattgataa

SEQ ID NO: 482 - DNA, 1107 bp, Bacillus cereus AH187
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaatccaagttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttaggaaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaggcaggagatcgttctaaaatctctgtacatgcagagaacattgatgtggatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaacagttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattctgttgaagacgaaatcgaatag

SEQ ID NO: 483 - DNA, 1083 bp, Dictyoglomus turgidum DSM 6724
atgaagttaggagaagatttttgggttgtattagagcaaataattacagaaaaaaaactcgataaaaatgtggttttagaagctttaagaaaggctttgctctctgcttttaagaaggcatatggtaccagtaaaggagcaagggtagagattaattttaataaacaagaaataaatatttatgtggttaaaaagatagttgagaaggttaatgacaatatttcagaaataagccttgaagaagctaaaagtttaaagcccgatgctaaaattggagatgaaatagaaatagagatagaaccacaagaatttggtagaatagcggttcaagtggcaaaacaagttataatgcaaagcctcaaagaggctgaaagaaaaattctttatgaaaaatataaagcaaaagaaggagaactagttaatggcacagtggtaagagtagaaaagggaaatgtatatgtacgttttcctgacattgaggcaatccttcctgtaaaagagcaaattccaggggaagaatactggattggaagaagacttagagcataccttttggaagtaagaaaaaccacaaaagatccgttagtaatcctttccagaagtcatcctggatttctaaaaagactctttgaattagaagttccagaaattagggagggtacagtagaaattgtaagcatagctagagagcctggaatgaggtctaaagttgcagtttattctcatcttccagaagttgatccaattggagcatgcgtagggtataaaggggttagaattcagaatattattaatgagctaaatggagaaaagatagatattgtgctatggagtaaagatcctgcagaatttgttgcaagaagtcttagtcctgcaaaacccctttccgtagagataagagaagacgaacataaagctattgtgatagttcctcccgatcaattttctcttgctatagggaaagatggacaaaatgtaaggttagctgttaaactaacatcttggagaattgatgtaagaactccagaacaatatgcaaaagagaaggaagaaaaagaaaaggtggtagagaagagtgagtaa

SEQ ID NO: 484 - DNA, 1107 bp, Bacillus cereus B4264
atgagcactgagttattagatgctttgctcgtattagaatctgaaaaaggcattagcaaagacattattattgatgcgattgaagcagctttaatctctgcttataagcgcaattttaatcaagcacaaaacgttcgtgtgagctttaacccagaagtgggaacaattcaagttttagcacgtaaagacgtagtagacaatgtgtttgatccacgtcttgaaatttctgtagaggaagcaagacaaattaatccaaactatcaagatggtgacgtactagaaattgaagtaacaccaaaagactttggtcgtattgcagcacaaactgcaaaacaagttgtaacacaacgagtgcgtgaagcagagcgcggtgttatttactctgagtttagtgaccgtgaagaagatattatggtaggtattgtacaacgtcaagatgctcgtttcatctatgtaagcttaggaaaagtagaagctttattacctgtaagtgagcaaatgcctaatgagcaatacaaaccacatgatcgtattcgcgtattcattacgaaagtagaaaaaacgacaaaaggaccacaaatttacgtatcacgtacacatcctggtcttttaaaacgtttattcgaaatggaagttcctgaaatctatgatggaactgtagaaattcgttctgtagcacgtgaagctggcgatcgctctaagatctctgtatatgcagagaacactgatgttgatccagttggttcttgtgtaggaccaaaagggcaacgtgtacaacgcattgtagacgaattaaaaggtgaaaaaattgacatcgttcgctggtcaaatgatccagttgaatatgttgcaaatgcattaagcccatcacaagttgttaaagtacttgtagatgaagaagaaaaagcgacaacagtagttgttccagaccaccagctatcattagctatcggtaagcgtggacaaaatgcacgtcttgcagctaaattaacaggctggaaaattgacattaagagtgagtctgatgcgaaacaacttggtattgtaacagaagaagatagcgtaatcgcattcggattcgattcagtggaagacgaaatcgaatag

SEQ ID NO: 485 - DNA, 1218 bp, Cyanothece PCC 7424
atgaccattgtgaatttgccaggactcaaaaatatgattgatgagatcagccaacggcataacctgcctaaatcggctgttcatgaagccctacgagaagccctcctcaaaggctatgaacgctatcgacgggcccaaagtttagaaaaaaatcagtttcatgatgactattttgagaattttgacgtggaactcgataccgaagaagaaggtttccgcatactctcaaccaaaaaaatagttgaggccgttagtaatacagaccatcacatctctttaaaagaagttcaagaagtcgtctcagaagctcaattaggagatgaagtggttttagatgttaccccggatcaaaaagaattcgggcggatggccgctatccaaactaaacaagttctcctgcaaaaacttcgagatcaacaacgaaaattaatccaagaagaattccaagacctagaaagtaccgttttaaccgccagagttttaagatttgaaagacaagcagtaatcatggccgttcaaagcgctttcggtcaacccgaagtcgaagcggaattacccaaacgcgaacagctacccaacgataattatcgcgctaatgctacttttaaagttctcctgaaaaaagttcgggaagggtctcaccgagggcctcaattaatcgtttctcgtgcggcagccggtttagtcgtgtatctatttgccaatgaagttcccgaaatcgaagaagaagtggttcggatcgtggccgtttccagagaggctaaccctccttctcgttatgtcggctctcgcactaaaatagcagtagacaccctagaaagagatgtcgatcccgtaggagcttgtatcggcgcaagaggctcacggattcaagccgtcgttaacgaactgcggggagaaaaaattgatgtgatccgttggtcgccagacccctcaacttatatcgctaacgccctcagtcccgctagagtagatgaagtcatcttgactaaccccgatgaacgtcaagctttagtgttagtggcagaagatcaactcagtttggccatcggcaaagaagggcaaaatgttcgcctcgccgctcgcttaaccggatggaaaatagatattaaagatagagcaatttacaaagccgataaagaaaatcaaacccaagacgaccaaagcgaagaccatcaagtcaatgaagaggttccagaagaagtagaaataagttaa

SEQ ID NO: 486 - DNA, 1239 bp, Cyanothece PCC 8801
atgtcccttgtgagtttgccagggttggcaaatatgattgaagaaattagccaactacacaacctacccaaatccgccgtacaagaagctttacgagaagccttgcttaaaggctatgaacgctaccgtcgttcccaaaacttagaacgtcaggcctttcacgaagattacttcgacaattttgaagtggaactagacaccgaagaagaagggtttcgtattctatcgacgaaaaaaattgtcgaagccgtcgagaataccgatcattttatttccctcgaagaagtccaagaagtcgcttccgaagcgcaactgggggatgaagtcgtcttagatgttacccctaaccaaaaagattttgggcgcatggctgccattcaaacgaaacaggttctgctgcaaaaactgcgagatcagcagagaaaactgattcaagaagaatttaacgaaatagaaggaacggtgctcaacgccagagttttgcggtttgagcgacaagacgcgatcgttgccgtgcaaagtacctttggacaacccgaagtcgaagccgttttacccaaacgcgaacaactccccaacgataattaccgagctaatgccacctttaaagtcttactcaaaaaagtccgtgaaggctcccaccgaggacctcaattgattgtctcccgttcggcagccgggttagtggtagatttgtttaccgttgaagtccctgaaattgaagaagaaatcgtgcggatcgtggcggtttcccgcgaagcgaaccccccttcgcgccatgtagggccgcggacgaaaatagccgtcgataccctcgaaagggatgttgatcccgtgggagcgtgtattggagctaggggatcgcgtattcaagctgtcgttaatgaactgcgaggagaaaaaatcgatgtgattcggtggtctcctgatccagctacttatattgccaatgcgttaagtccagctagggtggataatgttatcttaattaatcctgatgaacgtcatgcccttgtcttagtagccgaagatcaactcagtttagccattgggaaagaagggcaaaacgtgcgcctagcagctcgtttgacgggatggaaaatcgatattaaggatacagcgacttatcaagcagaagtggaacaaaaaaaacacgcacagaatcagacagccattgatcccctagaagaagaccccaatcttcccttaaccgagatgtcagaaacacagataggttag

SEQ ID NO: 487 - DNA, 1107 bp, Bacillus cereus G9842
atgagcactgagttgttagatgctttgctcgtattagagtcagaaaaaggtattagtaaagatattattattgatgcgattgaagcagcattaatctctgcttataaacgcaattttaaccaagcacaaaacgttcgtgtgagctttaacccagaagtgggaacaattcaagttttagcacgtaaggacgttgttgataatgtgtttgatccacgtcttgaaatctctgtagaagaggcaagacaaattaatccaaactaccaagatggcgacgtactagaaattgaagtaacgccaaaagattttggtcgtattgcagcgcaaactgcaaaacaagttgtaacacaacgagttcgtgaagcagaacgtggtgttatttactcagaatttagtgatcgtgaagaagacattatggttggtattgtacaacgccaagatgctcgtttcatctacgtaagcttaggcaaagtagaagctttattacctgtaagtgagcaaatgccaaatgagcaatataagccacatgatcgtattcgcgtatttattacaaaagtagaaaagacaacaaaaggaccacaaatttacgtatcacgtacacatcctggtcttttaaaacgtttattcgaaatggaagttccagaaatttatgatggaactgtagaaattcgctctgtagcgcgcgaagcaggagatcgttctaaaatctctgtgcatgcagaaaacattgatgttgatccagttggttcttgcgtaggaccgaaaggacaacgtgtacaacgtgttgtagatgaactaaaaggtgaaaagattgacatcgttcgctggtcaaatgacccagttgaatatgttgcaaatgctttaagcccatcacaagttgttaaagtacttgtagatgaagatgaaaaagcaacaactgttgttgttccagaccaccagctatcgttagctatcggtaagcgtggacaaaatgcacgtcttgcagctaaattaacaggctggaaaattgatattaaaagtgagtctgatgcgaaacaacttggaattgttacagaagaagatagcgtaatcgcattcggattcgattcagttgaagacgaaatcgaatag

SEQ ID NO: 488 - DNA, 1332 bp, Desulfovibrio vulgaris  Miyazaki F
atgagcctggaactcaagaaggccatcgaccagatcagcaaggacaagggccttgaccgcgacatgctgatcgacaccctggaggaagccgtccgcacctccgtggcccgcaagttcggcgacgagatggacgccgaagtcagctacaatgacgaaaccggcgaaatcgacgtctatcagttcaagatcgtcgtgaagaaggtcgagaaccccaacagcgaaatttcgctcgaggacgcgcgcacccacgaccccagcgtgcagctggacgacgaaatgggcttccgcgtgaagatcgaggaccttggccgcatcgccgcccagtcggccaagcaggtgatcatccagcgcatgcgcgacgcagagcaggagatcatctacgaggaatacaaggaccgccggggcgaaatcgtcagcggcatcatccagcgccgcgacaaggccgggtggatcatcaaccttggccgcaccgaagcgctgctgcccaaggaagaacagatcccgcgcgaacactacaagcgcggcgaccgggtgcaggccatcctcatcgacgtgcgcaaggaaggccgcggcccgcaggtcatcgtgtcccgcgcgcaccgcgactacatggcggccctgttccgccgcgaagtgcccgaggtggacgacggcaccgtgcagatcatgggcgtctcgcgcgatcccggcagccgcgccaaggccgccgtcatgtcgcgcgaccgcgacgtggatccggtgggcgcctgcgtgggcattcgcggttcgcgcatccagaacatcgtgcaggaaatgcgcggcgagcgcatcgacatcgtggtctggagcccggacatcgccacctacgcccgcaacgccctgtcgccggcggtcatctcgcgcatcgtggtggacgaggaagagaatctgctcgaagtcatcgtgcccgacgaccagctgaccaacgccatcgggcgcaagggccagaacgtgaagctggccgcgaagctgctgggctggaagatagatatctacaccgaaacccgctacaacgaggccaacgccatcggacgcgggctcgagcagatcgccagcgtcgccgaaatctccatcgaacagttcatcgcggcagggttccagtccatcgagcgcctgcgtgaagccgacgacgaggaacttgcctcggcgctgggccttgcgccgggcaagatcgccgacctgcgcgcggccatcaacttccttgcgccccaggcgcaggacgatgccgacgcgactgccgaaccggatgcggagcccgctccggaggcagccgatggcgcaggcgaaggaaccgaagccgaagcgaaggaatag

SEQ ID NO: 489 - DNA, 1107 bp, Bacillus cereus AH820
atgagcactgagttgttagatgccttgctcgtattagagtcagaaaaaggaattagcaaagatattattattgatgcgattgaagcagcgttaatctctgcttataaacgcaattttaaccaagcacaaaacgttcgtgtgagctttaacccacaagtgggaacaatccaagttttagcacgtaaagacgttgttgataatgtgtttgatccacgtcttgaaatttctgttgaagaagcaagacaaattaatccaaactatcaagatggtgacgtactagaaattgaagtaacaccaaaagatttcggtcgtattgcagcacaaactgcaaaacaagttgtaacacaacgagtgcgtgaagctgagcgtggtgttatttactctgagtttagtgaccgtgaagaagatatcatggttggtatcgtacaacgtcaagatgctcgtttcatctatgtaagcttagggaaagtagaagctttattacctgtaagtgagcaaatgccaaacgaacaatacaaaccacatgatcgtattcgcgtattcattacgaaagtagaaaaaacaacaaaaggaccacaaatttacgtatcacgtacacatcctggtcttttaaaacgtttattcgaaatggaagttcctgaaatctatgatggaacggttgaaattcgttctgtagcacgtgaagcaggagatcgttctaaaatctctgtacatgcagagaacattgatgttgatccagtaggttcttgtgtaggaccgaaaggacaacgtgtacaacgcattgtagacgaactaaaaggtgaaaagattgacatcgttcgctggtcaaatgatccagtagaatatgttgccaatgctttaagcccatcacaagttgtgaaagtacttgtagatgaagaagaaaaagcaacaactgttgttgttccagaccaccaactgtcattagctatcggtaaacgtggacaaaatgcacgtcttgcagctaaattaacaggttggaaaattgatattaagagtgagtctgatgcgaaacaacttggtattgtaacagaagaagatagcgtagtcgcattcggattcgattcagttgaagacgaaatcgaatag

SEQ ID NO: 490 - DNA, 1482 bp, Desulfitobacterium hafniense DCB 2
atgaatatggagttcattgaggccctccatgaattggagaaagacagagggatctcagcggatattctgtttgaagccattgaagcggccctgatatctgcttacaagaaaaattttgcttcattacagaatgtccgggtacatatcgaccgtatgactggagagttcaaagttttcgcccggaaaaacgtggtggaagaggttgaagattcacgaactcaggtaagtatggaagaagcacagaagattgaccccaactatgccatcgatgatgtggtggaatacgaagtcacgccccgtgaatttgggcggattgcggctcagacagctaaacaagtagtagtgcaaagaattcgtgaagctgagcggggcatgatttacgatgaatatatcaaccgggaaggggatatcgttaccggaattgttcagcgctatgatcagaaaaacgtcattgttgatttaggtaaggtagaggccattctgacagcacaggaacaaattcccggtgagacttatcaaccctttgagcggattaagacctttgtggtagaagtcaaaaaaacaaccaaagggcctcaggtcatgctctcccgtacccacccgggtctgattaaacgtttgtttgaactggaagtgccggaaatccatgacggactggttgagattaaaggtgtgtcccgggaggcgggagcccgctctaaaatcgctgtttattcccgggatgccaatgtagatcctgtgggggcttgcgtaggaccgaaaggcagccgggttcaaaccattgttaccgagttgaagggtgaaaagatagacatcgtcaattattccacagatcctgaggaatttgtggctaatgccctttccccggccaaagttgtgggagtataccctaaacctaatgagaaagtggctttggtcgtagttcccgactatcaattatccctggcgatcggcaaagaaggtcaaaatgcccgtttggccgccaagctgaccaattggaagattgacattaagagtgagtcccaggccctggcccaaaatcttattcccgataagaatgaagtccagggagaatacgaagagtacgacgaattcgctgattatgcagagtatgaaaactacgatgaatatgaagactatagcgaatacgatgactatgaagagaatgaggactacgatgaaaacgcgacctatggggagaattatgatgatgagctggtttatgatgagaatgaccagtatgaggaattcgatgcttatcaaaatgaagaacttccctacgaagaaagcgaagactatgcagcgactccggataacggggagcctaaggccgaaaatgctgaggaaaactatgcctacacagagtcaggcgataaggaagaacgactgacggaacgggatcggtccatgatgaaatactttgaagcggatgagaaaaacagccgcaaggagaaaaagaagaaagccaaaggcaaaaggtag

SEQ ID NO: 491 - DNA, 1134 bp, Halothermothrix orenii H 168
atgaatattgaatttttacatgcgctggatgatattgaaaaagaaaaaggaatatccaaggaagtattaattgaagctatagaaacagcactcctttctgcctataaaaaagaatttggttccaaggaaaatgttagagtacatatagttccagatagtggtgaggtacatgtttatagtcagaaaaaagtagttgatgaagttaataatgagcgaaaggaaatttccctggaagaggcacaaaaattaaacaaaaattacgaaccaggggatattgtggagaaggaggtaactccagctaattttggtagaattgctgcccagactgcaaaacaggttgttatgcagagaatcagagaagctgaacgtgatgtaatttatgaagaatataaacaaaaagagggggaaataattaccggtactgtccagcgctttcataataacaacgtgcttattgacctggggaggactgaagccctgttaccgccatctgaacaaatccccggggaattatatgaaatgggtagaaggattaaagtatatgttgtcgaagttgcttcaactacaaaagggccacgtatcctcgtttccaggtcccatcccggcctccttaaaagattatttgaagttgaagtaccggagatatttgatggtattgttgaaatcaaggcagtggcccgggaagcaggctatagatcaaagatggcagtcagttcctatgatgagaatgttgatccggtaggttcctgtgtggggcctaaaggaatgagggtacaggcggtagttgaccagcttaacggtgaaaagattgatattattgaatggagtgaggaccctgctatacttgtagccaatgcccttaatccggccaaggttataaatgttagccttgatgaagaagaaaaggttgctgaagtagttgtacctgattttcaattatctctggctattggtaaagagggtcagaatgcgagattagcagccaaattaacaggatggaaggttgatatcaaaagtgaatcccagtttgagaaagaaaccggagaggttgagaaaaaaattcccgcagatgatggggaaaaagttgatgaagtaggggttgaagatgatagtctagatatagaagagagttag

SEQ ID NO: 492 - DNA, 1149 bp, Clostridium cellulolyticum H10
atgagcgctgagttgatattagctcttgaacagctggaaaaggaaaagggtattaaaaaggaaataattattgaggctattgaggctgcacttatttctgcatacaagaaaaactttggttcagcaatgaacgttaaagtaaatatagatagggtaacaggtgatgtaaaagtttttgcactcaggaaagttgctgaagacccagatgtcgaggcaatggacatatcaataggagaggctgccaagcttaatcctacactggacataggagattatgtagaatctgaagttactccaaggtcctttggaagaattgctgcccagactgccaaacaggtagtagttcaaaaactaagagaagcagaaagaggaatcatttacgatgagttctacaataaggaaagcgacattgtaacaggaatcattcaaaggatagaaaagagaaatgtaatagttgaccttgggaaaactgaagccgttcttgggtctaccgagcagactcccggagaggaatacagatttaacgaacgactgaagtcatatattgtagaggttaaaaaaactacaaaaggtcctcagattatgctttccagaacacatccgggcttggtaaaaaggttatttgaactggaagtacctgaaattcatgacggtactgttgaaataaagagtatttcaagggaaccggggtcaaggactaagctagctgtgtactctaaagatgaaaatgttgatcctgtaggagcatgtgttgggcagaagggtaccagggttcaggctattgttgatgaactgaggggcgaaaagattgatattatcaaatggagtaatgatcccaaagattatatatccagcagtttaagccccgctaaggttgtgagggtagatgtggacgaagaagaaaaatctgcaaaggtagtggttcctgactatcagctttcattggcaataggaaaggaaggccagaatgcaaggttggccgcaaagcttaccggctggaaaattgatataaagagcgaatcccagctaagacagtcaattgagaaacaactgtttgatgatagcttaaacaacggatatttggatgaaacagatactgacagtatgaattatgataatgatgaccatgaaaataatataattgattga

SEQ ID NO: 493 - DNA, 1350 bp, Desulfovibrio desulfuricans ATCC 27774
atgaatcttgaacttaaaaaggccattgaccagatcagcaaagacaagggccttgaccgcaacatgctcatcgacacgcttgaagacgcggtgcgtacctccgtgctgcgccgcttcagtgaagatatggatgtggaagtatcctataatgacgaaacgggcgatattgaggtctaccagttcaaaatcgtgatggccgacggcgacgtggccaatcccgatacgcagatagaacttgccgaagcccgcgagcacgatccttccgttcaggtggacgacgaaatgggcttccgcgtcaaggttgaagaccttggccgcatcgccgcccagtctgccaagcaggttatcattcagcgtatgcgcgacgccgaacaggaaattatctacgaggaatacaaggatcgcgtgggtgaaatcgtttcgggcatcgtgcagcgccgcgacaagggcggctgggtggtcaacctgggccgcaccgaagccatcctgccccgcgaagagcagatcccgcgtgagcattacaagcgcggcgaccgcgttcaggccctcattatcgaagtgcgccaggaagggcgcggtccgcaggtggtcatatcccgtgcgcaccgcgactacatggccgccctcttccgccgcgaagtgccggaagtggacgacggcgtggtgcagattatgggcgttgcccgtgatcccggctcacgcgccaaggttgccgtgctctcccgtgagcgtgacgtggaccccgtgggcgcctgcgttggcgtgcgcggctcgcgcatccagaatatcgtgcaggagctgcacggagagcgcatcgacattgttgtgtggagcgccgatattgccacctacgcccgcaacgccctggccccggccctggtatcgcgcattgtggtggatgaagaagaaaatctgctcgaagtcatcgtgccggacgaccagctcaccaacgccatcgggcgcaaagggcaaaacgtcaagctggccgctcgccttctgggctggaaagtcgatatattcaccgagacccgctacaacgaggccaacgccatcggccacggtctcgagcaggtggccagtgtggccgaagtgtccattgaggctctgcttggcgcgggctacagctcgcttgaccagctgcgccaggccacggaccaggaactgtccgacaagctgaccatcagcgcgtcgcgcattgccgaccttcgctcggccatcaacttcctggctcccgtggtagaagaaacgcccgaatcctccgctgtggaactgggccggacgcatgccgacgaggaagactccggtcaagaccagaccggcgacagtccccgcgaggatgcgcaagattag

SEQ ID NO: 494 - DNA, 1242 bp, Cyanothece PCC 7425
atgtcaatggttcgtttgcccggtctacgcgaaatgattaatgccatcagccgggaacggaatttgcccaaatatgcagtgcagggggccttgcaggaagcactgatgaaaggctatgagcggtatcgtcgcaccctgcgcctggagggcggacactttgatgaagattacttccagaattttgacgtagaaattgatgtggaagaggaagggttccgggttctggccaccaaaacgattgtggagcaggtagacaacccggatcatcagatttccctatctgaagtgcaggaagttgcagcagaagctcaattgggagataccgtgattctggatgttaccccagaacagcaggagtttgggcgcatggcagcaattcaagccaaacaagttttagctcaaaaactgcgggatcaacagcggaaactggtgcaagaagaattccaggatctggaaagtacggtgttgcaggctcgggtgctgcggtttgaacgacgttccgtgatcatggcggtgagcagcggctttggtcaacctgaggtcgaggcggaattgccgaaaaaagagcagctacccaatgataattatcgcgctaatgccacatttaaggtttatctgaaaaaggttttggaagggccacaccggggaccccaattgctggtttcccgggcggatgccggtctggtggtttatctctttgccaatgaagtaccagaaattgaggatgaggtggtgcggattgtggccgtagcccgcgaagctaatcccccctcccgccaggtgggccctcgcaccaaaattgccgttgataccctggaacgggatgttgatcccgtcggggcctgtattggtgcccgcggatctagaattcaggctgtggtcaatgaactgcggggtgaaaagattgatgtgattcgctggtctcccgatcccgccacctacattgctaatgccctcagcccggcccgggtggaagaggtgcggttaatgaatccagaagagcggcaagcccatatcctggtgacggacgatcaactcagtctggcgatcgggaaagaaggacaaaacgtgcgcctggctgctcggctgacgggctggaaaatcgacatcaaagatattgccacctacgattacgaaggtgaaaatcgcaaagccgaagctgaggcggccgaaaaagcagcagcccaagaggccgtggaaccagaggacgaagacgactttgagccagaggagctagagtag

SEQ ID NO: 495 - DNA, 1074 bp, Anaerocellum thermophilum DSM 6725
atgcccaaaaaagagcaaactcttgattttcaggagctgttttcggcaattgatgagcttgaaagagagtataagattgaaaaggattatgtatactcagttttagaatcagctcttttgacagcttataagcaggtaaaaggaataaaagacaaaaatctttctaacgttaaagtttccattgatccagaaaagggaagtgtaaaaatttatgaatacagaaaagttgtcgaaaatgtaaaagatagaaaaaatgaaatttcacttgaggatgcacaaaaaattgataagagatataaaattggtgatattgtagcaatagagattcccatttcccagtttagcagaaaggcggcaatgacagtcaggcagacagttataggcaagataagagaaaaaaagaggagcatcatatttgaagattattcttcaaagattgataatatagttacaggtattatacagaggattgataaaaagaatgttattgtagaaattgaaggtgggaaggttgaagcaatacttccaatggaggagcaaatacccggtgaagagtacaaaccagggacattgatgaaattttatcttgttgatgttaaaattcctcccaaagaaaaagaacctattgtttatctttcaagaactcatccaaatttaataaaaaggcttatggagaatgaagtgcctgagatacaagagggtataattgaaataaaagcaattgcaagagaggcagggtcaaggtcaaaggtagcagtttattctaacagcttaaaagttgatcctgttggagcttgtataggtgaaaaggggatacgaattcagaatgtgctaaagcatttgaatggtgagaaaattgacattgtaaaatggagtagtgacattggggaatttataaagaatgcactcagccctgcggaggtcgtccatattgatttaaatttaattgaaaaaaaggcatttgtccttgttccaaacagccaattgtctcttgcgattggcaagggtggacaaaacgctcggcttgcagcaaaacttactggttggaaaatagatataaagggtaaagattga

SEQ ID NO: 496 - DNA, 993 bp, Acidimicrobium ferrooxidans DSM 10331
atggccgttgagaacccagaggtgatggacgcgctcgaggtgatcgctcgggagaagggcctgtcggtcgagacgctcctcgagtcgctcgccaacgcgctcgctgccgcctacaagcggcggcccggcgctgccgaggaggcctacgtcgagatcgatcccgcgagcgggacgatccgggtgatctgccaggagctcgacgagaacggtaccgtcgttcgcgagtgggaggacacgcctcgcgacttcgggcgcatcgcggcccaggctgccaagcaggtcatgctgcagaagatccgcgaggccgaacgcgagcagaagtacgaggagtacgccgggcgcgagggggacgtggtcacggggatcgtgtcccagatcgacccgcggttcacgctgctcgacctcggcaagatcgaggcgatcatgccgcactccgagagcccgtcgaacgagcgctactcggtgaaccagcgtttgaaggcctacatcgtcgaggtgcgacggtccatcaagggtccacagatcgtcgtgtcgagaacgcaccccggcttggtccggcgcctcttcgaggtggaggtgcccgagatcgcgagtggtgtcgtcgaggtcaaggccatcgcgcgcgagcctggtcatcggaccaagatcgcggtgtggtcgaacgatcgctcggtcgatccggtcggagcctgtgtcggtgctcggggatcacgcgtccacaccgtggtgaacgagctcttgggggagaaggtcgacatcgtcccgttctccgaggatctcgcggagttcgtcgagcgggcgatcgtaccagcgcacgccctctctgcgaccgtcgagggtcgcgatgcgctcgtggtcgtgcctgacgatcagctgtcgctcgccatcggccgcgagggccagaacgcgcgccttgccgctcgtctcaccggcacccacctcgagattcggccccagagcgaggtcgagggccgccaggagggtcagccatag

SEQ ID NO: 497 - DNA, 1326 bp, Desulfomicrobium baculatum DSM 4028
atgaatttggaactcaaaaaagccatcgaccagatcagcaaggacaagggcatcgaccgcgagatgctgatcgacacattggaagaagccattcgggcctccgtgaccaaaaaatacggcgacaagatggatatcgaggtcaccttcaacgaggagaccggcgagatcgaagtctaccagtttaagatcgtggtcgaggagatcgaagatcccgacacggagattctcatggtcgacgcgctcaagcacgaccccaacgtcgaactggacgacgccatcggattccgtctgcaggtcgaagacctgggacgcatcgcggcccagagcgccaagcaggtcatcatccagcgcatgcgcgacgccgagcaggaaatcattttcgaggaatacaaaaaccgcaagggcgagatcgtcagcggcatcatccaacgccgcgaccgttccggctggatcatcaacctcggacggaccgaggccctcctgcccaaagacaagcagattccacgcgaacgcttccgccagggcgaccgggtcgagggactcatcatcgaagtacgcaaggaaggacgcgggccgcagatcatcatcacccgctccgatcccgagtacatgaccgccctgttccgccgtgaagttcccgaagtggccgacggcaccgtgaacatcatgggcgtagcccgggatccgggcctgcgcgccaaggtcacggtcctgtcccaggattccaacgtcgatccggtcggagcctgtgtcggcatccgcgggtcgcgcatccacagcatcgtgcaggagctgcgcggcgagcgcatcgacatcgtactctggagccctgacatcgccacctacgcggccaacgccctgtctccggcgcgcatctccaagatcgccatcgacgacgaggaaaaatccctggaggtcgtggtccccgaggatcagctgaccccggccatcggcaagaagggccagaacgtcaagctcgcggccaagcttctgggctggaagatcgacattttcaccaacacccgcttcaacaaggtgcacaaggaccgccacctgctggaacagctggccagcgcggcccaggtttccatcgcggacttcgccgaggccggcttcgactcgttggaagccatggccgcctgcaccaacgagcagctgctcgacatccagggcatcagtgaagaaaatatcggcgccctgcgcggagcgttgaacctcctcatcagccagaaccgggaagaaaccccggaagaatccgaaccatcggaagtaaaaggcctggtcgaaggggaagatgcggattacgcggacggagacgaagcatag

SEQ ID NO: 498 - DNA, 1149 bp, Geobacillus WCH70
atgaatacacaattactcgatgccctagcggatattatccgtgaaaaaggcattagcaaagaagttgtgatggaagcgattgaagcggcgatcatttctgcgtataaacgcaatttcggccaggcgcaaaacgtacgggttgatttaaatacagaaacaggaacgatccgtgtatttgcgcgtaaagaagtggttgatgaagtaaatgatccgcgcctcgaaatttctttagaagaagcacaacgaatcaatccgaattatcaaatcggcgatgttctcgagttagaagtaacgccgaaagattttggccgcattgcggcacaaacagcgaaacaagttgttacacaacgggtgcgcgaagcagagagaagcgttatttatgctgagtttgttgaccgtgaagaagatatcatgacagggatcgtacaacgtgtagatcctcgttttgtttatgtcagtctcggtaaaacagaagcgttgctgccggctagcgaacaaatgccgaacgaaacatacaaaccgcacgaccgcattaaagtgtatattacaaaagtggaaaagacaacaaaaggaccacaaatttttgtttcacgcacccatccgggattgcttaagcgtctttttgaactggaagtcccagaaatttatgatggaacagtagaaattaaatccattgcccgtgaggcgggagaccgctcgaaaatttcggtgcattccgacaatccggaagtggatccggtcggcgcgtgcgtcggtccaaaagggcagcgggttcaagcggttgtggaggaattaaacggggaaaaaattgatatcgtccgctggtctgcagatcctgttgagtttgtcgcaaacgcattaagtccggcaaaagtgttgcgtgtaatcgtcaatgaagaacaaaaagcaacgaccgtaatcgtgccggattatcagctgtcattagcaatcggcaaacgcgggcaaaacgctcggctagcagcaaagctgacaaactggaaaattgatattaaaagcgaatcggaagcgagagaattaggaatcgatccatatgcgcaatccacttttcttgattcagaagagacatcggtcaataatgaaaatgacagcaaccaatcattcgatttacaagaagagaaaatcgagtga

SEQ ID NO: 499 - DNA, 1218 bp, Eggerthella lenta DSM 2243
gtggcaagttcagaactgattgaggcgttgcaggcgctggcgcatgagcgcaagatcgacgagttctacctcatcgaacgcctcgaggcatcgctcgccaagagctaccagcacatcctcgatctcgagtgggacgcccgcgtgaccatcgaccgccagacgggccacatctacgtgtacgagctggtgccggtgggcgagcccgacgaggagaccggcgagtacagcgagttcgaggagcgcgacgtcacccccgacgatgtcagccgcatcgccgcgcagaacgccaagggcgtcatcgcgtccatcgtgcgcgaagccggccgtcagtccatctacgaagagttctcggaccgcgtgggcgacctcgtgacgggcacggtgctgcagggcacgccggacttcaccatcatcaagattcgcgacggcgtggaggccgagctgccccattacgacgtgaagcgcaaccccaacgagcgcaacgagcgtccgagcaacgagcactaccgccacaaccagcgcctcaaggtgctcatcatcgaagtgcgcgacccgaactccgacgcgccgaagatgcgcggcgagcaggcgcgcccggccatcgtggtgtcgcgcacgcatccggacctcatccgccgcctgttcgagatcgaggtgccggagatctacgacggcatggtggagatcaagtccatcgcccgcgagcccggcgcccgctccaagatcgccgtggcgtcgcgcgaggcgaacctcgatcccgtgggcgcctgcgtcggcccgaagggcagccgcgttcgcatggtggtggaagagctgcgcaacgagcgcgtcgacgtgatccagtgggcggaggatccggcggtgtacgtggccaacgcgctgtcgcctgcgaaggtgacccgcgtcgtcatcgacgaggacaaccactacgccaccgtcgtggtgcccgacgaccagctgtcgctggccatcggcaaggagggccagaacgcccgtctggctgcgcgcctgaccggctggcatatcgatatcaagagcgccagcttcacgggcgagtcgctggctccgatggacaacatgctgatcgacgaggacgaggccgcggacgacgaagccggtctgtgcgcctacgtgggcgaggacggggtgcgctgccgcaaccatgcccgtccgggcagccgctattgcggcgtgcacgccgacctcgacgaagcataa

SEQ ID NO: 500 - DNA, 1329 bp, Chloroflexus aggregans DSM 9485
atgaaaagcgatttttacgcggcaattactcagattgcgtctgaacgcggtattccaaaagaggccatcattgacgtgatggaacgggcattggtgagcgcatacaagcgcttactcggccccaatccaccggcggtagaagtgacggtgaagctcgatcccgtcagcggtatggcgcgggtctacgccgagaagcaagtggtcgatgaagtgtacgacgagcggtttgagatcgacctcaacagtgcgcgccaaatcaagcccgacgttcagatcggcgagacggtgctggtcgagagcacaccgcgtgattttggccggatcgccgcccaaactgcgaagcaagtggtgttgcaagggattaaagagatcgaacggagctatatctatagcgaatttgaagatcgcgaaggcgagttggtgacggcgacggtacagcgcaacaacgggccacgcggcaacgtgatccttgagatagggaaggccgaggccattatcccgccgaaagagcaagtggcaaacgatcgctattaccacggccagcggctcaaggtattgctgctcgaggtcaagaaggatgatcgcggccctcgcctgattgcgtcgcgcgcgcacaagaatctgatcaaccgcctgtttgagatggaagttcccgaaatctacaacgggtcggttgagattaagtcggtggcccgtgaacccggtctgcgcacgaaagtcgctgttgcggcccgccaagaggggatcgatccggtcgggtcatgcgtcggcatgcgtggtatccgcattcagaatattgttaatgagctaaacggcgaaaagatcgatgtggtgcagtggtcgtcggatccacgtgagtatatcgccaacgccctctcgccggcacaagtggttgaggtgcatctccacgatcacgaccataccgcgctggtgattgtccccgacaaacaactttcgctggcaatcggtaaggaagggcagaacgtccggctggcagcgaagctcaccggttggcggatcgatattaagagtgcgtcggcgttgctcgaagaggaacgggccgctgctgaggcccgcgctgaagctgaggccgaacagatggtgattgcagccgaattggcgcatgccccggttgaacagcgcatcgtacaggctgacggcaccatccgctaccgcggtcatcgctacggcccactcggtaacgatttggttggacagacggtgcaggtacgggcaacatcgcaaaagatctttatttactataatgaccgcctgttcgcctcctatatcttgctggaaggtggacaggcttcgcctgatgaggagtaa

SEQ ID NO: 501 - DNA, 1209 bp, Cryptobacterium curtum DSM 15641
atggcgacttctgagcttatcgaggcattacatgctttagcgcatgaacgcaagattgatgaattttatctgatcgagcgtttagaggcttcgctggcaaagagctatcagaacattctcgatctcgaatgggatgctcgtgtcacaatcgatcgcaacacgggcaaaatttacgtttatgaattggtgccgcagggcgaacccgatcctgaaacaggtgaatataccgatttcgaagaacgcgatgtgacacctgatgatgttagccgtattgcggcgcagaatgcaaaaggtgttatcaacgccattgtgcgtgaagcgggtcgtcagtctatttacgaagagtttagccagcgggtgggcgacttagtcaccggtaccgtcctgcagggcactcctgatttcaccattatcaagattcgtgacggcgttgaagcggaactacctcattacgatcagaagcgttttcctgacgaacgtaacgaacgtccggctaacgagcgctatcgtcataatcagcgtttaaaaacccttattatcgaggtacgaaaccccaattcggaagaatcacggcagcgtggcgaacaggcacgtccgtctatcgtggtatcgcgtacccatcccgacttaatccgccgtctttttgagattgaagttccagaaatctatgacggtgtggttgaaattaaatcaatcgcgcgcgaaccaggtgcacgcagcaaggtggcagtggttagccacgaaaatcatcttgatcctgttggtgcctgtgttggccctaaaggttctcgtgtgcgtatggtcgttgaagaattacgcaacgaacgagttgatgtcatccagtggagtgatgatgcggcaacgtatgtgcgcaacgctctttcgcctgctcgtgtttctcacgttgatatcgatgaagaaacgcattacgcaaccgttatcgttccggatgatcagctttctttagcgatcggcaaagaaggtcagaatgctcgattagctgctcgccttaccggttggcatatcgacattaaatcatcgtcatttgctggcgagccggttgtttctgaaaacattctgatcgacgaagaacccgatgacgctgtttccggacaatgtgagtttatcgatgaagagggcgtgcgctgtcgtaaccacgcgcgtccaaacagccgcttctgcggcattcattctcaggcagagaagtaa

SEQ ID NO: 502 - DNA, 1302 bp, Anaerococcus prevotii DSM 20548
atgaacaatgattttatgttagctttggatgagctttgtaaggaaaaaaatctagataaggcaaccatcctagatgccttacagaaggctcttatcaaaagttaccaaaaaaattatgacaacgaagaaaatgtagatgtcataatcgatgaagaaaccggacaaatcgaagtctttgctctaaaggaagtagtggatgaagtagacgatactatcacagaaatttccttaaaggatgctttggaggaaaactcaagctatcacctaggagatatagcaaggattaagcttactcctaaaaacttcggcagagtcgcagcccaaactgcgagaaatatcgtaatccaaaagatcagagatgcccaaagagattccctctatggagaatacatcgaaagggcaaacgagatgatcacaggaactatacaaagacaagataagtacaatgtctatgtaaacttagacaaaatagaaggtgtagttccaatcaaagagcaagttccaacagaagagtatccagcaaatgccaagatgaagtttcttataaaggaagttagaaattcttccaaagaaccacaaattgtattatcaagatcaagtcaagatcttataactagacttttcgagcttgaagttcctgaaatcacagacggcattattgaaatctattcccttgcaagagaagctggatctaggacaaagatggcagtattttcaaatgacgagggaattgatgcagttggagcttgtattggctttaagggaattagggtaaactccatagttgaagagctacaaggagaaaaaattgacattataaactttgataaagacattaaagtatttatatcaaatgccctatcaccagctgacattatcgaagtcctagtcaatgaaaaaagcaaaaagagccttgttgtcgtatcaagcgaccaactttcccttgctataggtaaggaagggcaaaacgcaagacttgcagcaagacttactggctggaagattgatataaaaagtagcgaagaatacgaaagcctaagccaagaagaaatagatgaaatacttggcctaaatgaaatagacgaagaggccagcgaagtggctgatgaagatgatgctttagatgatgaagacatttctttagaccttgatgaagaaaatgatgatactgaagatgatttaataagcgattctgaagttgaagaaataatagaagaagaaagcgacgatacagtagaagatattgcaaatattgattccactgttaaagcttatgaagaagatgaatctaatgaggattag

SEQ ID NO: 503 - DNA, 1239 bp, Cyanothece PCC 8802
atgtcccttgtgagtttgccagggttggcaaatatgattgaagaaattagccaactacacaacctacccaaatccgccgtacaagaagctttacgagaagccttgcttaaaggctatgaacgctaccgtcgttcccaaaacttagaacgtcaggcctttcacgaagattacttcgacaattttgaagtggaactggacaccgaagaagaagggtttcgtattctatcgacgaaaaaaattgtcgaagccgtcgagaatactgatcattttatttccctcgaagaagtccaagaagtcgcttccgaagcgcaactgggggatgaagtcgtcttagatgttacccctaaccaaaaagattttgggcgcatggctgccattcaaacgaaacaggttctgctgcaaaaactgcgagatcagcagagaaaactgattcaagaagaatttaacgaaatagaaggaacggtgctcaacgccagagttttgcggtttgagcgacaagacgcgatcgttgccgtgcaaagtacctttggacaacccgaagtcgaagccgttttacccaaacgcgaacaactccccaacgataattaccgagctaatgccacctttaaagtcttactcaaaaaagtccgtgaaggctcccaccgaggacctcaattgattgtctcccgttcggcagccgggttagtggtagatttgtttaccgttgaagtccctgaaattgaagaagaaatcgtgcggatcgtggcggtttcccgcgaagcgaaccccccttcgcgccatgtagggccgcggacgaaaatagccgtcgataccctcgaaagggatgttgatcccgtgggagcgtgtattggagctaggggatcgcgtattcaagctgtcgttaatgaactgcgaggagaaaaaatcgatgtgattcggtggtctcctgatccagctacttatattgccaatgcgttaagtccagctagggtggataatgttatcttaattaatcctgatgaacgtcatgcccttgtcttagtagccgaagatcaactcagtttagccattgggaaagaagggcaaaacgtgcgcctagcagctcgtttgacgggatggaaaatcgatattaaggatacagcgacttatcaagcagaagtggaacaaaaaaaacacgcacagaatcagacagccattgatcccctagaagaagaccccaatcttcccttaaccgagatgtcagaaacacagataggttag

SEQ ID NO: 504 - DNA, 1146 bp, Desulfotomaculum acetoxidans DSM 771
atgaacacggagtttttggatgctttgagggaattggaaagggagaaagggattgctgttgatgtgctgattgatgctatcgaagcagccctgttgtctgcctataaaaggaatttcggttccttacaaaacgccagagtacatatagaccgggaaacgggtgattttaaggtttattcccagagaaccgttactgaagaagttcaggatgatcggctggaaattactttagcggatgcccaaaaaattgatcccagatttgaactgggagatgtggtggagaatgaagttacgcccaggaattttggccgtattgccgcccagactgccaaacaggtagtggtgcagcgtatacgcgaggcagaacgaaatattatttatgaaaccttttccagtcgcgagtcggatataattaccggtgttgtgcagcgtattgagcaaaagaacatatatattgaactaggcaaaacagaggctatattgactccttccgagcagatgccgaatgaaacatataagcatggagaccgtattaaggcatatattgtggaagttcgcaaaactaccaagggaccgcagatttatgtgtcccgaacccatcccggtcttttaaagagactttttgaattggaagttcctgaacttgaggaaggtattgtggaacttaaatcagtggccagagaggccggagccagatccaaaattgctgtttactccaaggatgaaaatgttgacccggtaggcgcctgtgtaggtcccaagggtgccagggtgcaaaatattgtcaatgaacttaatggggaaaagattgatataataaaatgggatcctgacgcatccaaatatgtggccagctcgcttagccccgctaaagtggtagccgtggaaatctgggaggatgagaaagttgccagggtagtggtgcctgactaccagttgtctctggctatcggcaaggaaggccagaatgcccgtctggcagccaagttgactggatgcaaaatagatattaaaagtgaatcccagatggcggctctttatcccgagggatacggagaggcttatgatgaggaatcccatgcgcacaatgatttggaagattcaggtatgtcagaacttgacctgtatcaggcagaagacttttaa

SEQ ID NO: 505 - DNA, 1122 bp, Alicyclobacillus acidocaldarius DSM 446
atgaatgtggattttctggaagcgctggaccagttggcgcgcgaaaaaggaattgacaaggaagttctgctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 506 - DNA, 1323 bp, Desulfohalobium retbaense DSM 5692
atgagtatggaattaaaaaaagctattgatcagatcagcaaggaccggggcatcgatcgcgatttgctcatcgacaccctggaagaagcggtccggtcctctgtaaataaaaaattcaaaaacaaattggacatcgaagtctcgtttgatgaagaggctggggacatcgaagtctatcaattcaaggttgttgtcgaggaagttgacgacccgaataccgagatttcgctggacgaagcccgcatcgaagatcccaatgtccagttggaagacgaactcggcttccgcatggaaatttccgacttggggcgtatcgccgcccaatcggccaagcaggttatcatccagcgcatgcgcgacgccgagcaggaaatcatctacgaggaatacaaggaccgccgcggagagatcatcagcggcatcatccagcgccgcgaccgggcgggatggatcatcaacctcgggcgcaccgaggccatcctccccaagcaggaacagatcccgcgcgaacggttccggcgtggcgaccgggtccaagggtatatcatcgatgtccgcaaggaaggccgtggtcctcagatcgtggtctcccgctcccaccccgactacatggcggcgttgttcaaacgcgaagtgccggaggtcggcgacgggaccgtgaccatcatgggcgtcgcccgcgatccgggcaagcgggccaaagtggctgtgctttctcaggattccgatgtcgaccccgtgggcgcctgcgtcggtgtccggggatcccggattcagaacatcgttcaggaattcaagggagaacggatcgatatcgtggtctggaaccacgatgtggccacctacgccatgaacgccctttccccggcaaaaatttcccggatgaccgtcgacgatgtcgaaaaaaccctggaagtcgtcgtgccagacgaccaattgaccttggccattggccgcaaggggcagaacgtcaagctggcttccaaacttctggggtggaagatcgatatcatcacggaaagccgctacggggcggacccgagcgatcaggccgatctcgaacaggcagaacatgtgaccgggattccgacggaccattttgtacaggcgggcctgggcagcttggacgccttacgcgaggccagcgacgagcaattggcggccgtagacggcatggacacgtccaaaatggctgacttgcgggccgcgctgaatctgctggccccgaatcgggacacgcgtgaggacgacggaatccaggcctccactgccgacgcgcccagccacgatactgttgtggccccggacgacagcaccgaataa

SEQ ID NO: 507 - DNA, 498 bp, Enterobacter sp. 638
gtggaaatgtcacagctgtctccacgccgtccgtatctgctgcgcgccttctatgaatggctgctggacaaccagctgacgccgcacctggtggtggatgtgacgttgccgggtgtgcaagttccgatggaatacgcgcgcgacgggcaaatcgtgttgaacattgctccgcgtgcggtcggaaatcttgagctgtccaacgacgaagtgagcttcaatgcccgcttcggcggtgtaccgcgtcaggtttctgtgccactggcagccgtactggcggtctatgcacgtgaaaacggtgcgggtacgatgtttgagccggaagcggcatatgatgaagacgtcgccagcctcaacgatgaagacggttctaccggtagcgaaagcgaaacggtcatgtctgttatcgatggcgataagcccgatcacgacaatgataacgatccggatgacgatccgccgccgcgcggtggccgtccagcgttacgtgttgtgaaataa

SEQ ID NO: 508 - DNA, 498 bp, Shigella boydii CDC 3083 94
atggatttgtcacagctaacaccacgtcgtccctatctgctgcgtgcattctatgagtggttgctggataaccagctcacgccgcacctggtggtggatgtgacgctccctggcgtgcaggttcctatggaatatgcgcgtgacgggcaaatcgtactcaacattgcgccgcgtgctgtcggcaatctggaactggcgaatgatgaggtgcgctttaacgcgcgctttggcggcattccgcgtcaggtttctgtgccgctggctgccgtgctggctatctacgcccgtgaaaatggcgcaggcacaatgtttgagcctgaagctgcctacgatgaagataccagcatcatgaatgatgaagaggcatcggcagacaacgaaaccgttatgtcggttattgatggcgacaagccagatcacgatgatgacactcatcctgacgatgaacctccgcagccaccacgcggtggtcgaccgacattacgcgttgtgaagtaa

SEQ ID NO: 509 - DNA, 501 bp, Salmonella enterica serovar Newport SL254
atggatttgtcacagttgacgccgcgtcgtccttatctgttgcgtgctttctacgagtggttgctggataaccagttgaccccgcatctggtggtggatgtgatgctgcctggcgtgcatgtccctatggaatatgcgcgcgatgggcaaatcgtcctcaatattgcgccgcgagcggtaggtaatctggagctgtctaatgatgaagtgcgttttaatgcgcgcttcggcggcgttccccgtcaggtttctgtgcctttggctgcggtgctggcgatttacgcccgtgaaaatggcgcaggcaccatgtttgagcctgaagccgcctatgatgaagacgttgtcagcttaaatgatgatgacaataccgcaggcgcggaaagcgagaccgtgatgtccgtcattgatggtgataagcccgaccacgatgacgacagtagtcctgatgacgagccgcctccgccgcgtggcggacgtccggcgctgcgtgtagtaaaataa

SEQ ID NO: 510 - DNA, 501 bp, Salmonella enterica serovar Heidelberg SL476
atggatttgtcacagttgacgccgcgtcgtccctatctgttgcgtgctttctacgagtggttgctggataaccagttgactccgcatctggtggtggatgtgatgctgcctggcgtgcatgtccctatggaatatgcgcgcgatgggcaaatcgtcctcaatattgcgccgcgggcggtaggtaatctggagctgtctaatgatgaagtgcgttttaatgcgcgcttcggcggcgttccccgtcaggtttctgtgcctttggctgcggtgctggcgatttacgcccgtgaaaacggcgcaggcaccatgtttgagcctgaagccgcctatgatgaagacgttgtcagcttaaatgatgatgacaataccgcaggcgcggaaagcgagaccgtgatgtccgtcattgatggcgataagcccgaccacgatgacgacagtagtcctgatgacgagccgcctccgccgcgtggcggacgtccggcactgcgcgtagtaaaataa

SEQ ID NO: 511 - DNA, 501 bp, Salmonella enterica serovar Schwarzengrund CVM19633
atggatttgtcacagttgacgccgcgtcgtccttatctgttgcgtgctttctacgagtggttgctggataaccagttgactccgcatctggtggtggatgtgatgctgcctggcgtgcatgtccctatggaatatgcgcgtgatgggcaaatcgtcctcaatattgcgccgcgggcggtgggtaatctggagctgtctaatgatgaagtgcgttttaatgcgcgcttcggcggcgttccccgtcaggtttctgtgcctttggctgcggtgctggcgatttacgcccgtgaaaacggcgcaggcaccatgtttgagcctgaagccgcctatgatgaagacgttgtcagcttaaatgatgatgacaataccgcaggcgcggaaagcgagaccgtgatgtccgtcattgatggcgataagcccgaccacgatgacgacagtagtcctgatgacgagccgcctccgccgcgtggcggacgtccggcgctacgcgtagtaaaataa

SEQ ID NO: 512 - DNA, 501 bp, Salmonella enterica serovar Agona SL483
atggatttgtcacagttgacgccgcgtcgtccttacctgttgcgtgctttctacgagtggttgctggataaccagttgaccccgcatctggtggtggatgtgatgctgcctggcgtgcatgtccctatggaatatgcgcgcgatgggcaaatcgtccttaatattgcgccgcgggcggtaggtaatctggagctgtctaatgatgaagtgcgttttaatgcgcgcttcggcggcgttccccgtcaggtttctgtgcctttggctgcggtgctggcgatttacgcccgtgaaaacggcgcaggcaccatgtttgagcctgaagccgcctatgatgaagacgttgtcagcttaaatgatgatgacaataccgcaggcgcggaaagcgagaccgtgatgtccgtcattgatggcgataagcccgaccacgatgacgacagtagccctgatgacgagccgcctccgccgcgtggcggacgtccggcactgcgcgtagtaaaataa

SEQ ID NO: 513 - DNA, 501 bp, Salmonella enterica serovar Dublin CT 02021853; identical to SEQ ID NO: 510

SEQ ID NO: 514 - DNA, 498 bp, Escherichia coli O157 H7 EC4115
atggatttgtcacagctaacaccacgtcgtccctatctgctgcgtgcattctatgagtggttgctggataaccagctcacgccgcacctggtggtggatgtgacgctccctggcgtgcaggttcctatggaatatgcgcgtgacgggcaaatcgtactcaacattgcgccgcgtgctgtcggcaatctggaactggcgaatgatgaggtgcgctttaacgcgcgctttggtggcattccgcgtcaggtttctgtgccgctggctgccgtgctggctatctacgcccgtgaaaatggcgcaggcacgatgtttgagcctgaagctgcctacgatgaagataccagcatcatgaatgatgaagaggcatcggcagacaacgaaaccgttatgtcggttattgatggcgacaagccagatcacgatgatgacactcatcctgacgatgaaccaccgcagccaccacgcggtggtcgaccggcattacgcgttgtgaagtaa

SEQ ID NO: 515 - DNA, 459 bp, Pseudoalteromonas atlantica T6c
atgaaaaagtttaaacagttactcgcctacattaccagccgcaacctagtggccgacgagcaactaagttgtttcgtgacagattgcgaaatcaccctaagcggtaaaaaggtgcaagacggcgcgattatcgccgcttacatacattaccaagcggtgtatgaaatagaacgtttcggcggtgatgccaaccgagtgctaacccattttagtagctggttgtacaacaacgaccaaagcgacaccgaagaagaactagacaaagccagttttgatattgagccggttgacgatcacctagtcgacattatggccaccgtggatttttcagaatccattgaactgcaagaacaagacggcggtgaattccagtttggcgccaaattttacagcctagtgcccaacgaattcagcgtggctgaaagctttgaaattgtcggcgacataacccatggctag

SEQ ID NO: 516 - DNA, 468 bp, Shewanella sp. MR-7
atgagccaacttaacgcactgacattgcacctgctcaacaccttaaagccatacgttaagccaaacgatatcgacgcatggcaaaccgacggccaactgcacattatccaagacgacttaggcgaaggcatcaatatcgccaaatggcaacacagtgcagtgatcgctattgaacgtttaccacacaccaaatttaacccgtacaccatcttagcgattttagccgcatggctatctgacaacgactggccgcaggaagagtacggactatcagagccagccattgatatcgacattatcagcgacgatcacgcccaaatgatcatcaacatcgatttagtcgatgacttaggcattgttgaagatgagcaaggcaacatcccctatatgggcaaaaaataccgccttgaaaatatccctatcaactgggctgaacaggttgatttgattaatcggggtgagcaatga

SEQ ID NO: 517 - DNA, 465 bp, Desulfovibrio vulgaris DP4
atgcgcaagatacgtggactcatcgaccatcttctggctgtcaccggcttgccgcgtgagcaggtggaggccttcgccgacaagggcacgctcatgcccacgggccgcgacctcggccccgacggtgacgggcgggcgcaggtcgaggccggggtgtggaagtacgacgcggtcatccggttgcaacgctatgcgggcgacgggcccacgctcatggccgtggtgctcggctggctcgcggatgccgaccccgaccgcgacggcctcgtcgaccctgaactggatgtggccatcaacgacgcccacacctgcgacgtggagatcgcctgcgagttcgaagagcgccttgtcatccgcgaagacccgcaaggcccggtggccttcgacggcagacactggagcatggccctgcccgacatctccgtggcggacgccgtgtcgggcatgagggggcagcgtggctag

SEQ ID NO: 518 - DNA, 489 bp, Shewanella baltica OS155
atgagccaaaccgtcagccaactacagcaagtcaccgcatttttactcgcgagtctgacgccatacgttaaagccaacaatatcgacgcatggcaagagcgcggcacgctgatcttaagcagcgaagacctaggccaaggcggctatcaagtcgctaagtggaagcacaacgcagtgatcgcgattgagcaattcccgcacaccaaatttaacgcctataacttgctcgccatgctgccatcttttttactcgacagcggttggccgcgtgacgaacacggcttagcggatcctgaacttgatatcgaagtcgtgagtaaagaccacgccatggtgttgattgagttggaactgatcgacgacatcgacttaatccccgacgacaacggccccgtgttatttaacggcgagcgttatcgcgtgtcgctggtgcctgtggactatgccgaaagtgttgatctgcaaactcggccagagggcgcgctatga

SEQ ID NO: 519 - DNA, 453 bp, Vibrio cholerae O395
atgagagctttgagaaaacacattgaagagtgtgtaggtgatcaaatcgctcaaaggcttgaggctgaaatgacggatatctcgttgaagttattacccaaacacatgggcaatggcttcaacttaatgcagcaaaaatacagagcagagttttatttcgacagattcccgttcaagaaatacgaccctgcggtgctatttgccaatgttggcgcatggattcttgaccatgatcttgaccgagcggaaagcaatgggctgcgtgacccagatattgatgtagttcttgaagatgaaaacagtgctgaagtgctagtcatcattgaatttgaagaagatatcaaaatcatcgaatgcgaaaacggtggcatcaaatggcgtgggaaaaaatggaaaatcgctgaatacgaaatttgggtagctgaaaacctgatcgatgtggtgaacagatga

SEQ ID NO: 520 - DNA, 438 bp, Pseudomonas aeruginosa PA7
atgaacaagctgcgcgccctgaccgcgtacctgatcgaacgccgtctggtccccgccgagcagctggattcgttcgccgagcaggtgaacctggctctggtctggaagcccgaggaacgcggcctgcgcctgggcgacatgcgctatcgcgccgtcatcatcctggagcggctggcagaccaccccgcacgcctgatggcgctggtcggcagttggcttgagaacaacgaccccgaccgcgacggcctgccggatccggtgttcgacgtcgagcagatggaccgcgacctggccgacgtcgagctggccgtggagttcgtcgagccggtccacctggcagaggattccgccggcgagatcgaggcgttcggccggcgctgggcgttcgtgccgttcgatctgtggattgccgaacatggcgaggtgcgccatggctga

SEQ ID NO: 521 - DNA, 438 bp, Pseudomonas aeruginosa PA7
atgaacaagctgcgcgccctgaccgcctacctgatcgaccgccaactggtgcccgccgagcagttggacagcttcgccgaacaggtgagcctgaccctggtctggaagcctgaacgcgaaggcctgcgcctgggcgacatgcgctatcgcgcagtcgtcctcctggagcgcctggccgaccaccccgcacgcctgatggcactggtcggcagttggcttgagaacaacgaccccgaccgcgacggcctgccggatccggtgttcgacgtcgagcagatggaccgcgacctggccgacgtcgagctggccgtggagttcgtcgagccggtccacctggcagaggattccgccggcgagatcgaggcgttcggccggcgctgggcgttcgtgccgttcgatctgtggattgccgaacatggcgaggtgcgccatggctga

SEQ ID NO: 522 - DNA, 453 bp, Marinomonas MWYL1
atggttaagttgcaacaaattaccgcctttttagtcggcctagatttggtggctgcagagaacatcgattcatgggtagagaaccctcggatcgtaccgcgctgcagcatcattgatgacggccaagtgattgtctatacgcaaacttatgacgccatgttgtcgattgagcgctacccacacactcgacaccctgccgaactgctgttcgctcaggtgagtgtttggctaatggaaaacgacgaagaccgatttgaaaaagagctgccgatgccagccacagacgtggatattttggatagtaaaacggccgacatcgacatcatgatcacgtttgaagaagacattaccgccgtgctcgatgagaacggccctatcgtcatcgatggccagcgctatcgactggatgacgcgacgatcacttacgtgaaagaaggcgagatgaaaagctga

SEQ ID NO: 523 - DNA, 492 bp, Vibrio harveyi ATCC BAA-1116
atgagtagtgcaatttacaaccaaaccaaacttgagcacttaacggcttacatcgtcagccatctcaatagcaatgtgcttgagaacaaaatggatgcttggcaagaaaacggctcgatagtgccaagcggtgaagaccgtgggaacggcgggtatatcgcctgttactggaaatataacgcggtgatttcggttgaggagtttcctcaccaattactggacccacgctgcttactagctcttattgcttgttggctcagtgatcatgaagaagagcgcaacgagcaagagctcgaagaccccacgctttcggtcgatgtgatcagcagtgaagcggccgatgtgagtattgaacttgagttgatggagcccattgagttggtcccagatgaagccggcatgatcacttggcgtggcatgagatatcgagttcaagccgtggagatttacaccgcagaagaagcggagttggtgaatgaaaccaacaattaa

SEQ ID NO: 524 - DNA, 489 bp, Yersinia pseudotuberculosis YPIII
atgagcaaattacactcattaaccgcctttgtgcaggacaatttaccgcagcggctgcgtaagctggaatttaacagcgacatggacgcgctgcgctttattccggcgcaacgggatttaggtctggatcagtatcaactggcgttgatgcagtttgatgcggtactgagttggggccgctttccttaccgtgactatgacccgcgcaacctgtgtgcattgctgcttgtctggatgattgagaatgcgcccgaccatgggccggtgccggaattacccagtattgatatcgatgtgatagacgataaaaccgccatggtggtggtgtcgatggggattacggaatcactgagtatcgccaaagatcccgccggggatatcccctttatgggggccagatggcgactgaccgatccgcagttatggctggccactgagggcacggtatttggcgctgatacccacggcgcaccactgggtgaaagctga

SEQ ID NO: 525 - DNA, 507 bp, Salmonella enterica serovar Newport SL254
atgagccagacgcagatccaaagcctgaccgctttttttcaggagaacgttccgccgcgggcgatgcagtcatttgacagcgtactggatgaaatgaagttcatccccgccgcgaaggattacgggctggggcaatatcgtcaggcggttattcggtatgacgcagttctgagctgggcgcgttttccctatcgcctgtgtccgccgcagttacttatgtccttactggcggcgtggctggatgatgcagacagagacctgctggatgaagtcgggctgagtgaagccgaacctgactgggatgtgtcggtggaagatgaggaaaccgccactgtggtgctgaccgttccgatggtggaagaactggtgatcaggcaggacgaaaacggggctattccgtggcgtggtgaacgctggtcactggcagatcctgaaatctggacggcgttaactgccagcattttcagtgtggatgaaaccggggcgccggtgagcggggaaatatga

SEQ ID NO: 526 - DNA, 507 bp, Salmonella enterica serovar Heidelberg SL476
atgagccagacgcagatccaaagcctgaccgctttttttcaggagaacgttccgccgcgggcgatgcaatcatttgacagcgtactggatgaaatgaagttcatccccgccgcgaaggattacggactggggcaatatcgccaggcggttattcggtatgacgcagttctgagctgggcgcgttttccctatcgcctgtgtccgccgcagttacttatgtccttactggcggcgtggctggacgatgcagacagagacctgctggatgaagtcgggctgagtgaagccgaacctgactgggatgtgtcggtggaagatgaggaaaccgccactgtggtgctgaccgttccgatggtggaagaactggtgatcaggcaggacgaaaacggggctattccgtggcgtggtgaacgctggtcactggcagatcctgaaatctggacggcgttaactgccagcattttcagtgtggatgaaaccggggcgccggtgagcggggaaatatga

SEQ ID NO: 527 - DNA, 483 bp, Salmonella enterica serovar Agona SL483
atgagccagcttaccgaattaacggattttctcattgcgaacatgcccagacgggcaatgcagggatttgacagccagatggatgaaatcgcattcatcccggcacagcgtgacaccgggctggggcagtatcgcattgccatcattcgttataacgccgtgctgacgtgggagcgttatccctaccgtgagtacgatcccaaaattctgatggcgttatttatgtcgtggctttgtcaggatgagcgggcgctctttgaggaaaccggcattgatgccgaattacctgaatttgatatcgaaaccatcgaccaggaaaccgccattatggtggtgacgctgccaatggtggaggaactgaatctgatccccgatcccaaaggtcagatcccgtttgatggccagcgctggaagctggcaaaccccgaagtctggacggcggatgaggtgacggtgatccccgtcaatgagggggatggatga

SEQ ID NO: 528 - DNA, 525 bp, Aliivibrio salmonicida LFI1238
atgagtgagattcaaagtcagccacaagcaggctttatgctgcaagggcttaatcagcacctaagtaatacaacaccagagcgcttgcataaacactttgaatgttggatggaagatgtagagctgactctacaaccaaaaaatcagggacaaggttttgatatcggctacatgcaatacaccgctgtatttagctttgagaagttcccatttaaaaaagtaaatccggcaaccgtgatggttaatgtgttggcgtggctcgatgacaatgatgagttcagagaaaagtttaatttggcggagcctagttttgatgtcgaaccagaaaacgacgatacggtgatcatgacattagaggtggaattgatagagccattaatggtgattgaagatcctgatggtgaaattgtatggcgtggtaagcgttggattaatgccccgtatgagatttgggaagctgagcatatttcagtaattaacgcgaataacccaccaagtccggtgattactgatgatcaaaattaa

SEQ ID NO: 529 - DNA, 525 bp, Desulfovibrio desulfuricans ATCC 27774
atgcgcaagctggccgcccttgtcgggcacattcttgaagttacaggcctgccgccagaacaggtgtttgcctatgctgaccagggcgatctgtatcccctgggccgtgaccgtgcccccttgcgcccggaaccgggggaagatgcccccgttctgcggcaggttgagcttggcacattccgctacgacggcgtgatccagatagagcgttaccctggagccgggcacgattttgccgcccttatcaccacatggcttattgagcgcgatccggcccgtgacggccttgctgatccggctcttgatattgaactcaatatccgtggtggggactgcgatgtgcagatgaccattgaatttgaggaaaggctggaagccgtggaggatccggcgggcaacataccctttgacggtacccgctggtccctggcttccgtgaccatcacgccagcaaccacgcttacggcgcttgccgccgttaataccggggcgggccatatgccgggcaagggtgatggcagatga

SEQ ID NO: 530 - DNA, 2370 bp, Ralstonia solanacearum
atgaaaccgtcctgccgtccgggtgcggcgcttgaagcggaccgctgcccatcgttccccgatcgaagcgccgccacgccgcaccgcggtctggcgtgggccatggctgtggtcctgatcggcgggtgcgccactaccagggacatcgagcagctgcagaccaccagccagcgggagccgaccaacgcgcagctcaagctcaagtacatggatgagcgcgaccgccaggtcaaggacttgctcgacggggcggaccggctgcgcctcatccacgatttcgaccgggcccaggtcctgctcctgcaagccctgcggctggatccgggcaacgagcgcggcaggcgcatcgccgccgccatcgatgtggaccggcgcaacggcgccgtgctccaggaagcggagcggatgatggcgcgcggctcgtatgacggcgcggccgagcgcgtcgagcgcgtgctcgcggagactccgaacgatgccggcgcattgcgcctctaccgcgagatcagcgagaagcggcgcctgcaaaagcaggccgccgaagagaagaacgccgcggcgtcgatcatgcgcaagccggtgtcgctgcagttccgggatgccaacgtgcgcatggtgttcgaagcgctgtcgcgcacgacgggcctgagcgtcatcttcgatcgcgatgtgcgcgtcgatctgaagaccacgatcttcgtctcgaatgcctcgctcgaagacacggtcgacatgatcctgctgcagaaccagctcgcgaagaaggtgctcaacgccaacacggtgttcatctatccggccacgccggccaagcagcaggaataccaggacctcaaggtgcgcacgttccagctgtccaacacggatgccaagcacatcgacacgctgctgaagaatctcctgaagatcaaggagatcgtcaccgacgagcgcgccaataccgtgtcgatccgggcgacgcccgagaccatccgcgtggccgagcggatgatcgccgcgcaggatctgcccgagccggaggtgatgctggaagtcgaggtgctggaggtgtcgcgcgaccggctcaccgatctgggcatcgactggccgaacagcttctcgctcgggacgccgtcctcggcaagcacgtggggcgcgctgcatcacctgacggtcaatcagctcacggccagcgggctgtcggtgacggccaatctcaagctgaccgataccgacgcgaacctgctggcgagcccgcgcatccgcacgcgcaacaaggagaaggccaagatcctgatcggcgacaaggtgcccgtgatctcgagctccagcgtgccgagcaccagcggcccggtctattcgcagtcgatccagtacctggatgtcggcatcaagctggaggtcgagccccaggtgtaccgggacaacgatgtcggcatcaagatgagcctcgaggtcagcaacatcacccagatcatttcgagcagcaacgcgcagaccggcctgagctcgctcgcttaccagatcggcacccgcaatgcgtcgacgacgctgcggctcaaggacggcgagacccagattctcggcggcctgatccaggatgaggatcgggacgcggccaacaaggtcccggggcttgggcagttgccggtgctcgggcgcctgttctcgaaccacaacggcgaccacaagaagaccgagatcgtgctgcagatcacgccgcatatcgtgcggccgcagctggcggcggatgcggatacgcgcgagatctggtccggcaccgacagcactgtgcgcaccgagcaattgcggctcgatccgccgggcgtggccgcgcctgccacacctgctgcgcctgctgcgcctgctgcggcgcttccggcgccggccgccggggtggcggtcgtctccccgggcgccgtcggcggcggtaccacgggtggcgaacagacgcccaaggctgccgcgccggccgcggccggcggcgtggttccgcccaacggcgcgtttgggcagccgcccgccgcgccgcgcacgacgccgccgccggcaatgttcggtggccgcttcatgaccacggtgccgccgcccgaaggggttgtgccaccggcgccgccggcaccggcagccgcgcctgcggcggtggcagcgccggcagcggcggcaccagcagcaccggcggctggcacggccgggcccgaggcagcggcagcggtcagcccgaccgaggccgcaccgcccgcacccgcgccggcagcgccatacacgccagcgcccgccgcgcccgccgccgcgccgccagcggcatcgccgccgccgatcgtgccgacgccgccgagcgacatgccgagcgataacccgttgcatccgatcccgacgggggcgtactga

SEQ ID NO: 531 - DNA, 2265 bp, Ralstonia solanacearum
atgaacaccggacaggcattgattcgcacgcttctcgtcgcctgcatggccgtgtcagtcgccggttgcggcgaattgccgccctatcgcgaaggtgaagcgctgagcgccgaaggcaagaacgaagccagtctcgaacgattcgagaccgccgccaaggcccaaccgaccaacgcgcgctatcgtgcggcctatctgcaggcaagggacaggaccgtcaacggttggctggacgaagcggaacggctgcgtcagaccggcaagcccgacgcggcgcgcaagatgtacgaacgtgtcctggcgcttgcgccggaaaacgcgcgagcgcgggcgggccttgagcaaggggagcgtgaccggcggcacgccaacctggtgcaacaggccgaggatgccctcaagaaaggcgagcgcgatacggcactggccaagctgcacctcgccctggcagaaaaccagcaattcaggccggcactggcccttcagcagcggatcgaacaacccaccggagacagcccggagcgcgcattgtcggcggcgttccgcaagccgatcagcctcgaattccgcgacgcgcagatgcggcaggtgttcgaggtgctgtctcgtgcgtcgggcctgaacttcgtgttcgacaaggatgtccgcaccgatcagaaggtgacggtattcctgcgcaacagtacggtcgccaacgtcgtcaacacggtgctcctgacgaatcagctcgaacagcgggtgctggacggcaactcgatcctgatctatcccaacacaccggccaagcagcgcgactaccagccgctgaccgtgcgcacgttcgtgctgagcaatagcgacgcgaaggatgtcgccaataccgtcaagacgatcctgaagacgcgcgacattgtcgtcgacgaaaagcgcaacatgatcgtgatgcgggatacccccgatgccatccaggcagccgaaaagctggtcgccgtgcacgagatgccggaaccggaggtgatgctggaggtggagattctcgaggtcaagcgttcgcgcctgcaggacctgggtatccagttgccgagccagctgtcgctgacgccgctggccagcagctccggcggcaccttgacacttgacgacctgagacacctgaatcccacgcgtatcggcgcaacggtcagccccttgaacgtcaatgtcaacgcggctgtcaccgacaccaatgtcctggcgaatccgcgtgtacggacccggaacaaggaaaaggcacgcatccaggtcggccagcgtgtgccgaatgtcaccaccacgtcaactgccacgggctttgttgccgaaaacgtccaatacgtcgacgtcggcctaaagctggaagtggaaccaacggtcacgccggacaacgaggtcaccatccgcatcaatctggaggtcagcgacatcatctcgcaggtgcagaccaagagcggttccattgcctacgagatcggaacacgaaacgccacgacactgctccggctcaaggatggcgaaaaccagatactggcgggtctgatccaggatgaagaccgggtctcgggcaatcgtgtccccggcctgggcgacatccccgcgctgggcagactgttcggcgcccagagcgacaacaagctcaaatcggagatcgtcctgtcgatcacgccccgcgtcatccgccctgcgcagcggccgaacctgggctctgccgagttcgacagcggtaccgaatcgagcttgcggctcacgtcgccgatgctgcgcgagcggggtgcgccggtaccaagccctgttgcgccagccgccgcccccacgccgtcaaccgacgcctccagtacgccgccacaaccggtagccgccgcaggcggcgggtccgcgctgacgatccaaggcccatcgtccgtgcccgccggctcaaccttcgatgtcctggtcaacgtccagcccgaacgcccattcaccagccttccgctcaccctgcagtacaacccggcccaactgcagatcatctcggtcacccccggcagcctggtatccgcgaacgaggtcttcgcaaacaacatcgatgcggccaaagggctggtctatatgacgatgaatgccaagcaaacgcagggcaaggacggtgcggggaatgtggtgcgcctcaccttcaaggcactggccgcgggcgagacgagcatccacatgcaggatcagatgctgatcaccccctccgggatggcgagcctgaagccgacggcaccgttggtcatgactgttcaaccatga

SEQ ID NO: 532 - DNA, 2004 bp, Thiobacillus denitrificans ATCC 25259
ttgaaaacgaagcacgtcgttgtgagtcttgtctgtgttctgggcctttcgggctgcgctgccgaccgcgccttcacccgcggcaagggcatgctggagcagggccagaccgaagccggtctgcgcgaggtcgaaaaggccgcgcgcatcgcccccgagaacaaggaataccggatctacctcgcgcgccagcgcgagggctcgatcaacacgctgctcggtgaggccgagcaggcgcggcggaccgggcgcctcgacgccgccgagcaggccttccgtcgcgccctcgcgctcgatgcggaaaaccgtcgggcggcggacggcctcgaggccgtggcgaccgcgcggaagcatcgcgtgctgctcgccgaagccgagacgctggccgtgcagggcaatctcgcagccgcggcgacgaagctcgacaccgtgctcgccgaggacccgcgcagtgccgagggccgcgcgctgaagacgcgactcgccgcgctgaaggccgagaagcggtcggaactgccgggcttgcgctcgctcttcgagaagccgatcacgctcgaattccgcaacgccgacctcaaggcgatcttcgaagtcatctcgcgcagcgccgggatcaatttcattttcgacaaggacgtccgccaggacctcgtcgcgagcatcttcgtcaggaacacgcgcatcgagagcgcgatcgacttcctgctcatgagcaaccagctcgcgaagaaggtgctcaacgagaacacggttctggtctacccgaacatcccggcgaagacccgcgactaccaggatcttcgggccaagaccttctatctcgcgagcatggacgccaagcaggcgctcaacatcgtcaagaccatcgtcaagacccgcgacgtcgtcatcgacgagaagctcaacacgctcgtgatgcgcgatacccccgacgcgatccggctcgccgaaaaactgctcggaagccaggacctcgcggaatccgaggtgctgctcgaggtcgaagtgctcgaggtcagccgcagccgcctgagcgacatcggcatcacgccgccgaccgaggcgacgttccgcacgctcggtccttcgggcgcgccgagcacgacgctcgccgatctcaaagggctcaactccgggctgatcggggtgtcgtcgctgagcgcgagcgtgcgcgcgcgcatggacaacggcgataccaacctgctcgcgaacccgcgcatccgcgtcaagaaccgcgagaaggccaaggtgcacatcggcgagcgcgtgccgatcatcacgaccacggtgacctcggccggcacgacgagctttttgcccgagacggtcaactatctcgacgtcggcatcaagttcgaggtcgagccgctcatttcgctgaacgacgaggtgacgatcaaggtcgcgctcgaggtgagcagcctcggacagaagagcgtgaccaagagcggcagcgaggtctaccgggtcggcacgcgcaacgcgtcgacgacgctcgcgctgcgcgatggcgaaacgcaggcgctggctggtctcatcagcgacgaggagcgcgagacggtcaacgggattcccggcttcggccgcatcccggcgatcggccggctgttcgcgagcaagagcaacagcaccgacaagacggagatcgtcctcctcatcacgccgcacatcgtgcgcaatctcgaccgcacggcgctcaccgcgtccgacttcgcggccggcaccgattcggcagccggcagcgcgccggtgacgctgcaggcgatcacgcccgaagtcatgcgcgcggtcgaggaaggcacggcaggcgcgccgggcgcggcgcccgcggcgccggcggacgcacccgcaggcggccaggcgccagccggggtggagatcggacgcgaaccggcggccgagggcggcgacgccgcgggcgaaccggccgcagcgcaggacgccgaaccggggaacgcagcgcccgagccctccgccgacggcgacgcacaggaagggtcctag

SEQ ID NO: 533 - DNA, 1971 bp, Thiobacillus denitrificans ATCC 25259
ttgtccttccatccgtcgcccttgctcaccgcgctggtcgcgttcagcctgaccgcgtgcgcaggcaccggtctcaaggagggccgcaagctgatcgacgccgggcagcccgaggccgggatcgcgcgcctgcgcaccgccctggccgaagaacccgacaacatcaagctcaaggcctactaccatacgcagcgcgagcgcatcgccagcgaactattggtgcgggcgcaacaggatgtccacgccgcacgcttcgacgcggccgaaaccaagctcgacagcgtgctcgaaatgcatccggaaaatccgcgcgcgctcgccctgcgcgccaatctcgagacggcgcgccgccacgaagcggccttgcagcaggcgaacaaggcgctcgccgcgggtaaggtcgacgcggccgcgcaggctgcgcgcgagatcctcgcgcaggcgccggggcatgccggcgcgcttgccctgctgcggcagacccaggccgcgcacgcgcccgacgaactcgcgatgcgccggctcggcccggcctttcacaaaccgatcacgctggaatttcgcgacgcgccgctgcgcaacgtcttcgacatgatcgcccgccagtccggcctcaacttcgttttcgacaaggatgtccgtctcgacaccaaggccacgctgttcgcgcgcaacacgccgatcgacgaggccgtcgacatgctcctgatgaccgggcagctgtcgaaaaaggtggtcaacgccaacacgctgttgatttatcccgaccagccgcagaagcagaaggcctaccaggagctgatggtgaaaagcttctacctcggcaacgccgacgccaaggcgacgatggcaatgctgcgcacgctggtcaaggcgaaggacctgcacgtcgacgaacggctcaacctgctggtcatgcgcgacacgcccgatgcgatccgtctcgccgagcgcatcgtcgccgtgcaggacctggccgagcccgaggtcatgctcgaggtcgaggtgctcgaagtgaagcgcgggcgcctgctcgacctcggcatccagtacccgaccaatttcagcctgctcaacctgccgccggcgacgagttcgaccatcggccccggcggggtcgtcaccaatacgaccccgccgccatcggtgctgaccgtcgagagcctgaagaacatcacggcgagccagatcgcgatcagcccgacgcccggcgtcgacctcagaaagcaggacagcgacgtcaacatcctcgccaatccgcgcatccgcgtgaagaaccgcgaaaaggccaagatccacatcggcgacaaggtgccggtgatcacgtccaacacgacgtcgaccggcgtcgtctccgaatcggtgtcgtatctcgacgtcggcctcaagctcgacgtcgaaccgagcgtgctgatgcgcgaggacgtgcagatccgcgtcggcctcgaggtttccaacatcgtgcgcgagatccgcagcggcaacggcacgctgacctaccagatcgggacgcgcaacgccggcacgacgctgcgcctgaaggacggcgagacccaggtgctcgccggcctgatctcggacgaggaccgcagcacggcgagccgcattcccgggctcggcgatctgccgctgatcggccgcctgttttcgagccagcgcgacgagcgcaacaagaccgaaatcgtgcttctgatcacgccgcgggtgctgcgcagcgacgcgacgcggctgcccgcactgaccgaattccggggcggcaccgagaacgcgatcggcggcggcggcgccgtgccgttcagcgcgccggccctgcccgaagcgtcgcagccgccgctgcccgacgaaggcccgacctcgccgtcggcgattgcacccgcgcccgagtcggagatcccgccggcgcccgacacgttcgggacgccgagcgtgcctgtcccacagattcccgcaccgccggacgcggccgattga

SEQ ID NO: 534 - DNA, 2250 bp, Nitrosospira multiformis ATCC 25196
atgaaaactggcaaacacgttctgcttgccctggttcttgccggaattgcaggatgcgcgacaaacaatgcgttcgtggagggcaagcggctcatagccgagggcaagctcgacactgggcttgccagtctcgaacaggcggcgcgcgaaaatccggataatcttgaaattcgcgcggtgctcgcgcgccagcgcgaagcgatagccgcgcgtttcgtattcgaggcggaagccgcaaggtcgacaggtgatctggaagcggctgaacggagttttcgccgggcgcttgaaataaatccacgtcatgaacgcgcactcgccgggttggaggcgatcaatatggatcgccgccatacagcggcaataaaacgagcggaagaattgctggagcggggggagtatgcagctgcttcaagcgaggtccgctccgtgctgcaggaaaatccgatgcagcgggatgcacgcaggctcattcagcgcatcaccgaaatggaagtgcaagccgcgcaagcgggccctatcctgaaaaccgcgtttaaaaaacctatcacgctcgagtttcgagatacgggcctgaaatcggtattcgaaatcctggcgcgcaccggcggcatcaacgtggtctttgacaaggacgtcaagcaggacagcaagacgacgattttcgtgcgcgagaccaatatcgaggatgtattcaagctccttctggtgacgaaccagctcgcacacaaggtcctcaacgaaaattcggtgctgatctatccgaatactccggccaagcagaaggaataccaggaattgatggtgcgcagtttctttgtcacgaataccgatgtgaagcagatggtcgcgatggtcaaggggttgatcaaaaccaaggacatgcacgtcgacgaaaagctgaacctgttcgtcatgaaagacacgccggaggcgatccggctggccgagcggctggttacgctgaatgatctggccgatcccgaagtcatgctggaagtggaggtgctggaaatcgggcgcaacaaactgctcaacctcggattgcagtatcctgagaagatcaatgtaaattatcttaccgcagccagtgctgccggcgcggctccttttccgccctttcagatcagccgtgcaggggttaacggcaatggttccaatctcgacaacctgattggattcgttgccaatcccgccctgatcgtcaacctcaagcagcaggacgggctgatcaatgtgcttgccaatccgcgcattcgcgtcaagaaccgggagaaagcgaaggtcctgatcggcgacaaggttccagtcgtcacgacgaccgcagccgccaacgtgggtgtggcatcatcggtcagctacctcgatgtgggactcaagctggacgtcgaatccaccatctcgctgcaggatgaggtttccatgaaggtcagcctggaagtgagcaatatcgtcaaggaagtgccggtaacgggagggggccttgcctatcaggtagggacgcgcacggcagcgaccacgctggcgttgaaggatggcgaaacccaggttctggcaggattgatcagcgatgacgagcgcaccacgctttccaaggttcccgggctggcagagttgccgtggatcggaaagcttttcatcaataagaacgttgtccgaaacaagactgaaatcgcgctgctgattacgccgcgtatcgtgcgcaatattgcccgtccggcgaaagcggtcagcgaagtgcccttcggtacggagaatgcgatagcggtttcgccgctgatgatcggcaaagtggcgccgcgggcgctggcgatggcttcttcctctccaacctccgatgctaacgccagccggcagtggccatccgcgccttccagggaggaaacccgtccgccggcgccgcccgagggggcaccggttgcgacactggctgcgccggaacaggtgtccgcaggacaggaatttgtggtgagcgtgaccctcgccggtgcagatgcactcccgcccgcggaactggatctgaattatgaccctgtggcgcttgaaccggtggacgagggtgataaatccggaacacgcgtattgaaactgagcaaggggggcggcgccgcggatgtgcgattcaggattttggcgcaaaagcctgtcacgactcagatcagtatcgggaatatcagtttcaaggacgaaagcgggccgcttcccgttccggtgcctttgccaccggctgtcaatgtggatattcgttga

SEQ ID NO: 535 - DNA, 1962 bp, Methylobacillus flagellatus KT
ttgaacaccacatcgcacgcaagcctgaaattcagcgcggtatttatcgcgatcatgctcgccgcctgctccggcacggaaatgcggcagaaccagaccaacctggagttccagcaagccagggacatgatcaacgccggacaggtcgaggccgggatagagcggctcaagagcctggtgcgcaccttccccgacaatccggaataccgcaactacctcaagcagcagcaggacattcagcttgccatcctgctcaaggaggcggaccagctcaagcggcaaaaacgctggggcgaagccgacatcgcctaccggcgcgtgctcgagctcgacagccagaaccagcgtgcgcagaacggcatccagcagatgcgcatcgccaccacgcacgacgccatgatgcagcgcgccgacgaactgctcgccaagcaggactgggaaggcgcgcagaacctggcgcgcacggtattggcggaagattccagcaaccgcagcgcgcgcgccctgttcgagcagatcgagcagaaacgcatggacaaggtggtgaacccgcctcacatccgctcttccttcaagcgtcccatttcgttggaattcaaggatatcaccatcaagtcagtgttcgagttcatctcgcaggccgccgcgatcaacttcacctacgaccaggaactgcgcagcgaccagcgcaccagcgttttcctgcgcaacacgccgatcgaggaagccattgatgtcatcctcgcgagcaaccagctcggcaagaaagtgctcaatgacaacaccctgctgatctaccccttgagccgcagccaggaataccaggaaaccttcgtgcgcagcttctacctgagcaacaccgatgccaagaagctcatggccatgatcaagaccgtggtgaagaccaaggacatctatatcgacgagaaactcaacaccttggtgatgcgggatacgccggaagcgatccgcaccgcggagaagctcatcatgtcgcaagacatggccgagccggaagtcatgctcgaggtcgaggtgctggaaatcaaccgccgcagcctggagaacatcggcatccgctatcccaccaatgtcagcctcgacgtgcagggtcgcgataccgtcaacggcaccaccacgctcacgccaggcaagctcaccatcaacgagctcaagaacttcaattccaacctcggcgtcttcagcatcagcgacccagtgctggcactgaacctgctgcagcaggacaccgacaccaacctgctggccaatccgcatatccgcgtcaagaaccgcgaaaaggccaagatccacgtcggcgatcgcatcccggtgcttaccagcgtcgccaactccaccggctttatatcgcagacggtgaactacatcgaggtaggggtcaaactcgacgtcgagcccaccatcctgctgcgcgatgaggtatcgatcaagattggactggaagtcagcaaccagaccgaccgcatggagacgagttccggcaccgtcacctataccataggcacccgcaatgccagcaccatcctgcgattgaaggatggagaaacacaaatccttgcgggcctgatgcgcaacgacgaacagaagatcacaaacggcgtgccggggctttccaaactgccactgatcggcaaactgttcaacaacaataacaacgacctaagcaagaaagagatcgccctgtttatcacgccacgcatcatcagcaacctcaccccggaaaatgccatctacacaaccttcccggccgggatagaccgcagcgcatctaggccgggccgggccgcggaaccaggcaccgtcaccgcgcaagccgcacctgctacaccggtcaagaccccgcaggaaatccaggccgaacgcgccgagtcggaccgttcctttgccggatcggtcatgcgtccggtggaagacattgcgagcccggatgagcaacaatga

SEQ ID NO: 536 - DNA, 2205 bp, Cupriavidus metallidurans CH34 uid250
atgcatacctcacgtgggcccaggctgatccgggcgagatgcaaagcgcagcccatctgcatcggcgtcatcctgttgggaacctgccttgccggttgctcgcccatgtaccagcgattcccgccggacccgagcaccaatgcagagcagatcgtcggcgcgctgcgcgagcgggacaggcaggtcaatgcactgctcgaggaggcggagcgactacgcgcggcaggccagtaccaggacgccgttccgctgcttggcgcggcgaaccagctggaccccaccaacgagcgcgcgcgcattcttggcgcggcgctgcagcgtgactggcgcgacgcggccatcctgcaggaagcggagcgtatgttcgatcgtggctcctacgatattgcagcggagcgcgtccgctacgtgcttgccgagaatccgaacagcattgccggcagacaactggcccagcgtatcgaggagcaacgccgtctgctgcggcttgcgcgtgaggaacagcgcgcggcggggtccatcatgcgcacgccggtgaccctgcagttccgcgatgccaacatccgcatggtgttcgaagcactatcccgtacctccggtctcaatgtcatcttcgaccgggatgtgcgtgccgatctcaagaccacgattttcgtgaccaatgcggcaatcgaggacgcggtggatctgatcctgctgcaaagccagctcgacaagaaggtgctgaacgccaacacgctgttcatctacccagccacgcccgccaagcagcaggagtatcaggagctcaaggtccgcacattccagctgtcgaatgtcgactccaagcaggtccagtcgctgctgaagagtctgctgaagatcaaggaagtcgtggtcgacgaacgcgcgaacaccgtgaccattcgcggtacgccagacacgattcgcgtggcggagcagatgatcgccgcgcaggacctgccggagccggaagtcatgctcgaagtccaggttctggaggtgtcgcgcgagcgtctgaccgaccttggcatcgcatggccaaattcgttcacgatggccacaccagcctctgcgacgacatggggcgtgctgcaccacctgaccgccaacgagcttgaagtgagtccgttgtcggcgacagccaacttcaagctgaccgataccgatgccaatctgctcgccagcccgcggattcgtacgcgaaacaaggagaaggcaaggatcctgattggcgacaaggtgccggtgatctccagttccagcacgcccagcacgagcggaccatcgttcacccagacgatccagtatctggatgtcggcatcaagctggaagtggagccccaggtgtatcgcgacaacgacgtgggcatcaaactggccctggaggtcagcaatatcaccaagacgatccagagcggcaacgcgcagacgggcctgagttcgctggcttaccagattggcacgcgcagcgcgtccacgagcctgcgactgcgggacggcgaaacgcagatactcggcgggctgatctcggatcaggatcggacgtctgccgacaaggtgcccgggctggggcagttgccggtggttgggaggctgttctccgaccacaatggtgaccacgtcaagaccgagatcgtgctgcagatcacgccgcatatcgtacgcccgcaactgacgatggatagcgacacgcgcgagctctggtccggcaccgataccaatgtccgcaccgaacaattgcggctggacccgagccgtcccgtcgcatcgacggcatccggcgcgcctgcgttgccctatacgccggtcaagcctggacaggtaggtggcggaaccatggggccgccaccggccgcaagcggcagcgctgcagcaacgccaaagagtgcattcgggcagcctccgccgccgatgcggaccacgccgccaccggctccctataacggtcgcttctcgggcacgcctgcggtgccgcaggggcaggcagcgccagccggcacagccgagccggcgccgccaccacccgtgccggcgtctggcaacgccgacggctcggccgaaaatacggcgccgccgccagcgccacgtggtccggtgcaggtggagctgattccaccgacgccgcccgcgccaatgccccggcagccgacggacatccccagcgacaatccgctgtactcgatccccggcggcagcccctga

SEQ ID NO: 537 - DNA, 1866 bp, Pseudomonas putida F1
atgaagtcgtcaaagctgtgcaagcctgctccgtttctgctcgtggcgctgtgcgtggccattgccggttgcggctccagtgcggttcgccaggacagcgaccagttgatgaaagagggccagtacgaggccggcatcgcccgcctggaagaggccctgcgcgacgacccgcgtgacacagagctgaatatcgccctggcccacagccgccaggcggcagtcgaggccctgattagccaggccgacagcgaccgcgtccgccatgacttcgccaatgcccgcatgggctatggccgggtgctcaccctggagccgaacaaccgccgcgcccaggatggcattcgccagctggagctgatccgcaccctggacgatcgcgtagcgcttggccaggcggcgctgcgccagggcgacctgttcggtgccgaacgttacatgcgcgaagtcttgcgtctggacccgcagaaccagaagggcataaccctgcgcagcgacatcgaaaacgtgcaggcacgcaccgcgcagccgtacccgcaattgcgcagcaagctcgagcggccggtcaccctggagtttcgcgatgccaacctgaagaccatcttcgaagtgctgtcgcaggtggccggcatcaacttcatcttcgacaaggacctgcgcccggacatgaaagccaccatcttcgtgcgcgaggtgcgcatcgaggacgcgatagcgctgctgctggaacaaaaccagctgcgccagaagatcgtcaacgacaacaccgtcatggtctaccccgattcgccgcagaagaccaaggactaccaggaactggtcatgcgtacgttctacctgaccagcatcgacgccaataccgcgttgaacatggtcaagaccatgctcaagacccgcgacgtgttcgttgacgagcgcctcaacaccctgaccatgcgcgacacgtcggacgcggtgcgcatggccgagaagctgctgcagtcgcaggaccagtccaaccccgaggtggtgctggaagtggaggtgatggaggtggccacctcgcgcatcctcgaccttggcctgcaatggccgaacaccttcggcgtgctgagcgacgatggcaacccggtcagcgtgctcgaccagctcaagggcatcagttccagccgcatcagcattgcgccggcgccgcaggccaagatcaacgcccaggacaaggacatcaacaccctggccagcccggtgatccgcgtcagcaaccgcgagcaagcgcgcatccacatcggccagcgggtaccgatcatcagcgccacctcggtgccatcgacccaagggccggtcattaccgagagcgtcacctacctggacgtcggcctgaagcttgaagtgcagcccaccgtgcacctgaacaacgaagtggcgatcaaggtggcgctcgaggtcagcaacgccaccccgctggaggccacccgccagggcaccatcccggtccaggtcgacacccgcaacgcgcagaccagcctgcgcctgcatgacggcgaaacccaggtgctggccggcctggtgcgcaacgaccacaacgccagtggcaacaagattcccggccttggcgatatcccgggcctgggccggctgttcggcagcaacaaggacgacatgagcaagagtgagctggtgctggcgatcaccccgcgcatcgtacgtaacctgccgtaccagagcccgtcggacatggagttttccacgggcaccgagtcggccatgcaggtgcgccagatggcgccactgccgccgatggacgtacccggtaatgcgccgaccaccgatgaaccggtcgtggacagccagatggcggtcgccccggtcaacgggagcccacggccatga

SEQ ID NO: 538 - DNA, 1866 bp, Pseudomonas putida GB 1
atgaagtcgtcgaagctgtgcaagcctgctccgttcctgctcgtagcgctgtgcgtggccattgccggctgcggtaccagcgcggtacgcaaggacagcgaccagttgatgaaagagggccagtacgaggccggcattgcccgcctggaagaagccctgcgcgatgacccacgcgacaccgagctgaacatcgccctggcccacagccgtcaggcggcagtcgaggcgctgatcacccaggccgacgccgaccgtatccgccacgacttcgccaatgcccgcatgggctatggccgagtgctgaccctggagccgaacaaccgccgcgcccaggaaggcatccgccagctggaactgatccgcaccctcgacgagcgcgtggcgcttggccaagccgcgctgcgccagggcgacctgttcggcgccgagcgctacatgcgcgaagtgctgcgcctggacccgcagaaccagaagggcatgaccctgcgcagcgacatcgaaaacgtccaggcgcgcacagcacagccatacccgcagttgcgcagcaagctggagcggccggtgaccctggagtttcgcgatgccaacctgaagaccatcttcgaggtgctgtcgcaggtcgccggcatcaacttcattttcgacaaggacctgcgcccggacatgaaagccaccatcttcgtgcgtgaagtgcgcatcgaagacgccgtggccctgctgctggagcagaaccagctgcgccagaagatcgtcaacgacaacaccgtgatggtctaccccgactcgccgcagaagaccaaggactaccaggaactggtcatgcgcacgttctacctgaccagcatcgacgccaacaccgcgctgaacatggtcaagaccatgctcaagacccgcgacgtgttcgtcgacgagcgcctcaataccctgaccatgcgcgacaccccggatgccgtgcgcatggccgagaagctgctgcaatcgcaggaccagtccaaccccgaggtggtgctggaagtggaggtgatggaagtggccacctcgcgcatcctcgacctcggcctgcaatggcccaacaccttcggcgtgctgagcaacgacggcaaaccggtcagcgtgctcgaccagctcaagggcatcgactccagccgcatcagcatctcgccggcgccgcaggccaagatcaacgcttcggacaaggacatcaacaccctggccagcccggtgatccgcgtcagtaaccgcgagcaggcacgcatccacatcggccagcgggtgccgatcatcagcgccacctcggtgccgtccacccagggcccggtgatcaccgaaagcgtcacctacctggacgtcggtttgaagcttgaagtacagcccaccgtgcacttgaacaacgaagtggcgatcaaggtggcgctggaagtgagcaacgccacaccgttggaagccacccgccagggcaccattccggttcaggtcgacacccgcaacgcgcaaaccagcctgcgcctgcacgatggcgaaacccaggtgttggccggcctggtgcgcaacgaccacaacgccagcggcaacaaaatccccgggcttggcgacatccccggcctgggccggctgttcggcagcaacaaggacgacatgagcaagagcgagctggtgctggcgatcaccccgcgcatcgtgcgcaacctgccgtaccagagcccgtcggacatggaattctccaccggcaccgagtcggccatgcaggtacgccagatggccccgctgccaccaatggacgtgcctggcaatgcgccaaccaccgacgcaccggtcgtggacagccaaatggcggtcgccccggtcaacgggagcccacggccatga

SEQ ID NO: 539 - DNA, 1878 bp, Pseudomonas putida W619
atgaagccatcgaagttgtgcaagcctgctccgttcatgctgctggcgctctgcgtggccattgccggctgcggttcgagcgcggtgcgcaaggacagccaggcgctgatgaaagaaggccagtacgaggccggtatcgctcgcctggaagaggcgctgcgcgacgacccgcgtgacaccgacctgaacattgcgttggcccaaggccggcagcaggcggtcgaggcgctgctgagccaggccgacagcgaccgcatccgccacgacttcgccggtgcgcgcctaggttacggccgcgtgctcaccctggaaccgaacaaccgccgcgcgcatgagggcatccgccagctggaactgatgcgcaccctcgatgaccgtgttgcgctgggccaggctgcgctgcgccagggcgacctgttcggtgccgagcgttacatgcgcgaagtgctgcgcctggacccgcaaaaccagaagggcatcatgctgcgcagcgatatcgagaacgtccaggcccgtacggcacagcccttcccgcaactgcgcagcaagctggagcgcccggtgaccctggagtttcgcgatgccgagctcaaggtcattttcgaagtgctgtcccaggtggccggcatcaacttcattttcgacaaggacctgcgcccggacatgaaggccaccatcttcgtgcgcgaggtgcgcatcgaggatgccatagccctgttgctggaacagaaccagttgcgccagaagatcgtcaacgacaacaccttgctggtctaccccgactcgccgcagaagaccaaggactaccaggaactggtcatgcgcacgttctacctgaccagcatcgatgccaacaccgcactgaacatggtcaagaccatgctcaagacccgcgatgtattcgttgatgagcgcctcaataccctgaccatgcgcgacaccccagacgccgtgcgcatggccgagaagctgctgcagtcgcaggaccagtccaaccccgaggtggtgctggaagtggaggtgatggaggtggcccgctcgcgcatcctcgaccttggcctgcaatggcccaataccttcggggtgctgagcgatgagggcaacccggtcagcgtgctggaccagttgcgcggcatcaactccgggcgtatcagcatctcgccggcgccccaggccaagatcaacgcccaggacaaggacatcaacaccctggccagtccggtgatacgcgtcagcaaccgcgagcaagcgcgcatccacatcggccagcgtgtgccgatcatcagcgccacctcggtaccttccacccaagggccggtgatcaccgaaagcgtcacctacctggatgtcggtctgaagcttgaagtgcagcctaccgtgcacctgaacaacgaggtggcgatcaaggtagcgcttgaggtcagcaacgccaccccgctggagccaacccgccagggcaccatcccggtccaggtcgacacccgcaatgcccagaccagcctgcgcctgcacgacggcgaaacccaggtgctggcggggctggtgcgcaacgacaagacctctagcggcaacaagatcccgggcctgggcgacatccctggcctgggccggctgttcggcagcaaccgcgatgacatgagcaagtccgaactggtactggcgatcaccccgcggatcgtacgcaacctgccttaccagagcccctcggacatggagttcgccaccggtaccgaatcgagcatgcaggtgcgccaactggccctgcctttgccagccggcgcgctgccggccgatgagccgggccaggcgcctgacgatgcaccggttgtcgacagccagatggcggtggtgcctgccggcaagggcccacggccatga

SEQ ID NO: 540 - DNA, 2283 bp, Leptothrix cholodnii SP 6
gtgacacgcaccctgccgaggatctggctcgccctggcgatgctgtgcggcgccggctgctcgacgccgcagccgccggacttccaggcccagctcgagcagggccagcacaaggaagcgctggtccgctacgaagaggccatgaacgcccgccccggcgaccccgaacggcggctgcagtacttccgggcacgcgaccaggtcatcaaccgcctgctcgcgctgggcagcgccgagttcggcgccggccagctcgaacccgccgcgcgggcttggggcgaagcgctcggcatcgaccccaagaacacccgcgccgccaacggcctggccacgatcgaggcggcgcggcgccaccagctgctcgccggcgacgcccgcgcccggctcgccgcgggcgacagcgccggcgccgacctgatggtcaaggccatcctgaccgagaaccccggccaccccgccgcccgcgaactcgaccgcgcgctgcgcgagcaggagcgcaggaagtcgctggcggtgccggtgctgaagtcgcggctgcagaagcccgtcacgctcgaattccgcgacgcgccgctcaagctggtgctggaggcgctggcgcgttcggccggcatcaacttcatcatggaccgcgaggtccggcccgacctcaaggcctcgatcttcgtgcgcgacgtgcgggtcgaggatgcgctcgacctgctgatccacaaccaccagctcgagaagaagatcctcaccgacaacaccgtgctggtctacccgaacacgccgcagaagctgcgcgagcaccaggagctggtgatgcgcaccttccacatcggcaacgccgacccgaagcagacgctcaacctgctgcgcaccatgctcaaggtgcgcgacgtgttcatcgacgagcgggtcaacctgctgttcctgcgcgacacgcccgacgtcatccgcgccgccgaacggctgatcgccgcgcaggacaaggccgacccggaggtcgtgctggagctggagatcctggaggtctcgcgcaccaaggtgcgcgacctcggcatcacctacccgagcgagttcgccgggccgggttcgagcggcgccaagctgttcgagatcggcgagctcaaccgccgcaccatcggcgtcgacaccggctacaagctcaagctgctgcgcaccgacggcgacaccaagaccctggccaatccgcgggtgcgggtgcgcaaccgcgagaaggcgcgcgtgcacgtgggcgaccgggtgccggtgatatcgagcaccatcgtcggcaccaccaatctgggttcgaacaacacgccggtcacgaccgagcagatccagtacctcgacgtcggcatcaagatcgaggccgagccgaccatctacgccgacgacagcgtggcgatcagcatcaacctcgacgtctcgtcgctgggcaaccagacccgcaccaacgccggcaccaccgcctacgaggtcggcacgcgcaacgccagcaccgtgctgcggctgcgcgacggcgagacccaggcgctgatgggcctgatccgcgacgacgacgtgcagaccggcgccggcctgccctacctcggcgagttcccggtgctcgaccgcatcttcggcagcaagcgcaccgaccggcgcagccgcgagctggtgctgctgatcacgccgcagctggtgcgcggcatcgagccggccgacgccacgctggccgagttctggtcgggcaccgaggcggcggtgcgcacccgctcgcccttcatcgaaccgatgaccccggtggcgctggggccggccaccgccaccgccaccgccaccgccagcaccgcgccgacgctcacgctcggcgaggtggcgccggccgccgtgccgctgccgctgaacctgtcgtggctggcgccggcagcgatccgggctggcgagcccttcgtggtcgcgctgcaggcgcgcagcgacggccccgtcaagggcgcctcggtccagctgcgctacgacgccgcacagctggaggtgctggcggtcgaggacggcggctatttcgacccggtcggcggccgggccgtcttcacgccgcgcatcgacccgacgctgggggtcgtgttcgcgaccgtcggcgcgtccggcaccggctcggcgacaggcgacgggccgctcatcaggctgcgcatgaagacacgcggcccggccgcgaccacgcggctgcagatcggcaacctggtcgcggtcgacccgatgaaccggcgactgccgatcgagggatcggcgccgctggagctgacgtcacggccatga

SEQ ID NO: 541 - DNA, 1845 bp, Azotobacter vinelandii DJ
atgaccatcgcaatgcgcaaggccgcagctgccttctggttgcccgtgctgctgggcggcgtgctgctgtccggctgcgccgggcagcccgccaaggaaggcatcgccctgatcgaccagggccgctatgaggaagggctggtgcaactggccgaggccgcgcatcgggcgccggacgacaccggcgtgcagatcgccctggccacccagcgcgcgctggcggtctccaggttgctgggccaggccgaaaaggcgcgcgtcgcgcgcgacaacgaggccgcacaggtcgccttccagcgagtgctggccatcgagccgggcaatgcccgggccgccgaaggcatgcgccagatcgttcagttgcgcaacgtcgccgagcattaccgccaggccgggctggccctgagccgcggcgacctcgccggggccgagcggctggtgcgctcgatcctcgccctggagccgcagcacgagggcgcgctggccctgcaggcgggcatcgagggcacccgcgcgcagaccgccgtcgcctatccgcagctgcgctccaggctgcagcagccggtgagcctggagttccgcgaggccaacctgaagctggtgttcgaggtgctggcgcagaccgcgggaatgaacttcatcttcgaccaggatgtgagcccggacctcaaggcgaccatctacgtgcgccaggtgcccatcgaggaggcggtggacctgctgctgcagcagggccagttgaagcacaaggtggtcaacgaaaacaccgtgctgatctatccgaacaccccgcagaagctcaaggactaccaggaactggtgctgaagaccttctacctgaccaacatcgacgccaataccgcgctgaacatggtcaagaccctgctcaagacccgcgacgtgttcgtcgacgagcgcctcaacaccctgaccatgcgcgacacaccggacgcggtgcacctggccgagcggctgttcctggcccaggaccaggccaatcccgaggtggtgctggaactggaggtgatggaggtgtcgcgcaagcgcatcctcgacctcggcctgcagtggccgaacaccttcggcatcctcgccgaggatggcaccagcgcggtgagcattctcggccagttgcgcggcatcgattccgaccgcatcaacttctcgccgtcgccgacgctgaaaatcaacgccaacgacagcgacgtcaacaccctcgccagcccggtgctgcgggtgagcaaccgcgagcaggcgcgcatccacatcggcgaacgggtgccggtggtcagcgccacctcgacgccctcgacccaggggccggtgatcaccgagaacatcacctacctggacgtgggcctgaaactggaagtcgagccgaccatccacctgaacgacgaggtggccatcaaggtggggctggaagtgagcaacgccacccagttgacgcgcacggaggcggggaccatcccgatccaggtcgatacccgcaacgcggtcaccaccctgcgcctgcgcaacggcgaaacccaggtgctggccggcctgatgcgcaacgatcagggcaagtcgggcgaccgcatccccggactgggcgatatccccggcatcggccggctgttcggcagcaacaaggacaccctgagcaagtccgagctggtgctctcgatcaccccgcgcatcgtgcgcaacctgccgtaccagaatccctacgacatggaattcgagtccggcaccgagagcagtctgcgcctgcgtccggccgcactgccgcgcaaggccggggccgctctgcgcggtcaggcttccgagccgctggccgccgccgggctggagcggccatga

SEQ ID NO: 542 - DNA, 1386 bp, Bacillus anthracis Ames 0581
ttgaaaaagtttagtttattattaacagcatttgtcatgattttaacattgttcattccaaatcttacaagtgctaaatctttccctgatgtccaatctaatcattgggcaattaaagaaattaactatttatcggataaaggtatcattaatggtacaccagaaggaacttttaaaccgagtgattatgtaactcgtggacaaatggccttaatgctagatttatcattaaaattagaaaaaccatctaactataatcatattttttccgatgtagccaaaggtgtctattactatgattctgtacataagttagcacataacaatattgtacaacgtgaaacaaactacttccctgaccgctcattaactcgtgcagaaatggcagtagtactagttaaaacttttaatttgaaacctacaggtgctgacgtcaatttccctgatgttccatctaatcattggggttacaattatgtcaaaattttagctcaaaataatattacagctggatttcctgatggtacatttggtccagacgtaaaagtaactcgtgaacagttcgctgcattcttagcaagagtattagaaccaagtttccgtccaggtcttcctaagcctaaaggagagttagaagtccattatataaatgtcgaacaaggtgatgctacatttattaaatctccaagtggagaaacgatccttattgatggcggaaataacggaaaaggtaaagttgtagcaaattatttaaaaggattaggattccaaactatcgattatatgattgccactcatcctgatgccgatcatgtaggcggattggatgaagtactttatgctataaatgtaaaaaacgtttacgcacctaaagtaagtcatacgacacaaacgtttaaggactttttaactgcagtagctaacaaaggattgactattaaagaagcgaaatctggagtaactttaccaatcaatggtttaaactcacaatttttagctcctgttaaagaatacggtaacgatctaaatgagtggagtgctgtattaaaagtaacacatggcagcaaatctttcttatttactggtgatgctgaatctaaaagtgaaaaagatatggttgcaacgtatggttccggcctaaaatccgatgtattaaaacctggacatcacggaagtaagacatcttcttctcagccatttttagatgcagtgaaaccaagtatcgctataatcagtgcaggtgcaggtaaccgatatggccatcctactcaggaaactttagcaaagttaaatgcaatgtctgttaaggtatatagaactgatttaaatggaactgtaattattaatagtgatggttctaacatttctgtaagagcggagagataa

SEQ ID NO: 543 - DNA, 1386 bp, Bacillus anthracis str Sterne; identical to SEQ ID NO: 542

SEQ ID NO: 544 - DNA, 1386 bp, Bacillus cereus ZK
ttgaaaaagtttagtttattattaacagcatttgtcatgattttaacattgttcattccaaatcttacaagtgctaaatctttccctgatgtccaagctaatcattgggcaattaaagaaattaactatttatcggataaaggtatcattaatggtacgccagaaggaacttttaaaccgagtgatcatgtaactcgtggacaaatggccttaatgctagatttatcattaaaattagaaaaaccatctaactataatcatattttttccgatgtagccaaaggtgtctattactatgattctgtacataagttagcacataacaatattgtacaacgtgaaacaaactacttccctgaccgctcattaactcgtgcagaaatggcagtagtactagttaaaacttttaatttgaaacctacaggtgctgacgtcaatttccctgatgttccatctaatcattggggttacaattatgtcaaaattttagcccaaaataatattacagctggatttcctgatggtacatttggtccagatgtaaaagtaactcgtgaacagttcgctgcattcttagcaagagtattagaaccaagtttccgtccaggtcttcctaagcctaaaggagagttagaagtccattatataaatgtcggacaaggtgatgctacatttattaaatctccaagtggagaaacgatccttattgatggcggaaataacggaaaaggtaaagttgtagcaaattatttaaaaggattaggattccaaactatcgattatatgattgccactcatcctgatgccgatcatgtaggcggattggatgaagtactttatgctatgaatgtaaaaaacgtttacgcacctaaagtaagtcatacaacacaaacgtttaaggactttttaactgcagtagctaacaaaggattgactattaaagaagcgaaatctggagtaactttaccaatcaatggtttaaactcacaatttttagctcctgttaaagaatacggtaacgatttaaatgagtggagtgctgtattaaaagtaacacatggcagcaaatctttcttatttactggtgatgctgaatctaaaagtgaaaaagatatggttgcaacgtatggttccggcctaaaatccgatgtattaaaacctggtcatcacggaagtaagacatcttcttctcagccatttttagatgcagtgaaaccaagtatcgctgtaatcagtgcaggtgcaggtaaccgatatggccatcctactcagaaaactttagcaaagttaaatgcaatgtctgttaaggtatatagaactgatttaaatggaactgtaattattaatagtgatggttctaacatttctgtaagaacggagagataa

SEQ ID NO: 545 - DNA, 1047 bp, Moorella thermoacetica ATCC 39073
atgatgacattaagcattctggccctgctggtggccgttttgctaacagtaaactccggctggtactttatccgccgcgccggtaaaaaagccaggcgccaggccctctatgccctcctggcgtttatcatttccgtagcggcagctgccggccatcccggtggaggtccgggcccgtccggcagcctacagtcccagccacgcagccaggcccaggcccctgtgcaggcgccagccggtacacccctgtcgcgggaatctcagacgaacccttctccacgccgggaagaagccggtaaattacgcgtccatttcctggatgtaggccagggtgatgccatcctggtgcaattgcccggcggccagaatattttaatcgatgccggcaccaatgaagccggtcctgttgtggtccaggacctgaaacagtatgccgttgcaaaacttgattatgtcatcgggacccatccccatgaagaccatattggcggcctggaccaggtcatcaatacttttccggtaggcaaggtttacctgcccagggtgaccaataatacggcttcctacagggaactgctgctggcaataaaaaacaagggcctcaaggttacagaggcccgggccggagttagcatccccctgggcgacggcgtccaggccctttttatcaacccggcgaagaaaaactatgatgacttgaatgactggagcgccgtcctgcgcctgacttatgggcaaacctcttttctctttaccggcgatgctggcagcgccgccgaggaagagatgctggccagccaccagcccctcagggccgatgtgcttaaagtagcccaccatggctcccgtaccgccaccggcaccgcctttttaaaggccgtagcacctgcatacgccgtcatctccgtcggtaaaggaaatgactacggccatccccatgcccagacccttaagcgcttgcaacaggccggggttaaggtatatcgcaccgaccgcgatggtaccataacggccgtctccgacggccgggaggtaatcatgccctga

SEQ ID NO: 546 - DNA, 1332 bp, Clostridium thermocellum ATCC 27405
atgtacacattttttaagaacatcatgcctcgttggtgccatattagacccgcatatttcctccaggttttacttattgccggttttatgatattatcggggtgcaacgctgacagtggtggctacgctaacaatcgtacaacagtaatgtcagaagaaatccaggctgacagcagtaattcctcagaagagggcaattttgttgatgtggctgaaacggcagaaccatcttctgctgctgataattcacaaaaatccggtgatttgcaggagacggtcaagtcgcaaaaacaggacacaatagaaagcaatgcttcaaatggccggctggaaataacgtttcttgatgtcgggcaggcagactcaattcttatatcacaaggccaataccacatgcttgtggatgccggaaacaatgctgatgcggaacaggtggttaattatcttaaaaacaaaggaatccgcaagttggaatatgtgattggtactcacggacacgaagaccatatcggaggccttgatgaagttattaaaagttttgaaataagcaaaattttaatgccgaaacaaataaacacaacaaagacttttgaagacgtattggttgccatacgaaataaaggcatgaaagttaccgctcccaaagtaggggatgtttatgagctcggcagggcaaaatggaccgttttggctccaggcagagaagaatacgagaatatcaacaactcatccatagtaatccgcctgacgtttggcaataattcatttttgtttatgggcgatgctgaggaattatctgaacgggaaatcctggcaaacaatcttgaaataaaatctgacttgataaaaataggacatcatggcagttcaaattcaacaacgtctgaatttttggaaaaggtgtctcccaagtatgcggtcattagcgtaggcaaaggaaatgattacgggcatcctcatacccaaacgctggataaactcaatgcagcaggaatacaaatatatcggacggacatatcaggtactataattgtcaccagcgacggaaaatctatcacctttgacaaaaaggcttctcctgttaaagagaatgcgccgccggcttcggataaaccaggtgtgcaaactgaatcaagtgatagtaaaagtaacatttccgccaacagcaatgctgagcagtcgaaagaaattgttgtatatataacaaaaactggagagaaataccatacaggcggttgcagttatctgaggaaaagcagtatccctgtaaagttgtccgatgcaaaaaacagaggatatacaccttgcagcaggtgtaatccgccaagatag

SEQ ID NO: 547 - DNA, 1104 bp, Herpetosiphon aurantiacus ATCC 23779
atgacagcaccatctttcccagctttttgcaatcgttgtggcaaccggcggagtcctcaagcgcggttttgcagatactgtggtaatgcctttcagcattggcaggccacagcaaccaagtcgatcccttcaactgaggtaggcgtaaaggctgtgcagcgtagcataaaatggcgttattggtttgcgttaacgcttgttttattcattggtgcacgacttagcctaaaaccattgatgggattggtactaggtggtttaaattttagcaacgcaccaattgctggtactcctaaccagagtccgcctaatcaacgccttgccacaggccaaacgctccgaattcacgtgatcgatgttgatcagggggacagtatcttaattcaaactccacaggggatgaacgccttaattgacggcggctatgacaatggtttggcattagaatacttacaccaacaaggcattcaacgaatcgatcatatgatcgtatcacaccctcatgctgatcatattggcgggctggttgaggtgctgaattctctcgaagttggcagtatttggacatcgggtgcagttcactccaccagttattttgagaatttgcttgatgcgattgatcgtcaacaagtgccatatcgcgaagttaaaacccaagagtctattcctctgggcgatttgagtttattagttgtccgcagcgaaccacaggctggtgatttaaatgatacctccctgattttgcgtttagagtatggtcaatttagtatgctttttactggtgatgctgaagcgagtagcgaggtcgatgttttacaaacaacgcccaatttgttaccagctacggtgcttaaggttggccatcatgggtcatatacctcaacgactcctgcatttgccctagcggttgatccaactctagcgatctattcagcaggtcgtaataattcttatggccatccacatcaacaaacattaacaacattgtgcaatctcggggcaacggtttatggcactgatcgtcatgggacagtcgttataacctccgatggacttgagtatcaggtgcaaacggcccagcgaacaacagcactgtgtcattaa

SEQ ID NO: 548 - DNA, 903 bp, Clostridium phytofermentans ISDg
atgaaaagaaataagaagattagtacaattattaaattattacttattataatattagtaattggacagtatctatatacatcagaccaacgagggcaaacagaagaaaacaaggaaacatctgcgaaggatacggatgatccgttaatgaaggttcactttattgacgtaggccaagcggattgtattttagtagaaaataacaataagtacatgctagtggatggtggtaataatgacgataaagatgttatactggactatctaaatcgtcttggcgtaaaagagtttgaggcaatcattatgacacatccacatgaagaccatattggaagcattgatacagtaatacgagaatttaaagtaaagaaaatctatgcaccgaaaaaagaacatactacaaagacttacgaagatgtattaaatgcagtaatagaaactggaaatacactcaacgcaccaaaatctggagaaaaatttaattttggcgctgttactgtaacatttttagcaccgagtagggattacggtaataatttaaacaactggtcaatcggaattaaagttagtaatggcaaacactcctttgtcatgtgcggtgatgctgagaaggaagcagaggaagatatgttagctacaaaacttgatttaagcgcagacgttttaaagttatcacatcatggtagtgatacttcttcaacgaaagagtttgtgaaggcagtaaatccaaagtatgctgtcatttcggtaggaaaaggtaatacttatggacatccaagtaaaagtacgattaagatgcttaagaataataagattaaatattttcgtacggatgaacaaggtactattgttatgatatcagatggagatcagttgacatgtaatgtgtctccaattccataa

SEQ ID NO: 549 - DNA, 957 bp, Thermoanaerobacter sp. X514
atgtacaagaagagattactgttgccctttatattaatactatttgcatttatattgacaaattatacaatatttgacaatacccttactcatgaagttcaacaggttttacaggatgaaggaataaaaaaacagcacgaagcagttaaaaaatccgcaacagacagtttaacagtaaattatatagacgtaggacaaggagacagtatatttatacaaactccatcaggcaagacgatgttaatagatgcaggaacacctgaaatgggtagcaaagttataaagtacataaaaagccagggaattaataaaattgacgtacttataggtacccatcctcataatgaccacataggaggtatagtggagattataaaaaccttcaaaataggaaagttttatatgcctaaagtaaccactacaacgaggacatttgaagaagttctaaaggcagcaaaatcaaaaggactttcgataaacgttgcaaaaacaggagtagtaattgaccttggagatggtataattgcaaaaatgcttgcgccaaatagttcccattacgaggacttaaataattatagtgcggtaataaaaattacgtatggtaatacatcttttttgtttacaggagatgctagtgaacaatctgaaaaggaaatgctaagtaaaggatataatttaaaagccgacgtcttaaaaattggacatcatggcagttcttcatcttctacttgggcatttttaaaggcagtacatcctaaatatgctgttatatcttgcggtaaatacaatgactatggtcatccccacaaagaaacaatgaaaaagcttaggtcattaggaataatagtatatagaacagatgaatgtgggactgtaattgcagtaagtgatggcaaaactataaattttaatgtagaaccaggtgataatttgtcgggaagtgagattaaaagataa

SEQ ID NO: 550 - DNA, 1386 bp, Bacillus cereus AH187
ttgaaaaagtttagtttattactaacagcatttgtcatgattttatcattattcattccaaatcttacaagtgctagatctttccctgatgtccaatctaatcattgggcaattaaagaaattaactatttatcggataaaggtatcattaaaggtacgccagaaggaacttttaaaccaagcgatgatgtaactcgtggacaaatggccttaatgctagatttatcattaaaattagaaaaaccatctagctataatcatattttttccgatgtagccaaaggtatctattattatgattctgtacataagttagcacataataacattgtacaacgtgaaacgaattatttccctgatcgctcattaactcgtgcagaaatggcaaaggttttagttaaaacttttgatttaaagcctacaggtgccgacgtcaatttccccgatgttccatctactcattggggttacaattatgtcaaaattttagctcaaaataatattaccactggattgcctgatggtacatttggtccaggtgtaaaagtaactcgtgagcaattcgcagcatttttggctcgtgtattagaaccaaattttcgtcctgctcttcctaagcctaaaggagagttagaagttcattatattgatgtaggacaaggtgatgctacttttattaaatcgccaagtggagaaacgattcttattgacggtggtaacaacggaaaaggtaaagtagtagcagattatttaaaaggattaggattccaaactattgattatatgatcgccactcatcctgatgctgatcatgtaggcggattagatgaagtcttatattctatgaatgtaaaaaacgtttacgcacctaaagtaagtcatacgacacaaacgtttaaagactttttaactgcagtagctaacaaagggttaactattaaagaagcgaagtctggagtaactttaccaataaatggtttaaactcacaatttttagctcctgttaaagaatatggtaacgatctaaatgagtggagtgctgtattaaaagtaacacatggcagcaaatctttcttatttactggtgatgctgaatctaaaagtgaaaacgatatggttgaaacacatggttctaacctaaaatccgatatattaaaacctggtcaccatggaagtaaaacatcttcttctcagccatttttagatgcagtgaaaccaagtatcgctgtgatcagtgcgggtacaggtaaccgatatggccatcctacacaggaaactttagcaaagttaaatgcaatgtctgttaaagtatatagaactgatttaaatgggactgtaattattacgagtgatggttctaacatttctgtaagaacggagagataa

SEQ ID NO: 551 - DNA, 1386 bp, Bacillus cereus AH820
ttgaaaaagtttagtttattattaacagcatttgtcatgattttaacattgttcattccaaatcttacaagtgctaaatctttccctgatgtccaatctaatcattgggcaattaaagaaattaactatttatcggataaaggtatcattaatggtacaccagaaggaacttttaaaccgagtgattatgtaactcgtggacaaatggccttaatgctagatttatcattaaaattagaaaaaccatctaactataatcatattttttccgatgtagccaaaggtgtctattactatgattctgtacataagttagcacataacaatattgtacaacgtgaaacaaactacttccctgaccgctcattaactcgtgcagaaatggcagtagtactagttaaaacttttaatttgaaacctacaggtgctgacgtcaatttccctgatgttccatctaatcattggggttacaattatgtcaaaattttagctcaaaataatattacagctggatttcctgatggtacatttggtccagacgtaaaagtaactcgtgaacagttcgctgcattcttagcaagagtattagaaccaagtttccgtccaggtcttcctaagcctaaaggagagttagaagtccattatataaatgtcggacaaggtgatgctacatttattaaatctccaagtggagaaacgatccttattgatggcggaaataacggaaaaggtaaagttgtagcaaattatttaaaaggattaggattccaaactatcgattatatgattgccactcatcctgatgccgatcatgtaggcggattggatgaagtactttatgctatgaatgtaaaaaacgtttacgcacctaaagtaagtcatacgacacaaacgtttaaggactttttaactgcagtagctaacaaaggattgactattaaagaagcgaaatctggagtaactttaccaatcaatggtttaaactcacaatttttagctcctgttaaagaatacggtaacgatctaaatgagtggagtgctgtattaaaagtaacacatggcagcaaatctttcttatttactggtgatgctgaatctaaaagtgaaaaagatatggttgcaacgtatggttccggcctaaaatccgatgtattaaaacctggacatcacggaagtaagacatcttcttctcagccatttttagatgcagtgaaaccaagtatcgctataatcagtgcaggtgcaggtaaccgatatggccatcctactcaggaaactttagcaaagttaaatgcaatgtctgttaaggtatatagaactgatttaaatggaactgtaattattaatagtgatggttctaacatttctgtaagagcggagagataa

SEQ ID NO: 552 - DNA, 963 bp, Desulfitobacterium hafniense DCB 2
gtgaaaggttataagatagggagctttcttttagttctcctattgtcaatattgttaataggctgcgcagacttggcgaatcctaatcctcagaactctcaggatcagaggaacagcgttaaagaagggcaaaaccccggaagtttcttagggaaagataacgcggatactaaggctttgcaggtaagctttatcgatgtaggtcaagccgattcagccctgattcagattcccaacggcaaaaatatactgatcgatgccggcaataatgccgatgccgagttcttaatcaagtatctccaagaccgagggattgaggaaattcatatcctgattggaactcatcctcatgaggatcacatcggaggattggataaggttatcgagaagtttaagatcgggcaggtgattatgcccaaggtgaccagcactaccaggacctttgaggatgttttgctggctgtccaggagaaaggcttgaaaatcaaggaagggaaggccggagtccagttggatttagggcctcttgaggaaggcatgcctgccgtttcagcagaaatccttgcccctctgtccggccaatatgaggacatgaacaattacagcatcgtcctgcgcttagtctatggaccccatgcctttctctttacgggagatgcggaagatgtctcggaaaaagaaatgctggccgctggtgtaaatctaaaggctgatgtcctgaaagtaggtcatcacggcagtaaatcatcgacgacgaaagattttctcgctgctgtagctcccaagtatgctattatctctgtagggaaggataacagctatggtcacccaacagaaactgttcttaaacggttaagcgatgcagggattggtatttacagaaccgatcaagtcgggaccataacagtgactgccaatggttccgcactcacatttgccacaacaacccatgaggttcaataa

SEQ ID NO: 553 - DNA, 1221 bp, Halothermothrix orenii H 168
atgggaaagaataaattaaccttaaaaacagttatatatttaatgttattcatttttatagcctatagtatgtatctatatttaaccccggaaacaccggaaaaaaaccagctcgaaatccactttatcagtgtaggccagggtgatgctgtcctgattaaattacctgacaccaaaaacatgctgattgatgctggaagcaataaatacagcaacaaagttatcaactacatcagacatcagggaataaatcaacttgattatgtaattgctacccacccccacgaagaccatataggcggtctggacagggttatatctacttttagaatcggtaagatatttatgcctgatgttattcaccccaccaggtcttttgaggatgttttaactataattaagaaaaagaaattgagaattacaccggcaaaaaaagatcttgttatcattaacaacaataaaaaggatttaaaagcagtgattatatcacctgaagacaaaaaatatgataagattaataattattcagtcgttttaaagttaacttatcataaaacctcattcttatttaccggtgacatcgaaaaagagattgagtcaaaactggttaattctaaatacaacctcagatccaatttaataaaaattccccatcatgggagtgcaacatcgtcttctactccatttcttaaagaagtatcacccggttatgctgttatatctgttgggagggataatgattataaccacccttcacccataaccctggaaaaattaaaagaaatgaaagtaaaaatctttagaaccgataaacagggcacaataatagtaatgagtgatggctccaggttgtcctttaatttgcaaccattagagatttcttaccaaaagaaaaataacaacaagaataaagcagttaaaattattagcctggaccttaaaaatgaagtagtggttattaaaaataccggaaatgagacaataaacctggcaggctggaaactggttagtcttaagggtaatcaacaattcaatttccctgacaacacagtcttaaaaccgggacaatcctttaaaatactgagcggcccctctgccctgaataagcctgataatatcatctggaccagatctaacatatggaataacagtggtgatggggccctcttgactgattctaacggagagataattgacaggttattaagggaggaagactaa

SEQ ID NO: 554 - DNA, 1362 bp, Atopobium parvulum DSM 20469
atgcccaactcaacgcaatttgacagcaaaactgaatcgcccagcacaacctctggcgagcaatctaactacttttttgcactcattctttccttgatatttggcatttttggcgttccacagttgtatctcaagggttggaaatcagggcttacaagacttgttgtaaatacgacgctgattgttggcacaatcgtcctagctcaaatatttgccttaccagcattgctttcttatcttctaccagcaattctttcgtacccggttatcgagagcgctctaaacctcatttacgaagatgccaatgcttccaaaaaactcataaaaggcaagctcaagctccacaagcggtacgccggaaaacaaaaagccggaattgcattagcctcactgagtatagcgctctactttagtgctgcactgacgcagccgcttccaactaccgtctctaccgcgggcgtatcaggtcaacaagccacagttcaagcgaccaacgcaccctcgcagacagactccgacacgtcatccacaacctcgctggcaaacacaaacgtaaccatcaagtttatcgacgttggccaaggagaagcaattctcattgcacttcccgaaaaaaccatgcttatcgatgccggtcctacaggttcaggtccaaaaatttctcaggtgctccatgaacttggtcgagagaagattgattacctggtagctacccatcctgacgaagatcacattggtggcatggcggacgtcatttccagcacccaaatcggaaccatttacgcaccaaataagacaaacaacacggcaacatacagaaagtttctaaccgctattcagaacaataacctacaaataacccttgctgaagcagggaccatcatcgaccaaaccgatgactacaagatagaaattctttggccagccaaagacgcaaattttcccgataccaatgactactcgataattatcaaactaaccattggcaacaagacgtttcttttcacgggagatgcacctacaagcgcaatccttcagagcaatccaggccacatcgacgtgctcaagctctcccatcacggctctagaacaggtacaaatgagcaactggtccgcaagctatcgcccacttacgccctcatttcttacgctttggataactcctacggacaccccatgaagtcagtcttaaacgccctccacaaacattccgttgagatttggggaacgggagctaacggaactattaccattacctgcgatggtacaaccattgaaatatctggcgagaagaacggcactgttgttgctcctacctcaccagaaaaatctggcacgtcgtcgacatcgaggactaagtaa

SEQ ID NO: 555 - DNA, 885 bp, Desulfotomaculum acetoxidans DSM 771
ttgaacaaacgaaagatattttggccggttttactggttttactgattattatcagcgcaggctgcagcagatcaagtaacaatttaagaaatacagatacagagaaagcagtgttacagccggatttaggcaagcaggtaaaagtgcactttattgatgttggacaggcagattccatattgctgcaaatacctggcggccaaaatattttagtggatgccggtaacaatgaagatggccctcttgttgtagaatacttaagagaacagggagttcaaaaaatagactatttggtagcgacacacccgcacgaagatcacattggcggcatggataatgttattaaaaattttgaaattggcaaggtatttatgccgaatattcaaacaacaacgaaaacctttgaagatgtccttttagctctgaaagcgaaagatttgaagataactaccgctaaagcaggagtaagtgttttagaacaggataatttaaaaatgaattttgttgctccaaataaaaataattatgaagacttgaacaattggtccgctgtaatgcgagttcaatatggagatacagcatttttattaaccggtgatgctgagcagctttctgagaaggaaatgcttgccgccggagctaatcttaaagcggatgtattaaaaataggccatcacggaagcaacagttctaccggtaaaaagtttctaaacgcagtagctcctgagtatgcagtaatatctgtaggtaaggacaatgattacgggcacccgcacaaagagacactggccagattaactaaagcgggaattaaaatatatcgcactgaccaaagcggaactattgtttttacttctgatgggaagaatatatcagttaattga

SEQ ID NO: 556 - DNA, 669 bp, Shewanella oneidensis
atggaaaattttcaatcacatttagcgcaaaatcgctatgataggcagttatcgccccctatcgaaatggctatggaaaacgataaccacaatttaaccgccgacgaacatataacggatatcgatcctttggtgagcgccatcatcaaagttgctaatcaaagggataaagcggcatttggctatttgttcagccacttcatgcccaaaattagagcatttggtctgcaacgattaaatcaacaaggcttagccatggatttagttcaagagaccatgaccaccgtttggaccaaatcacacttatacaatgcggacaaagggtctgtcgccacgtgggtctttaccatcatgcgtaaccaatgtttcgatatgctaagacgggtacagcataaccgagaagatgcatttggcgacgatatctggccactttatgacgttgctgttaaccaagataataatcctgaccataaattgaccgccaagttactcgctcacttagatgccctgccccttgcacaacgccaagtagtacaaggcatttatatgcaagaactcacccagcaagaactggccgatgccttaaaagtccccattggcacgattaaatcgcgactaagattggggctggaaaagcttaaaagctttttggagacacaacatgattaa

SEQ ID NO: 557 - DNA, 609 bp, Pseudomonas syringae tomato DC3000
atgcgcattactgccagtctcaggaccttctgtcacttgtccacccctcacagcgactcgacaacaagccgactttggattgatgaagtcaccgccgtggcccgccagagggaccgcgatagcttcatgcgcatctacgatcacttcgccccgcgtttattgcgttacctgacggggttgaatgtgcccgaggggcaggcggaagaattggtgcaggaggtgctgctcaagctgtggcacaaggcggaatccttcgacccgagcaaggccagcctgggcacctggctgtttcgtatcgcgcgcaatctgtacatcgacagcgtgcgcaaggaccgcggctgggtgcaggtgcaaaattcactggaacaacttgagcgtctggaggcccctgtagacagaacgctcgattacagccagcgccaggagcaacaacttaatagtgccattcagaaccttcccactgatcaggccaaagtgttgcgaatgtcttacttcgaagcgctcagccatcgggaaatttctgaacgtcttgatatgccactgggcacggtgaagtcgtgcctgcgcctggcctttcaaaaattgcgctcgcggatcgaggagtcatga

SEQ ID NO: 558 - DNA, 609 bp, Pseudomonas syringae pv B728a
atgcgcataactgccagtctcaggaccttctgtcacttgtccccctctcacagcgaatcgacaatcacccgactttggatcgatgaagtcaccgccgtggcccgccagagggaccgcgacagcttcatgcgcatttacgatcacttcgctccgcgcctgttgcgctacctcaccgggctgaatgtgccagaaggtcaggccgaagagttggtgcaggaagtgctgctcaaactgtggcacaaggccgactcgttcgacccggccaaggccagcctggggacatggttgtttcgcatcgcacgcaatctttacatcgacagcgtgcgcaaggaccgtggctgggtgcaggtgcagaactcgctggaacaactcgagcgtctggaggctccggtagatcgaacactcgattacagccagcgccaggagcaacaactcaacatcgccatccagaacctgcccgccgatcaggcccgagtgttgcgaatgtcgtatttcgaagcgctcagccaccgggagatttccgaacgcttgggtatgccgcttggcacagtgaagtcctgcctgcgccttgcgtttcaaaaattgcgctcgcggatagaggaatcatga

SEQ ID NO: 559 - DNA, 618 bp, Colwellia psychrerythraea 34H
atgcagactaacttgctaagcagaccgacaagtgctaaatctactagtatgtcagataaaataaatcacccacaactctgccaatggctagagtctgttgctataagtcgagacaaacaagctttcactcatttgtttcagttctttgcacccaaaattctacgtattgcacgtggtaaatttcctaatgaagcacaagccaatgaagtcgtgcaagacactatgagtaatgtgtggagaaaagcccacctttacaatcaagacaagggggctgcaaccacttgggtatacacggtaatgcgtaacgttactttcgatatgctgagaaaaattcaaggtaataaagaagataatctaagtgatgatatttggcctatcgctgaaagtatgagcatcgaaaatgaaatttttgatgaccatttagaacatgcaaacttgttaagtgtcatagaagagttacctcaagctcaacaagacgttgttaaaggtttttactttagagaaatgtctcaagagcagctagctgtgcatctacatttaccactagggacagttaaatctcgattacgtttggccctaggaaaactcaaagtacagttaggagaaaaacatgattaa

SEQ ID NO: 560 - DNA, 588 bp, Rhodopseudomonas palustris HaA2
atggatcatccgcgacgcaagccgcctgccgtttcgcaggatttgtccgactgcatcgttcggatcgccaccgatcacgacgaggccgcgttcgacgtgttgttcaggcactatgcgccgcggctgaaatcctacttcaccaggcgcggcggcgatccggcgatggcggaggagatcacccaggagaccatggtctcggtctggaagaacgccgcgcagttcgacccggccaaggcctcggcgacgacctggatcttcaccatcgcccgcaatctcggcatcgaccggctgcggcgggcgaagcggccgtcgttcgacccgcacgatccggcgttcgttcccgacgaggaggacccgccggaccgccagttcgagcgcgccgaagcgcagcgccgggtgcgcgacgtgatgaatacgctgtcgtccaacgagaagagcgttctgatgttgtcgttctacgaaaatcaatcgcacggcgagatcgcccaacggctcggcctgccggtcgggacggtgaagtcgcggatccggctggcgttcggcaagctgcgcgccgcgctcgagccgctgacgggagccggacgatga

SEQ ID NO: 561 - DNA, 384 bp, Jannaschia CCS1
atgcaggatgtcatggccaccctttggcgcaaagcacatatgtacgatccgtcccgcgcctctgtggcgacttggatctttacgattgcccgcaatcgaaagatcgatctgctgcgccgctatgcccgccctgacccggaagaattgccctggggccccgaacaggcccccaatccggccgatgtcattgccctgcaacaggacacaacccgcctgtcccaggcccttgccaccctgcccgagaagcagcgagaacttatcaaacacgcctattttggagacctgagccattctgaaatcgcgatagaaaccggtttgccccttggcacaatcaagtcgcggattaggttagcgctcgatcgacttagacactcgatgaattga

SEQ ID NO: 562 - DNA, 627 bp, Saccharophagus degradans 2-40
atgctcgcatcaacaacttctaggcaaaaaggccccgaaagacggatggatacagactaccgtagagacgacaattggtcaggtttgcttgagcgagtagcaacaagccaagatcaaacggcatttgcagccctttttgagcatttcgcccccctaataaagggcttttgccaaatgcatgcttctggtcttagtggcgagaatgcagaagagcttgtacaagaagtgatgtttaaagtttggcaaaaagccccctcctttgatgcgcgtaaatccgctgccagtacctgggtatttaccattgtgcgcaacacgcgtatcgactatttgcgcaaaaacagtaagcacacaacaaatatagtagatggattagaagccgatgatatttgggacgaaagcctagaccaccaaccctttgtatatttacaacaagcgcgcgatacagagagtgtgcgcgactttttaagcacgctccccgaagatcagtcgcactgcctgaaaaaggtatatatggaaggtaaatcacacacagaaatatcggaagaactaaaccttccgctagggacagtcaaatcccgagttcgattggggcttaaaaagcttcaatcttgcgtaggaggcaaataa

SEQ ID NO: 563 - DNA, 627 bp, Shewanella denitrificans OS217
atgaaaaacagcgcgccaaataaggatggctcaatcgaggctaatctgactgatttacaagttcaaactgaactttatcagtggcttagcttggtaagtcatcaaagagacaagcaggccttcactgaactgtttcagttttttgcgcctaaaattaagcgttttggcatgcagcgtctaggcagtaatgacaaggccaatgagctggtgcaagaaaccatgtccaatgtttggcgcaaagctcacctttatgatggggagaaaggggctgcaaccacttgggtttataccgtaatgcgtaatgcttgtttcgatatgttaaggcgaattaaaaccagaaatgaacagctattaggtgatgatatttggcctgtggaacaagcactagcagaaaacaaccccgagtcagagacctttagcgaccatttgatggaacagcacatgcgtgagcatattaataagctgccttcttcacaacaaacggtagtgaaaggggtgtatttccaatccctgtctcaagaacagttagcccagcagcttgacgtgccactcggtaccattaaatcgcgactcagacttgcattggcaaggcttaagctgcaaatgagagatgaatatcatgattaa

SEQ ID NO: 564 - DNA, 588 bp, Rhodopseudomonas palustris BisB5
atggatcatcctcgacgcgacccacgtgaatccgcgcatgatttgtccgactgcatcgtgcggatcgccacggatcaggacgaagcggctttcgatacgctgttccgacacttcgcgccgcggctgaaatcgtatttcaccaggcgtggcggcgatccggcaatggcggaagagatcacccaagagacgatggtgctgctgtggaaaaacgccgcgcagttcgatccgtcgaaagcctcgccggcaacctggatcttcaccatcgcgcgcaacctcggcatcgaccggttgcggcgcgcgaagcgaccgtcgttcgatccgaacgatccggcgttcatcccggacgccgaggagccgccggaccgccagtttgaacgtgccgaggcggagcgcagggttcgcgacgtcatggatacgctgtcagccaacgagaagagtgtcttgatgctgtcgttctacgaaaatcaatcgcacggcgagatcgccgaacgtctcggtctgccagtcggcacggtgaaatcgcgaataaggctggcgttcggcaagctgcgcgccgcgctcgatgcacagacgggagccgcacaatga

SEQ ID NO: 565 - DNA, 597 bp, Ruegeria sp. TM1040
gtgggcgagggcacaagcggttgccgggagagcgacagagtgacaggtgaggcatattccgagacgacagtctggatgctggcagtgcgcgatgacagggacaaagccgccttcgggcgcttgttcgatcactttgcgccccgcctcaaaggcgtgatttgccgctcgggtgtctcccctgcgcaggctgaggacatcgttcaggacgtgatgctcacggtctggcgaaagtcgcatatgttcgaccccggtcgcgctcaggtttcggcctggatctaccagatcgcgcgcaaccggcagatcgacatcttgcgcaaggaaaagcgtcccgtaccggaagagttgaagccggtcgaggacacagaggatgacgcgtcacaggtcgtggcgctggaacaggagacgcaggctctgcgtgcggcgcttcagaccctgaagcccgcgcagcgcgaaatggtggagcgcgcctatctgggcgagctgacccatgcggagatcaaggccgagaccggtctgccgctgggaaccatcaagtcgcgcatccggctggggctggagaaactgcgtcatgaattgaagggaacgcaacgctcatga

SEQ ID NO: 566 - DNA, 615 bp, Pseudoalteromonas atlantica T6c
atgctagtcggaatccctttggaatcaaaacattcacatgctgttgtaccaaaagattgtgcggatgaaatgtcatcgtatcttgtgttggtagggcagtctcgttgcaaacgttctttcgcagagatatttaattatttcgcgccacgtcttcgctcgtatgccctaaaacaaatgggtaatgaggctttagctatggaattggtgcaagacaccatgtcgaatgtgtggcagaaatctcacttattcaatgccgagaaaggtgctccctccacttggattttcactattgcacgtaatatccgcttcgacatgttgcgcaaacagcgtaaccgtaaagaagatatctgcgctgacgatctatggccagtgctttgcgagcaaaccgctgatgtaaacgaagtctcattagatgagcaaataacacttcagcagctcggggttatattcgaagacctgccgaaaaagcaacgcgaagtgattgaagcaatttatattgaaggtaaatctcagcaggaagtcgctgaccaatttgacatccctctggggacggtcaaatccagaacccgtcttgctttgcagcgattgaaagagatgttaaaagataatgattaa

SEQ ID NO: 567 - DNA, 621 bp, Rhodospirillum rubrum ATCC 11170
atgcccagtccgaccgcgcccggttcgacggcgaccccggcctccccggcccctcccccctctcccgccgccgacggcgccgatcacggcgcgctgatcgtcgccatcgcccgctcgggcgatcgcgccgccttcgccacgcttttcacccactacgccccgcggttgaaatcctatctgcggcgcctgggtgccaatgacgccagcgccgaggaagtggcccaggaggcgttgttgatggtctggcgcaaggccgagcgcttcgatccgacgaaagcgggagccgcgacctggattttcaccatcgcgcgtaatctgcgcatcgacatgttgcgtaaggagagacgacccgagatcgaccccgaggatcccttgctcgaaccctcaagtcccgatgcggccgatatcctcatcgaaaaggaccagcgcgagacccgggtgcgaacggctttgcgatccctgcccgccgatcaggccgaggtggtcaggctggcttttttcgaagatctgacccacgtcgaagttgccgatcgtcttggcctaccccttggaaccgtgaaatcccgtttgcgtttggccttttccaaggtgcgcggatctgttggagacgaagtgcgatga

SEQ ID NO: 568 - DNA, 669 bp, Shewanella sp. MR-7
atggaaaattttcaatcacatttagcgcaaaatcgctatgataggcagttatcatcccctatcgatatggctatggaaaacgatagcactatttcaactgctaatgagccaatcacagatgcggatcctttgacgcgagccattataagagtcgcgaatcaacgggataaagccgcctttgcggaattgttcagccattttatgcccaaaattcgcgcattcggtctgcaacgcttaaatcagcaagggctggccatggatctggtgcaagaaaccatgaccttagtatggaccaaagcccatttgtacaatgccgacaaaggctcggtggcgacttgggtatttaccattatgcgcaaccagtgtttcgacatgcttaggcgcatccaacataaccgtgaagatgccttcggagatgatatttggcctatttacgatgtggccgtcagtcaagaaggcggcccagatcataaactcaccgccaagctactcgcgcacttagatgctctacccctgccccaacgccaagtggttcaagggatctatatgcaagaactcacgcaacaagaattagccgatgccttaaaagtcccgattggtacgataaaatcgcgactcagattggggttagaaaagctgaaaagctttttggagacgcaacatgattaa

SEQ ID NO: 569 - DNA, 546 bp, Rhodobacter sphaeroides 2 4 1
gtgacggacaagagtgacaggacggactgggtggcgctcatgcgtgcgatccgggatcatcgggacgaggcggccttcgcagagctgttccagcactttgcgccgaaggtgaagggcttcctgatgaaatccggcagcgtggcctcccaggccgaggaatgtgcgcaggatgtgatggcaacggtctggcagaaggctcatctcttcgatccctcgcgggcatcggtcgcgacatggatcttcacgattgcgcggaaccgccggatcgacggcctgcgcaaggaccgccagcccgagcccgaggatctcttctggggccccgacagcgagcctgaccaggccgacgtctatgagatgcagcaggagaacgcccgcctgggccgcgccatcgcccgcctgcccgaggcgcagcgggccctgatcgagcgggccttcttcggcgacctcacccaccgggaactcgcggccgagaccggacttcccctcggaaccatcaagtcgcggatccggctcgcgctggaccgtctgcgccagcatatgagttga

SEQ ID NO: 570 - DNA, 669 bp, Shewanella sp. MR-4
atggaaaattttcaatcacatttagcgcaaaatcgctatgataggcagttatcacctcctatcgacatggctatggaaaacgatagcactatttcaaccgccaatgagctaatcacagatcccgatcctttggctcgtgccattgctaaggttgcaaatcaaagggataaagcagcctttgctgagctgtttaaccactttatgcccaaaattcgcgcattcggtctgcaaagattaaatcaacagggtcttgctatggatctggtacaagaaaccatgaccctagtttggaccaaggcccatttatacaatgcggacaaagggtcggtggcgacctgggtatttaccattatgcgtaatcagtgtttcgatatgctaagacgggtacagcataatcgagaggatgctttcggtgacgatatctggccactttgcgatgttgccgttagccaagagaacaacaccgaccataaattgactgccaaactactcgcacatttagatgccctgcccctacctcaacgccaagtggtgcaagggatctatatgcaagaactcacgcaacaagaattagccgatgccttaaaagtcccgattggcacgataaaatcgcgactcagattggggttagaaaagctgaaaagctttttggagacacaacatgattaa

SEQ ID NO: 571 - DNA, 585 bp, Maricaulis maris MCS10
atgacggatctgactgaccgccctgctccaacggttgatagccagagactgtcagacttgctggtgcaggtcgggcaggcgcgggaccgcgccgccttccgaaccctgtttgaccattttgcgccgaggattcgggcatttctgatccagcgtcgggtcataccggcgatggcggacgacctgacgcaggatgtgatgctggcaatctggcgtcgcgcgtcaagtttcgacccgtcacgggcggccgcatccacctggatctacacaatcgcccgtaatcagcacatcgatcaatatcgcaaggcccagcgggccagccgcatggacgagaccgacccgtctctccagcctgcgcccgcaccggcggcggatgatctgtgcgaacaggccgaagctgccgacagcgtcggtgtcgccctggaagacctttctgccgatcagcggcaggtcgtggaactcgccttcaccgaaggcctgacccacagcgaaatcgccgaccggcttgaactgccgctcggtaccgtcaaatcacgcatacgacttgccctgggcaagttgaagacgacccttggagaaatggtatga

SEQ ID NO: 572 - DNA, 663 bp, Shewanella frigidimarina NCIMB 400
atggaaaatgttcaatcacaaagcacacaaagtcgttatgataaggggcatcttgcaaaaagatccctaattaaactaagcggtgctatgaaatcaaacgaacccaatccaatggctgatgagctggcgtcattaatgacgcaggtggctaatgatcgatgcaaaacatcttttgcaaaacttttttcgcattttggcccaaaaattaactcttttggtgtccagcgcttaagccaacagggcttagccatggatttagtgcaagagacaatgactagagtatggacaaaagcccatctatataacgcagagaaagcagcggtaagcacttgggtatttaccatcatgcgtaatcaatgttttgacatgcttcgtaaagtacaacacaaccgtgaagattctttcggtgatgatatttggcctttatttgagtctgacgaagctgaaagcaacgacaatgattttttattatcggccagtttattgcagcatgtagaagaattaccccctcttcagcgccaggtagtacaaggtatttatatgcaagagcttactcaacaagagttagcggaaaaacttaatattccaattggaacggttaaatcacgacttagactcgggttagaaaaattaaaaagctttatggagaaacactatgattaa

SEQ ID NO: 573 - DNA, 669 bp, Shewanella sp. ANA-3
atggaaaattttcaatcacatttagcgcaaaatcgctatgatagacagttatcatcccctatcgatatggctatggaaaacgatagcactatttcaacagccaatgagccaatcacagatgcggatcctttagcgcgcgccattttaagagtcgcgaatcaacgggataaagccgcctttgcggaattgttcagccattttatgcccaaaattcgcgcattcggtctgcaacgcttaaatcagcaagggctggccatggatctggtgcaagaaaccatgaccttagtgtggaccaaggcccatttgtacaatgccgacaaaggctcggtcgcgacctgggtatttaccattatgcgcaaccagtgtttcgacatgctcaggcgtatccaacataaccgtgaagatgccttcggggatgatatttggcctatttacgatgtcgccgtcagtcaagaaaacggccctgatcataaactcaccgccaagctactcgcgcatttagattccctgcccttgcctcaacgccaagtggttcaagggatctatatgcaagagctcacgcaacaagaattagccgatgccttaaaagtcccgattggcacgataaaatcgcgactcagattggggttagaaaagctgaaaagctttttggagacgcaacatgattaa

SEQ ID NO: 574 - DNA, 648 bp, Shewanella amazonensis SB2B
atgcaaattttcaggcaaaatcagcacggatcccactatgatagaagctcgtctcctatcaatatcaaaggtatgcaggattcaaagccagatatcagtgaagaaacattgcgccactggttggtggcggtagccaataacagggacaaatcggccttccgcgccctgtttgatcattttggccccaaggtcagatcctttgggctgtcgcgtctttcgcaacaaggtctcgcaatggacttggtgcaggaaaccctcaccacggtatggaccaaagcgcatcttttcgataccgatcggggaaatgtcagtacctgggtgtacgccatcatgcgaaatcagtgttttgacatgctcagacgggtccaacacaaccgggaagatgcctttggtgacgacatttggcctttattcgatgtcgatacccatgcgggcgaccatggcgaccataagttggacgcattgcttaaccaatatctttcaaagctacccaagctccaacgtgaggtggttcaaggcatatatcttcaggaactcagccaacaggaactggccgaccgactcggcgttcccttgggtaccatcaagtccagattgcgcctgggccttgagaaactgaaaagcctgctggagaaacatcatgattaa

SEQ ID NO: 575 - DNA, 621 bp, Psychromonas ingrahamii 37
atgatagccagaatagctcataactcgacggacattacattgaataatacaaaacttaattcactagatagtgaacaattaaaaataaatttgtggttaaaattggttgcaaccaagcaggataaagaagccttttctgagctgttcaaatggtttgcaccgagaattcgtgcgcacggtatgcagcgttttaaacaagaagcactggcaatggatttggtacaagagacgatgttattagtgtggcgaaaagccgttttgtttaatgtggataaaggtaaagccagcacttggatttacaccataatgcgtaattactgtttcgatatgctgcgtaaaaaacaaactcagaaagaagatacgatcagtgatgatctttggccggttattgagcagcaagtaccggatgataaagatgatcatttacagaatcgcttattattaagccatctgggaagtttacccttagagcaaaaacaagtcgttgaagctatttatttgcaagaaatgactcaacaggaattagccactcatcttgatctccccttaggtacggttaaatcccggcttagattggcgatatcaaaattaaaatcaaaattggaggcagatcttgattaa

SEQ ID NO: 576 - DNA, 666 bp, Acidovorax avenae citrulli AAC00-1
atgaccatcgtccgcaagcccctggcagagcagcctcccgcgaggaccgctttcgctctgcctccctacctgtcgattgtgtcgaagtatcacaccgaaggactgccttcatcgccttcgtcggaagcgtggatcgccctggtgcgcgccgtggccgaccacggcgaccggcaggccttcgcggcgctgttcaagcatttcgccccgcgggtgaaggcctacctgatgcgcctcggcctggcggagggcgtggcggaagacctcacgcaggaagcgatggtcaatctctggcgcagggcgggcaccttcgacccggcgcatgcgggtgtctccacgtgggtgttcaccatcgcgcggaacctgcgcatcgaccatctgcgccgcaagtccaaccagttgtccgaaagcgacgacgggctcgacatggccctggacgacgatggccccgaggagctggcctacgccgcccagtgcgaaaacgacgtgcggcgggcgatcgagtcgctcgcccccgaacaggcacaggtgctgcgccgctccttcttcgaggaccagccccacgcccggatcgccgaggatctcggcatcccgctggggaccgtgaaatcccgcgtgcgcctggccgtacgccacctgcgccgcctgctcggcgcccatgcgccatga

SEQ ID NO: 577 - DNA, 648 bp, Marinobacter aquaeolei VT8
atgatgaccatagccagctcaaatacgataactgtcaaggagcgcccggtgacaacactggagcagcaaccaacgaaaaccgaagggcgcaaagacccctggggtgttttgttggaaaaagtcggcaagcatcaggatcgggcggcttatcatgctttgttcgagcactttgccccgcagatcaagtactacgcaatctcgaacgggctggccagccacgcggaagagctggtgcaggaagtcttcgtctctatctggcgtcgctcttgtctttacgactggcgcaaggcggccgcttccacctggattttcaccattgcccggaaccagcgcattgatatgctgcgcaaaatgcagcgcaccagtgctgagatggcggtggaaaccgaggatctctggcagatcccgggtgataacgaagacgaaccagtcacctccctgcatcgcctgatgtccgagcggcgcatccgggagtcgctgagccagctcccggaagagcagattaccgtcattgccaaggtatatatggagcacaaatcccaccagatggtggcagatgagctcaacattcctctcggcaccgtgaaaagccgggttcgcctggcactgaacaaactgaaagtgattttgcaggatcaaaacgtatga

SEQ ID NO: 578 - DNA, 663 bp, Shewanella baltica OS155
atggaaaatattcaatcacaaagcaggcaaaatcggtatcatggccctatcacgtctctgactcattcggctatggataacgacattcccgctctcaaaacctgcgagcctcaagcggatactttgatcacgtttatgctacaagtagctgacaaacgggacagagccgcctttgggcatttattccagcattttatgcccaagatccgcgcctttggtttacaaagactgaatcaacaaggcttagccatggatttagttcaagaaaccatgaccagcgtgtggactaaggcccatctgtacaatgcagataaaggctcagtgacgacttgggtatttaccataatgcgtaatcagtgtttcgatatgctgagacgagtacaacacaataaagaagatacctttggcgatgatatttggccgctgtgcgatgcgaccatggctcaagacacactcactgatcataaattgacggcgaaactcctccaacatcttgatgcccttcccctcgcacaaagacaagtcgtgcaaggtatctacatgcaagaactcactcaacaagagctagccgatgccctcaaggtgccaataggcaccataaagtcacgattaagactcgggctagaaaagttgaaaagtttcttggagacacacaatgattaa

SEQ ID NO: 579 - DNA, 507 bp, Rhodobacter sphaeroides ATCC 17029
atgcgtgcgatccgggatcatcgggacgaggcggccttcgcggagctgttccagcacttcgcgccgaaggtgaagggcttcctgatgaaatccggcagcgtggcctcccaggccgaggaatgtgcgcaggatgtgatggcaacggtctggcagaaggctcatctcttcgatccctcgcgggcatcggtcgcgacatggatcttcacgattgcgcggaaccgccggatcgacggcctgcgcaaggaccgccagcccgagcccgaggatctcttctggggccccgacagcgagcctgaccaggccgacgtctacgagatgcagcaggagaacgcccgcctgggccgcgccatcgcccgcctgcccgaggcgcagcgggccctgatcgagcgggccttcttcggcgacctcacccaccgggaactcgcggccgagaccggacttcccctcggaaccatcaagtcgcggatccggctcgcgctggaccgtctgcgccagcatatgagttga

SEQ ID NO: 580 - DNA, 639 bp, Shewanella loihica PV-4
atgcagacatttgttagcgcaggcgccccggataaagggagtgcgaatatcaagactcaaccagagacgcaggtgcctgccgagctgtcgacctggctggtgcgggtagctgatgcaagggacaagcaggcgtttacccgtctgtttcaattctttgcgcccaagatcaaacgctttggtatcaagcagttaggcaacgaggctcaggcacacgagttggtgcaggagaccatgagtaacgtctggcgcaaggcgcatctttatgacggcgacaaaggcgcggccaccacttgggtctataccgtgatgcgcaacgccgccttcgatatgcttaggcgcgtcaaggccaaggccgagatgaacctgggtgacgatatctggccattggaacaggcgcaggtccagagtgaggaggagccgctacattttgccgatcatctgatggagaagcagatgctggcctatgtcgacagcctgcccgaggcccagcgagccgtggtcaagggcgtctactatcaggagctctcccaggagcagttggcccagcaatttggcgtgccaatcggcaccattaaatccagactcagacttgccctggcaaaactcaagcagcagatgggagaccagcagcatgattaa

SEQ ID NO: 581 - DNA, 663 bp, Shewanella putrefaciens CN-32
atggaaaatattcaatcacaaagccgccaaaatcggtatcataagcacatatcgtccttcactgaatcggctatggatatcgacactaaagctccctgcgtaagtgaaccacaaatagaattgttgtccacattaatgctcaaagtggcaaatcatagagatagagccgcttttggatatttatttacttattttatgcccaaaatccgagcgttcggtctacaaagactcaatcaacaaggacttgccatggatctggtgcaagaaaccatgacgagtgtctggaccaaagctcatctctataatgctgacaaaggttcagttgccacttgggtatttaccatcatgcgtaatcagtgcttcgatatgttaagacgagtccaacataataaggaagatgcctacggtgatgatatttggcctttatgcgatacggccacgagtcaagaaactcaaattgatcataaattaacagccaacctactcaaacatttagataatcttccccttgcacaacgtcaggttgtacaaggtatttatatgcaagaactcactcagcaagaattggctgacgccctagaagtcccgataggaacaataaaatctcgcctaagattggggctagaaaagctgaaaagctttttggagacaccaaatgattaa

SEQ ID NO: 582 - DNA, 507 bp, Rhodobacter sphaeroides ATCC 17025
atgcgtgcgatccgggatcatcgggacgaggcagccttcgcggagctgttccagcacttcgcgccgagggtgaagggcttcctgatgaaatccggcagcacggagtcacaggccgaggaatgtgcgcaggatgtgatggcaacggtgtggcagaaggctcatctcttcgatccgtcgcgggcgtcggccgcgacctggatcttcacgatcgcgcgaaaccggcggatcgacgggctgcggaaatcgcgccagccagagcccgaggatctcttctgggggccggacgccgagcccgatcaggccgacgtctatgaaatgcagcaggagaacgaccgcctcggccgcgcgatcgccctcctccccgaggcgcagcgcgcccttatcgagcgcgccttcttcggcgacctcacccaccgggaacttgcggtcgagaccgggcttcccctaggcaccatcaagtcgcgcatccggctcgcgctggaacgtctgcgccagcacatgagttga

SEQ ID NO: 583 - DNA, 585 bp, Vibrio cholerae O395
atgtttaatccatcacctcatacgtttggccgccaagagtggctagagtgtatggaaaaagttaaaagcagggacacacaggcttttgctctggtatttagctattactcgccgaaattgaagcagtttgtgatgaagcatgtcggtagtgaacaggtagcgttggaattggttcaagaaaccatgtcaaccgtatggcaaaaagctagtctgtttgatgggcagaaaagctctctcgcgacttggatttacaccatagcgcgtaacctaagttatgacttgttacgtcgacaaaaggggcgtgacgcttatgtgttggccgatgatatttggccggaagattattgtcctcctgatctggttgatcactacgcaccggaacaagatctgctcaaagagcaggtgatgaaatttctcgaccgcctgccagaagcacagcagcaagtgatcaaagcggtctatttagaagaaatcccccagcaagatgtggccgatatgctcgacattccactcggcactgtgaaatcacgtctacgtcttgcggtagaaaagttaagattatcaatggatgcggagtccttatga

SEQ ID NO: 584 - DNA, 546 bp, Bradyrhizobium BTAi1
gtggattgggcggaattgatcggacgcgtcgccgaacgcggcgaccgtgaggcgttcaaggccctgttcgagcactttgcgccgcgcatcaaaggcttcctcatcaagtccggctgcaatgccgacgaggccgaggagattgcccaatccaccatggtcgcggtttggaccaaggccgggcagttcgatccgtcgaccgcaggcgctgccgcctggatcttcacgattgcgcgcaatcagcggatcgatgtggcccgcaaggccatccgcgagggccggctgagcaaggaaatcgtgctcgacgacgaggctgatccgacgctcgccgccgaccagatcctgtcgcgtgtcgaagatgccacacgcgtcgaggcggcgatcgaaagattgtcggtggagcaatccaccgtgatccggctgtcgttcatcgaggaacgaccgcattcggaaatcgcggccgtgcttggactgccgctcggaactgtaaaatcacgaatcagactggcgatgaaccgcctgagagacctgttggacgacgcgacatga

SEQ ID NO: 585 - DNA, 576 bp, Marinomonas MWYL1
atggaacgcgcaatacaaatagaaccagatgaacaacgcgtagcagatatgcttgctattgcggagcacagagatcaagccgcgctcgctcgcctgtttgattactatgttccgaaattaagagccttctgtctcgcagcacaacctggcgccaatttaatggctgatgatattgctcaagaagtgatgattcgcatctggaataaggctcatacctacaaaccggaatccgcatcgttgaatacttgggtttttacgctagcaagaaacgcacgtattgattacttgcgtaagaacagtcgtcatcagtctgatattgaccctgagtatctttggcaaaatgtggtcgatgaaaatgccgatccattcaaagatgcccaacaaaaaagagatcaggaacgcatccagcaaggcttagataaattgccagcggatcaaaaacaggttttggccaaagtctacttagaaggcaaaacccacaaagaagcagcagaagagctatctcttccacttgggacgattaagtctcgagttcggcttgctttgcacaaactcactatttacgttaagaggtag

SEQ ID NO: 586 - DNA, 663 bp, Shewanella baltica OS185
atggaaaatattcaatcacaaagcaggcaaaatcggtatcatggccctatcacgtctctgactcattcggctatggataacgacattcccgctctcaaaacctgcgagcctcaagcggatactttgatcacgtttatgctacaagtagctgacaaacgggacagagccgcctttgggcatttattccagcattttatgcccaagatccgcgcctttggtttacaaagactgaatcaacaaggcttagccatggatttagttcaagaaaccatgaccagcgtgtggactaaggcccatctgtacaatgcagagaaaggctcagtgacgacttgggtatttaccataatgcgtaatcagtgtttcgatatgctgagacgagtacaacacaataaagaagatacctttggcgatgatatttggccgctgtgcgatgcgaccatggctcaagacacactcactgatcataaattgacggcgaaactcctccaacatcttgatgcccttcccctagcacaacgacaagtcgtgcaaggtatctacatgcaagaactcactcaacaagagctagccgatgccctcaaggtaccaataggcaccataaagtcacgattaagactcgggctagaaaagttgaaaagtttcttggagacacacaatgattaa

SEQ ID NO: 587 - DNA, 669 bp, Parvibaculum lavamentivorans DS-1
atgcgaacgaaacacgcagtgcagatcggaccggctcgcgccggccgccaaatgtggcggccgaacctgaggaagctaggcctgatggatgaaggaaaggcgcccgcagaggtgtcgccgggaggtgccgaagagatggccgggctcatcgccgccatcgcccttcatggcgaccgcaccgcctttgcgcggcttttcggtcattacgcgccgcgcgtgaaatcctatctgcggcgcctccgcgtcgacgagcggctcgccgaggatctcgcccaggaagtcatgttgacggtctggcgcaaggcttcgcagttcgacggaaccaaagcctccgccggcacctggatattcaccatcgcgcgcaaccgtttcatcgacacggtgcgccgcgagcgccgcccggatttcgatccgtcggatccgatgctgcagccggaagaagcccgccccgccgacgaggaaatggcgggcgccgagatcggccttcgggtccgcgccgcactcgtcaccctgccgccagatcaggcggaagtcgtggagctgtccttcctcgaaggtctgccccattcggccatcgccgagcggctcgatattccgctcggcaccgtgaagtcgagattgagattggcgtttgcgcgtttgcgtccggcgctggaggatctgaaatga

SEQ ID NO: 588 - DNA, 693 bp, Xanthobacter autotrophicus Py2
atggatgtcgccgagcccagcctgtttgctctcccgctccccccgtcgcaccgggcgggtacgcctgtcggcgtccggccgcgcgggcggtttgcggtcccgccggccggttcgccggccatgagcgccgtccaacccgagcgccgagcgggcgctgacatgagcgctctggtcgtagccatcgcgcgcaccggggaccgtgaagccttcgcacagctgttccgccatttcgcgccccgggtgaaggcgttcctcatgcgcagcggcctttccgccaacgcggcggaggagctggcgcaagagacgctgctgatggtgtggcgcaaggcgtcctatttcgacccggcccgcgccgccgcctccacctggatcttcgccatcgcccgcaacctctccatcgacctgaagcgccgcgagcgccacatcagcacggtggatgcggacgccgccgacgaggaggccgacgagacctccggcgaaaccatcctcatgggcgccgagcgcgatgcgcgggtgcgggcggccctcgccaagctctccgaggagcaggccaccatcgtccggctctcctttttccaggagaagccccattcgcagatcgcgcaggagctgggcattccgctcggcaccgccaaatcgcgcgtccgcctggcgctgagccgcctgcgcacgctgctggaagatttgaaatga

SEQ ID NO: 589 - DNA, 585 bp, Vibrio harveyi ATCC BAA-1116
atgatgagtgaaagcccacaaaagctcgggcgaagcgaatggaacgattatatggacaaagtgaaagcgcgagacaaagacgcttttgccttcgtatttcgtttttatgcaccaaagcttaagcagttcgcctacaaacatgttggtaatgagcaagttgcaatggaaatggtgcaagaaaccatggcgactgtttggcaaaaagctcatttatatgacggcacaaaaagtgccttgtcgacatggatctataccattatccgtaacctttgcttcgaccttttaaggaaacaaaaaggtaaggatttacacattcattctgatgacatttggccgtcagactactacccacctgatttggttgaccattattcacctgagcaagacatgctcaaagaacaggtagtcaaatttttagacatactgccgaaaaaccaaagagaagtactccaagcggtgtaccttcaagaacttccacaccaacaggtcgcagagttgttcgacatacctttgggtaccgtgaagtctcgcttgaggctagcggttgaaaagctaaggcattcgatgcacacggagcaattatga

SEQ ID NO: 590 - DNA, 570 bp, Dinoroseobacter shibae DFL 12
gtggcactggcgcacaagacgacgatggagcggcccctcgacatggaatgggtctcggtcatgctggccattcgcgaccggcaggatacggctgcattcgcgcgcctgttccggcacttcgcgccgcgcatcaaggccttcctgatcaagtccggcgcctccgacaccctggccgaggattgcgcgcaggacgtcatgaccacggtctggcagaaggcgcatatgttcgatcccagccgcgcgagcgtagccacctggatcttcaccatcgcccggaaccgccggatcgacatgctccgcaaggaacgccgcccggaaccagaggagcttccctggggtccggaacccgagcccgaccaggccgatgtcctcatgcttcaacaagaaagcgaaaaacttcaggccgcactgatccagttgcccgagaagcaacgtatacttgttgaacgttgctatttcggggatatgtcccacagcgagattgcaacccaaacgggtttaccccttggcacgatcaagtcgcgacttaggttagcgctggacaagctgaggcatgaattaaagcagtag

SEQ ID NO: 591 - DNA, 663 bp, Shewanella baltica OS195
atggaaaatattcaatcacaaagcaggcaaaatcggtatcatggccctatcacgtctctgactcattcggctatggataacgacattcccgctctcaaaacctgcgagcctcaagcggatactttgatcacgtttatgctacaagtagctgacaaacgggacagagccgcctttgggcatttattccagcattttatgcccaagatccgcgcctttggtttacaaagactgaatcaacaaggcttagccatggatttagttcaagaaaccatgaccagcgtgtggactaaggcccatctgtacaatgcagagaaaggctcagtgacgacttgggtatttaccataatgcgtaatcagtgtttcgatatgctgagacgagtacaacacaataaagaagatacctttggcgatgatatttggccgctgtgcgatgcgaccatggctcaagacacactcactgatcataaattgacggcgaaactcctccaacatcttgatgcccttcccctagcacaaagacaagtcgtgcaaggtatctacatgcaagaactcactcaacaagagctagccgatgccctcaaggtgccaataggcaccataaagtcacgattaagactcgggctagaaaagttgaaaagtttcttggagacacacaatgattaa

SEQ ID NO: 592 - DNA, 630 bp, Caulobacter K31
atgcatgtcgggacctcgtcattcacgtcgcaagctcgtcggtctctccgcgtgacctccccggagccagagcgagatccgctgatccacgatcgcttgatcgaggcggtggcgctgcggcgcgaccgcgaggccttcgcccagctcttcagctatttcgccccccgccttaaggcctggctgatcaagtccggggccgcgcctagcgcggccgaagacttcgcccaggacgccatgctgaccgtctggcgcaaggcgagcctcttcgattcccgcaaggcccgggctgcgacctggattttcaccatcgcccgcaaccgtcgcctcgacatgttgcgccgcgacgcccgtcccctgccgacgcccgagatcgaattgaccggcgaagccgttccccgccccgatgacgtcctgtcgatgtccgaggacgctgaacgggtgcgcgaggccctgtcgcgtctcgacccccaacagttggaggttctgcgccacgccttcttcatggaaagccctcactccgaaatcgcccgtcacctcaacctgcctctgggcaccgtcaaatcccgcattcgcaacgccatgatcaaacttcgcctcatcctcgaaccgtcgcaggaggcgtctcgatga

SEQ ID NO: 593 - DNA, 651 bp, Shewanella woodyi ATCC 51908
gtgctggaaaatgagtacaccaatatgcagaaagtcgaggggatccgacacattgtcgaggtcaataatatcatctctaaacaaacacaagagcaggttcctactgagctaagtgcttggatagtgctagttgccactaagcgcgataaacgtgcatttactgctatttttactttttttgcccccaagattaagcgctttggcattaagcagctcaacacggacgccatggcggcagagctggtgcaggagacgctatcacgtgtatggaacaaagcgtccctttttgaccctaataagggcgctgcaaccacatgggtttatagcatcatgagaaatgccgctttcgatatgttgcgaaaaattaaggttaagaatgagctgttacttggcgacgatatctggccaattgaagccgaagagtatagcaccagtgaagagttctctgatcatttgatggacaggcagatagctgattatgttgatcagttaccagaagctcaaaagttagtcgtcaaaggggtatattttcaagaattatctcaagagcaacttgctaaacagctcaatattccaattggtactgttaagtccagattaaggttagcccttgctaagttaaaagagcaggtaggagagtcacatgattaa

SEQ ID NO: 594 - DNA, 588 bp, Rhodopseudomonas palustris TIE 1
atggatcaattgcgcgacggtccacgcccgccctcggcggagatggcggactgcatcgtccgcatcgcggtcgcgcaggatcgcgcggcgttcgagacactgtttcgccacttcgcgccgcgcctgaaatcgtacttcgcgcggcgtggcggcgatccgacactggccgaagagatcacccaggagacgatggtgtcggtctggcgcagtgccgcgcagttcgacccggccagagcctcggcctcgacctggatcttcaccatcgcgcgcaatctcagcatcgaccggctgcgccaggcgaagcggccgggcttcgatccccatgatccggcgttcgtgcccgacgaggaggagccgcccgaccggcggctggagcgcaccgaaactgagcagcgggtgcgcgaggtgatggagacgctgccgttcaacgagaagagtgttttgatgttgtcgttctacgaaaaccaatcgcatagcgagatcgccgagcagctcggcctgccggtcggcacggtgaaatcacggatccggctcgccttcggcaaactgcgcgccgcgctcgacaccaccgccggagagccgcgatga

SEQ ID NO: 595 - DNA, 624 bp, Stenotrophomonas maltophilia R551 3
atgtaccctgacgccgccagccccgccttcaacttcgatagcgtacgcatcgtgtccagttcccagcagccgagcagcgagccgacgaactgggccggtgacatggacggtgtggcgcggctgcgcgaccgcgattgcttcatgcgcatctacgatcatttcatgccgcgcctgtgtgtctatctgcgcggtctgggtgcgcccgaggcagtggccgaggagctcgcgcaggagtgcctgctgcggctgtggctgcgcgcagccgactacgacccggcgcaggcagcgctgagtacctggctgtaccgcatcgcgcgcaacctgcatatcgaccgggtacggcgtgagcgcagctggatacaggtgcaggccgcggtggagtacgcagcgacggcagacgtggtcgagcgcagcagcgccgagcagttcgctgaccaggcccggctgcgccagcgcatcaatgagctgcctgcggtgcaggcgcgcctggtccgcatgtcctatttcgaggccaagagccacggcgagatcgccgaagcgctgggaatgccgctgggcacggtcaaatcgcatctgcggcgcgcgttcctgcagttgcaatccaaggtggggggcgcgctgtga

SEQ ID NO: 596 - DNA, 612 bp, Alteromonas macleodii  Deep ecotype
atgttagttggaattcctttggaacaaagtaacagcacaatcaaacctaaagagtgtgctactgaaatgtctgattacctagtcgcggttgcagatgctcgatgcaagcgttcatttgctcgagtgttcaactattttgccccacgtttgcgctcttatgcccttaagcagatggggaacgaagcactagcaatggagcttgtacaagacaccatgtcaaacgtttggcaaaaagcgcatttgtttaatgctgagaaaggctcgccttctacgtggattttcactattgcacgtaacatacggtttgacatgttacgcaagcttcaaaatagaaaagaggacgtgtgctctgacgacctgtggcctgtgttatgtgagcagacggcagatgtgaatgaggcgccacttgacgagcaagtaactctagagcaaattggctatatgtttgaatcacttccggttaaacaaaaggcggtggtagaagctatctatattgatggcaaatctcagcaagaagtcgctgacgaactttctattcccttaggtacagtaaagtcaagaactcgcttagcgcttcaacgattaaaggtcatgttaaacgataatgattag

SEQ ID NO: 597 - DNA, 663 bp, Shewanella baltica OS223
atggaaaatattcaatcacaaagcaggcaaaatcggtatcatggccctatcacgtctctgactcattcggctatggataacgacattcccgctctcaaaacctgcgagcctcaagcggatactttgatcacgtttatgctacaagtagcagacaaacgagacagggccgcctttgggcatttattccagcattttatgcccaagatccgcgcctttggtttacaaagactgaatcaacaaggcttagccatggatttagttcaagaaaccatgaccagcgtgtggactaaggcccatctgtacaatgcagagaaaggctcagtgacgacttgggtatttaccataatgcgtaatcagtgtttcgatatgctgagacgagtacaacacaataaagaagatacctttggcgatgatatttggccgctgtgcgatgcgaccatggctcaagacacactcactgatcataaattgacggcgaaactcctccaacatcttgatgcccttcccctagcacaaagacaagtcgtgcaaggtatctacatgcaagaactcactcaacaagagctagccgatgccctcaaggtgccaataggcaccataaagtcacgattaagactcgggctagaaaagttgaaaagtttcttggagacacacaatgattaa

SEQ ID NO: 598 - DNA, 759 bp, Agrobacterium vitis S4
gtggattgccgggagtggaatttttttagggcagtgatccagttttcgcaagaaggcgtagaaagccccatgacaataatcatttcccaagcggctctggaatgccacaataagagagtgacggccccgcgccttttcaggcgcagccggttgggtgggagatccgtgccttctggcgcaaacgggatgattatgaaggctgaaaccgaagacatgtcttccatgctcgcagccgttgctcgcgaacgggatgtggaagcattcgaaacattgttccgccattacggtccgcgcgtaaaggcctatatggctcgccaggcgcgtgaccagcaggcggcagaggaattgatgcaggaaaccatgatggtggtctggaacaaggccgcattattcgatccgacccggggcaatgtctccgcctggatctttaccattgccagaaatctgcgggtttcggcctatcgcaagcagaaccggccggaattcgacccgaacgacccggccttcgtgcctgacgaggtgatgccagccgacaaggatctggaaaaccgccaggatgcggaaaggctgcacaaggccatgggacaattgccgcaggagcagttggaactgttgcaacggtccttctttcacgaaattccgcacagcgcgcttgccaaagaattcaatctgccgctcggcacggtgaagtcgagaatccgcatggcctttgccaagcttcgtgccacccttgaagaccgctcagaggaggatcgctga

SEQ ID NO: 599 - DNA, 492 bp, Clostridium perfringens SM101 uid12521
atgaatcttaatgagattaaagagcttatagataaaatcgattcttctaatattgcttattttgaggttaaagtagataattcatatataaagatggataaatctctaactagaaatttagtggaagaaaaaaaagcttcaaatatagaagaaacagaaaaaactgatatatcagaagaaaaaaatgaatcaatttcaaaggttgaggaagtaaaattacaacctaaagaagagagagttcaggatgaagacttatatttagttacttcacctatggtagggacattctatgaatcacctggagttggagaaaagagttatgtttctataggaagcaaaatttcttcaggagatgttttatgtatagttgaagccatgaaacttatgaatgaaattgaaagtgaagtatctggagaaattattgatatattagttcaaaatggaaatatggttgaatatggtcaacccttatttaaggttaggagagcataa

SEQ ID NO: 600 - DNA, 501 bp, Streptococcus agalactiae 2603
ttggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaatga

SEQ ID NO: 601 - DNA, 492 bp, Clostridium perfringens ATCC 13124
atgaatcttaatgaaattaaagagcttatagataaaatcgattcttctaatattgcttattttgaggttaaagtagataattcatatataaagatggataaatctctaactagaaatttattagaagaaaagaaagcttcaaatctagaagaaacagaaaaaactgatatatcagaagaaaaaaatgaatcaatttcaaaggttgaggaagtcaaatcacagcctaaagaagagataattcaagatgaagacttatacttagttacttcacctatggtaggtacattctatgaatcacctggagttggagaaaagagttatgtttctataggaagcaaaatttcttcaggagatgttttatgtatagttgaagcaatgaaacttatgaatgaaattgaaagtgaagtatctggagaaattgttgatatattagttcaaaatggaaatatggttgaatatggtcaacccttatttaaagttaggagagcataa

SEQ ID NO: 602 - DNA, 507 bp, Oenococcus oeni PSU-1
gtggacgaaaaaactattaaagatctaattgaacagatcaatcaaagttcgattcgtgaatttgatttaactgttgacggggttcgtttatatttgtcgaaaaacaaaaataatcgtgaaagttcaacttctaaaacagctgataaaccagcttcctcggcacaagttcctttggattctaacaactccgattctaatgatgaagtttccgaggcagacaaaggaaaagctaaagccaaacaacaagaggacgaaaatacgagcactattaactctcctttagttggagtggcttacttgcaggccaatccagatgcagagtcatacgtaaaagttggcgatcaggttaaggctggcgatgttgtctgtgttatcgaggcaatgaaaatgatgactgaaattaaaagctcggtcagcggcacagttgccgaaattttaattgataacgaatcaatggttgattatgatcagcctttaattaaagtacacacggaggcaaagaaatga

SEQ ID NO: 603 - DNA, 459 bp, Leuconostoc mesenteroides ATCC 8293
atgagtttaaatattgaggaaattcgtggattaattgctgatttagagaacagttctttacgcgaattcaaagttgttgatggcgaattcagtttgcatttatcaaagaacaaaaatgaagcagtcgtgaacgcgccagttcaaactccagttgttgctcctgccgctgttacatcagatcaagctcaagtagctgcagaacctgaaacgcttaaaacaggaactgaaattgttgctcctatggttggaacagtatatttgcaaccaaaacctgatgcaccaatgttcaaacaagttggtgataaggtctcagtgggagaaacagttgctgtgattgaagcgatgaaattaatgacagaaattcatagtgaagtcagtggaacagtagccgaaatactagttgctaacgaagaagtagtagactacaataagccactctatagaataacaacagattaa

SEQ ID NO: 604 - DNA, 468 bp, Lactococcus lactis cremoris SK11
atgaacatttcagaagtaaaagatttgatgaaccaattcaatggttctactttacgtgaattttcttggaaaaatgctgacggcgaattatcgttttcaaaaaatgaagggcaagcccttgttggtcctcaaagttccgctcctattgcagctgcttttacagctcaacaagctgcgccagttgcagaaagcacagaagttcccgtggcaaatgaaatagccgtagaagctgaaggtgaagcagttacttctccattggtaggtgtggcttatcttaaaccttctccagataaagctgaatttgctaaacttggagatacggttaaaaaaggtcaaaccttgcttattattgaagcaatgaaggtgatgaacgaaattccagcaccaaaagatggaattatcactgaggtgatggtttcaggagaagatgttgttgaatttggtcaagatttgatgagaatcaaataa

SEQ ID NO: 605 - DNA, 489 bp, Streptococcus thermophilus LMD-9
atgaatatttctgaaattaaagatttgttggctcaatttgatgcctcaactttgcgtgaattctcatataaaaacaatggagaagagttgaacttgagtaaaaatcaaacaagttcagtaactacttctccagtagctcctacagttgaagtggttgcgtcatctcctcaggttccagttgctccagtagcagcacctgccgctgttgaaactccagcaacaccagttgaagaagcttctgctcaagctgctgaaggtgaagtggttgaaagtccacttgttggtgtggcttacttgtctccatcacctgaaaaaccagcctttgtttctgttggtgatactgttaagaaaggtcaaacgcttcttatcgttgaagcaatgaaggtgatgaatgaagtaccagcacctaaagatggtgttattactgaaatcttggtagcgaatgaagaagttgttgactacggaaaaggattggtacgcatcaaatga

SEQ ID NO: 606 - DNA, 453 bp, Lactobacillus reuteri DSM 20016
ttggaatttaaagaaattcaaacattaatgcaatattttgaagattctgatattcgtgaattagaaataaatcaagattcctttcagctctatttaagcaaaaataagcaaactcacaagcatgaagatcttataacaaccgaaaaaacagagcaaacgacttcagttaagaaaaaagcaaacgaacaaccaactttaccttcgcaaaatataactgcgcccctagttggaactgtctatctccaaccaacccccgatgcagatccctatgttagaagtggcgaccatgtaaaaaagggggatgttgtttgtgtgattgaagcaatgaaaatgatgacagagataaaaagcccttttaacggaatcgttacttcaatttgtgtaagcaatgaagaattagttgaagtagaacaaccacttttctcagttcaggaggataaagataatgactaa

SEQ ID NO: 607 - DNA, 432 bp, Clostridium phytofermentans ISDg
atggaaattaaagatattattgatttgattgaggcagtatcttcttcgaagttaacttcttttacttatatagagggagagacaaagctctcttttgaattaaatcatgaattactgataacggatgcttctaaggtagtagcagctactgcaattagcgaacaagattgtattttaaaagatacagttccatgtaatattattacttctccgatggtaggaacattttactgtgctaagggagaaggggaagaacctttcattcaagttggagataaggtcataaaagggcaagttgttggtattgtcgaggctatgaagcttatgaatgaaattgagtctccatatgatggttttgtagaagaagttttagtgaaaaatcaagaaatggttggatttgatcaaaaactagttcgtatccgtccattatag

SEQ ID NO: 608 - DNA, 435 bp, Slackia heliotrinireducens DSM 20476
atgcatgacgagaagatccgcgcgtatgcggaaatcatggacgaaatgggacttaccgggctggaagttgaagaaggcggcgcgaaaatccgcctcgaacgcggcgtcccccaagccgcggctcccgtcgtcataacccagcaggggcttgccggcgacggtgcggcagatgcggagtccgccaccccgaagggcgaactgtactcggttcgctcgcctctcgtgggcgtgttctacgtggccccggccgaaaacgccgaaccgttcgtcatgcccggcgatcgcgtgaagaagggtcagacgctctgcatcgtcgaggccatgaagctcatgaacgaaatcaccgccgaagaacccggcgttgtcgagaaggtttgcgtgaccaacggccagatggtcgaatacggcgccgagctgttccagataagaaggtaa

SEQ ID NO: 609 - DNA, 588 bp, Jannaschia CCS1
atgtatacaaatgacgcgagggcaggcctaattgcgctgggtgcaaacctgccttccggcggattgccgccggaaatcagcgtaccgaaggcaatggcccggttggtggagcgagtgggcggcccccacagtcaaagccgcttgtttcacacgcctgccttcccgccggggtcggggccgcaattcgtcaatgcggctgtaaagatcgagtggcgcggccatgccggggaacttctggccctgctccacgagattgaagaggaatttggtcggacccgcgcccatcgttgggaggcgcgggtgatggatctggatctgatcggcctgggcgatgcgatcctgccggatgcggccacgcgggccaattgggcgaatctgccgccggagcgggcggcgcaggtggtgcccgatcagctgattctcccccatccgcgtttggcagagcggggattcgtgctggtgcccctggccgatatcgcgcccgaatgggtggatccggccaccggcctgaccgtggccgagatgctggcggcgcgtccccatgccgagctggcggggatccatccggtgcctgtcgcagcggaataa

SEQ ID NO: 610 - DNA, 570 bp, Ruegeria sp. TM1040
atggccgaaaaccggtcaacttatcttgtggctatgggaagtaacctcgaggatgagggtactataccattagaaatcctgcaaatgtgccttgcggagttatcgggcgaaggtttcgacctagtggctgtttctcgtttctatgcaacgccttgctttccagcgggcgccgggcctgattatgtgaatgcggcaattgtattgcgcggcgctttttctgcggacgagacattgcgcagacttcacaaaatcgagaccaagtttcaccgcagaaggcaacagcgctggggcatgcggacacttgatctagatcttttggctgtggatcaggaaattgcgcccgatattcagacgtttagccattggcactcgctgcctcaaagcgagcagaggacgaaagcacccgagcatttgattctgccgcacccgcgtgtgcaggaccgtgcgtttgtgcttgtgccgcttcgggatattgccccagactgggtgcatccggttctcgagctgagcgtccgggagatgctgaaacgatgtccggcctctgatgtggccgaggtgcgcgccctctga

SEQ ID NO: 611 - DNA, 486 bp, Rhodospirillum rubrum ATCC 11170
atgatctatatcgctctcggcgccaatctggccggtccggccggctcgcccagggatacacttgacgcggcgttggtcgcccttgaggacgccggagtggtggtcgccgcccgctccgcctggtatcggacgagcccggttccaccgtccgatcagcccgattacgtgaacggcgtggcccgtctggtcaccgacctcgaccccgtcgccctgctcgggctgcttcatcgccttgaggatcaattcgggcgtcggcgcggcgagatcaatgccgcccgcacccttgatctcgatttgcttgattatgacgagctgcgccggaccggggcgccgccgctgctgccccatccgcgcatggccgagcgcggtttcgttttattccccttgcgcgagatcgcgcccgactggcgccacccggttcttgaccaaccgatcgacaccctgatcgccgcccttgccgccgatcaggcggcggaacgtttgtaa

SEQ ID NO: 612 - DNA, 537 bp, Rhodobacter sphaeroides 2 4 1
atgccatctgcgggaaggttcccggagggcaacgtttccgaggcgatttctgcggttgcgagcgcatttcaagccccatttcgggtgagcaggctgttcaaaacgcccttttttcccgcgggcgcagcccctgattttgtcaatgcggccatggctctgcaccttacggatgatgtcgatccccgcaagatcctcgcacggctgcacgagatcgaggcggattttggccgatcccggtcgcacagatgggccgaccggacgctcgacctcgatctcatcgccctggatgattcggtctggcccgacgccgacacccaggagcggtggaggcaccttcctcccgaggagcaggcccgccgcacgccggacgggctcatattgccgcacccccgacttcaggaccgggccttcgtgctcgtcccgctggccgacgtggcgcccgactggcgccatccgctgcttggcctgacggtgagagagatgctcgcggcgctgcccgaggcggagcgggccgctgccgtgccgctcgaggcttga

SEQ ID NO: 613 - DNA, 573 bp, Maricaulis maris MCS10
atgaatacgggaaaacaatctgcgccgatatatatcgcgctcggggccaatcttccactgggcgagtggagcccgcgtgagacccttgcccgggcgcggatcgccctggcagaggcgggtctcggtatcgtgtcggcgtcctcggactggcatagcccggcctggcccgacccgtccgagccgccctatgtcaacgccgttgccgagattgcctcggaccagtccgcccgggccatcctcgaaaggctgcacgccattgaagcgactttcggacgcaagcgcgccgtgtgcaatgagccgcggccgctcgatcttgatctcattgattgtcggggcgagcggacagacgcgccggacgggttggtccttccccatcccagggccacgtcacgagccttcgtgttactgccactggccgagattgcgccgggctggagcgacccggtgagcggacagtccatcattgatctgatcgccgcattgccgcaggcggatcgcagcgcaacatacaagctgcaagagagcggaaaactctcacccgaccaccttgcttttgaagggcgaggggattag

SEQ ID NO: 614 - DNA, 492 bp, Paracoccus denitrificans PD1222
ttgtccaacatattgaaattacctgcggttgtgccggtcgccgtcagcagattctggtcaacgccggcttttcctgccggttcgggtcccgaatatgtgaatgcggcggcatcatttcgctgcgatcttccgcccgaacaacttctgcacgaattgcacatgatcgagaaaatattgggccgcagccgcgaaggccggcgctggcaggcacgcgggctggacctggacctgctggcccatggcgatctggtcctgcccgatgccgcagagcaggaccattggcgcagcctgccgcctcaagaacagccgctgcgcgcgcccgaccggctgatcctgccccatccccgcctgcaggaccgcggtttcgtgctggcgcccctggccgagatcgcgccgaactggatgcatccgcgcctgggacgcagcgtggcgcagatgctggccgccctgccgcccgaggctttggcggggattcggcctgcaagtgcttga

SEQ ID NO: 615 - DNA, 537 bp, Rhodobacter sphaeroides ATCC 17029
atgccatctgcgggaaggttcccggagggcaacgtttccgaggcgatttctgcggttgcgagcgcatttcaagccccatttcgggtgagcaggctgttcaaaacgcccttttttcccgcgggcgcagcccctgattttgtcaatgcggccatggctctgcaccttacggatgatgtcgatccccgcaagatcctcgcacagctgcacgagatcgaggcggattttggccgatcccggtcgcacagatgggccgaccggacgctcgacctcgatctcatcgccctggatgattcggtccggcccgacgccgacacccaggagcggtggaggcaccttcctcccgaggagcaggcccgccgcacgccggacgggctcatattgccgcacccccggcttcaggaccgggccttcgtgctcgtcccgctggccgacgtggcgcccgagtggcgtcatccgctgctcggcctgacggtcagagagatgcttgcggcgctgcctgaggcggagcgggccgccgctgtgccgctcggggcttga

SEQ ID NO: 616 - DNA, 537 bp, Rhodobacter sphaeroides ATCC 17025
atgccgtttgcgggagggttccccgagggaaccgttcgcgaggcgattgctgcggtcgcaaaggcgtttggtgccaattttcaagccagcagactctatcttacccctttttttcctgcaggtgacgcaccggattttgtcaatgcggccatgacactgcacctatcggatgaagtgggtccagaggcggttctgcgccgcctgcatgaggttgaggcggatttcggccgatcgcggtcgagacggtgggcgagccgcaccctcgacctcgatctgatcgcgctgggtgattcggtctggcccgacgccgacacgcaagggctgtggagaaacctgccccccgaagatcaggcccggcgggtgcccgatggcctgatcctcccccatccccggcttcaggatcgcgccttcgtcctcgtgccgctcgccgatgtggcgccggaatggcgtcatccgctgctcggccgcaccgtcctcgagatgctggcggcgcttcccgcggccgaccgggcggcggtggtgccgctcgaggcctga

SEQ ID NO: 617 - DNA, 417 bp, Acidiphilium cryptum JF-5
atgcagaaaattgagacaattcaccttgaggctgtctcatcctggtatcgcacgcgcccggttccgcctgatccgacgcaaccggatttctgcaatggtgtcgtccggttttcgggagcgcctgatcccgttgcgctgctcgaggcactgcacgagatcgaggctcggtttggccgcgtccggtcggttccgaatgcggcacgcacgctggatctcgacctgatcgacgtgaacgggatggtgcgggagaccgggtcgccgatcctgccgcatccgcgcgctcatctgcggacattcgtgctccggccgctgcttgatgtcgcgcctgattgggtgcatcctctgctgctacgtccggcaagggaattgttctccgcgctgccggaacgtgcggaaggcgaaatccgcctctggtag

SEQ ID NO: 618 - DNA, 564 bp, Parvibaculum lavamentivorans DS-1
atgatgtctgatatcaggccacatattcccggcattcttgtggcactgggcggcaacctggccaccgtgcatggcagccccgtgaagacgctggaggctgcgctggcagtgatgcccgggttcggcattcgcgtcgtgaaatgtgcgcatctatacaagacgccggcgctttcctcttatgtacagcctgattacgttaattctgtcgtctccatcgagacggccctgccgcccgcggatcttctcaatatcctgcaccggatcgaagctatcttcggccgggtgcggcgggagcgatgggcgtcccggcccctcgatctcgatctgctggactaccggggaatgattatgccggctgcgggaccccgtggcgccgatgcgggagcgggaaaattgccgcttgcgctgccgcatccgggaatcgcgctgcgaggcttcgtgcttctgccgctccgcgatgtggcgcctgaatggcggcacccggtaacgggagaaagtgtcgaccgcttgattgccgcattggggcccggtggtctggccggaattgagcggacgggtagttga

SEQ ID NO: 619 - DNA, 570 bp, Dinoroseobacter shibae DFL 12
atgaaaattcagtcattcggcataattgcgcttggcgcaaatcagcccctcggcgggcgcacgcccaaggtgaccttgcgtcaggcctgcgaggcgttggcggacgcgccgttggaaatcgttgcgcgcagccgatttttcgccacgcccgcgtttccggatccgtcgcaaccggagtatgtcaatggctgtgtgaccgtggaaaccgggctcggtgccaaggcgcttctgaaggtgttgcacgatgtggaggacaggcttggccgtgcgcgcgggcagcggtggggcgcccggacgctggacctcgatctgctggcgctgggggcgcaggtcttgccggacatggagacctatgcccagtggcgcgacctgccgcgcagcgcgcaggtggcgcgcacgccgaatgagttgattctcccccatccgcggatcgcggaccggcccttcgttctggtgccgctgatggatgtcgcaccgctctggcggcacccggtgactggcaaaacggcctcggaaatgcttcggaacctgccgaaatcggaaatagatgccattcgaccgcttgagtaa

SEQ ID NO: 620 - DNA, 498 bp, Gluconacetobacter diazotrophicus PAl 5 JGI
atgatcctgatcgcaataggcgccaacctgccgcgcgccgaggggagtaccccgctggagacctgccgctgggcggtggagcacatcgcttccatcccgggggtccgggtcgtggcggtgtcggcctggtacgaaagcgcaccgattcccccctcgggccagccgccctatgtcaacggcgtcgtcgccgcgacgggcgagctggacccggccgtcctgctggcggcgctgcagggaatcgaagcccgggccggacggcgccggacggtggccaacgccgcccggccgctggacctggacatcatcgcgatgggtgacctggtgcgcgacgccccggacccgatcctgccgcacccccgggccgacgcgcgggccttcgtcctgctgccgctgcgcgacgtggcccccggatggcgcgaccccaggtccggccggacggtcgatgcgctggtcgcggacctgcccgaccagcagatccgccggctggaggcggactga

SEQ ID NO: 621 - DNA, 393 bp, Escherichia coli BL21 (DE3)
atggctgaaaatcaatactacggcactggtcgccgcaaaagttccgcagctcgcgttttcatcaaaccgggcaacggtaaaatcgtaatcaaccaacgttctctggaacagtacttcggtcgtgaaactgcccgcatggtagttcgtcagccgctggaactggtcgacatggttgagaaactggacctgtacatcaccgttaaaggtggtggtatctctggtcaggctggtgcgatccgtcacggtatcacccgcgctctgatggaatacgacgagtccctgcgttctgaactgcgtaaagctggcttcgttactcgtgacgctcgtcaggttgaacgtaagaaagtcggtctgcgtaaagcacgtcgtcgtccgcagttctccaaacgttaa

SEQ ID NO: 622 - DNA, 393 bp, Pseudomonas syringae tomato DC3000
atgtcggcgactcaaaattacggcactggccgtcgcaagaccgcaaccgcacgcgttttcctgcgtccgggtactggtaacatctcgatcaacaaccgctccctggacaatttcttcggccgcgagactgcccgcatggtagttcgtcagccgctggaactgaccgagacagttgaaaagttcgacatctacgtcaccgtaatcggtggcggtgtaagtggtcaggctggcgcaatccgccacggtatcactcgcgctctgatgcagtacgacgagacgctgcgcggcgctctgcgtaaagcaggcttcgtgactcgcgatgctcgtgaagttgaacgtaagaaagtcggtctgcgtaaagcgcgtaagcgtccgcagtactcgaagcgttaa

SEQ ID NO: 623 - DNA, 393 bp, Pseudomonas syringae pv B728a
atgtcggcgactcaaaattacggcactggccgtcgcaagaccgcaaccgctcgcgttttcctgcgtccgggtactggtaacatctcgatcaacaaccgctccctggacaatttcttcggtcgcgaaactgcccgcatggtagttcgtcagccgctggaactgaccgagacagttgaaaagttcgacatctacgtcaccgttatcggtggcggtgtaagtggtcaggctggcgcaatccgccacggtatcactcgcgctctgatgcagtacgacgagacactgcgtggcgctctgcgtaaagcaggcttcgtgactcgcgatgctcgtgaagttgaacgtaagaaagtcggtctgcgtaaagcgcgtaagcgtccgcagtactcgaagcgttaa

SEQ ID NO: 624 - DNA, 390 bp, Chromohalobacter salexigens DSM 3043
atgacacagcagtattacggtaccgggcgccgcaagacttccacagctcgggtgttcctgaagccgggcactggcaaaatctccgtcaacagccgcgagctgaacgactatttcggtcgtgtcaccggcgagatggtcgtgcgccagccgctcgagctgaccgagaccactggccagttcgacgtgtacgtcaccgtgaccggtggcggcggctccgcgcaggcgggtgcgattcgtcacggcatcacgcgtgctttgatcgactacaacgaagacttccgtcgtccgctgcgtgacgcgggctacgtgacgcgtgacgcgcgtcaggtcgagcgcaagaaggtcggtctgcgcaaggcgcgtcgtcgtccgcagttctccaagcgttaa

SEQ ID NO: 625 - DNA, 393 bp, Haemophilus somnus 129PT
atggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatatgtcacagttaaaggtggtggtatttccggtcaagcgggtgcaatccgccatggtataactcgtgcattaattgagtatgatgaaacactacgtcctgcattacgtgcggctggttttgttactcgtgatgctcgccgtgttgaacgtaagaaaatcggcttacacaaagcacgtcgccgtccacaatactcaaaacgttaa

SEQ ID NO: 626 - DNA, 393 bp, Enterobacter sp. 638
atggctgaaaatcaatactacggcactggtcgccgcaaaagctccgccgctcgtgtgttcatcaaaccgggcagtggtaaaatcgtaatcaaccagcgttctctggaacagtacttcggtcgcgaaactgcccgcatggtagttcgccagccgctggaactggttgatatggttgaaaaattggatctgtacatcactgttaaaggtggtggtatctctggtcaggctggtgcgatccgtcacggtatcacacgcgctctgatggagtacgacgaatccctgcgttctgaactgcgtaaagctggcttcgtcactcgtgacgcgcgtcaggttgaacgtaagaaagtgggtctgcgtaaagcacgtcgtcgtccacagttctccaagcgttaa

SEQ ID NO: 627 - DNA, 393 bp, Marinomonas MWYL1
atgtcagctactcaatactacggtacaggtcgtcgcaaaacgtctaccgctcgtgttttcctaaaagccggttctggtaacctagttatcaataaccgttcaattgatcagtacttcggtcgtgaaactgctcgcatggttgttcgtcagcctcttgagttggttgatgcaactgagaagtttgatgtttacatcactgttaaaggtggtggtatttctggtcaagctggtgcgatccgtcatggtatcactcgtgcattgatgcaatacgatgagactctacgtcgtactctacgttctgctggattcgttacacgcgactctcgtgaagttgaacgtaagaaagttggtctacgcaaagctcgtcgtcgtcctcagttctctaagcgttaa

SEQ ID NO: 628 - DNA, 393 bp, Escherichia coli HS; identical to SEQ ID NO: 621

SEQ ID NO: 629 - DNA, 393 bp, Escherichia coli E24377A
atggctgaaaatcaatactacggcactggtcgccgcaaaagttccgcagctcgcgttttcatcaaaccgggcaacggtaaaatcgtaatcaaccaacgttctctggaacagtacttcggtcgtgaaactgctcgcatggtagttcgtcagccgctggaactggtcgacatggttgagaaactggacctgtacatcaccgttaaaggtggtggtatctctggtcaggctggtgcgatccgtcacggtatcacccgcgctctgatggaatacgacgagtccctgcgttctgaactgcgtaaagctggcttcgttactcgtgacgctcgtcaggttgaacgtaagaaagtcggtctgcgtaaagcacgtcgtcgtccgcagttctccaaacgttaa

SEQ ID NO: 630 - DNA, 393 bp, Serratia proteamaculans 568
atggctgaaaatcaatactacggcactggtcgccgcaaaagctccgccgctcgcgttttcatcaagccgggcagtggtaacatcgtaattaaccagcgtagtctggaacagtacttcggtcgcgaaactgcccgcatggtagttcgtcaaccgttggaactgaccgacatggttggtaagtttgacctgtacatcaccgttaaaggtggtggtatctctggtcaggctggcgctatccgtcacggtatcacccgtgcactgatggagtacgacgagactctgcgcggtgaattgcgtaaagctggcttcgttactcgtgacgcccgtcaggttgaacgtaagaaagtcggcctgcgtaaagcacgtcgtcgtccgcagttctccaagcgttaa

SEQ ID NO: 631 - DNA, 420 bp, Coxiella burnetii RSA 331
atggcacaagcggcaaaaaagcagaatttgggtacggggcgacgtaagacatcttctgcacgggtttttttaaggtccggtactggtcaaattatcattaatggactgcctttagacgaatattttggtcgagaaacggctcgcatggttgttcgccagcccttggtgaaacttgatgttcaatctcggtttgacgtttacgccactgttcaaggtggcggcgacagcgggcaagccggcgcgattcgccatggtattacccgtgctctcatccagtacgatgaagaaggcggggaaggcggcacgtggcgcagcactttgcgaaaagccgggtttgtcacgcgagatccccgaatggttgaacgcaaaaaagtgggtctgcatggagcgcggcgaggcacgcaattctccaaacgataa

SEQ ID NO: 632 - DNA, 393 bp, Yersinia pestis Angola
atggctgaaaatcaatactacggcactggtcgccgcaaaagttcttccgcacgcgtctttcttaagccgggtagcggtaaaatcgttattaaccaacgtagcctagaagtttacttcggccgtgaaactgcccgcatggtagttaatcagccgctggaactggtagacatggttactaagtttgacatgtacatcactgttaaaggtggtggtatttctggtcaagctggcgctatccgtcacggtatcacccgtgcactgatggagtatgacgagtctctacgtggtgaactgcgtaaagctggcttcgtaacgcgtgatgcgcgtgaagttgagcgtaagaaagtgggtctgcgtaaagcacgtcgtcgtccacagttctccaaacgttaa

SEQ ID NO: 633 - DNA, 393 bp, Escherichia coli C ATCC 8739; identical to SEQ ID NO: 621

SEQ ID NO: 634 - DNA, 393 bp, Yersinia pseudotuberculosis YPIII; identical to SEQ ID NO: 632

SEQ ID NO: 635 - DNA, 393 bp, Shigella boydii CDC 3083 94; identical to SEQ ID NO: 621

SEQ ID NO: 636 - DNA, 393 bp, Salmonella enterica serovar Newport SL254
atggctgaaaatcaatactacggcactggtcgccgcaaaagttccgcagctcgcgttttcatcaaaccgggcaacggtaaaatcgttatcaaccaacgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgacgagtccctgcgtggcgaactgcgtaaagctggcttcgttactcgtgacgctcgtcaggttgaacgtaagaaagtcggcctgcgtaaagcacgtcgtcgtccgcagttctccaaacgttaa

SEQ ID NO: 637 - DNA, 393 bp, Salmonella enterica serovar Schwarzengrund CVM19633
atggctgaaaatcaatactacggcactggtcgccgcaaaagttccgcagctcgcgttttcatcaaaccgggcaacggtaaaatagttatcaaccaacgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgacgagtccctgcgtggcgaactgcgtaaagctggcttcgttactcgtgacgctcgtcaggttgaacgtaagaaagtcggcctgcgtaaagcacgtcgtcgtccgcagttctccaaacgttaa

SEQ ID NO: 638 - DNA, 393 bp, Salmonella enterica serovar Dublin CT 02021853
atggctgaaaatcaatactacggcactggtcgccgcaaaagttccgcagctcgcgtgttcatcaaaccgggcaacggtaaaatcgttatcaaccaacgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgacgagtccctgcgtggcgaactgcgtaaagctggcttcgttactcgtgacgctcgtcaggttgaacgtaagaaagtcggcctgcgtaaagcacgtcgtcgtccgcagttctccaaacgttaa

SEQ ID NO: 639 - DNA, 393 bp, Escherichia coli O157 H7 EC4115
atggctgaaaatcaatactacggcactggtcgccgcaaaagttccgcagctcgcgttttcatcaaaccgggcaacggtaaaatcgtaatcaaccaacgttctctggaacagtacttcggtcgtgaaactgctcgcatggtagttcgtcagccgctggaactggtcgatatggttgagaaactggacctgtacatcaccgttaaaggtggtggtatctctggtcaggctggtgcgatccgtcacggtatcacccgcgctctgatggaatacgacgagtccctgcgttctgaactgcgtaaagctggcttcgttactcgtgacgctcgtcaggttgaacgtaagaaagtcggtctgcgtaaagcacgtcgtcgtccgcagttctccaaacgttaa

SEQ ID NO: 640 - DNA, 393 bp, Dickeya dadantii Ech703
atggctgaaaatcaatattacggcactggtcgccgcaaaagctccgccgctcgtgtatttatcaaaccgggcagtggcaacatcgttatcaaccagcgtactctggaacaatactttggccgcgaaaccgcgcgcatggtagttcgtcagccgctggaactggttgatatgattggtaaactggatcttttcatcaccgttaaaggtggtggtatctccggtcaggccggcgcgatccgtcatggtatcacccgcgctctgatggagtacgatgagtctctgcgttctgaactgcgcaaagctggcttcgttactcgtgacgctcgtcaggttgaacgtaaaaaagtcggtctgcgcaaagcacgtcgtcgtccgcagtactccaaacgttga

SEQ ID NO: 641 - DNA, 393 bp, Dickeya zeae Ech1591
atggctgaaaatcaatactacggcactggtcgccgcaaaagctccgccgctcgcgtattcatcaaaccgggcagtggcaacatcgttatcaaccagcgtactctggaacagtactttggccgcgaaaccgcgcgcatggtcgttcgccagccgctggaactggtcgatatggttggtaaactggatctgtacatcaccgttaaaggtggtggtatttccggtcaggcaggtgcgatccgtcacggtatcacccgcgctctgatggaatacgacgaatctctgcgctccgaactgcgtaaagccggcttcgttactcgtgacgctcgccaggttgaacgtaaaaaagtgggtctgcgcaaagcacgtcgtcgtccgcagtactccaaacgttaa

SEQ ID NO: 642 - DNA, 393 bp, Pectobacterium carotovorum PC1
atggctgaaaatcaatactacggcactggtcgccgcaaaagctccgccgctcgcgtgttcatcaaaccgggcaacggtaacatcgttatcaaccagcgtagtctggaacagtacttcggtcgcgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtatgatgagtctctgcgtggcgaactgcgtaaagcaggtttcgttactcgtgatgctcgtcaggttgaacgtaagaaagtcggtctgcgtaaagcacgtcgtcgtcctcagttctccaagcgttaa

SEQ ID NO: 643 - DNA, 1104 bp, Escherichia coli BL21 (DE3)
atgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctggcctcgcgtgaccaattagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatctgccggcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgactgcagggctgcaacgtttgcgttatctgctgctgctgtggggggcagatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgcagcaaccggcgacaggaaatgcagctactgcgcctgctgcgccgacacagcctgctgctaatcgctctccacaaagggctacgccgccgcaaagtggtgctcaaccgcctgcgcgtgcgccgggagggcaatag

SEQ ID NO: 644 - DNA, 1068 bp, Shewanella oneidensis
atgaagccaatttttgttcgtggtatttcgaaccagttccgtttaacactggcaattatcctgtcggtgattttgctcgcggcaaatcaccgtcttgagcctgcccgtgaatccctttcatctgctttaagccctattcaatacctcgcgagcgtccccagtgcgatcctcgattggtcatctgagagttttgcgacccgcaatatgctggcattgcaaaataaagagctgttaaggcaacaattattaatgagtgaacgcctacagcgtttcgaacatctgcgtcaagaaaacgaacgcttacgtgctttgcttggttcgccagcctatcaggattcccgcaagatggtggtggaggtgatggaggttgccagtgaaccttcccatcactatgtggtcttgaatcggggttcccgcagcggtgttttcgtcggtcagccggtggtggatgcgcagggggttgtggggcaagttgtacaggttagcgagatgaccagccgagtgttacttgtatctgacgtttcccacggtttacccgtgcggattacccgtaatgatgtacgtttaattgctaatggtacgggtgagctcgatgagattgagctgcgccatgtggctaagagtaccgatattcgagtgggcgatttattagtcacctctggcttaggtaaccgctttcctgaaggctatcctgttgcgcgagtgatgaaagtctttaccgaagatggccaaagctacacgcgagtcacggctcagcctctggcggcacttgatcgcattcgttatctgctgctgatttggccatcacctgactcgggtgtgactttgcctaatcaaatccctgtgcctgcggcggatcatccggtagaagaagccaaaccagatgctgttaatggtgccatcaatcctcaaggcgaagcgcagggcacaaacgccactgttcctaatgccactgttcctaataccactgctcctaatgccacagttccaaacgcgactgcggcaccgagaaatgccaatggtgcatcgaacgctgctaccacccaaccgccagcagaggtgcactaa

SEQ ID NO: 645 - DNA, 999 bp, Pseudomonas putida KT2440
gtggtgatgtcggtcgcgttgatggttgtcgacgcgcgcttcgacgtgctcaaacccgtgcgcagccagatgggcctggtgctgatggagtcgtactggatcaccgatttgccacagcgtgcctggcaaggtgtggccggccagttcggtagccgcaccgagctgattgccgaaaacgagaagctcaagaccgaagccctgctgctgcaggggcgcctgcagaagctggcggccctgaccgagcagaacgtgcggctgcgcgagttgctcaactcttcggcgctggtcaacgaaaaggttgaagtggccgagctgatcggtgtcgaccccaacccgtttacccaccgcattctgatcaacaagggtgagcgtgatggtgtgttcctgggccagccggtgctcgatgcccgcggcctgatgggccaggtcgtagagttgatgccctataccgcgcgggtgctgttgctgaccgataccacccacagcattccggtgcaggtcaaccgcaacggtctgcgtgccatcgccagcggcactggcaacccggagcgcctggagttgcggcatgtggccgacactgccgacatcaaggaaggcgacctgctggtcagttccggcatggggcagcgctttcctgccggctacccggtggccacggtcaacgaagtgatccacgattccggccaaccctttgccatcgtccgtgccatccccaccgccgcgctcaaccgcagccgctatatgttgctggtgttcagtgaccggcgtagcccggagcagcgcgccaccgatgccgccattgcccaggaagaggctgaccgcaagggcgctgcacctgctggccagccggccgctacccgtgatcaggtcgcacccgccgctggcacgcctgccgcgtcggtcacaccggcagcaccggccactccggtcgcgcagccagcagccccgtctgctgcacctgccacgccggccgcacccgctcaaccccggaggcaatga

SEQ ID NO: 646 - DNA, 1080 bp, Pseudomonas syringae tomato DC3000
gtgctggccgttctgtcggtagcgttgatggtggtcgacgcccgctttacgatcctcaagcccgtgcgcagccagatgtcgatggtgctcatgcagtcttactgggtcgtcgatctgccacaacgtttgtatcagggcgttgccagtcagttcggcagccgcacagaactcatcgctgaaaacgaaaaactcaagaccgaagccctgctcctgcaaggtcgcctgcaaaagctggcggcactgaccgagcagaacgtgcgcctgcgcgagctgctgaactcttcggcgctggtcaacgagaaggtcgaggtcgccgagctgattggcatggacccgaaccccttcacccatcgcattatcatcaacaagggcgagcgcgatggcgtggtgctcgggcagccggtgctcgatgcacggggcctgatgggccaggtcgtcgaattgatgccctacacctcgcgggttctgctgctgactgacacgacccacagcattccggtgcaggtcaatcgcaacggcctgcgtgccattgccagcggcaccggtaacccggaacgccttgagcttcggcatgtggcggacaccgcagacatcaaggaaggcgatctgctggtcagctccggccttggtcagcgttttccggcaggctacccggtggccacggtcaaggaggtcattcacgactccggtcagcctttcgcgattgtccgcgccgtgcctacggccgctttgaatcgtagtcgctacctgttgctggtgttctccgacggtcgctcgcccgaagagcgcgctgccgatgccgcgcaggctcaggagtcgatcgacaaaggcctcgaacccacggtcatggctaccttgccgccgccaacaccggcatttccgatgtggccgcaagcaacggtgccgacgttccccggcagtacaacgacgcataaacccgccgcgcaacccgcgacgccagctccggctgccacgcctgccgcgactccggcagcaaggcccgccgcccgacctgctgcgtcgcgtccgcctgcgtccacgccttccaactccaacgcccgggagcctatcgatggttag

SEQ ID NO: 647 - DNA, 903 bp, Methylococcus capsulatus Bath
ttgatacgagaggggcgcgccatcaagctcgcattcaccaagaagccggcccagaatttccggctgctggttttcgccgtcgtctcgctggtcctgctcgcggccgaccggcggggagcgatcggcgcgctccggggcgggctggatgccgcggtctatcctctgcagcagttcgtcagtgcgcctgtgcgcttcgccgagtggctccgggaaaacgtgtccggctatgccagcctcctggaagaaaatcaaaggctcaaggaggagagcctgcgcctggaagccaggctggctaaattctccgcgctggagcaggaaaacatccgtctgcgggcgctgctgggcgcctcgatcaagatcggcgagcatttcctgatcgccgaactgctgtccatcaatctggtgccctacgagcacctggtgctggccaacaagggttcgaacatcggtgtccacgtcggccagccggtgttcgatgcccgcggcgtggtcgggcaggtgctgcgcgtttcgccggtcagtgccgaagtgatgctgatcaccgatccgaatcatgccatcccggtccaggtcgagcgcaacgggctgcggacgatcgcggtgggtaccggccggatcgaccggctgatcctgccctacctcagcggcagcgccgacatccgggagggcgaccggttggtgacctccggcatgggcggcgtgtttccggccggctatccggtggcgacggtggtggacatttccaacaccggcagttcgctcgccaaggtctcggcggagccggtcgcccccctggaccgtatccgcgaggttctgctggtctggacccgcagcgatgtccagactcgggacgagacgggggaaagtccgtccggcgcagcggctccgcatgtggcgcactag

SEQ ID NO: 648 - DNA, 1074 bp, Pseudomonas syringae pv B728a
gtgctggccgttctgtcggttgcgttgatggttgtcgacgcccgctttacgatcctcaagcccgtgcgcagccagatgtcgatggtgctcatgcagtcctactggatcgtcgacctgccgcagcgtctgtatcaaggcgtcgccagtcagttcggcagccgcacagagctgatcgccgaaaacgaaaaactcaagaccgaagccctgctcctgcaaggtcgcctgcaaaagctggcggcactgaccgagcagaacgttcggctgcgtgagttgctgaactcctcggcgctggtcaacgaaaaggtcgaggtcgccgagctgatcggcatggacccgaaccccttcacccatcgcatcatcatcaacaagggcgaacgcgacggcgtggtgctcggccagcctgtgctagatgcgcgcggcctgatggggcaggtggtcgagttgatgccctatacctcacgtgtcttgttgctgactgacaccacccacagcatcccggtgcaggtcaaccgcaacggtttgcgtgccatcgccagcggcaccggtaacccggaacgtctggagcttcggcatgtggcggacaccgcagacatcaaggaaggcgacctgctggtcagttcgggccttgggcagcgtttcccggccggttacccggtggcgacggtcaaggaagtgattcacgactccggccagccgtttgcgatcgttcgtgcagtgccgaccgctgcgctgaatcgcagtcgctatctgttgctggtgttctccgacgggcgctcgccggaagagcgcgctgccgatgccgcgcaagcacaggaatccctcgacaagggcgtcgagccctccgtgatggcgacactgccgccgccgacacccgccttcccgatgtggccgcaggccgtcgttccggtctttccgggcagtacgatgacgcacaagcctgcagcgcaatcggcaacacctgcacctgcaccggcggccacgcccgcgacaccggcaaggcctgctgcccggcctgcggcgtcacagccgcctgcttcacgaccttccactgcccgggagcctatcgatggttag

SEQ ID NO: 649 - DNA, 861 bp, Psychrobacter arcticum 273-4
atgactccaagtatttttgctcgccagccactcgtgcttcgtatgactgctgttttattgatagtggcattgatactgatgtggtttgatagcaaaaatccagaatggttcaatcctatacgctcaagcagccacgccgcgatgcagcctatttatgagctgtcattgctacccagttatgccaaacactggtcaagcggtagtctgcaatcaaaagaagcgctgcgccgcgaaaatatgcagctcaaatcgcagcttattcacgcccaagccaaattacagcagcaagattatatcttggcgcaaaacgcccgtttgcaaggtattctatcgaccacgagtccagagcaatttgatttaaacttggcacaagtgattggtaccgacaccaatcttttgcgtcaaattgtggtattgaataaaggtgctcaagatggggtgcaagttggacaaacagtcatcgatgaagacggcatcttagggcagattattaatgtctatcctaataccagccgtttattactaattactgatgagcggcagtccgtcgccgttactgtcaagcggactggtcagcgcgctattgtcactggtcaaggcatacctacctcattgagccttgagtatgtttttaaaacctcagatgtgcgtgtcggtgatgaactggtatcatctggattaggtgagcgtatccctgcaggctatcgcgttggtcgtatcgcgcatattgaagacacgcaagcagataattttagaagtattaaagtcactcctgcggcaaactttgttaataatgcttatgtgctgatattgcaagacaagctggctaataaagataatattggcatcactgagccttaa

SEQ ID NO: 650 - DNA, 876 bp, Colwellia psychrerythraea 34H
atgaacccaatttttaatcaaggcacatccccagcgcaccgacttatcttggtgctttgctgttcggtggccttgatttttttcgaccataaaatggcgagttttgaaaccgcacgtggttatttacaatccctagttagcccgctgcaatatatggctaatgcacccaagcaaatgatgacttgggcttcagaaaatatagttattcgtcagcagctcatggaagaaaataaaaattttcgagaaaatgagctattcttccatgagcaagtgatgcagttaagtattgtgcgtcaagaaaatgaacgattacgctcattactttcttcacccgttcgtggtgaaataaaaaaaatgtttgccgaaatattatccgttgatagtgacccttattctcaccaagtagtgattaatcgcggcgccaatgatggtgtctacgaaggtcagccagtacttgatgaaaaaggtattgttgggcaaatattacatgtgggtgtaagcagttctcgtgtgatcttgatcagcgatatatctcatgctattcctgtacgtattcaacgaaatggcttaaggctcatagcttcgggcagtggtcaaattgatcgacttattcataactttgttccacatagcgctgacgtgaaagaaggtgatttattagttacttcaggcttaggtggtaagtatcctgaaggttatcctgtttcccgtgttgtttttgtgcgtgccgacgagtcacgagaatttgcgactatttatagtgagcctgtcgctcaaattgatcgattgcgttatatgcttctactttcgaaggatgaagccgttaagcctgcgtccccattaaccactaagaaagcaacggtaggaaaatcataa

SEQ ID NO: 651 - DNA, 936 bp, Dechloromonas aromatica RCB
atggccggcctcgaccacgcgcctccaccgttcttcaagcgagggccagcaccgctggcccttctgactttctacatcgccgtttcattggcgatttttgtgctcgacctgcgcttcaagagccttgaattactgcgccagagcatcgctctggtcatcgacccggtgcagcgcgttgcccagacaccgggtagcctggtcgactacgcggccagttatctgcaaggcctgcgcgccctgcaactagaaaatggcgagctaaaacacaatcagctgacaaccgcgcccaatctgcagcgcttggcccaactcgaagttgagaatgagcggttgcgcaagctgctggcggtcaaggaacgcgaaaaggccaacggtcaggttacccagattctgtacactgcccgcgacccgttctcgcgcaaggtcattgtggacaaaggccagcaggctggtattgtcgccgggcaacccgccattgatgaggccggggtagtcggtcaggttacccgcgttttcccgttctcggctgaaatcaccctgattaccgacaaggatcaggtcgtgccggtccaggttgtgcgtagtggccagcgctcagtcgttttcggcctcggcaacggccagctggaattgcgttacatgcccgccaacgccgacatccagattggcgatattctggtcacctccggactggacggcatctacctggccggcttcccggtcgccaaggtcgtcgatatcgagcgcgacagcgcctattccttcgcccgtatcttctgcgtacccattgctggcgtcgaaaattttggcgaagtgatggtgcttgacccgcgcaaggcgctgccgccggcaccgccagagtcatccggacgtccgggcagttccgacaaaccaagcctgcgcaagaaaaagaaaaccgctggaaaagaacactga

SEQ ID NO: 652 - DNA, 846 bp, Thiobacillus denitrificans ATCC 25259
atggcgatgccgggccagctcatgttcgcgcgccggctcgggccgacggcgcgcctgtcgatctggctgctgctgggtctcgcctgtattgtcatcgacgtccgctaccatgcgctcgaaggcctgcgcagcggattttccctgttgctccagcccgtgcgtcaagccatgcgggcaccggtcgacgtcgcggtcgaactcggcggcttcttcacccgccaccgcctgctgcagaaggaacgcgatgccctgctcgacgaacgcgcacgcctgcgcgtcagcgaaaaccgggcgaacgaactgagccgtgaaaaccgcgagctgcgcgcgctgctgcagttgcgcagccgcccgggccagcagctggtccatgcggctctgctctatcgaggccacgactggttcgcccagcgcatcacgctcgatcagggcgccgacgccggcttgcgtcgcggccttccggtcgtcgacgccgtcgggctggtcggccaggtcacgcgggtctatccgcactcgagcgacgtcacgctggtgagtagccccgatcacctcacgccggtctacgtcgaacgcacgggtcagcgcggcctcgccgcaggcggcggccgcgggcgcctcgaactgcgctacatgccggttcacaccgacatccgcccgggcgaccgcctgcttacgtccggcatcgaccgcgtctatccggccggcattccggtgggccgcatcgtcagtgtgtcgcggctgaagacgagcccctatttgaacatcgagggcgcaccgctggccgggctcgatcgctcgcgcgcggtgctcgtcctcgtcgcccgacccctggagcgtgcgccatga

SEQ ID NO: 653 - DNA, 849 bp, Thiomicrospira crunogena XCL-2
ttgactattaacctcagcacgacatctcctcaaaaagaaggaacacagttccttttattttttatcctgagtatcgcattaatggtaatggatcattacagccatttactttccaattttcgcaacgtgttactcaccacaatcgatccaattgagcgaacggccaccttgccgctagacatctataactggatgcagcaggactacaccaccatcaatcagctacaaatgcgaaatcaacaactggaaacggaaaacttgcttcttaaagctcaacaacaacaaatgggcaaactcaaactggagattagccgtttaaaccgtttactagggaccgccagtcaaatgagctcttccagtgttcaaattgccaatgtaagttcttatagcgaaacacctctagcgcagttttacacgttaaacaaaggttctttagatggggttaaaatcaatcaaaccgttatcgatgctaaaggtttaatcgggcaaatcacctctttaactccgtcgtcttcacgtgttcaattgattacagacccagacattcaagtgcctgtaaggattcaacgtacgggtcaacgtggcatcctaaatgggttagggcacaaccaattgtcattgatgtttattccaaactccagttcaatcaaggaaggtgatttacttgaaacgtcagggctgggagatgttttcccggaaggacatcctgtagccattgttaggcaagtgaacattctaaagggtgagccttattatgagatttttgcgcgacctgttgcagatttaaatctgtctcaaaaagtgctgattttgtcgaaaaaaacggagcgtgacaaccatgtccgataa

SEQ ID NO: 654 - DNA, 897 bp, Nitrosospira multiformis ATCC 25196
atgatagaaatctctccccggtttttcaggcacagtcccagtttactggcccggacggctttttttgtcatgctgtcattgcttcttatggcactggatagccgatccaagtatctcggcggcgtgcgggaaatcttttccgtgatagtttatccgctgcagaaattggctcatatgcccatggcaatgtacgatgccacaagcgaactcttccagcatggcgagatagcggaggaaaatgcacgtctcaagcagcagcatctcgttgacaaaggccagctcctccggctgcgtgcgctggaagccgagaatactcagctgcgcaagctcctgaatacgacgcagcgtattgaaaacaaggcaacagtggcggaaatcctgcgcgtgccgcatgatccattcaatcgcaaggtattgcttgacaagggcagcatggccggaatcgagtcggggcaggtcgtcgtggatgatatgggcgtggtgggacaggttacccgcaattaccccctggcctcggaagtgactcttctcacggacagggaccattccgttcccgtgcaagtagtacgcaacggcctgcgctcgatcatatcaggcaccggcagggaaggagttctggagttgaggtatatggcaatcaacaccgacattcaggaaggggacgtcctggttacatccgggatagatggcatctatcccgcggggcttcccgttgctgcagtatcccagatcgagcgtaatcccaattatatctttgcgcgcatcatctgcacgcctgcttccggtgtgaatcagaatcggcagctgttaatcctttccacgcgggcgcctcgtaccggaacaccggcagaagcgaccaaaacgaagccccgcccccaggaagcgagaagacagtga

SEQ ID NO: 655 - DNA, 765 bp, Saccharophagus degradans 2-40
gtggcgggtatttttatctacaccgattggtttgcgtccctcaaaaatcaggcgacggacgtcgctgcgcctttttattgggtatctgatatccctgccaaagtagaagattgggccgataaccgcgttatgtcgcgctcgcgactacagcaagaaaacgaatccctgcgcaccgaactgcttattcacaagcgcaaattacagcaaatggcatcgcttgcggccgaaaacgtacgcctgcgacaattgcttaattctgcggagatgatcgaagatagggttattatcgccgaacttattggcgtaagccccgacccactggtacacaaggtaattgttaaccgcggcagtaatcacggcgtgtatatcggccaacccctgctcgatgccaatggcttaatgggccaagtggtgcaggtgggggcgctaagtagccaagtgctacttattacagatacaacccatgccttgccagtacaaatcaatcgcacaggtgttcgcttaattgcagaagggctgggccggctggatgaactcgcattgcgctacgtgccaaacaccaccgatatagaggtgggtgacctgttggtaagttccggtttggggcagcgcttccccgccggttacccggtagctgaagtggtagaggtgcagcgcgacccgggcaaggcatttgcctcggtgatggccaagccaaaagcggagctaaaccgcagccgccatgtgctattggtgtttgatatgcccccctcggaaggcctgtag

SEQ ID NO: 656 - DNA, 933 bp, Methylobacillus flagellatus KT
atgccacgcgccttagaacaccaacaccacactggcttctttgttcgcggcccgagccccatcgcacgcctgctgtttttttccgtgctatctttggcgctgattgtcacggatgcacggctcaactaccttatcgaagtgcgccagggattcattgccctgcttcaccccctgcagatcattgccaatgccccgctcagcctggttgaagacgtaggggcatacctgcatacccagactaccctggcggaagagaacacccgcctgcggcaccaggccctgatgcatgcggaagagctgcagcgcttccaggcgctgatggctgagaatgagcgactacgcagcttgctgggcgcagcccaggtatccagccagccggcaaggcttgccgagatattgcatatggggcgcgacccgttcagccacaaggtggtcgtcaacctcggctcaaggcagaacatcgttccgggccaggcggcaattgatgagcacggggtgatcggccaggtcacgcgcgtttatcctttcagcagcgaagtgacgctgattaccgacaaagagctctccatccctgtacagatcgaacggaacggtttgcgggccatcgcgttcgggcaaggacgcaatgcgacattggaattgccctccctgcctgcgaacgttgatatccaggtaggtgacaaactggtgacttccggcatcgatggtatctacccgccaggcctggctgtcgccgaaatcatccgcgtagaggccgacggcgactcgccctttgcccatatcatcggcaaacccatcgccggtatcgatcgtcacaggcaactccttctggtcagcattccccaggttgagcgcccggcagacagcagcgctgtgaaaaccaactccgccactcaaaaaaccaccccgaccaagcgccatgtccgcaactag

SEQ ID NO: 657 - DNA, 885 bp, Shewanella denitrificans OS217
atgaaacctatctttgttcgcggtatttcaaaccaatctcggctcacactggctatttttttgtcggtggcccttatcgtggcaaacgataagttagaagctccccgtcagtccttatcgtcgatattaagtccattgcagtatttggccaatcttcccggcctactcatggattggtcctcagatacactcgcaacccgcgacatgctgcaaacccaaaatggtgagttacagcgtcaacaattgttgatgtctgaacgtttgcaacgttttgaacacttgcgccaagaaaatgagcgcttgcgtgccttgcttggcagcccagtgcagttagcggtaaaaaaagtggtcgccgaagtgatggaagtggccagcgacccttttcgtcattatgtggtacttaatcgcggcgcacaggatcaagtctatgtgggtcagcctgtggtcgatgcccttggggtgataggccaagtgattgaagtcagcgcactgaccagtcgcgtcttgatggtgtcagatcccactcacggcattcctgtgcgagttacccgaaacgatgtgcgggcagtggccaatggcaccggcgaaattgaccaaattgagctgcgtcatgtggcaaaaagtgccgatattattgccggtgacctcttggtctcttctgggcttggcaatcgatttcccgaaggctacccggtggcgagggtgatgaaggtctcccgtgatgaaggccaaaattatgcggtgatcacggcgcagccgctggccgcattagacagaattcgctatgtgttgctgatttggcccgaagatttgatagagaatgaaaccctgctagaagatgaacaagcatttagcggcaaggatgtggagacaagccatgagtaa

SEQ ID NO: 658 - DNA, 954 bp, Chromohalobacter salexigens DSM 3043
gtgtcgtcgcgcacgctttccgcggagggaaggcctatcaaacctctgttttcgcacggccccgtgcccagttatcggatgttgctgtgtgcggtgcttgccttcaccttgatgttcgcggagcaccgcttgtccttcatggaggacgtgcgggctcaattgaccacggtggtcgcgccggtgcagtgggcggtcagcctgcccagcgaggggctcgcctgggccgcgctggtgttttccgaccagcgcgccctggtggaagagaaccagcgcctgcgccagcagttgctgacgctgtcgcatcgtgtgcagcgcatggcgaatctcaccgcggagaacgttcgtctgcgtgaactgctcaatgccgcgcctcgcgaagacgtcccctatatcaccgccgagctcttgtcactggattccgaccccttcacccagcagatggtgatcgggcgcggacgtcgtgacggcgtctacgtcggacagccggtcatggacgcttccgggctgatcggccaggtcgtcgccgtgtccgcctataccagccgggtcttgatgatcgccgatgccaatcatgccgtcccggtgcagatcaatcgtaccgggcgccgcttcatcgtgcagggcacgggcaagctcgatacgcttagcgtgctcaatgtgccggcgacggcggacattcgagagggcgacctgctcaccacgtccggcctgggcggacgctttcccgagggctatccggtcgccgaggtcacgcgtgtgcagcgggatggccagcactcgttcgccgatgtcgaggcacggccgctagcgcagcccgagcgctcgcgtcatttcctgctgctgtttccaccgccctcgtcggcggccgtgaacagtgaggtcgatctcgaggccgcgctgcgtctgatggaaggcgtctcgggcggggccggggcccaggaggcaacaccatga

SEQ ID NO: 659 - DNA, 861 bp, Psychrobacter cryohalolentis K5
atgactccaagtatttttgctcgccagccactcgcgcttcgtatgactgctgttttattaatagtggcattgatattgatgtggtttgatagcaaaaatccagaatggttcaagcctatgcgctcaacgagccacgccgcaatgcagcctatttacgagctgtcattattacccagttatgcacaacactggtcaagcggcagcctacaatcaaaagaaacgctgcgccgcgaaaacatgcagctcagatctcaacttattcacgcgcaagctaaattgcagcagcaagattatatcttggcgcaaaacgctcgcctgcaaggtattctatcgaccacacgccctgaacaatttgatttaaatttggcacaggtaattggtactgacaccaatctactgcgtcaaattgtggtgttgaataaaggggagcaagatggggtacaagttgggcaaacggtcattgatgaaaacggcattttagggcagattatcaatgtctatcctaataccagccgtttattgcttattactgatgaacagcagtccgttgccgttactgtcaagcggacagggcagcgcgctattgtcaccggtcagggtatacctacttcattgagccttgaatatgtctttaaaacctcagatgtacgcgtcggggatgagctggtctcgtctggattaggtgggcgtatccctgcaggctaccgtgttggtcgtatcgcccatattgaagacacgcaagcggataattttagaagcattgatgtcacacctgccgcaaactttgtcgataatgcttatgtgctgatactacaagacaagctggctaataaaaacaatattggcattaatgagtcttga

SEQ ID NO: 660 - DNA, 1011 bp, Cupriavidus metallidurans CH34 uid250
atggattactctccaccgccgctcttcaagcaaggcacgtccgccgttgcgcgtctggttatcttcgtgacgatcgcgctggtgctgctgatcgtcgacgcgcgctttgacgccatgcgcaacgtgcgccaggtggctgccaccgtgctgatgccggtggagcgtctggtgctggtaccgcgcgacgccatccgtggcgtcttcgactacgcccagtcttccgtcgaactggccaacgagaaccgcgagctgcggcgtgcggcgctcgagcaggccaatgcctcggttcgccaggcccagctcgaatccgagaacaaccagcttcgcaagctgctgaacctgacgcagcaatcgaccacgccggtgaccccggcggaaatcctctacgacgcccgggacccctacagccagcgtatcgtgatcgatcgcggcagcatgcagggcctgcgcgccggctatccggtcatcgacgagcgcggcgtgatcggccaggtgacgcgcgtttccccgttccagtcggaagtgacgttgctgaccgacaaggaccaggcgatcccggtccaggtggtgcgcaacggtctgcgcagcgtggcctttggcggctcacgcgccggtctgctggacctgcgcttcatggcggcatcggccgatctgcagcagggcgacctgctggtgacgtcgggcctcgatggcacctatccgccgggcctgccggtggcgaagattgtccagatcgaacgcaaagccgatacggcgttctcccgcgtgtattgcgagcccgtggccggtgtgcgttcgcaccgccagttgctagtggtgcgctatgagtcgggccttgccccgcgcccgccggaggcagccacgtcgcagaaggccgagcgcggctcgcggtcggcggcggcacgcgctggcgccgagcagaaggcagacaaggcggccacgtcggccgacaagcccgcggacacgcccacggccgcgccggcgcagaaaccctcggagcccgcacggtga

SEQ ID NO: 661 - DNA, 867 bp, Baumannia cicadellinicola Homalodisca coagulata
atgaactggaatcgaatagtcttatttaaatatcgttctgttattaaacctattagaggtaattctatgtcattgcgactatatctagctatgatagttgctatcatattaatcatagttgataatagactagatagttttactactattcgtatgtatatggatacggtgttaagtccaatttacttgtttaccaatagtacagtgcaaaaattagataatttatcaacaatatttacaacaaatgctaagttaaagcaagaaaatagagctttgcgtcaggagctaatattacaaaagagtaaacaattattactaatgcattataaacaagaaaatactactttgcggaaactactaatagctccattacatcatgatgagcatacaattctgacaaaggtaatttccctacaaatagatccatatattaatcaaatagttattgataaaggatggaataatggtatttatattggacagccagtaataagcgaccaaggaatagtaggacaagtaattgctactagcaagtatactagtcgtatcttgctaatttgtgatacatcccatgcaataccgatccaagtattgcgtaataatatacgtggtatcttaataggtaaaggatgtaatgcagatttacagattgaatatttacctcaagatctagaaaagatcgatattcatgttggagacttattggttacttcaggcttaggaggtagatttccagaaggttatccagttgctgttgtttcatctgtaaagttagatttacctcgtactcatatgctaattaaagcgaaacctattgctacactacagcatttacattatctactattactctggaaaaataagtaa

SEQ ID NO: 662 - DNA, 861 bp, Pseudoalteromonas atlantica T6c
atgaactcgatttttctgcgtggtccatcgttacacattaaactggtttttgcccttgcgctatcagccggattaatcgtgtttgatcatgtctttgatggcttcgccacaacccgtgtttacctcaactctgtggtcagccccattcaatatctagctaacttacctagcgaaatgctcaacgccagtgctagtcgtttggtgtcgcatcagcaattacttgaagaaaatgctgagctacaacacgatgccgttgtgcttaatggcaagttgcagcgttttgttttgctgcaagaagaaaacgaccgcttacgccgtcttctgaacaccccagtgcgcggcgatattcgtaaagaagtggcagaattaatggcggtagataacaacccttatagtcaccaaatcgttattgaccgcggtgccattcaaggggtgtatgaaggccaacccgttattgatgataaagggatcgtaggacaaattatgcaggtcggttcgaccaacagccgcgtattgctgatttcggacgtgactcatgccattcctgtgcgtgttgccagaaacaacatacgcatgattgcttcgggctcagggagcttaaacgagttaatcattcagcatgttccccacagcgctgatattgaagaaggcgatttgctgctttcatctggtttgggcaatgtatttcctgaaggctatccggtggcaagaattacctcgattgtccgcgatgaaggacgcccttttgctcaggtcaatgctgagccagtggcgctgctggatcgtctgaaatacttactcttgttgtggccaaataatcttgtagggccagagcagtctgttccggatgcagaacaatga

SEQ ID NO: 663 - DNA, 858 bp, Rhodospirillum rubrum ATCC 11170
gtgaagcaaccgacgggacaaaccgcgcggctgaccgccttgcgggttttcgtccagaaatcggccttcgtggctttggcggggctggctttcgccttcatgctgctgggcaaggccgatacggttctggttgaacgggtgcgggcgacggtgatcgatgccgccgccccggtgctcgacttcatgtcgaccccggcggaaaacgtcgcggcgatcttcgccaatctgcgccagctcacttcgattcgcgccgagaacgaccggctggcgaccgagaatgaccgcttgatgcgctggcaggccgccgcccgccatctggaagccgaaaacgaggcgctgcgcggcctgctcacctatgtgcccgagcccaaggcctcctatgtgacggcccgggtggtcgccgataccggcggcaccttcgcccgctccctggtcgtgctcgccggcaccatccatggcgtcaacaaggggcaggcggtcatttcgggcgaaggattggccggaacggtggccgaggccggccagcggtcgtcccgggtgcttttgctgaccgatatcaacagccggattccggttctgcttgaagacagccgcgttcgcgccattctcgccggcgataatcaggatcggccgcaattgcgcttcttgcgcgaccgcatcgccgttcagcccggagaccgggtggtgaccagcggcgacgcccgcattttcccgccgggcattccgatcggcgtggtcgccagcgttgacgagaaaaagggcatccgggttgatttgttcgttgaacaagaccgcctggaagtggtgcgcatcgccaatttcggcatccccaacccgctttccgaaggggccgattag

SEQ ID NO: 664 - DNA, 1056 bp, Haemophilus somnus 129PT
atgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggacggtgtatcagaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtacgtgtaattgccagtggaacagggcgaagtgatgaattgactttagagaatgtgccgagatcggtcgatattataaaaggtgatttgcttgttacgtctggacttggggggcgttttttagaaggttatcccgtcgcaattgtggaaaatatttctcgtgatagtaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctctatataaggtgaaaaagactccggtacaggaggaattttttccatccaataataatacagatgagtattcagtagatatattagaaaccttaccggaaaatttacctgagcaagagtttctacaaaaagagcagggggatgaaaattaa

SEQ ID NO: 665 - DNA, 1062 bp, Shewanella sp. MR-7
atgaagcctatttttgttcgtggtatttcgaaccagttccgtttaacactggcaattatcctgtcggtgattttgctcgccgcaaatcaccgtctcgagcctgcccgtgaatccctttcatctgccttaagtcccatccaataccttgcgagtgtgcctagtgcgatcctcgattggtcatcggagagttttgctacccgtaatatgctggcattgcaaaataaagagttgttaaggcagcaattattaatgagtgagcgtctgcagcgcttcgagcatctgcgtcaagaaaatgagcgtttacgcgccttgttagggtcgcctgcctatcaggattcccgcaagatggtagccgaagtgatggaagtggctagcgatccttctcaccattatgtggtgctgaaccacggttcgcgcagtggggtatttgtcggtcaacccgttgttgatgctcagggcgtagtcggtcaagttgtacaggtcagtgagatgaccagccgcgtgctcttgctctccgatgtgtcccacggtttacccgtgcgaattacccgtaacgatgtgcgtttagtggctaacggtactggtgaactcgatgagattgaactgcgccatgtggccaagagtactgatattcgcgtcggcgacttattagtcacatcaggccttggtaatcgttttcccgaaggttatccggtggcgcgggtcatggaggtcttaaccgaagatggtcagagctacgcgcgtgtcacggctcagccgttagcggcgctcgataggattcgttatctgctgttgatttggccatccccagattctggcgtgactttaccgaaccaactccctgtgcctgcggcagatcgccctgcggaagaagctaagcccgatgccggcactggcagtgctaatcctcaaggcgcggctgctaatgcgagtgcgccgagtagtgcagcacctaatgccactgctcctaatacgacagtgcctaatactggtgcgacgccaagcaataccaatggtgcaccgaatgctgccaccactcaaccaccagccgaggtgcactaa

SEQ ID NO: 666 - DNA, 1062 bp, Shewanella sp. MR-4
atgaagcctatttttgttcgtggtatttcgaaccagttccgtttaacactggcaattatcctgtcggtgattttgctcgccgcaaatcaccgtctcgagcctgcccgtgaatccctttcatctgccttaagtcccatccaataccttgcgagtgtgcccagtgcgatcctcgattggtcatcggagagttttgctacccgcaatatgctggcattgcaaaataaagagttgttaaggcagcaattattaatgagtgaacgtctgcagcgtttcgagcatctgcgtcaggaaaacgagcgtttacgcgccctgttggggtcgcctgcctatcaggattcccgcaagatggtggccgaagtgatggaggtggctagcgatccttctcaccattatgtggtgctgaaccacggttcgcgcagtggggtatttgtcggtcaacccgttgttgatgctcagggcgtagtcggtcaagttgtacaggttagtgagatgaccagccgcgtgctcttgctctccgatgtgtcccacggtttacccgtgcgaattacccgtaacgatgtgcgtttagtggctaacggtaccggtgagctcgatgagattgaactgcgccatgtggccaagagtaccgatattcgcgttggcgatttattagtgacctcaggccttggtaatcgctttcccgaaggttatccggtggcgcgggtcatggaagtcttaaccgaagatggtcagagctatgcgcgtgtcacggctcagccgttagcggcgctcgataggattcgttatctgctgttgatttggccatccccagattctggcgtgactttaccgaaccaactccctgtgcctgcggcggatcatcctgcggaagaagctaaacccgatgccggcactggcagtactaatcctcaaggggcagctgctaatgcgagtgcgcctagtaacgcagctcctaataccacggctcctaatacgacagtgcctaatactggtgcgacgccaagcaatgctaatggtgcatcgaatgcagccatcactcaaccgccagccgaggtgcactaa

SEQ ID NO: 667 - DNA, 933 bp, Alkalilimnicola ehrlichei MLHE-1
gtgcgactggtgctgctggcgctggtctcggtgctcttgatgaccctggatcaccgccagcaactggccgatccggtccgccagggcctggccgcggtggtctggccggtgcagcaggcggtgagtttgcccattgaggccagccagcgcctgggcgagcatctggccagtcgccagcagttggtggacgagaaccgcgagctgcgccggcgctacctgctcgaccaggcacggctccagcgtctgcaggcattggagatggagaaccagcggctgcgtgacctgctcggctcctcggggcagctcggcgagacggtgctcatcgccgagctcacccgggtggacctggatccctactcccacctgatccaggtggacaagggcagtgtccaccaggtgaccgtgggtcaggcggtcctcgacgccgagggggtgatggggcaggtggaccgggtgggcacccacggggcgatggtgcgattgatcaccgaccccagtcacgccattccggtggaggtcaaccgcaacggcctgcgcaccatcgccctgggcaccggcgacctgaaccgcctggaattgggcagcgtgcccatcaatgccgatatccagtccggcgacctgctggtgacctccgggctggggggtgtcttcccgcgcgggtacccggtggccgaggtggagcgggtggtgctggatccgggcgagcccttcgcccgggtcagcgcccgcccgctggcggccttggaccgcagccggaaaatggtactggttcaggggggcgctctcggccggatgccggacctgccggcggtggaggctccggctgtgccgtcggcatccgaaccggccccagccccaggggcggtcccgccggaggaggccccggacgccgcctccccgccggccgctgtgccgggggaggaggcgcaatga

SEQ ID NO: 668 - DNA, 963 bp, Shewanella frigidimarina NCIMB 400
atgaaaccaattttcgttcgtggcgtctcgagtcaatttagattgacactggcaattatattgtcggtggcattacttatgaccaataatcgcctagatcctatacgccaatccttatcctcagtattaagtcctctacagtatttagccaatgtgccaggggtgatgctcgactggtcggccgaggcatttgccacccgcaatatgcttgaactgcaaaacaaagaattattacgccaacaactggttatgtcagaacgtttacaacgttttgagcatgtacgtcaagaaaatgagcgtttacgcgcattacttggttcgcctgtgcacatggattctcgtaaaatggtggctgaggtcatggaagttgccagtgacccatttcgtcaatttgtggtgttaaatcatggttcgcaaaccggcatttatgttggtcagcctgtagttgatgcccaaggtgttgtggggcaggtggttgaagtgagtgagtttaccagtcgagtattgatggtgtcagataccacgcatggtattccggtacgcgttacccgtaacgatgtgcgggcaatagcgaatggcatgggtgatattgatcaaattgaactacgtcatgtggctaaaagtactgacattatagtgggtgatttattagttacttcaggcttgggtaatcgttttcctgaagggtatcccgtcgcgcgtgttattagtgtgtcgcgtgatgatggccagagttatgccgtgatttatgctcaacctttggcagcgctagatcgtattcgatacgtgttgcttatttggcctgatgaaaccaaaccgtttacgctgcctaatgacgtacaagaattaataaaagaagcggcagataaagcagctgccactgcaaattcttcagaaccccaaccccaacctcaacccgtagaaacaaccactacaccagtaacaagcgaggtaaaccaatga

SEQ ID NO: 669 - DNA, 993 bp, Pseudomonas aeruginosa UCBPP-PA14
gtgctggccgtgctgtcggtcagcctgatggtggtggacgcccggttcgactatctggagcccgtccgcagcaagctggggatggtgctcacgcctttctacggcctggcggaaatgccggtgcgcgcctgggaaggcgtgcgcgaccagttcagcagccgtagcgagctgatcgccgagaacgaacgcctcaaggccgagtccctgctgatgcagcgccgggtgcagaaactcgccgcgctcaccgagcagaacgtgcgcctgcgcgagctgctcaattccgccgcgctggtcgacgacaaggtactggtcagcgagctgatcggcgtcgatccgaaccccttcacccaacgcatcatgatcgacaagggcgagaacgacggcgtcttcgtcggccagccggtgctcgatgccagcggcctgatgggccaggtggtcgaggtgatgccctataccgcgcgggtcctgctgctcaccgacaccacccacagtatcccggtgcaggtcaatcgcaacggcctgcgcgccatcgccgtcggcaccggcaatcccgagcgcttggaattgcgctacgtcgccgacaccgccgacatcaaggaaggcgacctactggtcagctccggcctggggcaacgcttccccgccggctatccggtggccacggtcaaggaagtgatccacgattccggccagccgttcgccgtggtgcgcgcggtgccgaccgcgaagatgaaccgtagccgctacgtgctgctggtgttcagcgacagccgcaccccggaacagcgcgccaacgacgccgccgaggcccaggaagaggcggacaagaaagccgccgccggcgcccaggcgccccagcctgccgcgcaaccggccgccgcgccgtcgccggccaccccggcagcccagggtgctgcgcagcagcccgccgccgcgcccgcgccagctcccacgcagcctgccgctccggcggcgaacgggggacgccgctga

SEQ ID NO: 670 - DNA, 924 bp, Magnetococcus MC-1
atgctgcccttgtggagcttaatacgtctacaccgacaaagactaacggccgcaacctttttgttgctggccgtttttctattgtttgtcttgcgtgctgattcgccaggggtgttggcgtttaagggggtgctggccaacctgttgggtgggatgcaacggttggtgctctccccggtggaggcaacccgtgccgctggccaacggctgcaagagttggggcacctggatgaagaaaacctacgcctcaaacggctgctggccaatgtgggacctatgcagttgcaactggacgaggcgcttaaagagaatcgtcgcctgcgtcagattttacgtatgtcggtggatcctcactacacctacacggtggcgcgggtggtgggtgacagctcgtcggctttttcacgggtattgttggtcaatgccggtgctcaggagaaggtgcgacccgacaccccggcggttagcccggccggtgtggtggggcgggtggtggcggtgggtacccgtcgcagcacggtgctaaccctgcatgacatcaactcgcgggtgccggtgcaggtgcagcgttcgcgcttgcgtgccatggtggctgggaccaacagcagtactctggagctacgttttgtggtcaaggggggggatattttggtgggggatctgctcattacctcgggtaccggtggggtttttcccaaaggggttggggttgctcgggtgacctcgcttaatcccaatgcggatgggttgtttatgcaggctaccgcccgggcattggtggatcttgaccgcttggaggagttgcgtctcatgctgccggtggtggatgccgaaccccttagtgagggtgaggaggccaccattacggatcgcaccgatttgcgccccttgggattgctgcccgaggggacaaacacaccatga

SEQ ID NO: 671 - DNA, 1062 bp, Shewanella sp. ANA-3
atgaagcctatttttgttcgtggtatttcgaaccagttccgtttaacactggcaattatcctgtcggtgattttgctcgccgcaaatcaccgtctcgatcctgcccgtgaatccctttcatccgccttaagccccatccaataccttgcgagtgtgcccagtgcgatcctcgattggtcatcggagagttttgctacccgcaatatgctggcgttgcaaaataaagagctgttaaggcaacaattattaatgagtgagcgtctgcagcgcttcgagcatctgcgtcaggaaaacgagcgtttacgcgctctgttggggtcgcctgcctatcaggattcccgcaagatggtggctgaagtgatggaggtggctagcgatccttcccaccattatgtagtgcttaaccacggctcgcgcagtggggtatttgttggtcaacccgtagtggatgcccagggcgttgtcggccaggttgtgcaggtcagcgagatgaccagccgcgtgctcttgctctccgatgtgtcccacggtttacccgtgcgaattacccgtaacgatgtgcgtttagtggctaatggtactggtgagctcgatgagattgaactgcgacatgtggccaagagtaccgatattcgcgtgggcgatttattggtaacctcaggccttggtaatcgcttcccagaaggttatccggtggcgcgggtcatggaagtcttaaccgaagacggtcagagctatgcgcgtgtcacggctcagccattagcggcgctcgataggattcgttatctgctgttgatttggccatccccagattctggcgtgactttgccgaatcaaattcctgtgccagctgcggatcatcctgcggaagaagctaaaccagatgccggcaatggcaatgcgaatcctcaaggcgctgctgctaatgcgaccgtgcctagtaacgcagtacctaatagcactgtacctaatacgacagcgccgaacgccgctgcggcgccaagcaatgccaatggtgcatcgaacgctgccaccactcaaccgccagccgaggtgcactaa

SEQ ID NO: 672 - DNA, 930 bp, Shewanella amazonensis SB2B
atgaagcctatttttgttcgcggcgtctcaaatcaattccgactgacactggcaattattttgtcggtgctgcttatcgtggccaacgatcgcctcacgccggttcgacagtccatggcgactctgctcagcccgctgcagtatctggccaatgttcccggcgacatgctggatggttttgccgaaatgctcgctacccgcaccatgctggaacgtcagaacgccgaaatgttgcgtcagcaattgatgatgagcgagcgcctgcagcgttttgaacatttgcgccaggaaaacgagcgtctgcgtaccttgctcggctcgccgctgcatatggatgcccgcaagatggtggcggaggtgatggaagtggccagcgatccattccatcagcaaattgttattaaccgcggtacccaaaatggtgtctatgtgggccagcctgtgctcgatgcccagggtattgtgggccaggtggttgaagtcagtgccattacggcgcgggtgctgttgatgtctgacaccagtcatgccatcccggtgcgtatcacccgtaacgatgtgcgcatgatagtgaatggcacaagcgagttggatgaagttgaattaagacacgtcgccaaaagcaccgacgtgaaggtgggtgatttgctggtgacctcaggcctgggccgtcgtttcccggaaggatacccggttgcgcgcgtcaccgtggtagagcgtgacgacgcccaatcctatgccaaggtgatggcgcagccgctggccgcgctcgaccgtattcgttacttgctgctgatttggcccgatgccggaaacaaccccgtgaataccgaagccgttgagggcaccaccgtcgatgacgtcaatgcgccggcccagaatgagcctgccacagaggctgttccaaccgccgctgaggaggcccaatga

SEQ ID NO: 673 - DNA, 981 bp, Psychromonas ingrahamii 37
atgaaaacaatttttacgcgcggcccttcatttttattaagactatccatagtggtagttttttcggtttttttatttgttgctgacagcaacttcaatctctttgcatcatcacgtatttatttaaactccctggtcagccctgtgcaatacgttgctgatctgcctgaaaaattattcagtgccatctctgctagtgtgatgactcgccatgagttaaaagcgcgtaatcaacagttagaaaaagacaatttacatctcaaagctgaccgcctattactcacccaattagaaaatgaaaataagcagttacgtgagctgctcagctcaaatcgcacctttaccaacaaaagaatgataaccgaagtgatgagtttacgctcagatcccttttctcatcagttattgatcgataaaggcgcggtaaacggtgtttatgtcggccaacctgttattaatgaagatggtgtggttggacaagtttctcaggtaggcagtacaaccagtcgggttttactgattgttgatgtaagccatggtattccggtgcgcgttcagcgtaatgatcttattgccgtgctccatggtagtggtgattggaataggctaaatgtgccttttgtacaaagtaatgccgatttaaaagaaggtgatttactggtcacgtcaggtttgggggggcgtttccctgcaggttacccggttgcgacaataagccatgttaattatcaagaaggcgcggcttacgctgatgtgagcgcaacacctgttgctcccctccaccgcagccgttatttattgttgttatggaatgaggatcaatataatgaatctgatttatcaaaggatagattaacaacatcagcggcactggccacagagaatgctgataattcaaagacaagccctgattctctgaacacgctagagacagacaaaaaaatcgaaccgctggaatcgaaaaatgtcattgttcagtaa

SEQ ID NO: 674 - DNA, 921 bp, Acidovorax avenae citrulli AAC00-1
atgcccatcggtaccctcgaacggactgcaccgtcgttcttcaagcaaggcccgtcgccgcgcgcccgcttcgcgctgtgcggcgcgctggcgctgttcctcatggtggcggacgcccggttccacgtcacggagcccctgcgcaaggccatcgccgtggcgctctacccggtgcagtgggtgatgctgcagcccgtggagttcgtgggcggcggcatcgcctacctgcgcaccatggaatccgcccaggccgaggtcgacaccgcccggcgcaacatggtcgccatggcccagcgggccaaccaggccgaacaactcctgcaggagaacgagcgcctgcgcaagctgctgcagttgcgcgaccggctgcagacgcccgcgaaggccgcgcaggtgatctacgacgccgccgatccctatacccgccgcgtgatgatcgaccagggccagatggccggcatcgtgctcggctccccggtcatggacgaatcgggcatgctcgggcaggtgacccgggtgcatccgctgctgagcgaggtcaccctgctcatcgaccgcgaccaggccattccggtcatgaacctgcgcaccggtgcgcgcggcgtggcctatggcgaccccgtcatcgcgcacggtggcggcatggagctgcgcttcatgcccagcaatgccgacgtgcaggaaggcgacctgctcaccaccagcggggtggacggcctctatccgccggggctgccggtggcccgcatcgtgcgcgtggagcgcagggccgactccgccttcgcccgcatctactgcgcgcccctggcgcaggcgcagggcgcgcgccacgtcatggtgctgcagccgctggatgccggcctgcccgagcgcccccccgccacggagccggcgccggcacgcaagggaggacgccgatga

SEQ ID NO: 675 - DNA, 918 bp, Acidovorax sp. JS42
atgccactgggaaccctggaccgttcggcgccgacgctgttcaagcaggggccatcgccgctctcccgcctcaccctctacagcgccctggcgctgtttttgatggtggcggacgcacgctttcacctgacagagccgctgcgcaaggccgtctccacggcgctgtacccgctgcaatggctgatgctgcagccggtggagttcgcggacaagggggctggatacttccagtcgctgcaggccgcacagcagggcatggacgacgcgcagcgcaccatggcgcaaatggcggtgcgcgccggcgaggccgaccagctgctgcgcgagaacgccgagctgcgccagttgctggcactgcgcgagcgcctgaccaccgaggccacggccgcgcaagtgatttatgacacggcagacccctatacgcggcgtgtgatggtggaccgtgggcagctggcaggcgtggagccgggctcgccggtgatggatgcctcgggggtgctggggcaggtcacacgcgtgttccccatgctcagcgaagtcacgctgctcatcgaccgcgaccaggccattcctgtgctcaacctgcgcaccggtgcacgcagcgtggcctacggcgacccggtggccgggcatggcggaggcatggagctgcgcttcacgccgggcaatgcggatgtgcaggaaggcgacctgctcaccaccagcggcgtggacggcctgtaccctgcgggcctgccggttgcgcgcgtgctgcgcgtggagcggcgtgccgactccgcctttgcgcgcatctactgcgctcccgtggcgcagatgtacggagcgcgccatgtgatggtgctcaagccggtggtggccgacctgccaccgcgccccgaacccgagccggcggcgcccaagcgcggaggccgcaaatga

SEQ ID NO: 676 - DNA, 936 bp, Verminephrobacter eiseniae EF01-2
atgccacagggtactttggagcgcggcgctccccccctcttcaaacagggcccttcggccctgtcgcgtttggccttgttcagcgcgctggcgctgttcctgatggtggcggatgcgcgcttcgggctgaccgagccgttgcgccaggccgtggccgccgcgctctacccgttgcagtggctgatgttcaagccgatggagttcgccagccagggcagcgcttatttccggtcgctgcagacggcgcagcaagcgctcgacgccgagcgcagaaagatggcgctgctgggccagagcgcccagcaggccgcgcaactggcactggaaaaccggcggctgcgccagttgctcgcgttgcgcgcgcgcctgcaaattccggcgctggccgccgaggtgctccacgacacggccgacctccatacgcgccgcgtggtgatcgaccgggggcggatcgacggcgtgcagaccggggcggcggtgatcgaccaggccggtgtgctcgggcaggtcacgcgcgtttttgcgctcgacagtgaagtcacgctgttgatcgatcgcgaccaggccattccggtgctgaacatccgcaccggtgtgcgcggtgtggcctatggcgacccctacggcgacccggtgacccggcgcggcgccggcatggaactgcgtttcatgccggccaacgccgatgtccgcgaagacgacctgctgaccaccagcggcgtcgatggcctgtacccgccgggcctgccggtggcgcgtgtggtgcgcgtcgagcgcggggcggactcggcgttcgcgcgcatctactgtctgccgctggcccaggtgcaggggtccggccatgtgctggtgctccagcggctgaccgatcagcggctgtcgcagccggcgcctgaacgcccggagtctgcggacaaacccggggcgcgccgatga

SEQ ID NO: 677 - DNA, 846 bp, Halorhodospira halophila SL1
gtgcgcctggtgctgctggctacggtctcgatcctgctcatgagtctggaccaccgcgagcacctcgtcgagccggtccgcgagaccgtctccggggtggtgtatccgttgcggttcgtcgtcgacgcccccttctccatcgccgagcgggtctccgagcgtctggccacccgccaccagatcatggaggagaaccgccagctgcgcgaccgacacctggagtaccaggagcgcctgcagaggatgcacagcctggagcgggagaacgagcgcctccgcgatctgctcggctcctcggagcggctggagaccgaggtggccatcgcccagctgatgcgcgtcgagctcgacccccacacccacttggtggagatcgaccgcggctcccggcagggggtcttcgtcggccagccggtcctcgatgccaacggggtcatgggtcaggtggatcgcgtcggggcccactcggccagcgtgcggctgatctccgacccgagccacgccatcccggtggagaacaaccgcaacgggctacgcacggtcgcgctgggcagcggcgacccgcagcgcctggaactggccaacgtgccgggcaacgcggacctccgcgagggcgacctgctgacggcctcgggcctgggcggcgccttcccccggggctacccggttgccgaggtgacctcggtggaggtcgaggccggcgagcccttcgcccgggtgaccgcccgcccggccgccgagctggatcgcagccgtaagctgctgctggtctccgtggccgagaacgcggatgatcaggccggggacgacgaggcggcggacaacgagagcgaggacgcgtcttga

SEQ ID NO: 678 - DNA, 732 bp, Marinobacter aquaeolei VT8
gtgtactggcttggcaatgccccatattcctttgccgactggttttccggcctgtttgtcagccgcgatgatctgcagcaggagaacgaagagctcaaaacccgcctgctgattctggaacgccgtgctctcaagtacgcggctctggcgtcggagaataacgagctgcgccggctgctgaattcttctgaagtactggatgaccgggtcattgtgggcgaagtggtgggggtctccccggatccgttctcccacgagatcatcattaacaaaggcgagagtgatggtgtcacaaccggtcaggcggtactggacgcagagggcctgatgggccaggtgatccagaccagccagttcacctcccgtgtcctcctggtgtccgacagcagtcacgccgttcctgttgaggtggtacgtaatggtctgcgttcgattttgctgggtaacggcgaaaccgatgagctggatctggttcacgtaccggatactgctgacatccgcgagggcgacatgctggttagttccggtcttggcgggcgattcccccggggctacccggtggcagaggtcagttccatcgtcaaagagccgggggagccttttgtgaccattcaggccgcgccgaaagcccgcctcaaccagagccggctggtgctgatcgtgtttcagccggaagagcgctcggtgcccgaaaatgggcaggcggccccggataacgaggaggcaaactga

SEQ ID NO: 679 - DNA, 1017 bp, Shewanella baltica OS155
atgaagccaatttttgttcgtggtatttcaaaccaattccgtctgacactggcaattattttgtcggtggccttgcttgtggctaatcatcgcctcgatcctgtgcggcaaaacctatcctctgtctttagtccattacagtatttagccagcgtgcccggtgcggcgcttgactggtcatctgaaagttttgccacccgcaatatgctggcgttgcaaaataaagagctgttacgacaacaactattgatgagtgaacgcttacagcgtttcgaacacttacgccaagaaaatgagcgtttgcgtgcactgttaggctcccccgcctatctggattcgcgcaagatggtggccgaagtgttagaggtcgccagcgatcctttccatcattacgtggtgctgaatcacggttcccgtagcggtgtatttgtcggtcagcccgtggtggatgcgcaaggagttgttggccaagtggtgcaggtcagtgaaatgaccagcagggtgttattgctctccgatgtatcgcacggtttacctgtgcgtattacccgtaatgatgtgcgccttgtggccaatggtacgggtgagcttgatgagatagaactgcgccatgtggccaagagtactgacattcgtgtcggcgatttattagtgacttcaggcttaggcaatcgtttccccgaaggttatcccgttgcgcgagtcatggaggttttgactgaagatggccaaagttacgctcgagtcacggcccaaccgttagccgctttagatcgtattcgttatgtgttgttgatttggccgtctcccgattcgggtgtgaccttgcctaatcagcctacagtccctgctgcggatcattcgcttatcgaaaactcatcaaaaatcggcagtgcgagtccagcggaaggcacatctgcagacgcgactaagcctgtaactgcacccgcagccacagccactgtggccaaaccggcaacggaaaccactcctccagcgactgaggtgcaccaatga

SEQ ID NO: 680 - DNA, 882 bp, Shewanella loihica PV-4
atgaaacctatttttgcccgcggtatttcgaatcaattcaggctcacattggcaatcgttttgtcggtgatcttactggtggccaacgataggctggagccggtgcgccaatctatctcctctgtgctcagcccactgcaatacgtggctaacatccccggcgccattctggattggtccgccgagagtatcgccacccgcaacatgttggccaagcagaacaagcagctgctgcggcagcaactcctgatgagcgagcgtctgcagcgcttcgagcacctgagacaggaaaacgatcgtctgcgcgccctgctaggctctccggtacacatggactccaagaagatggtggccgaggtgatggaggtggccagcgatccctttcgtcactatgtggtgctcaaccatggtgcccgcagcggtgtcttcgtgggtcagcccgtggtggatgcccatggcgtcgtcggtcaggtggtggagatcagcgagctgaccagccgggtgctgctgatttcagacgtgactcatgctatcccggtgcgggtgacccgtaacgatgtccgcctggtggcccagggtatcggcgagctcgacgagctcgaactgcgccacgtggccaagagtacagaccttagggttggcgatctcctggtctcctcgggtctgggtaaacgctttcccgaaggctaccccgtggcgcgcatcatgacggtcgagcgcgacgatggccagagctatgctaccgtcaccgctcagcctttggcggcactggaccgtatccgttacctgctgttgatctggccagatggcaatcagagcgagcaagccgagcctatcgaagcaggcgccgatgcccagccgcaagcggaggagacgccatga

SEQ ID NO: 681 - DNA, 936 bp, Polynucleobacter necessarius asymbioticus QLW P1DMWA 1
ttgcaacatagcgctccaccacttttcagacagggcataccagccttacttaaactgattgtctgtctgtcgatcagcatcgctctgatgctgatcgattttcgtttcaaagcactcgatcctatccgcaacaatgtgaattggattttgcgtccacttgaatatgtcatgatggcgccgcgcaatgcatttgaagcaagctcagactatttcaccacgcgctcaactcttgatcaagaaaaccaagtgatgaaggctcgtcaagcagagctttctttgctggcaaatcaatctgaatttcttatggtggaaaaccaaaatctgcgcgagcttatggcgcttcaaaaacaggttccttttaaaactttgccagtagaaattctatttaatccacccaatccaatttcacaacgcattgtgataaaccgcggtagcaatgatggccttaagctaggcaaccctattgccaacgattcaggcattttgggtcaagtggtacgcctatacgagcgctctgccgaggtttctttgctggaagatcgggattttgcggttccagtgcaagtggctcgcaatggtttgcgtgctgccgtgtttggcgcaggacgcggcaaccctctggaacttcgttatctaccagttgcgagcgatctggaagtgggcgacatcctgctaacctctggaattgatggagtttatccccctggtttcgcggtggccgtgattagcaaaatcgagcgtaacgccgacaaaaattcttccaatgttttttgtgttcctgtagcggcagtcaatcgctaccgccaagccttagctcttttatatgacccgcaatttgatgcaaaggcagcaagcaataatactaagtctgccactggcgcacctttaacaaacaatcctggccgacgccaaacgcgagcgcgaggaatgcaatga

SEQ ID NO: 682 - DNA, 1017 bp, Enterobacter sp. 638
atgaagccaatttttagccgtggcccgtcgctgcagtttcgcctgatcctgggggttctggtagcgcttggagtcatcatcgccgacagccgccttggtatgttcagccaaatcagaacatacatggataccgccgtcagccctttctattttgtatctaatggtccccgtgaattactcgatagcgtttctcaaacgttgtcttcgcgcgatcaactcgaactcgaaaaccgggccttacgccaggaactgctgctgaaaaacagcgaactgctaatgctgggtcagtatcgtcaggaaaacgcccgtctacgtgaactgctgggttcgccgctgcgtcaggatgagcagaaaatggtgacgcaggtgatctccaccgttaacgatccgtacagcgatcaggtggtgatcgacaaaggcagcgtgaatggtgtttacgaaggtcagcccgttatcagtgataaaggcgttgtgggtcaggtcgtggcggtggcgaagttgaccagccgcgttctgctgatctgcgatgcgacgcatgcgttgccgattcaggtgctgcgtaacgatattcgtattatcgcggccggtaacggttgcacggacgacttacagctggaacatctgcctgccaacaccgatattcgcgtgggtgacgtactcgtgacgtccggtctgggtggccgcttccctgaaggctatccggtggccgtggtttcctccgtgaagctggatacacaacgcgcttatacggtcattcaggctcgtccgacggcgggtttacagcgcttgcgttatcttctgctgctgtggggggccgatcgtaatggtaccaacccgatgacgccggaagatgtccaccgcgtggccaatgagcgcctgatgcaaatgatgccacaggtactgcctgcgcctgattcgatggggccgcctgcgcccgtaccagcgcctgcgaccggattaacgcagccaacgtctgatgcgccaccgccgccgcaactctcctcaggagggcagtag

SEQ ID NO: 683 - DNA, 987 bp, Pseudomonas mendocina ymp
gtggcgcacaaggagcaggtcattaagccgctcttcgccaaaggtccctcgctgggcatccgcctgctggtattcgccgtgctctcggcggtgctgatggtggtcgacgcgcgtttcgaggcgctcaagccactgcgcagccagatgggcctggtgctgacgcccttctactggctggccgacctgccggtacgcgcctgggacggtgccacccagcagatctcctcgcgcagcgagctgatggccgagaacgagaagctcaaggccgaggctctgctgctgcagcgccgcttgcagaagctggccgcgctcaccgagcagaacgtgcgcctgcgcgaactgctcaactccgccgcgctggtggacgaagaggtgctggtcggcgagctgatcggcgtcgatcccaacccctatacccaccgcatcctgatcgacaagggcgagaaggacggcgtgttcctcggccagccggtgctcgatgcccgcggcctgatgggccaggtggtggagatcatgccctacacctcgcgcgtgctgctgctcaccgataacacccacagcatcccggtgcaggtcaatcgcaacggtctgcgcgccatcgcggtcggtaccggcaaccccgagcgcctcgaattgcgtcacgtcgccgataccgccgacatcaaggaaggcgatctgctggtcagctccggcatgggccagcgcttcccggccggctacccggtggccacggtcaaggaagtgatccacgattcgggccagcccttcgccatcgtccgcgccgtgcccaccgccgcgctcaaccgcagccgttacctgcttctggtgttctccgatcagcgtaccccggagcagcgtgccaatgattcggccgaggcccaggaagcggctgatcgcgaagccgagcgggcgcgcgagcagggcgagcagaagcctgccgagggcgatgcgccggtgacccctgctgccgcccaggagacgaactga

SEQ ID NO: 684 - DNA, 1005 bp, Shewanella putrefaciens CN-32
atgaagccaatttttgttcgtggtatttctaaccaatttcgtttaacactggcaattattttgtcggtgattttgctcgtggctaatcatcgtctcgaacctgcgcgtcaatccctttcatctgtattaagccctgtgcaatatctcgccagttttcccggggccttactcgattggtcatccgagagttttgcaacgcgtaatatgctggcgttacagaataaagagctattaagacagcaattactaatgagcgagcgtttgcagcgttttgaacatttgcgccaagagaatgagcgtttacgcgccttgcttgggtctcctgcgtatcaggattctcgcaaaatggtggcagaagtgctcgaggtcgctagcgatccctcccatcattatgttgtgttaaatcacggagcgcgcagtggcgttttcgtcgggcaacccgttgttgatgcacaaggggttgtggggcaggtggtgcaaattagcgagatgaccagtcgtgtattgctgctttctgatgtttcccatggtttacctgtgcgtattacccgcaacgatgtgcgcttaatcgccaatggtacgggtgaaaatgatgagattgaattgcgccatgtggctaaaagtatcgatgtgcgtgttggtgatttattagtgacttctggccttggtaatcgttttcccgaagggtatcccgttgctcgggtcatggaagtcctgacggaggatggccaaagctatgcccgtgttaccgctcaaccactggcagcccttgatcgtattcgttatttattattgatttggccatcatcagattcaggtgtgactttgccgcatcaaatgccagtacctgctgcggatcagcctgaagaggctaagccggatcccaatacgataaatagtgcacccaatacccaaggttcggcaaacacgccacaaggggctgcaactaatgcgaatgctacaacgggcgctgtgaccactccaccgccagcagaggtgcattaa

SEQ ID NO: 685 - DNA, 891 bp, Vibrio cholerae O395
atgaaacctatctttggtcgaggaccttctctgcagctacggctattttttgcggttatgctatcagccagccttatgctggctgatagtcgtttaggtgcattctcacatgtacgctttctgctcaatagtctggttgcgcctattcagtacgcagcggatctgccgcgcgtactgtttgacgatttttatgacagcatcagctctcatcagcagttacgggaaaataaccaactgctaaaacgtgaagtcctgaccctgaaaagtaatctgttactgcttgagcagtacaaagaagagaaccaacggctgcgtaagttactcggatcctcctttttgcgtgatgagaaaaaggtggtgaccgaagtgatggcggtcgatacgtcgccctatcgtcaccaagttgtgatcgataaaggccgggtagatggagtgtacgaaggtcagccgatcatcaatgaaaaaggcattgttggacaagtcacctttgtggcggcgcacaatagccgagtcttgctcctgattgaccctaataccgcgattccggtacagaacattcgcaatgatattcgagtcatcgcctcaggcaatggacaaaccgatcaaatccaactggaacatatacctaccagtaccgatattgaagtcggcgatatgctcgtcacctctggcttgggtggggtttaccctgaaggctacccagtggcgattgtgtcacaggtggataaagacacgcgccgtgagtttgcctcgatcaaagccgatcctgtagtagaatttgatcgcttgcgctacttattgctgatttggccaaacgaagatcgcttacaaaaagtgatgcaggctgatccgcaggtgctattagaggaagaagccaatgctcagcagtga

SEQ ID NO: 686 - DNA, 993 bp, Pseudomonas putida F1
atgtcggtcgcgttgatggttgtcgacgcgcgcttcgacgtgctcaaacccgtgcgcagccagatgggcctggtgctgatggagtcgtactggatcaccgatttgccacagcgtgcctggcaaggtgtggccggccagttcggtagccgcaccgagctgattgccgaaaacgagaagctcaagaccgaagccctgctgctgcaggggcgcctgcagaagctggcggccctgaccgagcagaacgtgcggctgcgcgagctgctcaattcttcggcgctggtcaacgaaaaggttgaagtggccgagctgatcggtgtcgaccccaacccgtttacccaccgcattctgatcaacaagggtgagcgtgatggtgtgttcctgggccagccggtgctcgatgcccgcggcctgatgggccaggtcgtagagttgatgccctataccgcgcgggtgctgttgctgaccgataccacccacagcattccggtgcaggtcaaccgcaacggtctgcgagccatcgccagcggcactggcaacccggagcgcctggagttgcgccatgtggccgacactgccgacatcaaggaaggcgacctgctggtcagttccggcatggggcagcgctttcctgccggctacccggtggccacagtcaacgaagtgatccacgattccggccagccctttgccatcgtccgtgccatccccaccgccgcgctcaaccgcagccgctacatgttgctggtgttcagtgaccggcgtagcccggagcagcgtgccaccgatgccgccattgcccaggaagaggctgaccgaaagggggctgcacctgctggccagccggccgctacccgtgatcaggtcgcacccgccgctggcacgcctgccgcgtcggtcacaccggcagcaccggccactccggtcgcgcagccagcagccccgtctgctgcacctgccacgccggccgcacccgctcaaccccggaggcaatga

SEQ ID NO: 687 - DNA, 921 bp, Psychrobacter PRwf-1
atgccaacaagcatctttgctcagtacagtctatcgttacgaaaaacagcggccgtgttattggtcgctatgattttgatgttactggatagcaaaaaccctgactggttcacaccaatccgtgataccagtcattcggccatgcagcctatttatcagatgtctgtgctgccaagttttgtgagtcactgggcagatggcactttgatgagtaaagaggcgctgcgtcgcgaaaacgtacagctgcatgcccaattgttgcatgctcaagccaaactacagcagcaggattatgtgttggcccaaaacgcccgcttgcaaggcatcttgtcgacgaccaagccggatcaatatgatttgaatttggcacaggttatcggcacagataccaaccccctaaagcagattgtggtgctgaataaaggcagcaatgatggggtggaagtcggtcagaccgcgatcgatgaaaatggcatcttgggacaaattattaatgtgtatcccaataccagccgtttgttattaatcactgatgaattgcagtcagtgtcagtgacagtgcgacgtaccggtcagcgtgctattgtttcaggggagggcacgccaagctccttgaagctggattatatatttaagacctcagatatccgagtcggtgatgagctcatatcatcagggctcggtggccggtttccagctggatatcgtgtgggccgtattgaatatattaatcctgagcaaaatgataattttatgaatatcgaagtaacgcccgcagctgattttgtgaacagctcgtatgtgctcattatgcaagacagcaagcactctccgcgttattccgatgacagctttaccgggtcattagagcttactcaggccccgtatgtgcccccaagccgtcctattgatgagccttag

SEQ ID NO: 688 - DNA, 990 bp, Pseudomonas aeruginosa PA7
ttggtgctggccgtgctgtcggtcagcctgatggtggtggacgcccggttcgactatctggagcccgtccgcagcaagctggggatggtgctcacgcctttctacggcctggcggaaatgccggtgcgcgcctgggaaggcgtgcgcgaccagttcagcagccgtagcgagctgatcgccgagaacgagcgtctcaaggccgagtccctgctgatgcagcgtcgcgtgcagaagctcgcggcgctcaccgagcagaacgtgcgcctgcgcgaactgctgaattccgccgcgctggtcgacgacaaggtgctggtcagcgaactgatcggcgtcgacccgaaccccttcacccagcgcatcatgatcgacaagggcgagaacgacggcgttttcgtcggccagccggtgctcgatgccagcggcctgatgggccaggtggtcgaggtcatgccctacaccgcgcgggtcctgctgctcaccgataccacccatagcatccccgtgcaggtcaaccgcaatggcctgcgcgccatcgccgtcggcaccggcaacccggaacgcctggagctgcgctatgtcgccgacaccgccgacatcaaggaaggcgacctgctggtcagttccggccttgggcagcgtttccccgccggctatccggtggccacggtcaaggaagtcatccacgattccggccagccgttcgccgtggtccgcgcggtgccgaccgcgaagatgaaccgcagtcgctacgtgctgctggtgttcagcgacagtcgtacgccggaacagcgcgccaatgacgccgcagaggcccaggaagaagcggacaagaaggccgccgccggcgcccaggcggccccgccggccgccgcgcccgccccggcgccggcaagccccgcgccgcagggtggcgccactcctgccgccggtgcccccgccgcgcccgcacaacccgccgcaccgacggcgcccgccgggggacgtcgctga

SEQ ID NO: 689 - DNA, 804 bp, Marinomonas MWYL1
gtgtctagcactcgttttgttgtgctggttattttgtctatggcgatgatcattgcagatgttcgttactctgttttctcacaagcaaggccttatttgaccttgcttgttacgcctattcaggttgtggtgaatacgcctcagaaaatgcttaattgggctggtgaacatcttgcaagtagagaagggttggtaaaagagaatcaatccctgcaagcagaaattttgttactgcgcagtcgccagcagcgtctcgattccctccaagcagaaaatgttcgtttgcgcgagttgctagatgcttctcaacgtgtagatgaaaagattgttatggcggaagttattggttttgatcagaatgcgtacagtcataaattaatgatagataaaggcttttcttctggtgcctacgttggtcaaccggttttagatgcaactggtgtattggggcaggtagtggaaacagcggcatacagtagtcgagtattattgattgctgatgcgagccattttgttcctgttcagcttactagaacagggtttagaggcattttgagaggcacaggaaacttaaaacgtttagagctaatgagtgttcctcgatctgttgatattaagaagggcgatattttaaccacttcaggattggataaacgttttccaagtggctaccctgttggtgtcgttagaagtgttaaatacacgcaaggtaaggcttatgcagatgtggatgtcgttcctttagctcaattgggacgtagccgtcatgttatgctgattgaaaagcctaaggcagggcgataa

SEQ ID NO: 690 - DNA, 1011 bp, Shewanella baltica OS185
atgaagccaatttttgttcgtggtatttcaaaccaattccgtctgacactggcaattattttgtcggtggccttgcttgtggctaatcatcgcctcgatcctgtgcggcaaaacctatcctctgtctttagtccattacagtatttagccagcgtgcccggtgcggcgcttgactggtcatctgaaagttttgccacccgcaatatgctggcgttgcaaaataaagagctgctcaggcaacaactgctgatgagtgaacgcttacagcgtttcgaacacttacgccaagaaaatgagcgtttgcgtgcactgttaggctcacccgcctatctggattcgcgcaagatggtggccgaagtgctagaggtcgccagcgatcctttccatcattacgtggtgctgaatcatggttcccgtagcggggtatttgtcggtcagcccgtggtggatgcacaaggtgttgtcggccaagtggtgcaggtcagtgaaatgaccagccgggtgttattgctctccgatgtatcgcacggattacctgtgcgtattacccgtaatgatgtgcgccttgtcgccaatggtacgggtgagcttgatgagatagaactgcgccatgtggccaagagtactgacattcgtgtcggcgatttattggtgacttcaggcttaggcaatcgtttccccgaaggttatcccgttgcgcgagtcatggaggttttgactgaagatggtcaaagttacgctcgagtcacggcccaaccgttagccgctttagatcgtattcgttatgtgttgttgatttggccgtctcccgattcgggtgtgaccttgcctaatcagcctacagtccccgctgcggatcattcgcttattgaaaactcatcaaaaattggcagtgcgagtccagcggaaggtacatctgcagacacgactaagcctgtgactacacccgcagccactgtggccaaaccggcaacggaaaccactcctccagcgactgaggtgcaccaatga

SEQ ID NO: 691 - DNA, 996 bp, Yersinia pseudotuberculosis IP 31758
atgaagccgatttttagtcggggtccatccctgcaactgcgactcttctttgccattattgcggccattgtactggttattgctgatagccggttgggtacgttcgttaaaatacggacttacatggacaccgcagttagccctttctattttctggccaatgggccacgtaaaattctcgacaacgtttctgatacgctagccactcgcgaacaactggagttggagaatcgtgcgttacgccaagagctgttactgaaaaataccgatcttcaattactggggcagtttaaacaggaaaacaaccgcttacgggaattattgggttctcctctgcgtcaggatgagcaaaaaatggtgactcaggtcatgtccagcgggacagacccttatagtgatcatgttgtgattgataaaggctcgaacagcggcgtttatgagggccaaccggtcattagtgatcgcggtgtcgtcggccaggttgttgcagtgagtaaatttaccagccgcgtattattgatttgcgatgcttcccatgcactgcctattcaggtgctgcgtaatgatattcgggtgattgctgccggtagcgggtgtagcgatgatttattattggagcatttacccagtaatacagatattcgtgtaggcgatgtgctggtgacgtcgggcttgggtgggcgcttccctgaaggctatcccgttgccgttgtctcttcggtcaaagtcgacaaccagcgcgcttatacggttattcaagctcggcccaccgcagatttacaacgcttacgttatttactgctattgtggggcgctgatcgtaatggtgatatgcccatgccaccggatgaggtacgccgggtcgccaatgaacgtctggcaccaatgatgtctcaggtgttgccttctgctgatgctatggggccgcctgcgcctgccgcatccacgcccgcgggtgccacaccaggagttgtcacaccaggagtttcgccgtga

SEQ ID NO: 692 - DNA, 891 bp, Vibrio harveyi ATCC BAA-1116
atgaaaccgatttttggcagaggcccatctctgcaattgcgtctgttttttgctgtcatcgtgtcggcgagcttaatgctggctgataaccgtctagatacgttttccaacgtccgatacctattgaacagtatggttgctcctattcagtatgcagccaatatgcctcgtagcatgtttgatggaatgttcgagcgtttaaacactcgtcaggcattgattgaaggcaatcgcaatttgaagcgcgaagtgcttcgcctgaagagcgagctgatcttgctcgaccaatataaagaagaaaaccaacgcctgcgcaaacttctcggttcttcctttgtccgtgacgagaagaaagtcgtgacagaagtgatggccgttgatacatcaccatatcgtcaccaagtggtgattgataaaggccgtattgatggtgtgtacgttggccaacctgttatcaacgagaaaggtatcgttggtcaggtgacgtttgttgcggcgcataatgcacgcgtattgctgctaacagatgcgaaaaacgcgattccagttcaggtaattcgtaacgatattcgcgtgatcgcttccggtaacggtgaagtggatgaaatccaactggaacacatcccaaccagtactgatatccaagtaggtgatttgctggtgacatcgggtcttggtggtatttacccagaaggctacccagttgcgacagtcacgaatgtcgatcacgatactcgccaagagtttgcatcgatcaaagcggagcctgtggttgagtttgatcgtctgcgctacttgttgttgatttggccgaatgaagaccgtcaacataaagtactgcaatccaatgtagaagaaggttcagaacaagaggtaaccgatggccaatag

SEQ ID NO: 693 - DNA, 1104 bp, Escherichia coli HS; identical to SEQ ID NO: 643

SEQ ID NO: 694 - DNA, 1104 bp, Escherichia coli E24377A
atgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctggcctcgcgtgaccaactagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatctaccagcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgacagcagggctgcaacgtttgcgttatctgctgctgctgtggggggcagatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgcagcaaccgacgacaggaaatgcagctactgcgcctgctgcgccgacacagcctgctgctaaccgctctccacaaagggctacgccgccgcaaagtggtgctcaaccgcctgcgcgtgcgccgggagggcaatag

SEQ ID NO: 695 - DNA, 897 bp, Shewanella sediminis HAW-EB3
atgaagcccatttttgcacgtggtatttcaaaccaattcaggctgacactagcaattattttgtcggtgatcctcatcgtggctaacaaccgactcgaccccgttcgtaaatctgtctcatctgttctaagtcctcttcaatacgttgctaatgttcccggtgcactcttagactggtcggccgagagtctcgcgactcgaaatatgctgacaaagcagaacaaggagctattgaggcagcaacttctgatgagcgagcgactacagcgcttcgaacacctcaggcaggaaaatgaccggttacgtgcactactgggctctcccgtgcatatggactcgaagaaggtcgttgccgaggtgatggaagttgccagcgatccctatcatcaatatgtggtactaaatcatggtgccatgagcggcgtgtttgtcggccagcctgtggtcgatgcccaaggcgtagtagggcaggtggtgcaggtcaatgagctaaccagcagggtacttctgatctccgatgcaacccatggtatcccggtaagagtcacgcgtaacgacgtgcgtctggtcgttaaaggcacgggagtgctcgatgaactcgagctcagttatgtgtctaagagtacagatatcagggtcggcgatctcttggtctcctcgggtttgggaaaccgttttcccgaaggttatcccgttgcccgtgtgatgagcgtggtcaaagatgacgggcaaagctatgccaatgtgatcgcccagccgttagccgcgctcgatagaattcgttaccttttgctgatctggcccgatgagcaggatgaaagtttgagtaaagatgagcttttgaacattgaaaatacctcagaatctacaaagcaaaccgctgaggtgagccaatga

SEQ ID NO: 696 - DNA, 1005 bp, Serratia proteamaculans 568
atgaagccgatttttagcagggggccttccctgcaactacgactttttttagcagtgattgtggctatctgcctgatcgttgccgacagccgtctcggtacgttcgtgaaaatacgtaactacatggatacggccgtcagccctttctattttctggccaatgggccgcgtaaggttttggacagcgtttcagaaacgctggctacccgccaacagctggagctggaaaaccgtgctctgcggcaggaactgctgctgaaaaacagcgatattcttcttcttggccaattcaagcaggaaaacgcccgtttgcgtgagctgttaggctcgccgctgcgccaggacgaacacaaaatggtcacccaggtgatctcgaccggatctgatccttacagcgaccaggtggtgatcgacaaaggttcggacaacggcgtttatgaaggccagccggtcatcagtgataaaggcgtagtcggccaggtagtcgcggtggcgaaagtcaccagccgcgtgctgctgatctgcgatgcttcacacgcgctgcctatccaggtactgcgcaatgatatccgggtgatcgctgcaggcagcggttgtgccgacgatttacagctcgaacacttgccgaacaataccgatattcgcgtgggcgacgtgctggtcacttccggcctgggcggccgcttcccggaaggctatccggtggcggtggtgtcctcggttaaagtggataaccagcgggcttataccgtgatccaggcacgcccgacggcgggtctgcagcgtttgcgctatttgttgttgctgtggggtgccgatcgtaatggcgatatgccgttgccgccggacgaagtgcatcgtgtcgccaatgagcggctgatgcagatgatgcctcaggtgctgccaccggccgatgccatggggccgcaacagccactgccggcaccggtaaccggcgttgcagtgccgcaaaccgccgcaccggccgcgggagtgacccaatga

SEQ ID NO: 697 - DNA, 888 bp, Shewanella pealeana ATCC 700345
atgaagcctatttttgctcgcggtatttccaaccaatttcgattaacactggctgttatcatgtcagtgattctgcttgtcgctaacgacaggctagagcctgtgcgtaattccctctcatcattattaagccctttgcaatatgtggctaatattcccggtgccttactcgatctttctgctgaaagtctcgcaacgcgcaatatgttggctaagcagaataaagagttattacgtcatcaactcttgatgagtgaacgcttacaacgctttgaacaccttcgccaagaaaacgatcgtttgcgtggattactcggctcgccagtgcatatggatgccaagaaagttgttgccgaagtcatggaagtggcaagcgacccgtttcgtcaatatgtggtactgaaccacggttcacgtaacggcgtatttgttggccaacctgtggtcgatgctcaaggtgtcgttggacaggttgtgcaggtgagtgagctcaccagtcgagtgttattactttccgataccacccacggtattccggtgcgaattacccgaaacgatgtacgcttaatggcgtttggaactggtgtgctcgatgagttagagctaagacatgtggccaagagtaccgatgttcgtgtcggcgatctgctggtgtcttccggtcttggcaagcgttttcctgaaggctaccccgtggctcgagtcatgagtgtcgaaaaagatgatggtaagaattacgctaccgttatcgcccaaccgttagcggccttagacagaattcgttatctgttactactctggccggatattgagtctgacggaaaagatcttactccgcctgaggagatagaagaggtcttgaaggcgagtcaggagagcactcaatga

SEQ ID NO: 698 - DNA, 1011 bp, Shewanella baltica OS195; identical to SEQ ID NO: 690

SEQ ID NO: 699 - DNA, 879 bp, Coxiella burnetii RSA 331
atgaataagttaatttttaaacgctcttcgatgcccgggctgcgtacccttatttatatggggctagcgatcgcattgatcgttttagatcaaaaggccctttttttccagaaaatacgggctgatttagcccttgtggttcttccccttcaatatttagtcagcgttcctataaagaccatccattggatcgctatcaatgtcactactcagcaagagttagtggccgacaatgcgcggttacgcgcgcatgagttgttgttggaatcgaagctgcaaaaattgctggcgctggagcgtgagaatgcccagttatggacattgttgaaatccaccgcccatgtgggaggcgctcgggtggcggtcgcgcaattactcgctgtgaatttagatcctaatcttcaacagattattgtggataaaggaatgcggaatcatatttatgtaggccaacctgtgcttgatgcctacggtgtggtggggcaagtgattcacgccggcctcctgacgagtaaagtaatgcttatttctgatcctaaaagtgctgttcccgtgcaagattaccgtaatggcattcgcgccctcgctcttggtatgggtagctcagggaagctcttgctgatcaatgttcccgacacaagcgatatccaaaaaggcgacctcttcgtgtcttcaggcttgggattgcgctatccggtgggataccctgtgggagtggtgactgaacttgaacgcgatccgactaaacgatttgcgacgattactctgcaaccttcggcccatcttgatcaatcgcagcaagtattaatgacttggccgaacaaagcctcattagctcaagacgtccatcaagaattgaacttaaaagagaaagagtaa

SEQ ID NO: 700 - DNA, 996 bp, Yersinia pestis Angola
atgaagccgatttttagtcggggtccatccctgcaactgcgactcttctttgccattattgcggccattgtactggttattgctgatagccggttgggtacgttcgttaaaatacggacttacatggacaccgcagttagccctttctattttctggccaatgggccacgtaaaattctcgacaacgtttctgatacgctagccactcgcgaacaactggagttggagaatcgtgcgttacgccaagagctgttactgaaaaataccgatcttcaattactggggcagtttaaacaggaaaacaaccgcttacgggaattattgggttctcctctgcgtcaggatgagcaaaaaatggtgactcaggtcatgtccagcgggacagacccttatagtgatcatgttgtgattgataaaggctcgaacagcggcgtttatgagggccaaccggtcattagtgatcgcggtgtcgtcggccaggttgttgcagtgagtaaatttaccagccgcgtattattgatttgcgatgcttcccatgcactgcctattcaggtgctgcgtaatgatattcgggtgattgctgccggtagcgggtgtagcgatgatttattattggagcatttacccagtaatacagatattcgtgtaggcgatgtgctggtaacgtcgggcttgggtgggcgcttccctgaaggctatcccgttgccgttgtctcttcggtcaaagtcgacaaccagcgcgcttatacggttattcaagctcggcccaccgcagatttacaacgcttacgttatttactgctattgtggggcgctgatcgtaatggtgatatgccaatgccaccggatgaggtacgccgggtcgccaatgaacgtctggcaccaatgatgtctcaggtgttgccttctgctgatgctatggggccgcctgcgcctgccgcatctacgcccgcgggtgccacaccaggagttgtcacaccaggagtttcgccgtga

SEQ ID NO: 701 - DNA, 978 bp, Pseudomonas putida GB 1
atgtcggtcgcgttgatggttgtcgacgcgcgcttcgacgtgctcaagcccgtgcgcagccagatgggcctggtgctgatggaatcgtactggatcaccgacttgccgcagcgtgcctggcaaggtgtggccggccagttcggcagccgcaccgagctgatagccgaaaacgagaagctcaagaccgaagccctgctgctgcaggggcgcctgcagaagctggcggccctgaccgagcagaacgtgcggctgcgcgagctgctcaattcatcggccctggtcaacgaaaaggtcgaagtggccgagctcatcggtgtggaccccaacccgttcacccaccgcatcctgatcaacaagggggagcgtgatggtgtgttcctgggccagccagtgctcgatgcccgtggcctgatgggccaagtggtcgagttgatgccctacacctcgcgggtgctgttgctgaccgataccacccacagcattccggtgcaggtcaaccgcaacggcctgcgtgccatcgccagcggcaccggcaacccggagcgcctggagttgcgccatgtggccgacaccgccgacatcaaggaaggcgacctgctggtcagttccggcatggggcagcgcttcccggccggttacccggtggctacggtcaacgaagtgatccacgactccggccagccatttgccattgtccgtgccatccccaccgccgcactcaaccgcagccgctatatgctgctggtgttcagtgatcggcgtagcccggagcagcgtgccaccgatgccgccattgcccaggaagaggccgaccgcaagggcaacgcgcctgctggccagccggccgctaccggcgagcaggctgcacctgccgtgccagccaccccggcagcgccggctacaccgcccgcgcagtcagcagccccagctgctgcacctgtcacgccggccgcacccgctcacacccggaggcaatga

SEQ ID NO: 702 - DNA, 1104 bp, Escherichia coli C ATCC 8739
atgaagccaatttttagccgtggcccgtcgctacagattcgccttattctggcggtgctggtggcgctcggcattattattgccgacagccgcctgaggacgttcagtcaaatccgtacttatatggataccgccgtcagtcctttctactttgtttccaatgctcctcgtgaattgctggatggcgtatcgcagacgctggcctcgcgtgaccaattagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatctgccggcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgactgcagggctgcaacgtttgcgttatctgctgctgctgtggggggcagatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgcagcaaccggcgacaggaaatgcagctactgcgcctgctgcgccgacacagcctgctgctaatcgctctccacaaagggctacgccgccgcaaagtggtgctcaaccgcctgcgcgtgcgccgggagggcaatag

SEQ ID NO: 703 - DNA, 1002 bp, Pseudomonas putida W619
atggtggtcgatgcgcgctttgacctgctcaagcccgtgcgcagccagatgggcctggtactgatggaatcgtactggatcaccgacttgcctcagcggatgtggcaaggcgtggcgggccagttcggcagccgtaacgaactgatcgcggaaaacgagaaactcaagaccgaagccctgctgctgcaggggcgcttgcagaagctggcggccctgaccgagcagaacgtgcgcctgcgcgagttgctcaactcctccgcactggtcaacgagaaggtcgaggtggccgagctgatcggcgtcgaccctaacccgttcacccatcgtatcctgatcaacaaaggcgagcgcgacggtgtgttccttggccagccggtgctcgatgcccgcggcctgatgggtcaggtggtcgagctgatgccctacaccgcacgagtgttgctgctgaccgacaccacccacagcatcccggtacaggtcaaccgtaacggcctgcgcgcgattgccagcggtactggcaacccggagcgtctggagctgcgccatgttgccgacacggctgatatcaaggaaggcgacttgttggtgagctccggcatgggccagcgcttcccggccggctacccggtggccacggtcaacgaagtgatccatgactccggccagccgttcgcgatagtgcgcgccattccgaccgccgcgctcaatcgcagccgctacatgttgctggtgttcagcgaccggcgctctccggagcagcgtgccaccgacgcggcgctcgcccaggaagaggcagaccgcaaagacgcagcgagccctgctcagcctggtgccaatggcgagcccgctgcccccgttacgcctgcacctgcaacgcctgccccggccacgcccgcggtccctgccacagcggtaccggccccgcccgctgcagcaccggcggcggcacccgccagccctgccgcagcgcctgcggcacctgcccagccccggaggcaatga

SEQ ID NO: 704 - DNA, 996 bp, Yersinia pseudotuberculosis YPIII
atgaagccgatttttagtcggggtccatccctgcaactgcgactcttctttgccattattgcggccattgtactggttattgctgatagccggttgggtacgttcgttaaaatacggacttacatggacaccgcagttagccctttctattttctggccaatgggccacgtaaaattctcgacaacgtttctgatacgctagccactcgcgaacaactggagttggagaatcgtgcgttacgccaagagctgttactgaaaaataccgatcttcaattactggggcagtttaaacaggaaaacaaccgcttacgggaattattgggttctcctctgcgtcaggatgagcaaaaaatggtgactcaggtcatgtccagcgggacagacccttatagtgatcatgttgtgattgataaaggctcgaacagcggcgtttatgagggccaaccggtcattagtgatcgcggtgtcgtcggccaggttgttgcagtgagtaaatttaccagccgcgtattattgatttgcgatgcttcccatgcactgcctattcaggtgctgcgtaatgatattcgggtgattgctgccggtagcgggtgtagcgatgatttattattggagcatttacccagtaatacagatattcgtgtaggcgatgtgctggtaacgtcgggcttgggtgggcgcttccctgaaggctatcccgttgccgttgtctcttcggtcaaagtcgacaaccagcgcgcttatacggttattcaagctcggcccaccgcagatttacaacgcttacgttatttactgctattgtggggcgctgatcgtaatggtgatatgccaatgccaccggatgaggtacgccgggtcgccaatgaacgtctggcaccaatgatgtctcaggtgttgccttctgctgatgctatggggccgccagcgcctgccgcatccacgcccgcgggtgccacaccaggagttgtcacaccaggagtttcgccgtga

SEQ ID NO: 705 - DNA, 897 bp, Shewanella woodyi ATCC 51908
atgaaacccatttttgctcgtggtatttcaaaccaattcaggctgacactggcaattattttgtcggtgatccttatcgtggcgaacaatcgtctcgatcctgtgcgtaaatctgtctcatctgtattaagccccctgcaatatattgctaacgttcccggtgcactcttagattggtctgcagagagtttagcgacccgcaatatgcttgctcagcaaaataaagagctgcttagacagcaactattgatgagtgaaagattacaaagattcgaacacctaaggcaggagaatgatcgtctacgatctttactaggatcgccagtgcatatggatgctaagaagattgttgccgaggtgatggaggttgccagcgatccttttcaccaatatgtggtgctaaaccatggtgcaagaagtggtgtttttgtcggtcaacctgtggttgatgctcagggtgtggttggacaggttgtgcaggtgagtgaactcagtagtcgcgtactgctgatatcagatgtgacccatgctattcctgtcagagtgacacgtaacgatgtcagagttgtggctaatggaacaggtgtactcgatgagcttgagctcaagtatgtctctaagagtacagatattcgtgttggcgatcttctggtctcctcaggccttggaaatcgattccctgaaggttaccccgtagcccgtgtaatgagcttagtgaaagatgacggtcagaattacgcaaatgtgatcgctcagccgttagctgcgttggatcgtattcgttatcttctgttgatatggccagatgagcccgcatctgaggcgttagaagatgaaacggcaatgatcttatctgcggcaaaaaaggcggcagaaaaagctgaggtgggcgaatga

SEQ ID NO: 706 - DNA, 951 bp, Xylella fastidiosa M12
gtgccctcctaccccggtttttcattagcgtctcgttcgccagcagttgtcagcacaatacgtttgctgacttacttaaccttggcaattgtgttggttgtgctcgacagtcgcggcgcttggttgtcgcagttgcgtcagcgggctaactggctggcgcagccggtgtgggcgctggctgggttgcctggttggtttggtggtcagctcagtgagcgtgcaatcagtaatgcgcgtttggttaacgagaaccgtcagttgcgcaatcagctgttgattgcgaatgcgcgtttgacccgattgcaaacggcagcacgtgacaatgcccagttgcgtgagttgcttaattttgctgagcatcacggtctggatgtgcagttggcgccgattctggatgttgatttggatccaactcggcagcgtcttgttctggatgccggcagccgtgatggtgtcagcgtcggtcaaacggtgattgatgctggcggtttaatgggtcaggtgattgaggtgacgccgctgcattcaattgtgctgctgttgaccgatccggatcacgctgtgccggtgactgtggcacgtaatggtgttcgcttgattgtttatgggcggggggatcgcttagagctgcgcaatattccgctgagttcaggtgtgaaaattggtgatgtccttattacttcagggctgggagcgcgtttcccggctggtttccctgtgggcaatatttcagcactgcacccggatgatagccatgcttttctagttggggagatcacgccggcagccaagttggatcgaggtcgtaatgtactgttgttgcgcttgggtgcgtccatgtcacctggtggtggagggtcgttaacatcaagatctattattgactcaaacagtgagtctcactccaccaaccttggcgcttccagggtaatcaaggagccgcagcaatga

SEQ ID NO: 707 - DNA, 1104 bp, Escherichia coli SMS 3 5
atgaagccaatttttagccgtggcccgtcgctacagattcgccttattctggcggtgctggtggcgctcggcattattattgccgacagccgcctggggacgttcagtcaaatccgtacttatatggataccgccgtcagccctttctactttgtttccaatgctcctcgtgaattgctggatggcgtatcgcagacgctggcctcgcgtgaccaactagaacttgaaaaccgggcgttacgtcaggaactgttgctgaaaaacagtgaactgctgatgcttggacaatacaaacaggagaacgcgcgtctgcgcgaactgctgggttccccgctgcgtcaggatgagcagaaaatggtgactcaggttatctccacggttaacgacccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatttgccagcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgactgcagggctgcaacgtttgcgttatctgctgctgctgtggggcgcggatcgtaacggcgctaacccgatgacgccggaagaggtgcatcgtgttgctaatgaacgtctgatgcagatgatgccgcaggtattgccttcaccagacgcgatggggccaaagttacccgaaccggcaacggggatcgctcagccgactccgcagcaaccggcgacaggaaatgcagctactgcgcctgctgcgccgacacagcccgctgctaatcgctctccacaaagggctacgccgccgcaaagtggtgctcaaccgcctgcgcgtgcgccgggagggcaatag

SEQ ID NO: 708 - DNA, 939 bp, Leptothrix cholodnii SP 6
atgccgctgggcacactcgatcgctcacccccaccgttcttccgccagggcccttcggcgctgacgcggctggttttcttcgcctcgctggcggtgttcctgatggcggccgacacccgcctgggcctgaccggcccgctgcgcacggccgccgcggtggcgctgcacccggtcgagcgcgccctgctggcgccggtcgatgcgctgagcaccgtgggcgcctatttcgacggcatcacggtggcgcgccagcaggccgacgccgcacaggcgcgactcacccagcaggccgagcgcacgctgcaggtcgatcgcctgctgcaggagaacacccggctgcgcgccctgctcgaactgcgcgccggcctgacctaccgcagccacgccgccgagatcctctacgacgccgccgacccgtacacccgcaaggtcgtgatcgaccgcggcgagaacgtcggcatcctgcgcggctcgccggtgatcaacgacgccggcgtgctcggccaggtcacgcggatctacccgctgaccgccgaggtgacgctgctgatcgaccgcgacgcggccatcccggtgctcaacacccgcacgcaactgcgcaacgtcgccttcggcgatccggacagcgccggcatggagctgcgctacgccgccgccaacaccgacgtgaaggtcggcgacgtgctcagcacctcgggcctggacggcgtctatccgcccggcctgccggtggcgcgggtggcaagcctggagcggcgcacccagaccgacttcgcccgcatcgtgctgcagccggtggcgcaggccgacggcgtgcgccatgtgctggtgctcgacccgatgtccacccagttgccggtccgccccgaggccgccgcctcggcggcgggccgcgacaaggacgccctgagcctgcgcaagtcgacccccaggcgctga

SEQ ID NO: 709 - DNA, 846 bp, Polynucleobacter necessarius STIR1
atgctgatcgattttcgtttcaaagcactcgatcccattcgcaacaatgtgaactgggttttgcgcccacttgaatatgtcatgatgatgccgcgcaatgcgtttaaagcaacatcagaatatttcacaactagatcaactcttgatcaagaaaaccaagtgatgaaagcgcaccaagcagaactctcgttgctggcaaaccaatctgaatttttgatggtagaaaaccaaaacctgcgcgagctcatggctttgcaaaagcaggtgccatttaaaacattgccggttgaaattctatttaatccacctaatccgatttcgcagcgaattgtgattaatcgcgggagcaacgacggcttaaagcttggtaacccaatcgctaacgattcaggcattttgggccaagtggtccgcctgtatgagcgctcagctgaggtttccctgctggaggaccatgattttgcggttccggtccaggtggctcgcaacggcttacgtgctactgtatttggcgcaggacgcggcaaccctctagaacttcggtacctacccgtagccagcgacctagaagttggggacattttgctgacctctggaattgatggtgtttacccgccaggatttgcagtggccgtcattagcaaaattgagcgcaacgtcgataaaaattcatccaacgttttttgtgtaccagttgccgcagtcaatcgctatcgccaggcgcttgctcttttatacaatccacagttcgatgccaaggctccggcaaatactaaatctactacaggcacaccattaacaaatactcctggtagacgccaaactcgcgcgcgaggaatgcagtga

SEQ ID NO: 710 - DNA, 951 bp, Xylella fastidiosa M23
gtgccctcctatcccggtttttcattagcgtctcgttcgccagcagttgtcagcacaatacgtttgctgacttacttaaccttggcaattgtgttggttgtgctcgacagtcgcggcgcttggttgtcgcagttgcggcagcgggctaactggctggcgcagccggtgtgggcgctggctgggttgcctggttggtttggtggtcagctcagtgagcgtgcaatcagtaatgcgcgtttggttaacgagaaccgtcagttgcgcaatcagctgttgattgcgaatgcccgtttgacccgattgcaaacggcagcacgtgacaatgcccagttgcgtgagttgcttaattttgctgagcatcacggtctggatgtgcagttggctccgattctggatgttgatttggatccaactcggcagcgtcttgtcctggatgccggcagccgcgatggtgtcagcgtcggtcaaacggtgattgatgctggcggtttaatgggtcaggtgattgaggtgacgccgctgcattcaattgttctgctgttgaccgatccggatcacgctgtgccggtgactgtggcacgtaatggtgttcgcttgattgtttatgggcggggggatcgcttagagctgcgcaatattccgctgagttcaggtgtgaaaattggtgatgttcttattacttcagggctgggagggcgtttcccggctggtttcccggtgggcaatatttcagcactgcacccggatgatagccatgcttttctagttggggagatcacgccgacagccaagttggatcgtggtcgtaatgtactgttgttgcgcttgggtgggtccatgtcacctggtggtggagggtcgttaacatcaagatctattattgactcaaacagtgagtctcactccaccaatcttggcgcttccagggtaatcaaggagccgcagcaatga

SEQ ID NO: 711 - DNA, 1086 bp, Shigella boydii CDC 3083 94
atgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctggcctcgcgtgaccaactagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatctgccagcgaatacggatattcgtgttggtgatgtgctggtgacctccggtctgggcggtcgtttcccggaaggctatccggtcgcggttgtctcttccgtaaaactcgatacccagcgcgcttatactgtgattcaggcgcgtccgactgcaggactgcaacgtttgcgttatctgctgctgctgtggggcgcggatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgcagcaaccgacgacaggaaatgcagctactgcgcctgctgctaatcgctctccacaaagggctacgccgccgcaaagtggtgctcaaccgcctgcgcgtgcgccgggagggcaatag

SEQ ID NO: 712 - DNA, 1224 bp, Stenotrophomonas maltophilia R551 3
gtgccgccctacgccggacctcccgtcgcttcccgatccggtgatgccgccagcccgctgcggctgctggcttacctcgcgctggccatcaccctgatcgtgcttgacgaccaggccggctggctggcgcgcctgcgcgggcaggccaacagtctggtgcagccggtgtgggcactggccggcctgcccggcaagctcggcaaccaggtcaaggactctgcagccagccacagccagttggtgaccgagaaccgcgaactgcgcaaccagctgctgctggccaacgcccgcctgacccggttgcagaccgccgcgctggacaacgcccagctgcgcgagctgctgaacgtagccgagcgcagtggcctggacgtgcagctggcgccgatcctggacatcgacctggacccggtgaagcagcgcctggtgctggatgcgggcagccgcgaaggcgtgcacgtcggccaggccgtgatcgatgtcgggggcctgatgggccaggtgatcagcgtcaccggcagcacctcaacggtgctgctgctgaccgaccccgaccatgcggtaccggtcaccgtggcccgcaacggcgttcgcctgatcgtctatggccgcggtgacaagctggaactgcgcgacatcccgctcagcgccggcgtggaagtgggcgacgagatcgtcacctccggcctcggcggccgtttcccggcaggcttcccggtcggcaccatcaccggcctgcgcccggacgacacccatgccttcctggtcggcgaactgaagccggcggcacagctcgaccgtggccgcgacgtgctgctgctgcgcccgggtgcggcgatccgcattccgccggaactgcgcctgcagctggaagagaccgccccgggtggcccggcggcgggcggaactgtgccggcggcaaccgcaccggccaccaccacgccggcacccgcacctgcaacgcctgcaccgactgtgggccggtcaccggctccgtccgcgtcgccgacggtggccccggcatctccagccagctccacggtagtgccggccgctggccggcagcaatccccgtctgcgacgaggaatgctgcccccgcatctttccttaaccccgcgcctgcggcgcgcccccttgaacaacaagggggctccactccagccagcgctccggtagtgccggccgctggccggcaaccgaccacgccggaggcccagcgatga

SEQ ID NO: 713 - DNA, 1053 bp, Salmonella enterica serovar Newport SL254
atgaagccaatttttagccgtggcccgtcgctacagattcgccttattctggcggtgctggtggcgctcggcgttatcattgccgacagccgcctggggacgttcagtcaaatccgaacgtacatggacactgccgtcagtcctttctattttatttcaaacggccctcgtgaactgctcgacagcgtgtcgcaaacgctggcttctcgcgaccagcttgagctggaaaaccgggcgctgcgccaggaattactgctaaaaaacagcgacctgctgatgctggggcagtacaaacaggagaacgcgcggttgcgcgagctgctggggtcgccgctgcgtcaggacgagcagaaaatggtgacgcaggttatttcaacggttaacgatccttacagcgatcaggtcgttatcgataaaggcagcgttaatggcgtatatgaaggtcaaccggtcattagcgacaaaggtgtcgtagggcaggttgtcgccgtggcgaaactgaccagccgcgtgttgctgatttgcgatgcgactcatgcgctgccgattcaggtactgcgcaatgacatccgcgtgattgccgccggtaacggctgtactgacgatcttcagcttgaacatctgcccgccaataccgatattcgcgtcggcgatgtgctggtaacgtccggacttggtgggcgtttcccggaagggtatccggtggcggtggtctcctccgtcaagctggacactcagcgcgcctataccgtcattcaggcacgtccaaccgcgggtttgcagcgtttacgctatctgctgctgttgtggggagccgatcgtaacggcgccaatccgatgacgccggaagaggttcaccgcgtcgccaatgagcgcctgatgcagatgatgccgcaggtgttgccttctccggatgcgatggggccgccggcgccagtgccggatccggcgacggggattactcagccatctgcgggccaggctgcgccggtatcaacgcaaccatcgccttcgggcgcgaccacgccgcctgcgcgtgcgccgggagggtaa

SEQ ID NO: 714 - DNA, 1053 bp, Salmonella enterica serovar Heidelberg SL476
atgaagccaatttttagccgtggcccgtcgctacagattcgccttattctggcggtgctggtggcgctcggcgttatcattgccgacagccgcctggggacgttcagtcaaatccgaacgtacatggacactgccgtcagtcctttctattttatttcaaacggccctcgtgaactgctcgacagcgtgtcgcaaacgctggcttctcgcgaccagcttgagctggaaaaccgggcgctgcgccaggaattactgctaaaaaacagcgacctgctgatgctggggcagtacaaacaggagaacgcgcggttgcgcgagctgctggggtcgccgctgcgtcaggacgagcagaaaatggtgacgcaggttatttcaacggttaacgatccttacagcgatcaggtcgttatcgataaaggcagcgttaatggcgtatatgaaggtcaaccggtcattagcgacaaaggtgtcgtagggcaggttgtcgccgtggcgaaactgaccagccgcgtgttgctgatttgcgatgcgactcatgcgctgccgattcaggtactgcgcaatgacatccgcgtgattgccgccggtaacggctgcactgacgatcttcagcttgaacatctgcccgccaataccgatattcgcgttggcgatgtgctggtaacgtccggacttggtgggcgtttcccggaagggtatccggtggcggtggtctcctccgtcaagctggacactcagcgcgcctataccgtcattcaggcacgtccaaccgcgggtttgcagcgtttacgctatctgctgctgttgtggggagccgatcgtaacggcgccaatccgatgacgccggaagaggttcaccgcgtcgccaatgagcgcctgatgcagatgatgccgcaggtgttgccttctccggatgcgatggggccgccggcgccagtgccggacccggcgacggggattactcagccatctgcgggccagactgcgccggtatcaacgcaaccatcgccttcgggcgcgaccacgccgcctgcgcgtgcgccgggagggtaa

SEQ ID NO: 715 - DNA, 1053 bp, Salmonella enterica serovar Schwarzengrund CVM19633
atgaagccaatttttagccgtggcccgtcgctacagattcgccttattctggcggtgctggtggcgctcggcgttatcattgccgatagccgcctggggacgttcagtcaaatccgaacgtacatggacactgccgtcagtcctttctattttatttcaaacggccctcgtgaactgctcgacagcgtgtcgcaaacgctggcttctcgcgaccagcttgagctggaaaaccgggcgctgcgccaggaattactgctaaaaaacagcgacctgctgatgctggggcagtacaaacaggagaacgcgcggttgcgcgagctgctggggtcgccgctgcgtcaggacgagcagaaaatggtgacgcaggttatttcaacggttaacgatccttacagcgatcaggtcgttatcgataaaggcagcgttaatggcgtatatgaaggtcaaccggtcattagcgacaaaggcgtcgtagggcaggttgtcgccgtggcgaaactgaccagccgcgtactgctgatttgcgatgcgactcatgcgctgccgattcaggtactgcgcaatgacatccgcgtgattgccgccggtaacggctgcactgacgatcttcagcttgaacatctgcccgccaataccgatattcgcgtcggcgatgtgctggtaacgtccggacttggtgggcgtttcccggaagggtatccggtggcggtggtctcctccgtcaagctggacactcagcgcgcctataccgtcattcaggcacgtccaaccgcgggtttgcagcgtttacgctatctgctgctgttgtggggagccgatcgtaacggcgccaatccgatgacgccggaagaggttcaccgcgtcgccaatgagcgcctgatgcagatgatgccgcaggtgttgccttctccggatgcgatggggccgccggcaccagtgccggatccggcgacggggattactcagccatctgcgggccagactgcgccggtatcaacgcaaccatcgccttcgggcgcgaccacgccgcctgcgcgtgcgccgggagggtaa

SEQ ID NO: 716 - DNA, 834 bp, Alteromonas macleodii  Deep ecotype
atgttgtcagtaacgctgatatttgtcgatcacaaaatggacgggttcaaatctacgcgagtgtatctaaactctttaatgagcccccttcagtatatcgctaacctccccggacttatgctaagtgaaagcgcccagcgtcttacttcacaagagcaactattgaccgaaaatcaaaagctcaacaatcagcttttgctaatgagcgaaaagcttcagcaattcgacgtgatcgaaaacgaaaacgcacagcttagagaattactgcaagcgccagtacgtgagtcatccagaaagatggttgccgagttaatggccgttgacaagaacccctacagtcagcaggtggtgatcaacaaaggcgcgatagacggggtttatccgtctcaaccggttattgacgacaaagggattgtaggtcaggtaatggaagtggggtcaacgaacagccgtgtattactgcttgctgacgttactcacgctatcccggtccgttctcttcgcaacgacattcgttttattgccacggggagtggcgccttaaacgaattatatcttgagcacgtaccgcacagcgttgacattcaagaaggcgatacgcttatttcttctgggttaggaaaggtttttcccgaaggttacccggtggctaccgttacccaagtggtacgcgatgaaagccgcccctttgcccgtgtaatagccacgcctttggcgaacttagacaggcttcgtcacctgctattgctatggaaaaaaactaatcctgagcgcgatgtaaaagatgagaccaagggcgagatggtaaacgaggaagaatcgaccgatgcgtaa

SEQ ID NO: 717 - DNA, 1053 bp, Salmonella enterica serovar Agona SL483
atgaagccaatttttagccgtggcccgtcgctacagattcgccttattctggcggtgctggtggcgctcggcgttatcattgccgacagccgcctggggacgttcagtcaaatccgaacgtacatggacactgccgtcagtcctttctattttatttcaaacggccctcgtgaactgctcgacagcgtgtcacaaacgctggcttctcgcgaccagcttgagctggaaaaccgggcgctgcgccaggaattactgctaaaaaacagcgacctgctgatgctggggcagtacaaacaggagaacgcgcggttgcgcgagctgctggggtcgccgctgcgtcaggacgagcagaaaatggtgacgcaggttatttcaacggttaacgatccttacagcgatcaggtcgttatcgataaaggcagcgttaatggcgtatatgaaggtcaaccggtcattagcgacaaaggtgtcgtagggcaggttgtcgccgtggcgaaactgaccagccgcgtgttgctgatttgcgatgcgactcatgcgctgccgattcaggtactgcgcaatgacatccgcgtgattgccgccggtaacggctgtactgacgatcttcagcttgaacatctgcccgccaataccgatattcgcgtcggcgatgtgctggtaacgtccggacttggtgggcgtttcccggaagggtatccggtggcggtggtctcctccgtcaagctggacactcagcgcgcctataccgtcattcaggcacgtccaaccgcgggtttgcagcgtttacgctatctgctgctgttgtggggagccgatcgtaacggcgccaatccgatgacgccggaagaggttcaccgcgtcgccaatgagcgcctgatgcagatgatgccgcaggtgttgccttctccggatgcgatggggccgccggcgccagtgccggatccggcgacggggattactcagccatctgcgggccagactgcgccggtatcaacgcaaccatcgccttcgggcgcgaccacgccgcctgcgcgtgcgccgggagggtaa

SEQ ID NO: 718 - DNA, 840 bp, Acidithiobacillus ferrooxidans ATCC 53993
atgcctgcattgtttttcccccgccgctacccgccgctccttcgcgtagcggtgctgatgttgttgactgtattcgtctcggtatccagcgaaaaacaccccaacatgggaaacgtctctttgaccatagcttatcctgtgcagtggatcagcatgcagggggcacgtctgtggcggcagaccgaccattacctgcaaagccgtgctgcgctggaatccgaaaacgtcagactacgcgccgaactcgtccatgcacagcccaagctgttggaagcagatattctgcgtgacgaaaaccgtcaacttctcgcattgctcgacagcatcccccacccgcccggaaaggtggccgtagcgcagattatcgcccaaaacttggcaccaggcagccagttattggtcgccaacctgggtacgcgtgcgggggtctttgtcggacaaccggtcctcgctgccggcggagtggcgggacaggtggttcgcgtttccccggagagcagcgaagtggcgctgctctccgacctggacagcagcatccccgtaaagcccgcaggctcggacacaccattgctggtggatggcacggggaacctggacagtcttacggtacccttccaaccgcgcaacacccccctgaaagtcggcgacaagctcgtcacctcgggtctgggtgggcgttacccggcggggctcaatgtcggtacgatttccgcagtcatccacaatggtgaccaaccctttgcacagattgcggtacgaccggccgttcacctcgggcgattgggcaccgtgctcatgctctgggttaacccagcctcccagcccgcagcagcgccatga

SEQ ID NO: 719 - DNA, 1053 bp, Salmonella enterica serovar Dublin CT 02021853
atgaagccaatttttagccgtggcccgtcgctacagattcgccttattctggcggtgctggtggcgctcggcgttatcattgccgacagccgcctggggacgttcagtcaaatccgaacgtacatggacactgccgtcagtcctttctattttatttcaaacggccctcgtgaactgctcgacagcgtgtcgcaaacgctggcttctcgcgaccagcttgagctggaaaatcgggcgctgcgccaggaattactgctaaaaaacagcgacctgctgatgctggggcagtacaaacaggagaacgcgcggttgcgcgagctgctggggtcgccgctgcgtcaggacgagcagaaaatggtgactcaggttatttcaacggttaacgatccttacagcgatcaggtcgttatcgataaaggcagcgttaatggcgtatatgaaggtcaaccggtcattagcgacaaaggcgtcgtagggcaggttgtcgccgtggcgaaactgaccagtcgcgtactgctgatttgcgatgcgactcatgcgctgccgattcaggtactgcgcaatgacatccgcgtgattgccgccggtaacggctgcactgacgatcttcagcttgaacatctgcccgccaataccgatattcgcgttggcgatgtgctggtaacgtccggacttggtgggcgtttcccggaagggtatccggtggcggtggtctcctccgtcaagctggacactcagcgcgcctataccgtcattcaggcacgtccaaccgcgggtttgcagcgtttacgctatctgctgctgttgtggggagccgatcgtaacggcgccaatccgatgacgccggaagaggttcaccgcgtcgccaatgagcgcctgatgcagatgatgccgcaggtgttgccttctccggatgcgatggggccgccggcgccagtgccggacccggcgacggggattactcagccatctgcgggccagacggcgccggtatcaacgcaaccatcgccttcgggcgcgaccacgccgcctgcgcgtgcgccgggagggtaa

SEQ ID NO: 720 - DNA, 858 bp, Aliivibrio salmonicida LFI1238
atgactccaatctttggtagaggtccctctctacagcttcgcctgtttattgctgtaatggtatcggctagccttatgttagccgatagtcgtttaaatgccttttctgacatacgttacctattaaatagttttgtttctccaattcattatgcggcgaatctgcctcgtactatgtttgatggcatgtatgagcgtttcaatagccgtaatgcactcatgtttgaaaatcagaaactcaaacaagacatgtttatacaaaacagcaatttattgttgttggagcaattaaagcaagaaaatagtcgattacgtgatttgcttggttccccttttattcgtgatgaaaaaaagttggtgacagaggtaatggctgtggattctgcaccctatacccaccaagtaatgatagataaaggccaagttgacggtgtctatgaagggcagccagttattagtgataaaggtattgttgggcaaattaactacgtaggtgcacataatagtcgcgtgctgttgttaaccgatcctaacaatgcgattcctgtacaagtagttcgaaatgatattcgtgttattgcatcaggaaaaggtaatttaaatttaatgcaacttgagcatataccaacaaatactgatattgaaattggtgatttattggtgagctcaggtttaggtgggcgatatcctgaagggtatcctgtcggttacatttctagtatagataataataataaacgcccttttgcatcgatagaattagaaactgcggttgaatttgataaattaagatatttattactcgtatggccaacagaaattgaaggtaagataaaggaagtgactaatgacgagtag

SEQ ID NO: 721 - DNA, 1104 bp, Escherichia coli O157 H7 EC4115
atgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctggcctcgcgtgaccaactagaacttgaaaatcgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtaattgcagccggtaacggttgtacggatgatttgcagcttgagcatctgccagcgaatacggatattcgtgttggtgatgtgctggtgacctccggtctgggcggtcgtttcccggaaggctatccggtcgcggttgtctcttccgtaaaactcgatacccagcgcgcttatactgtgattcaggcgcgtccgactgcagggctgcaacgtttgcgttatctgctgctgctgtggggggcagatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgcagcaacccacgacaggaaatgcagctactgcgcctgctgcgcccacacagcccgctgctaatcgctctctacaaagggctacgccgccgcaaagtggtgctcaaccgcctgcgcgtgcgccgggagggcaatag

SEQ ID NO: 722 - DNA, 879 bp, Thauera sp. MZ1T
atgtctctcgtcggccatcagccccctcccatcttccggcgcggcccggcacccttggcgcgcctgttcgtgttcgtcgcgctgtgcctcgtgctgctcgtggccgacctgcgcttccgctatctcgaggtgctgcgcaacgcgctgtccgtggtcacctacccgctgcagatggcggcgtcgacgccggccgacgtggtgcgcaacgcctcgcgctatttcggcaccctggtcgatgtgcagctcgagaacgcagagttgcgccgccaccagctcggcgccggcgaacgcctgctgcgcttcgagcagctcgagcaggagaacctgcatctgcgcgagctgctgcagatgtcgcagcgcgtgcagacgaagagcatcgccgccgacatcctctacaacgcgcccgaccccttcgcgcgcaaggtgatcctcgaccgcggcacccagcagggtgtcgaggccggtctcgcggtgctcgacgccaacggcgtgatcggccaagtcacccgcgtccatccggtccagtccgaagtcaccctgctcaccgaccgcaaccagtcgattccggtcagcgtggtgcgcaacggcgtgcgcggcgtgctctacggcgtcggccgcggcatgctggagatgcgccacgtactcgccgaggtcgatatccagcccggcgaccgcctcgtcacctcgggcctcgacggcatcttcgtgcccggcctgccggtggcgacggtgacccgggtcgatcgcgaccaggacgccttcgcgcgcatcgaatgcgagccgctggcggcgatcgagcgcagcgtgcaggtgctggtgatcgggcgcgccgcgtatccgccgcctccaccgccgcccgaacccgcgggagggcgctga

SEQ ID NO: 723 - DNA, 1011 bp, Shewanella baltica OS223
atgaagccaatttttgttcgtggtatttcaaaccaattccgtctgacactggcaattattttgtcggtggccttgcttgtggctaatcatcgcctcgatcctgtgcggcaaaacctatcctctgtctttagtccattacagtatttagccagcgtgcccggtgcggcgcttgactggtcatctgaaagttttgccacccgcaatatgctggcgttgcaaaataaagagctgctcaggcaacaactgttgatgagtgaacgcttacagcgtttcgaacacttacgccaagaaaatgagcgtttgcgtgcactgttaggctcacccgcctatctggattcgcgcaagatggtggccgaagtgttagaggtcgccagcgatcctttccatcattacgtggtgctgaatcacggttcccgtagcggtgtatttgtcggtcagcccgtggtggatgcgcaaggagttgttggccaagtggtgcaggtcagtgaaatgaccagtcgggtgttattgctctccgatgtatcacacggtttacctgtgcgtattacccgtaatgatgtgcgccttgtggccaatggtacgggtgagcttgatgagatagaactgcgccatgtggccaagagtactgacattcgtgtcggcgatttactggtgacttcaggcttaggcaatcgttttcccgaaggttatccagtcgcacgggttttggaagtcttaactgaagatggccaaagttacgctcgagtcacggcccaaccgttagcggctttagatcgtattcgttatgtgttgttgatttggccgtctcccgattcgggtgtgaccttgcctaatcagcctacagtccccgctgcggatcattcgcttatcgaaaactcatcaaaaattggcagtgcgagtccagcggaaggcacatctgcagatacgactaagcctgtgactacacccgcagccactgtggccaaaccggcaacggaaaccactcctccagcgactgaggtgcaccaatga

SEQ ID NO: 724 - DNA, 840 bp, Acidithiobacillus ferrooxidans ATCC 23270; identical to SEQ ID NO: 718

SEQ ID NO: 725 - DNA, 861 bp, Thioalkalivibrio HL EbGR7
gtgcgtctcgcgctgctcgccctgttttccatcggcctgatgtgggccgaccaccgtcatcagcacctccaggagttccgctccgccgtcgccatgctggtctatccggtgcaggccggcgtgaacctgccggtgcaggcgggggcctgggtgctggaacagctgcgcagtcaccagaccctggtggaggacaaccgccgcctgcgggaggaacagctgcacctcaacgcactgatgctgcgcttcgaggccctggaggaggaaaacgcccggctgcgcgagctgctggacacctccgtacggctgcgcgacccgctgatggcggccgagatcatggccgtggacctggaccccttccgccagcagctggtgatcaaccgcgggcgggtgcacggcgcctacccgggccagcccctgatcaacgcccagggagtggtggggcaggtgctggagagccaccccctgcacagcatcgtgctgctgatctcggacccgagccacgccctgccggtgctggtcaaccgcaccgggctgcgcaccctggccgtgggcaccggcaacccccagctgctggaactgcgctacatcccgcccgccgaggatctcgagcccggcgacatcatcagcacctcgggcctgggcgggcgcttcccggcggactacccggtggcccaggtcacccgggtcgaacgcatccccggcgagtccttcgcacgggtggaggcccgcccgctggcccgcctggaccgctcacgggaggtactgctgctgcgcccggtcaacggcaacgccacggagcgccccgctgagatcggggcagaggcgcccgccgcggaatcagccccggaggatcgcccatga

SEQ ID NO: 726 - DNA, 918 bp, Diaphorobacter TPSY uid29975
atgccactgggaaccctggaccgttcggcgccgacgctgttcaagcaggggccatcgccgctctcccgcctcaccctctacagcgccctggcgctgtttttgatggtggcggacgcacgctttcacctgacagagccgctgcgcaaggccgtgtccacggcgctgtacccgctgcagtggctgatgctgcagccggtggagttcgcggacaagggggctggatatttccagtcgctgcaggccgcacagcagggcatggacgacgcgcagcgcaccatggcgcaaatgtcggtgcgcgccggcgaggccgagcagctgctgcgcgagaacgccgagctgcgccagttgctggcactgcgcgagcgcctgaccaccgaggccacggccgcgcaagtgatttatgacacggcagacccctatacgcggcgtgtgatggtggaccgtgggcagctggcaggcgtggagccgggctcgccggtgatggatgcctcgggggtgctggggcaggtcacacgcgtgttccccatgctcagcgaagtcacactgctcatcgaccgcgaccaggccattcctgtgctcaacctgcgcaccggtgcacgcagcgtggcctacggcgacccggtggccgggcatggcggaggcatggagctgcgcttcacgccgggcaatgcggatgtgcaggaaggcgacctgctcaccaccagcggcgtggacggcctgtaccccgcgggcctgccggttgcgcgcgtgctgcgcgtggagcggcgtgccgactccgcctttgcgcgcatctactgcgctcccgtggcgcagatgtacggagcgcgccatgtgatggtgctcaagccggtggtggccgacctgccaccgcgccccgaacctgcgccggcggcgcccaagcgcgggggccgcaaatga

SEQ ID NO: 727 - DNA, 957 bp, Azotobacter vinelandii DJ
atgcgtctgttggtgctggtggtgctcgccgccacgctgatggtggtggatgcccgtttcgacacgctcaagccggtacgcagccaactgggattggtgctgacccctttctattggctggccgatctgccggtgcgcatctgggatggcgtcaatcagcagttcagcagccgtagcgagctgctagcggaaaacgagaagctcaaggccgaggccctgctgatgcaacgccgcctgcagaagctggcggcgctgaccgagcagaacgtgcgtctgcgcgaactgctcaactccgcggcgctggtggacgagaaggtgctggtcggcgagctgatcggcgtcgatcctaatcccttcacccatcgcatcctgatcgacaagggcgagcgcgacggggtgtttctcggccagccggtgctcgatgcccgcggtttgatggggcaggtagtggaagtcatgccctactcggcgcgggtgctgctgctcaccgataccacccacagcattccggtgcaggtcaaccgcaacggtctgcgcgccatcgccgtcggcaccggcaatccggagcgtctcgaactgcgccatgtcgccgataccgccgacgtcaaggaaggcgacctgctggtcagctccggcatgggccagcgctttcccgccggttatccggtggccgtggtgagcgaggtgatccacgattccggacagccgttcgccatcgttcgcgccgtgcccacggcggccctcaatcgtacccgttacatgctcatggtgttcagcgatccgcgctcgccggagcagcgcgccagcgaggcggcccaggcgcaggaggcgcacgatcgccagctcgccgagcaggcgaagaagcaggacgcgaagccctcggcggaggctgcgccggctcccgcgccggcgcagccggcacgaccggccccggcaagtgcgggtggggcacgctga

SEQ ID NO: 728 - DNA, 1245 bp, Dickeya dadantii Ech703
atgaagccgatttttagccggggcccctccctgcaactgcgcctttttttcactgtcattatcgcaattgtcatgatctttgctgacagtcggctcggtacgtttgtcaaaatcagaacctacatggatacggccgtcagtccgttctattttctggccaatggcccacgtcagatactggacaatgtgtccgccacgttgacttcccgcgaacagttggtacgtgaaaacgctgctttgcggcaggagttgctgttgaaaaacagcgatctacagttgcttgggcagtttcgtcaggaaaacgtgcgtttaagagaattgctgggatcgccgctgcggcaggaagagcaaaagatggtaacgcaggtgttatcgtccggcaccgatccctatagcgatcaggtggtgatcgataagggcgcatccgagggcgtgtatgaagggcaaccggtcatcagcgataaaggcgtggtagggcaggttatcgccgtggggcagttcaccagccgggtgttgctgatttgcgatgtgtcccatgctttgcctattcaggtgttacgcaacgatattcgtgtgatcgccgccgggaacggttgtaccgaagacctgcaactggagcatttgccgaacaatacggacatccgcgtcggcgacgtcctggtgacttccggtctgggaggccgttttccggaagggtatccggtggcggtcgtttcgtctgtcaaagtggatacccagcgcgcctatacggtgattcgcgcgcgtccgacggcggaactgcagcgcttgcgttatttattgctgatgtggggcgtggacaaaaattcccgcgtggcgctgccgacggacgatgtgcacaaggtggcgaacgaacgcctgatgcagatgatgccgcatgtgctgccttcgcctgatatggggccgccggcgccgtcgggaacaccggctcaggcgccggattttgtcgggccgcccgcgccgccggccaggagtgcgccagccgttcaggaacgacgtagccgttcatcgcagaatccgacgacatcgtctcagaatacgccggcccaggagtcatccgctcgtgccgcaacggcgccgggaacgcccgcgcagaacgcatcgggtagaactatgtcgacacaaaatgcgccgacacaaaatacgccgacacaaaatacgccgtctgaaagacgtcagccatcggcggcaagcccgggcgcctcatcgtcgggaggcaaccgatga

SEQ ID NO: 729 - DNA, 1152 bp, Dickeya zeae Ech1591
atgaagccgatttttagccggggcccctccctgcaactgcgcctttttcttgctgtcattaccgcaattgtcattatttttgccgacagtcggctcggtacgttcgtcaaaatcagaacgtacatggataccgccgtcagccctttctattttttggcgaatggcccgcgcgctatgctggataacctgtccgccaatctgacttcccgcgagcaactggaacgggaaaataccgctttgcgtcaggagctgttgctgaaaaacagcgatctgttgctgttggggcaattccgtcaggaaaacgcccgtctgcgtgaactgctgggctcgccgttgcgtcaggaagagcagaagatggtcacacaggtgctgtcctccgggtccgacccgtacagcgatcaggtggtgatcgacaaaggcaacgtcaacggcgtgtacgaaggacaaccggtcatcagcgataaaggcgtggtggggcaggttgtcgcggtggggcagtttaccagccgtgtgctgttgatttgcgatgcctctcatgcgctgccgattcaggtgctgcgtaacgacatccgtgtgattgccgccggcaacggctgcaccgaagatttacaactggagcacttgcctaacaatacggatatccgggtcggcgatgtgctggttacgtccggtctgggcgggcgtttccctgaagggtatccggtagcggtcgtctcgtcggtaaaagtggatacccagcgcgcctacaccgttattcaggctcgccctaccgccgagctgcagcgtttacgctatctgctgttgatgtggggcgtggacagtaattcccgtaccgcgttaccgcaggacgaggtacatcgggtggcgaatgagcgcctgatgcaaatgatgccgcacgtactgccgtcgccggaggaaatggggccgcctgctcctgcctcggccaatacatcgtcgcctgatttcgtcggcccgccggcgccgccggctaaagcggctccggcaaaagccactccaccgaaaacgaatggtgcggcgcagtctaagcctgccaatacggcgacgcctcgcaatacgacatcgccggctgtgaatcagacggcgccgtcaccgcagggaacgtcacccgctgcgccgggaggtagccgatga

SEQ ID NO: 730 - DNA, 984 bp, Pectobacterium carotovorum PC1
atgaagccgctttttagcaggggaccttccctgcaattacgactttttcttgctgtcgttaccgcgattgtcgtgatcgttgcggacagtcggctcggttcgttcgtcaaaatcagaacgtacatggataccgccgtcagcccattttattttctggcaaatgggccccgtcaggttctggacaacatgtccgcctcactggcgacccgtgagcaattaggccttgaaaatactgcgctgcgtcaggagctgttgatgaaaaacagcgacctgttgatgttaggccagctcaagcaggaaaatgcgcggttacgtgaactgctcggctcgccgctgcgtcaggatgagcagaagatggtgacgcaggtgatgtctgccggaaccgacccctacagcgatcaggtagtgattgataaaggtcagacgaacggcgtgtatgaagggcaaccggtcatcagcgataaaggcgtggtgggtcaggttgtggcggttgggcagtttaccagccgggttttgttgatttgtgatgtttcccacgcgctgcccattcaggtgctgcgcaacgatatccgcgtgattgctgccggtaatggctgcgccgacgatctgcaactggagcatttgcctaataataccgatattcgcgtcggtgacgtgctggtcacatcggggctgggcggacgtttccctgaagggtatccggtcgcggttgtgtcatcggtcaaagccgatacacagcgcgcctatacgattattcaggcacgcccgacggcggggctacagcgcctgcgctatctgttgttactgtggggcgtggagaacaactccaatacctcgttgccgccagcggaagtccatcgggttgccaatgagcgactgatgcagatgatgccgcaggtgttaccgtcgcctgacgacatggggcctccgttgcctcctgataccgctgcgcccaccgtcgagccgcagagaggccgccaatga

SEQ ID NO: 731 - DNA, 897 bp, Nitrobacter winogradskyi Nb-255
atgtcctcgggcttgaccggatcggtcttgaccggagatgcgataccagcttgcgtgagaaaacgcttccagaacaacggttcggggttggcttcctcgtggcgtcgctatgtcgccgcaggccaccgcatacaatcgctttcatcgaccgcgccgagctactatttattcgccatgccgacactgatagcaggcctcttcacgttcctgtttctgtatttgctgcttcaattgttgcgggcggcaaatccggccgttctggcgcgagccatcaggctcgccggcggcatcatcgcgtttggaatggcggctttcataggcagcaggggggagctggcggttgcgctgccgctagcgcttctcggcgtcggacttttgggatggtcgtcctcgggcatgtcattcttcgccaggctttttggcgcgggaatgcagcgtacggcccacggacacacgtcccaggttcgttcgcggtttctcgaaatggtcctggatcacgccagcggccgcctcggcggatggatcattgacggacccgatgccggccgctcgctggatgacttcgacctgcctcgactcctcgccatgatgacaggcttcgacgcggagagttgcgcgctacttgaagcttatctggaccgcaggtttcccgcctggcgtcataacgcgcaaggcgatccggcaggggggaggagccgcgcgtcgccgggcggcaaaatgacggacgaggaggcctatcagatccttggcttgcagccgggggcgggaaacgacgagattcgtcgcgcgcatcgggggctgatgaagaaactgcatcccgaccagggggggtcgacgtacctcgcggcccgcgtaaacgcggccaaggatactttgcttcgcactcatcgcagctaa

SEQ ID NO: 732 - DNA, 759 bp, Nitrosococcus oceani ATCC 19707
gtgcgtcctatcgttctgcttgctttacttggcctcatcggggctattttattgcgccgttggatcgccaacacccctcgtccagtagcgatacgggctatgcgccggatcggtatcgcactaattgtcggcattttcctgcttcttacggccacgggccggctaccctggattatggctctattaggggctctagcagcaggggttgcacggctgctgcctttacttcgctttgttcctttgctgcaacggctatgggcttaccgccacgccaacgcgggttttggcaatcagagcgccggcaccgccgacccccagcagtccaccgctgaggctcggttcgtgcgcatgaccctggatcacgaaacgggagagatgagcggagaggtcctggcaggcacttttgcaggtaaaccaatggacgcgctggatttgtccgacttaacccagttgctgttggaatgccaggctgcggatgaaaaatccgcggccctggtgcgagcctatctagaacgggtttatggagaggattggcaagcccaggctaatgctcaaagacaggggaattcttccccgggtcaagcggaaatgacaccagaagaggcccatcaaattctgggtttggcagtgggcgccagcgagcaagaaatcattgccgcccaccgtcggctcatgcagaaagttcatccggatcgcggcggctccgattatcttgctgcaaaaattaaccaggccaaagagatattgcttggaaaataa

SEQ ID NO: 733 - DNA, 735 bp, Rhodopseudomonas palustris HaA2
atggcatccatgactctgatcgtcggcgtcgtcgccgttttcgttctctacatgctgctgcagatggtccggacggccaacccggccgtgctggcgcgcgcgatcaaggtcgccggcggcatcgtcacgctcgcggcggcgctgttcaccggcgtcaagggacagctggctgtggcgatcccgctcggcctgttcggcgccggcctgctcggctgggcgccgatgggcaatgccggcttcggcaggctcggcggcgtgttcggatcagcgggacggcgctcgcccggccagacctcgcaggtgcgatcgtcggcgctggagatgacgctcgaccacgagagcggtgcgatcaacggccgcattctgaccggcgcccatgccggccgctcgctcgacgcgttcgatctttccgaactcgccgcgatgatggccggcttcgacgccgagagctgtgcgctacttgaaagctatctggaccgccggtttcccgcctggcgtcagaacgcgcagggagacgcggcagggcggcgtggaagccagccgtcgggcagcaaaatgacgaccgaggaggcctatgagatccttggcctgaagccgggcgcggggccggacgacatcggccgcgctcaccgcgccctgatgaagaaattgcatcccgaccaaggggggtcgacgtaccttgccgcccgtgtaaacgcggccaaggatactttgcttcgcacgcatcgcagctga

SEQ ID NO: 734 - DNA, 738 bp, Rhodopseudomonas palustris BisB18
atggaggccatgcctacgctgatcgccggcgtcgtcgccgtcatagtgctgtattcgctgttgcagatgttccgggccgccaacccggcggtgctggcgcgtggcatcaagatcggcggcggcgtggtgacgctggcggtggcggcgttcaccggcatcaagggcgagttggctgtggcgatcccgttggggatcttcggcgccgggctgctcggctgggccccattcggcagcggcgccttcggcaatctcgggacactgttcggctcgcgcggaaagcgctcggccggccagacctcgcgcgtggtatcgcaatacatcgagatgatgctggaccacgacagcggggccttgagcggccggtttctggccgggccgcaggccggccgcgcgctcgacgagttcgatctgccgcaactggcggcgatgatcccggcgttggacgccgaaagctgcgcgctacttgaaagctatcttgaccgccggtttcccgcttggcgtcagaacgcgcagggtgagcgggcaggggggcagagccgcgagacgtcgagcggcaaaatgacggacgaggaggcctatcagatccttggcctgaagccgggtgcggggcgagctgaaatcgggcaagcccaccgtacgctcatgaagaaactgcatcccgaccaaggggggtcgacgtaccttgccgcccgcgtaaacgcggccaaggatactttgcttcgcactcatcgcagctaa

SEQ ID NO: 735 - DNA, 729 bp, Rhodopseudomonas palustris BisB5
atgcctacattgatcgccggcgttatcgccgttttcgttctctatactgtgctgcagatggttcggtcggccaacccggccgtgctggcgcgggcgatcaagatcgccggcggcatcgtcacgctcgcggcggcgctgttcaccggtgtgaagggcgaattggcggtggcgatcccgctcggcttgttcggcgccgggctgctcggctgggcgccgatgggcaatgccggatttggcaggcttggcgggctgttcggatcggccggccggcgttcgagcgggcaatcgtcccgggtgcgctcgtcctatctcgagatgacgctcgatcatgagagcggtgcgatcagcggccgcctgctggccggcccgcaagcgggccgctcgctggacgagttcgatcttcccgagctcgctgcgatgatgaccggcttcgacgccgagagctgtgcgctacttgaaagctatctggaccgccggtttcccgcttggcgtcagcacgcgcagggagacccggcaggggggcagggacgccagacgtcgagcggcaaaatgacgaccgaggaggcctatcagatccttggcctgcagccgggcgcggggcctgacgagatcgggcgcgctcaccgcaccctgatgaagaaattgcatcccgaccaaggggggtcgacgtaccttgccgcccgtgtaaacgcggctaaggatactttgcttcgcacgcatcgcagctga

SEQ ID NO: 736 - DNA, 786 bp, Nitrobacter hamburgensis X14
gtgtgtcgccgtgaccgctttcaacaatcgctttcgccggttgcgccgacatactatctatccgccatgccgatcctgattgcaggccttctcgccttcgtttttctgtatttgctggttcagctgctgcgggctgcaaacccagccgtgctggcgcgagccatcaggctcgccggcggcatcgtagcgctcgcggtggctgcctttaccggcatcaagggagaactggtggttgcgctgccgctcgggattttcggcgccggacttttgggctggtcgccgtccagcgcatcgttcttaggcagactcttcggcgcgcggacacagccctctgtgggaaagacgtcccaggtgcgttcgcagtttctcgacatggtcctggatcacgacagcggccgtctcggcggatggattgttgccggacccgacgcgggtcgctcgcttgacgatttcgacctgccgcagcttgtcgcaatgatgacgagcttcgatgccgagagctgcgcgttacttgaaagctatctggaccgcaggtttcccgcctggcgtcagaacgcgcaaggcgatccggcaggggggcgaagccgcgcgtcgtcgggcggcaaaatgacgaacgaggaggcctatcagatccttggcttgcagccgggggcgggtggcgacgagatccggcgcgcgcatcgagggctcatgaagaaactgcatcccgaccagggggggacgacgtacctggcggcccgtgtaaacgaggccaaggacactttgcttcgcactcatcgcagctaa

SEQ ID NO: 737 - DNA, 696 bp, Mesorhizobium BNC1
atgacctctccgctctttcttatcggccttttagttgtgctcgcgttcgccgcctatgccttttcgcgcgcgagcccggcggcaatcgccgccgcggtaagattggcggggccgacattggtagcgctttgcggattggcactgatgcttgcgggcagggcaggggtcggcggaacccttctgtcgctcgcggccgcctggctgggaactgtcaggctgagccaacgcagaaagcgatcggccggcacgcggtccagcgttcgctcggctgcgctcgaaatggaactcgatcacgatagcggatcgcttgagggaacagtccttgcgggccggttcgaggggcgcaaactgggagagctgccgctcgacgatcttctgctcttacacgccgaacttgccgaggatgaagaaagcctccagctactggagacgtatcttgacggcaggtttcccgtttggcgcgaacgcgttcagacgaaccatgaccgacggcagcgaggcgcgccagcttctggccccatgagtgaggaggaggcttacaagatccttggtcttgaagttggagcgtccgcggcggaaatccgcaaggctcatcgccgtctgatgcagcgcctgcatcccgatatgggaggctccgcctttcttgccgctcgtatcaacgaggctcgggacgttctcctgtccgatcatcgctag

SEQ ID NO: 738 - DNA, 762 bp, Psychromonas ingrahamii 37
atgttagtatttatcgctttaatagcggttatcatcatcggctatatcacagtcggatatattcgaactctgaaacgggaacaaagaaagaaagtcggtgcgaaagccggcgtgctcgcgtttatcgcgacgctaatcttgctaacagtcactggaaagctttatattttggcagcactgggaacaggtttagttgtatttgctaagcgcttgttaccctttctacgttactttccgttttttaaaggcctttaccagaaggctaaaactaaacagagttcgggttcatccaagcattctactgttgaaaccagtttactaaaaatgaccttcgatcatgaaagtggtgaagtagatggtgaattattggacactgttagcaagggtaaatatctgtctgaatttgatctgccagatttaatctctctctatatcctagctggtaaggaatatccagatgctattgagattttggctgcctatcttgatcgcaagtatggtgctgactggcgcgaagctgccaatgcaggaaatggctatcaagagagcgggcaaaaatctcgtggaagcgatagcagtaagatgactgtaattgaagcttatgcagtactgggccttgataataacgcaacggaggaagatattatcaaggcccaccgcaaactgatgctgaaactccacccagataagggaggaagcaattatctggcagcaaaaataaaccaggcgaaagatttactagtgagcagcaaggagaagtaa

SEQ ID NO: 739 - DNA, 717 bp, Bradyrhizobium BTAi1
atgacactgatcgctggcgccgttgccgtcatcaccctctatctgttgctgcagatgttccggaacgccaacccggccgcgctggcgcgcgcgatcaaggtcgccgggggcatcggctgtctggccgccgcggcctttaccgggatcaagggcgagctggtggtcgccattcccatcggcctgtttggagcggggctgctgggctggagcccggctggcctcggcagcttcggaaacatgttcgggctggggtcgcagcgctccggcggtcaaggctcgcgcgtgcgctcgcagttcatcgagatgacgctcgatcacgacagcggtcgcgtggagggacggttcgtcgccggcgcgcatgccggccgcgcgctggacgaattcgatctggcgcagctcgcggcgacgattccgagtctcgacgcggacagcgtggctttacttgaaacgtatctggaccgccggtttcccggatggcgtcagaacgcgcagggcgacgcggcagggcggcagcgccgcgcggcggcgagttccaaaatgacggacgaggaggcctatcagatccttggcctgcagccgggcgcggggcgcgacgagatcggtcgagcccaccgtgcgctcatgaagaaactgcatcccgaccagggggggtcgacgtatctcgccgcgcgggtgaacgaggccaaggatactctgcttcgtacgcatcacggctaa

SEQ ID NO: 740 - DNA, 729 bp, Xanthobacter autotrophicus Py2
gtgatcagcctgattgccggtgccctgctgctgatcatcggcctctacggcctcaagatctggaccaaggccgaccccaaggtgctgatggccatcctcatgcgctcgctggcctatgcggctttgctgggcgcggcgggggcgctggccatgggacggttcggggcggcgatcccgctggcggcggtgggcatcggcctgctgggccggctcgatccgcagggggtgggcggctatctcggcagcctgttccgtaagcgaggcgcaccgcaggtctcgaaggtgcgcacccagttgctggagatggagctggaccttgccagcggtgagatgaagggcgtcgtcgtttccggtcccgatgcgggcaccacgctcgatgcgctggacgtgccggccctgcttgccatgcgccgcatctgcgatccgcaatcgctggcgctactcgaagcttatctcgaccgccgggcgcccgcctggcgtgagcacgcacagacggatgcgggtggcgggaatatgggcgcgggtgagagcgtccgcgcgggcagcgacgcgatgaccgaagaggaagcctatcagatccttggccttgagccgggtgcggacaccgaggctgtccgcgcggcgcaccgcgccctcatgaagaggctccaccccgacctgggcggatccagctatctcgcgtcgaggataaatcgcgccaaggacgtgatcttgcgcaagcatggctga

SEQ ID NO: 741 - DNA, 729 bp, Rhodopseudomonas palustris TIE 1
atgcctacgttgattgccggcgccatcgccgttttcgtgctctacacgctgctgcagatgttccggtccgccaacccggcggtgctggcgcgggcgttgaagatttccggcgggatcgtcatgctggcggcggcgctgtttaccggtgtcaaaggcgaactggcggtcgcaatcccgctcggcctgttcggtgccgggctgctgggctggacgccgctgcagaacgccggcttcggcaatctcggcgggctgttcggaggcctgggcgggcgctcgcgggggcaggcctcgacggtgcgctccacctatctggaaatggtgctggaccacgacagcggtgcgatgaccggacggatcctggccggccccaatgccggacgctcgctcgacgaattcgacctcggccagcttgctgcaatgctggccggcttcgatgccgagagctgtgcgctacttgaaagctatctggaccgccggtttcccgcttggcgtcagaacgcgcatggagatgcggcaggggggcagcgtagccaggcgtcgggcagtaaaatgacgaccgaggaagcctatgagatccttggcctgcagccgggagcggggccggacgagatcggacgcgcccaccgcactctcatgaagaaattgcatcccgaccaaggggggtcgacgtaccttgccgcccgggtaaacgcggccaaggataccttgcttcgaacgcatcgcagctaa

SEQ ID NO: 742 - DNA, 723 bp, Methylobacterium sp. 4-46
atgatccctctcggtctcggcgtgctcgtcctcaccggcctgtggtggctcggccgcaatgccagcaccgccaacccggccacgctcgccaagctgctgcggcgcctcggcgggctgctcgccctggcggccgccgcgctgctgttcctccgcgggcgcttcgacgcggcgatcctcctcggcctgttcggcggctcgctcctcggctggcggcagatgccagccctcccgttcggcctcggcggggcggcggcgccgcgcgcggccggcaccgcgtcccgggtgcgctcggccacggtcgagatggaactcgaccacgacaccggcgccctgcgcggccgggtgctgaccgggcccctcgccgggcgggacctcgacacgctcggcctgccggacctgcgcagcctcctcgccgccgcccgcgcgggcgacccggagggcgagaagctcctagaggcgtatctggatcgccggtttgccggatggcgtgaagacgctgagcgcgacgcggacccgcggccgggcggagcggcgcagccagggccgatggcggaggatgaggcttatcagatcctggggcttcagcccggggcgtccgccgaggaggtgcggcgcgcgcaccggaccctcatgaagcggctgcacccggaccagggcgggtcggactacctcgcggcgcgcgtcaacgcggccaaggaccggcttctcaaccgacatcgctga

SEQ ID NO: 743 - DNA, 732 bp, Methylocella silvestris BL2
atgatctatcttatcgtcgcctttctcatgctttggctttcgctggccgggcttcgcgccttcgccaacgccaatccggcgacgctcgcaagggtgatcagccgcggcggcggaatagctctgcttgtcttcgccgcctttctcatggcgcgcggcgccgtctccatcgctctcggcttcggcggtctcggcctctggcttttgaaaggcgggcgcggcccgttgctttcgctgtttggctggccgtcggcggcgagacggtccggcgcctccgcgcgggtctcctgcgtcagatcggcgatgatcgagatgcagcttgaccatgagacgggaaagatgcgcggcgtgatcctggcgggcgaggatgagggaaggcagctagactcgctgacgcgcccgcagtgtgaagtcctctacgagctttgccgtcgagacgatccggagggcgcccgccttctggaagcatatctcgatcgccggtttgccggctggagtcacgcaggacaggctcaaggcgactcgcggagcggcgaggcggggcgtcgcgctggggccatgacccaggatgaagcgtatgaagtcctggggcttgctaaaggcgcgtcgcgtgaggaagttgttcggtcgcaccgctcgctcatgaaaaagcttcatccagatcatggcgggacgacggatctggcggcgcgggttaatgaagcgaaagaagtcctgatgcggcgtcatccgtag

SEQ ID NO: 744 - DNA, 726 bp, Methylobacterium nodulans ORS 2060
atgattgctctcggtctcggcgtgctggtcctggtcggcctgtggtggctcggccgtcaggcgacgaacgccaatccgaccctcctggcgcgggtgctgcggcgcctcggcggctggctcgcgctcgcggtggcggccgtgctgttcctgcgcgggcgcttcgacatggcgattgcccttgggctgatcggcggctggctcctcggctggagccagatgcccgcgctgcccttcggcctggggcagcagggacccgcgccgcgcagccccggcagcacctcccgggtgcgctcgatgatgatcgagatggagctcgatcacgagaccggggcgatgcggggtcgcgttctcgccggaccgcgagccgggcaggcgctcgacgccctgccgctgccggacctgctcgccctcctcgccacctgccgcgccggcgatccggacggagcgcggctcctagaggcttatctggatcgccggtttgccggctggcgtgaacacgctgagggcgatgcggacgcgcggccgggcgctgcgccgcagccaggggcgatgacggaggaggaggcctatcagatcctggggcttgagcgcggggcgtccgtggaggacgtgcgccgggcgcaccggaccctcatgaaacggctgcacccggaccaggggggatcggactacctcgcggcgcgcgtcaacgcggccaaggaccggcttctcaaccgacatcgctga

SEQ ID NO: 745 - DNA, 1755 bp, Frankia CcI3
gtgcaggtccacaggtacgacgcagtcatcgtcggtgcgggtggagccggcatgcgtgccgccatcgaggcgggcacccgctgccggaccgccgtgctcaccaagctctatcccacccgctcgcacaccggcgcggcgcagggcggcatgtgtgccgccctggccaacgtcgaggaggacaactgggagtggcacaccttcgacacgatcaagggcggtgactacctggtcgaccaggacgccgcggaaatcatggcgaaggaggccatcgacgctgtcctcgacctggagaagatggggctgccgttcaaccggacgcccgagggtcgcatcgaccagcgccggttcggcggccatacccgcgaccacggcaaggccccggtgcgccgctcctgctacgcggcggaccgcaccgggcacatgatcctgcagacgctgtaccagcagtgcgtcaagcacgacatcgagttcttcaacgagttctacgtcctcgacctgctactacagaagggcgcggcggccggggtggtcgcctacgagctgaagaccggagagatccacatcttccaggccaagtcggtggtgttcgccaccggcggtttcggcaaggtcttcaaggtcacctccaacgcgcacacactgaccggtgacggaatgggtctggcgttccggcggggcatcccgctggaggacatggagttcttccagtttcatccgaccggcatctggaagatggggattctcctcaccgagggtgcccgcggcgagggcggaatcctacgcaacaaggacggcgaacgcttcatggagcgctacgccccgaccatcaaggaccttgcgccacgcgacatggtggctcgcgccatctacaccgagatccgtgccggccgcggctgcggcccggacgccgaccacgtctaccttgacctcacccacctgccgccggagcacctcgacgcaaagctgcccgacatcaccgagttcgctcggacctatctcggcatcgaaccgtacaacgacccgatcccgatccagccgacggcgcactacgcgatgggcggcatcccgaccaacgtggacgcgcaggtgctcgcggacaacgacacggtcgtgcccggtctgtacgcggccggcgaggtggcgtgcgtgtccgtgcatggcgcgaaccggctgggcaccaactcgctgctcgacatcaacgtattcggccggcgggctggcatcgccgccgccgagtatgcgaacgcgaacgcacagcacgtcgacctcccggagaacccggcgtcgttcgtcgaggacctgctcgggcgcctgcgcgcgggcgccggaaccgagaacgcggccgcgatccggcgcgaactgcaggagtcgatggacgtcaacgcctcggtgtaccggacggaggcgacgctcaagcaggcgctgagcgacatctccggcctcaagacgcgttaccagcgggtgggcgtgtccgaccgggggcgtcgctacaacaccgaactgctcgaagcggtggagctcggcttcctgctggacctcgccgaggtcctggtcatcggggcgatggcccgcaacgagtcccgcggcggccactcccgtgaggactacccgaaccgggacgacgtcaacttcatgcgccacacgatggcctaccggtcggggccgctggtggccgcctcgccggaggcggagatccgcctggactacaagccggttgtcatgacccgctaccagccgatggagcgcaagtactga

SEQ ID NO: 746 - DNA, 1752 bp, Deinococcus geothermalis DSM 11300
atgcaccatcgttacgacgtactggtggttggcgcgggcggcgcgggactgatggccgccctgtacgccgccaagggcaacgtgtcggttgcctgcatcagcaagctctatcccacccggtcccacaccggcgctgcccagggtggcatcggcgcggcgcttggcaacgtgtccgaggaccactgggaatggcacatgttcgacaccgtcaagggcggcgactacctcaccgaccaggacgcagcggagatctttgccaaggacatcatcgaggcggtgtacgaactcgaacacatggggctgccctttagccgcctccccaacggcaagattgcgcagcgcaagttcggcggccacacccgtgacttcgggaaggcggcggtcgagcgctcctgctacgcacaagaccgcaccggccacatgattctgcaaacgctctaccagcagaacgtcaaggccggaaccaccttctacaacgagtttcacgtcaccgacctcatcctcgaaaacgggcgctgctgcggcgtggttgcctaccacctggccacgggcgagattcacaccttccacgccaaggccgtgatcctggcggcgggtggctacgggcgcgtctacaagatcacttccaacgccctcacgctgaccggcgacctgatgagcatctactaccgcaaaggcctgccgctggaggacatggagttctaccagttccaccccaccggcctcgccaagctagggattctggtgacggaaggcattcgcggtgagggcggtatcctgcgcaactccagcggcgagcgcttcatggaacgctatgcgcccaccatcaaagacctcgcgccgcgtgacatcgtctcgcgttcgatcatcaccgagattcgcgagggccgcggtgtgggccgcgataaggacgcggtctatatcgacctgacgcacctgccgcgcgaagtcatcgaggtcaagctggccgagatcaccgacctggcgcgcacctacctggggcaggacccagtcaaggacctggtcgccgtgcagccgacggcgcactacgcgatgggcggcattcccaccgacgtgaacggcctgtgcctggcagacggacagggcaccaaggtcgaggggctgtacgcggcaggtgagcaggcctgtgtctcgctgcacggcgccaaccgcctggggaccaactcgctgggcgacctgatcgtgttcggtcggcgcgccgggattgccgcggccctgtacgcgcgccaggccgaatacgccgagatgcccgagcaccccgagcgcgacactgtggagatgattgcgcgcttgcggaatgcgagcggcaaggacagccctgctgtgatccgcaaggagctgcaagagtcgatgatgaacaacgtcggcatcttccgcaacggcccggatatggaaaagcaggtcgaaatcatcaaggagctcaaggagcgctaccagaatgtcgcggtgaccgaccccggtgctcgctacaacagcgacctcatcgaggcgatggaactcggcttcctgctcgactgtgccgaagctgccaccgccagtgcgctcaatcgcaaggagtcgcgcggcgcccacgaccgcgaggattatcctgagcgcgatgaccagaactggctgaagcacacgatggcgtacaaggatctgagccgccccggcaatgtggtgatcggctacaaggaagtcgccctcaagggctacacccgggccttcgagccgaagccgcgcgtgtactga

SEQ ID NO: 747 - DNA, 1755 bp, Mycobacterium MCS
atgttgattgaacatcgctacgacgtcgtcatcgtcggggccggcggcgcgggtatgcgcgccgcggtcgaggcgggtccgcgcgcccgcaccgcggtgctgaccaagctgtacccgacccgcagccacaccggcgcggcccagggcggcatgtgcgccgcgctggccaacgtcgaagaggacaactgggagtggcacaccttcgacaccgtcaagggcggcgactacctcgccgaccaggacgccgtcgagatcatgtgcaaggaagccatcgacgcggtgctcgacctcgagaagatggggatgcccttcaaccgcacccccgagggccgcatcgaccagcgccggttcggcgggcacacccgtgaccacggcaaggccccggtgcgccgggcctgttacgccgccgaccgcaccggccacatgatcctgcagacgctgtatcaaaactgcgtcaaacacgacgtcgagttcttcaacgagttctacgccctcgacatcacgctgaccgagacccccggcggcccggtggccaccggcgtcatcgcctacgagttggcgaccggcgacatccacgtcttccacgccaaggcgatcgtgttcgccaccggcggttcgggccggatgtacaagacgacgtccaacgcgcacacgctgaccggcgacgggctgggcatcgtcttccgcaagggtctgccgctggaggacatggagttccaccagttccacccgaccggtctggccggcctcggcatcctcatctccgaggccgtgcgcggtgagggcggtcgcctgctcaacggcgacggcgaacggttcatggagcgctacgcgccgaccatcgtcgacctcgccccgcgtgacatcgtcgcccgctcgatggtcctcgaggtgctcgagggccgcggcgccggaccgaacaaggactacgtctacatcgacgtgcgccacctcggcgaggacgtcctcgaggcgaagctgcccgacatcaccgaattcgcccgcacctacctcggtgtcgacccggtcaaggaactggtgccggtctaccccacctgccactacgtcatgggcggcatcccgaccaccgtgcacggtcaggtgctgcgcgacaacaccacgatcgtcccgggtctttacgccgccggcgagtgcgcctgcgtgtcggtgcacggcgccaaccggctgggcaccaactcgctgctcgacatcaacgtgttcggccgccgcgccgggatcgccgccgccaactacgcattgggccacgacttcgtcgacctgcccgagcggcccgccgagatggtggtcaactgggtcggcgacatcctctccgagcacggcaacgagcgcgtcgccgacatccgcggtgcgctgcagcagtcgatggacaacaacgccgcggtgttccgcaccgaggaaaccctcaagcaggccctgaccgacatccacgcgctcaaggagcgctactcgcgaatcacggtgcaggacaagggaaaacgctacaacagcgacctgctcgaggcgatcgagctgggcttcctgctcgaactggccgaggtcaccgtcgtcggcgcgctgaaccggaaggaatctcgcggcggccacgcgcgcgaggactaccccaaccgcgacgacaccaactacatgcgccacaccatggcctacaaggagggcaccgacctgctctccgacgtgcgcctggactacaagcccgtggtgcagacccgctacgagccgatggaacggaagtactga

SEQ ID NO: 748 - DNA, 1800 bp, Arthrobacter FB24
atgcaggtccataagtacgacgtcgtcatcgtcggtgccggtggcgctggcatgcgcgccgcgatcgaatccggtcagcgcgcgcgcacagcagtactgaccaagctctaccccacccgctcgcacaccggtgcggcgcagggtggcatgtgtgcggcactggccaatgtcgaggaagacaactgggagtggcacacgttcgacaccattaagggcggcgactacctggtggaccaggacgcggccgaggtcatggcgaaagaagccatcgacgccgtgctggacctggaaaaaatgggcctgccgttcaaccgcacgccggaaggacggattgaccagcgccgcttcggcggccacacccgtgaccacggcaaagcccctgtccgccgggcctgctacgcggctgaccgcacgggccacatgatcctgcagacgctgtaccaaaactgtgtcaagcacaacgttgagttctacaacgagtactacgtcctggacctcctgacggttgaggaagacgcagtccgcgaagacggcacgccgtacaagcagaagcgtgttgccggcgtcgtgtcctacgacctcgcttccggcgaactgcacgtgttccaggccaagtcggtggtgttcgcctccggcggcgccggcaaggtcttcaagaccacgtccaacgcccacaccctgaccggcgacggcatgggcattgcgttccgccgcggcattcccctggaggacatggagttcttccaattccacccgaccggccttgccggcctgggcatcctgctgtcggaagccgcgcgtggcgaaggcgccatcctgcgcaactccgagggtgaacgcttcatggagcgctacgcccccaccatcaaggaccttgcaccgcgtgacatcgtggcccgctccatggcgaacgaagtccgcgaaggccgcggctgtggaccgaacaaggactacgtgctccttgacctgacccacctcgagcccgcgcacatcgacgccaagctgccggacatcaccgagtttgcgcgcacgtacctcggtgttgagccctacacggagccggttccggtgttcccgacggcgcactacgccatgggcggcatcccgaccaacatcaccaccgaagtcctgcaggataacgacaccgtggtgccgggtctctacgcggccggcgaagtggcctgtgtttcggttcacggctccaaccgcctgggcaccaactcgctgctggacatcaacgtgttcggcaagcgcgccggcatcgccgccgcggagtacgccaagacggctgacttcgtggacctcccggccgacccggaggcgtacaccatcgaactgctggacatcgcccgcaacggcaccggcgacgagaaggtggccgtgatccgcaaggaactccaggacaccatggacgccaacatgcaggtgttccgcacggctgacacgctgaaccaggtcctcagggacatcgagtccttcgaagagcggtacaagcgcatcagcgtccaggacaagggcaagcgcttcaaccttgacctgctggaggccgttgaactcggcttcctgctggaactggccaaggtcatgacggtggcagccctgcaccgggaggagtcccgcggcggacacttccgcgaggacttcccggaacgtgacgacgaaaaattcatgaagcactccatggcgtacaaggacgaccacgccccggctgacggctctgcggaagcaattgccggcatccgcctggccaccaaaccggttgtctttacccgctacgagccgatggtgaggaagtactaa

SEQ ID NO: 749 - DNA, 1755 bp, Mycobacterium KMS; identical to SEQ ID NO: 747

SEQ ID NO: 750 - DNA, 1755 bp, Mycobacterium vanbaalenii PYR-1
atgattgttgaacaccgctacgacgtcgtgatcgtcggcgcaggtggcgccggaatgcgcgcggccgtggaggcaggaccgcgggcacggaccgcggtgctgaccaagctctacccgacgcgctcgcacaccggcgccgcacagggcggcatgtgcgccgcgctggccaacgtcgaggaagacaactgggagtggcacaccttcgacaccgtcaagggcggtgactacctggccgaccaggacgccgtcgagatcatggccaaggaggccatcgacgcggtgctcgacctggagaagatggggatgccgttcaaccgcacccccgagggccgtatcgaccagcgccgcttcggcgggcacacccgcgaccacggcaaggccccggtgcgccgggcctgctacgccgccgaccgcaccggacacatgatcctgcagacgctgtaccaaaactgcgtcaagcacgacgtcgagttcttcaacgagttctacgccctcgacatcacgctgaccgagacggcgtcgggtccggtggccaccggcgtcgtcgcgtacgagttggcgacgggcgacatccacatcttccacgccaaggcgatcgtgttcgccaccggcgggtcgggccggatgtacaagaccacgtcgaatgcgcacacgctgaccggcgacgggctgggcatcatcttccgcaagggacttcccttggaggacatggagttccaccagttccacccgacgggcctggccggcctgggcatcctgatctccgaggccgtgcgcggcgagggcggccggttgctcaacggcgagggcgagcgcttcatggaacgctacgcaccgaccatcgtcgacctggcgccgcgcgacatcgtcgcccgctcaatggttctcgaggtgctcgaaggtcgcggcgccggcccgaacaaggactacgtctacatcgacgtgcgccacctcggcgaggacgtgctggaagccaagctgcccgacatcaccgagttcgcccgcacctacctgggcgtggacccggtcaaggaactcgtgcccgtctacccgacgtgccactacgtgatgggcggcatcccgaccaccgtcaacggccaggtgctcgcggacaacaccacgatcatccccggcctgtacgccgccggagagtgcgcatgcgtgtcggtgcacggcgccaaccggctgggcaccaactcgctgctggacatcaacgtgttcggccgccgcgcgggcatcgccgccgcgaattacgcactgggacatgacttcgtggacctgccggagaaccccgccgagatggtggtcggctgggtcggcgacatcctctccgagcacggcaacgagcgcgtcgccgacatccgcggagcgctgcagcagtcgatggacaacaacgccgcggtgttccgcaccgaggagacgctcaagcaggcgctcaccgacatccatgcgctcaaggagcggtactcgcgaatcacggtgcaggacaagggcaagcgctacaacagcgacctgctggaagccatcgagctgggcttcctgctggagctcgccgaggtcaccgtggtgggcgcgttgaaccgcaaggaatcccgcggcgggcatgcccgtgaggactaccccaaccgcgacgacaccaactacatgcgtcacaccatggcgtacaaggagggcaccgacctgctctccgacatccggttggactacaagcccgtcgtccagacgcggtacgagccgatggaacggaagtactga

SEQ ID NO: 751 - DNA, 1755 bp, Mycobacterium JLS
atgttgattgaacatcgctacgacgtcgtcatcgtcggggccggcggcgcgggtatgcgcgccgcggtcgaggcaggtccgcgcgcccgcaccgcggtgctgaccaagctgtacccgacccgcagccacaccggcgccgcccagggcggcatgtgcgccgcgctggccaacgtcgaagaggacaactgggagtggcacaccttcgacaccgtcaagggcggcgactacctcgccgaccaggacgccgtcgagatcatgtgcaaggaagccatcgacgcggtgctcgacctcgagaagatggggatgcctttcaaccgcacccctgagggccgcatcgaccagcgccggttcggcgggcacacccgtgaccacggaaaggccccggtgcgccgggcgtgttacgccgccgaccgcaccggccacatgatcctgcagacgctgtaccaaaactgcgtcaaacacgacgtcgagttcttcaacgagttctacgccctcgacatcacgctgaccgagacccccggcggcccggtggccaccggcgtgatcgcctacgagttggcgaccggcgacatccacgtcttccacgccaaggcgatcgtgttcgccaccggcggttcgggccggatgtacaagacgacgtccaacgcgcacacgctgaccggtgacgggctgggcatcgtcttccgcaagggtctgccgctggaggacatggagttccaccagttccacccgacgggtctggccggcctcggcatcctcatctccgaggccgtgcgcggtgagggcggtcgcctgctcaacggcgacggcgagcggttcatggagcgctacgcgccgaccatcgtcgacctcgccccgcgtgacatcgtcgcccgctcgatggtcctcgaggtgctcgagggccgcggcgccgggccgaacaaggactacgtctacatcgacgtgcgccacctcggcgaggacgtcctcgaggcgaagctgcccgacatcaccgagttcgcccgcacctacctcggtgtcgacccggtcaaggaactggtaccggtctacccgacatgccactacgtcatgggcggcatcccgaccaccgtgcacggtcaggtgctgcgcgacaacaccacgatcgtgccgggtctctacgccgccggcgagtgcgcctgcgtgtcggtgcacggcgccaaccggctgggcaccaactcgctgctcgacatcaacgtgttcggccgccgcgccgggatcgccgccgccaactacgcgctcggccacgacttcgtcgacctgcccgagcggcccgccgagatggtggtcaactgggtcggcgacatcctctccgagcacggcaacgagcgcgtcgccgacatccgcggggcgctgcagcagtcgatggacaacaacgccgcggtgttccgcaccgaggagaccctcaagcaggccctgaccgacatccacgcgctcaaggagcgctactcgcgaatcacggtgcaggacaagggcaaacgctacaacagcgacctgctcgaggcgatcgaactcggcttccttctcgaactggccgaggtcaccgtcgtcggtgcactcaaccgcaaggagtcccgcggcggccacgcgcgcgaggactacccgaaccgcgacgacaccaactacatgcgccacaccatggcctacaaggagggcaccgacctgctctccgacgtgcgcctggactacaagcccgtggtgcagacccgctacgagccgatggagcggaagtactga

SEQ ID NO: 752 - DNA, 1755 bp, Mycobacterium gilvum PYR-GCK
atgattgttgaacaccgctacgacgtcgtcatcgtcggcgcaggtggcgcgggcatgcgtgccgccgtggaggccggaccccgcgtccgcaccgcggtgctgaccaagctgtacccgacccggtcgcacaccggcgcggcccagggcggcatgtgcgccgcgctggccaacgtcgaagaggacaactgggagtggcacaccttcgacaccgtcaagggcggcgactacctcgccgaccaggacgccgtcgagatcatggccaaagaggccatcgacgcggtgctcgacctggagaagatggggatgccgttcaaccgcacccccgagggacgcatcgaccagcgccggttcggcgggcacacccgcgaccacggcaaggcccccgtgcgccgcgcctgctacgccgccgaccgcaccggacacatgatcctgcagacgctctaccagaactgcgtcaagcacgacgtcgagttcttcaacgagttctacgcgctcgacatcacgatgaccgagaccccgtccgggccggtcgcgaccggtgtcgtcgcctatgagttggcgaccggggacattcatgtcttccacgccaaggccatcgtgttcgccaccggcggatccggccggatgtacaagaccacgtcgaacgcgcacacgctgaccggcgacggcctgggcatcatcttccgcaagggacttcccctggaggacatggagttccaccagttccacccgacaggtctggccgggctgggcattctgatctccgaggccgtgcgcggtgagggcggtcgtctgctcaacggcgacggcgagcgcttcatggagcgctacgccccgacgatcgtcgacctcgcgccgcgtgacatcgtcgcgcgctcgatggtgctggaggtgctcgagggccgcggcgccggaccgaacaaggactacgtctacatcgacgtgcgccacctcggcgaggacgtgctggaggccaagcttcccgacatcaccgagttcgcccgcacctatctcggcgtggaccccgtcaaggaactcgtgcccgtctacccgacatgccactacgtcatgggcggcatcccgacgacggtcaacggccaggtgctctcggacaacaccaccgtggtgccgggcctctacgccgccggcgagtgcgcgtgcgtgtcggtacacggggccaaccggctgggcaccaactcgctgctcgacatcaacgtcttcggccgtcgcgccggcatcgccgccgcgaactacgcactgggacatgacttcgtcgagctgccggagagccccgccgagatggtggtcggctgggtcggcgacatcctctccgagcacggcaacgagcgcgtcgccgacatccggggcgcgctgcagcagtcgatggacaacaacgccgcggtgttccgcaccgaggagacgctgaagcaggcgttgaccgacatccacgcactcaaggagcgctactcgcgtatcacggtgcaggacaagggcaagcgctacaacagcgacctgctcgaggccatcgagctgggcttcctgctcgagctcgccgaggtcaccgtcgtcggtgcgttgaaccgcaaggagtctcgcggcggacatgcccgcgaggactacccgaaccgcgacgacaccaactacatgcgccacaccatggcctacaaagaaggttcggaccttctgagtgacatccgcctggattacaaacccgtcgtgatgacgcgttacgagccgatggaacggaagtactga

SEQ ID NO: 753 - DNA, 1773 bp, Mycobacterium tuberculosis F11
ttgatctgccaacaccgatacgacgtggtgatcgtcggcgcgggcggtgccgggatgcgcgccgcggtcgaggcgggtccgcgggtgcgtaccgcggtgctgaccaagctgtatcccacccgcagccacaccggcgcggcccagggcggcatgtgcgccgcgctggccaacgtcgaggacgacaactgggagtggcacacgttcgacaccgtcaagggcggcgactatctcgccgaccaggacgccgtggagatcatgtgcaaggaagccatcgacgcggtgctcgacctggagaagatggggatgccgttcaaccgcacccccgagggccgcatcgaccagcgccgcttcggcgggcacacccgcgaccacggcaaggccccggtgcgccgggcctgctacgcggccgatcgcaccggccacatgattctgcagacgctgtatcagaactgcgtcaagcacgacgtcgagttcttcaacgagttttacgcgctggatttggctttgactcaaacgccgtcgggcccggtggccaccggggtgatcgcctacgagctagcgaccggtgacatccatgtctttcacgccaaggccgtcgtgatcgcgaccggcggctcgggccgcatgtataagaccacgtccaacgcacacaccctgaccggcgacggcatcggcatcgtgttccgcaagggacttcccttggaggacatggagtttcaccagtttcaccctaccggcctggccggtctgggcatcttaatctccgaagcggtgcgcggcgaaggcggccggctgctcaacggggaaggtgagcgtttcatggagcgctacgccccgacgatcgtcgacctagcgccccgcgacatcgtcgcccgctcgatggtgctggaagtgctggagggacgcggcgccggaccgctcaaggactacgtctacatcgacgtccgccacctgggcgaggaagtgctcgaggccaagctgcccgacatcaccgagttcgcccgcacctacctgggcgtggatccggtcaccgagctggtgccggtctacccgacgtgccactacctgatgggcggcatcccgaccacagtcaccgggcaggtgctgcgggacaacaccagcgttgtcccgggcctgtatgcggccggcgagtgcgcgtgcgtgtcggtgcatggcgccaaccggctgggcaccaactcgctgttggatatcaacgtcttcggtcgtcgggccggcatcgccgccgccagttatgcgcagggtcacgactttgtcgacatgccgcccaacccggaggccatggtggtgggctgggtcagcgacatcctgtccgaacacggaaacgagcgggtcgccgacattcgcggggcgctgcagcagtcgatggacaacaacgccgcggtgttccgcaccgaggagaccctgaagcaggcgctcaccgacatccacgcgctcaaggagcgctactcccgaatcacggtgcacgacaaggggaaacgcttcaacaccgacctgctggaagccatcgagctgggatttttactggagctggccgaggtcacggtggtcggcgctttgaatcgcaaggagtcccgcggcggtcacgcccgcgaggactatcccaaccgcgacgacgtcaactacatgcgacacaccatggcctacaaggaaattggggccgataaggagggccccgagctgcgcagcgatgtccgccttgatttcaaacccgtcgtgcagacccgttacgaacccaaggaacggaagtactaa

SEQ ID NO: 754 - DNA, 1758 bp, Chlorobium phaeobacteroides BS1
atgcaggttgtctatcatgatgtgatcattgtcggtgcgggtctcgcaggtctcagggcggcggtcgaactttccggaaaacacgacgttgcggtactttcaaaacttcatccgctccggtcgcattcgggggcggcgcagggaggaatatccgctgcgcttggaaatgcagaaaaggattcttccgaatggcatgcctatgacaccataaaaggctctgactatcttgccgatcagtatgctgtcgaggttatgtgcaatgatgcgccgagagcgataatagaactggaacatctcggcgtcccgttttcgcgctttgaagacggtcatatcgcacagcgtccttttggcggccatacaaaaaatttcggagaggccccggtccgacgaacctgctatgctgccgacagaaccggtcatgtctgtcttcataccctctatgagcaggcggtaaaagataaggtctttttttatgacgagtaccaggtgctcgatctctgcatggcggacggggcggtcaacggcgttgtcgctatcgaattgaaaacaggacggtttctgctgtttcatgcccgggcggtgatgtttgccacaggagggtacggcaaggcatggaaaacaacttccaatgcgtttgccaataccggcgacggtctgggtattgtcctgaataacggcattccgctgcaggatatggagttcgtgcagtttcacccgacaggtctctatccgctcggaattcttattaccgaggcggcaagaggcgaagggggtgtgctccgaaacgccgacggagaacggtttatggagcgctacgctccgacgatcaaggaccttgccccacgggacattgtcagccggagcatctatgatgagctgaaggaagggagaggtgccggaccgatgaaagatcacgtgctgcttgatctgaccgctctttcgagagaggcgattgctgaaaaactgcctgaaattgagtctttttccagaatatatctcggcattgacccctctgtcaccccgataccggtgtcgccgacgtgccattatgcgatgggaggaatccctaccgatgtgaacggcagggtgctcattgacgcacaaggaaaagagcttccggggttctgggctgccggagaggtcgcctgtgtctcggtacacggggctaaccggctcggatcaaattcgctgcttgatcttattgttttcggacgccgcgcaggaaaggatatcaaccggttccttgatcgtgttctcctgaagccccgtcctcttgatacaggagcgcttgaaaaggtcagcaggaagatagagggcttactgggcagaaaagagggggaaacggtagcggcggttcgtaccgatctgcagaaggtgatgatggacaaggtttctgttttccgtaacgagcacgggcttgcggcggcggtggaagagcttgccgttctgcaggggcgtgccgcaggaatccgggtgaaggaccagagcaaggttttcaacactgagattctcgaagcgctggaactgcagcatatggtaaactactcgaaagcggtcgctctgtgcgccctcaaacgtcaggagtcgagaggggcgcacagcagagatgattatcctctgcgagatgatgaaaaccacctgaaacattctcttttttttctcaaagaaaatggagaagcggtctacgaacagaaaccggtcgatctttcgcttgcttcgaccaggcctgaattcgtgcccaaagaaagaaagtactga

SEQ ID NO: 755 - DNA, 1755 bp, Prosthecochloris aestuarii DSM 271
atggatgttgtttatcatgatgtgatcattgtcggcgcagggcttgccggcctgcgtgcagcggtggaacttgcaggatcagccgatgtggcggtgctatccaagctgcacccccttcgttctcattccggtgctgctcagggagggatatctgcagctctcggaaatgttgaagaggataaccctgactggcatgcctatgatacgatcaagggttcggattatcttgctgatcagtatgctgtccaggtgatgtgcaatgacgctccgagagcgattatcgagatggagcatctgggagttcctttttcccgtctcgatgacgggcgtatagcccagcgtccatttggcggccatacccggaatttcggtcaggcgcctgttcgcaggacctgttttgctgcggatcgaacaggacatgtctgcctgcatacgctctacgagcagtcgctcaagcagggcgttaggttttatgatgaaattcaggtgctcgatctgtgtatggaggatggctcggttaacggtgtcgttgccatggagcttctgaccggccgcatagtgctcatgcatgcaaaagcggtgatgtttgcgaccggaggttatggtaaggcatggaagacgacctcgaacgcttttgccaataccggtgatggtttggggatcgtgcttcgtaacggtcttcctcttcaggatatggagtttgtccagtttcatccgacaggactctatcagttggggattcttattaccgaggcggcaagaggagagggcggcatattgctcaacggcaacggagagcggtttatggaacgctatgcacccagtatcaaggaccttgctccgcgagatattgtaagtcggagtatttatgatgagctgaaagccggcaggggcgctggtcccgaaaaagatcatgtgctgttggacctgacatcgctttcgcatgagaaaatcgcaagccgtctgcccgagatcgagtcttttgcgaaagtctatctgggcatcgatccttcacgagcgcctattcctgtacttcctacctgccactatgccatgggcggcattcccacctcggtggatggtcgcgttctcggcgatgctgagggtcgtgaggttccgggtttctgggcggcaggagaggtcgcctgtgtttcggtgcatggcgccaatcgtctcggatcaaactctcttctggatcttattgtgtttggccggcgcagcggaaaggatattgctcaattcctgaagaagagcgggccggcgttgcctctcgacatgcatgccgctgatcgcgtcaagggggttatcagcacgcttctggatcgtcagagcggtgaatccgttgccgcagtgcgccgtgatcttcagcgggttatgatggatgacgtatcggtgttccgccaggagtcatgcctggccgatgcggtcagcaagctgcgcgaactgcagcagcgggcatcgttgatccgggtcagggacaggacaagaaatttcaaccaggagcttaccgacgctcttgagctgcagcacatggtcaattattctctgacggttgcgctttcagcgctcaatcgtcgtgaatcgcggggcgcgcacagcagggaggattatcccgaccgggacgacgccaattggctgaagcattcaatgtgccgtatggatgaagagggtggcgtgcagctttttgataggcctgtcgatctctcattagcggcggcaaatcctgtgtttgttccgaaagaaagaaagtactga

SEQ ID NO: 756 - DNA, 1800 bp, Arthrobacter chlorophenolicus A6
atgcaggtccataagtacgacgtcgtcatcgtcggtgccggtggcgctggcatgcgcgccgcgatcgaatccggtcagcgcgcgcgcacagcagtactgaccaagctctaccccacccgctcgcacaccggtgcggcgcagggtggcatgtgtgcagcccttgccaacgtcgaggaagacaactgggagtggcacacgttcgacaccgtcaagggcggtgactacctggtggaccaggacgccgccgaggtcatggccaaggaagccatcgacgccgtgctcgacctggaaaagatgggcctgccgttcaaccgcacgcccgagggccggatcgaccagcgccggttcggtggccacacccgcgaccacggcaaggcacccgtccgccgtgcgtgctacgcagcggaccgcaccggccacatgatcctgcagaccctgtaccaaaactgcgtcaagcacaacgttgagttctacaacgagtactacgtcctggacctgctgacggtcgaagaggacgcggtccgcgaagacggcacctcctacaagcagaagcgcgttgctggtgtggtttcctacgacctcgccaccggcgaactgcacgtgttccaggccaagtccgtggtgttcgcctccggcggcgccggcaaggtcttcaagaccacctccaacgcccacaccctgaccggtgacggcatgggtatcgcgttccgccgcggcatccccctggaggacatggagttcttccagttccacccgacaggccttgcgggcctgggcatcctcctctccgaggctgcccgcggtgagggcgccatcctgcgcaactcggacggtgaacgcttcatggagcggtacgcccccaccatcaaggaccttgcaccccgcgacatcgtggcccgttccatggccaacgaagtccgtgaaggccgcggctgcggccctaacaaggattacgtcctcctggacctgacccacctggaaccggcgcacatcgacgccaagctcccggacatcaccgagttcgcccgcacctacctgggcgtcgagccgtacacggagccggtgccggtgttccccaccgcgcactacgccatgggcggtatccccacgaacatcgaaaccgaggtcctccaggacaacgacaccgtgatccctggcctgtacgccgcgggtgaggtggcctgcgtgtccgtgcacggctccaaccgcctgggcaccaactccctgctggacatcaacgtgttcggcaagcgtgccggcgtcgccgccgcggaatacgccaagacggcccagttcgtggagctgccggaaaacccgctggattacaccacggaactgctggacatcgcccgcaacggcaccggcgacgaaaaggtggcccagatccgcaaggaactgcaggacaccatggacgccaacatgcaggtgttccgcaccgcggacaccctgaaccaggtcttgagcgacatcgcctccttcgaggagcgctacaagcacatcaacgtgcaggacaagggcaagcgcttcaaccttgacctcctcgaggccgtggaactgggcttcctgctggaactggccaaggtcatgacggttgctgccctgcaccgtgaggaatcccgcggcggacacttccgcgaggacttcccggaccgtgacgacgagaaattcatgaagcactccatggcgtacaaggatgaccacgcgccggctgacggatcggcggaagcaatcgccggaatccggctggccaccaagccggtcgtctttacccgctacgagccgatggtgaggaagtactaa

SEQ ID NO: 757 - DNA, 1752 bp, Actinosynnema mirum DSM 43827
atgcagttccacaagtacgacgtcgtgatcatcggggctggtggcgcgggtatgcgcgccgccatcgagtcgggccagcgcgcccgcaccgcggtgctcaccaagctctaccccacccggtcccacacgggcgccgcgcagggcggcatgtgcgccgcgctggcgaacgtggaggaggacaactgggagtggcacaccttcgacacgatcaagggcggcgactacctggtcgaccaggacgccgccgagatcatggcgaaggaggccatcgacgcggtcctcgacctggagaagatgggcctgccgttcaaccggacgcccgagggcaagatcgaccagcgccggttcggcgggcacacccgcaaccacggtgaggccgcggtgcgccgcgcctgctacgccgccgaccgcaccggtcacatgatcctgcagacgctgtaccagaactgcgtcaagcacggcatcgagttctacaacgagttctacgtcctcgacatctgcatgaccgagaccgaggacggcccggtctgcaccggcgccgtggcgtacgagctggcgaccggcgagatccacgtgttccaggccaagtcggtcgtgttcgcgaccggcgggttcggcaaggtcttcaagaccacctcgaacgcgcacaccctgaccggcgacggcatgggcatcgtgttccgcaaggggctgccgctggaggacatggagttctaccagttccacccgaccggtctcgcgggcctgggcatcctgctcaccgagggcgcgcgcggcgagggcgcgatcctgcgcaacgcctccggcgagcggttcatggagcgctacgcccccaccatcaaggacctggcgccgcgcgacatcgtcgcccggtcgatggccctggaggtgctggagggccggggcgcgggcccgaacaaggactacgtgctgctggactgcacgcacctgggcgccgaggtcctggagaccaagctgcccgacatcaccgagttcgcccgcacctacctggcggtcgacccggtgaccgagccggtgccggtgtacccgaccgcgcactacgcgatgggcggcatccccacgaacgtgctgggcgaggtgctgcgggacaacgacaacgtgatccccggcctgtacgccgccggtgagtgcgcgtgcgtgtcggtgcacggcgcgaaccgcctgggcacgaactcgctgctggacatcaacgtgttcggccgccgcgcgggcatcgccgccgccgagtacgccctggcgcacgagcacgtggacctgccggagaacccggcggcgggcgtcgaggcgcaggtggcgctggccctgtccgagcacggccacgagcgcgtcgcggacatccgcaccgagctccaggccaccatggacgcgaacgcgtcggtgtaccgcaccgaggacacgctcaagacggcgctgaacgacgtgcaggcgctgaaggagcggtaccagcggatcaccgtgcaggacaagggcaagcggttcaacacggacctgctggaagccgtcgagctgggcttcctgctggagctggccgaggttctggtcgtgggcgcgctcgcgcgcaaggagtccaggggcgggcacgcccgcgaggactacccgacccgcgacgacacgaacttcatgcgccacagcatgtactacaagcagggtgagggcctgtccgccgagatcaggctggactacaagcccgtcacgttcacccggtaccagccgatggagcgcaagtactga

SEQ ID NO: 758 - DNA, 1803 bp, Beutenbergia cavernae DSM 12333
gtgcagacgcacagctacgacgtcgtcatcgtgggcgccgggggcgccgggatgcgagccgcgctggagtcgtcctcacgcgcccgcaccgccgtcctcaccaagctctaccccacccgctcccacaccggtgccgcccagggcggcatgtgcgccgccctcgcgaacgtcgaggaggacaactgggagtggcacacgttcgacaccgtcaagggcggcgactacctggtcgaccaggacgcggccgaggtcatggcgaaggaggccatcgacgcggtcctcgacctggagaagatgggcctgccgttcaaccggacgcccgacgggaagatcgaccagcgccggttcggcggccacacccgcaaccacggcgacgcccctgtgcgccgttcctgctacgccgccgaccgcacgggccacatgatcctgcagaccctgtaccagcagtgcgtcaaggccggcgtggagttcttcaacgagttctacgcgctcgacctcctgctgaccgccgacccgcaggatcccgacggcgacccgcaggtggccggcgtcgtcgcctacgagctcgccaccggtgagatccacgtggtgcgcgccaagtcggtggtcttcgccacgggcggcgccggcaaggtgtacaagacgacgtcgaacgcccacacgctgaccggcgacggcatggcgatcgcctaccgccgcgggctcccgctcgaggacatggagttcttccagttccaccccacgggcctcgcgggcctcggcatcctgctctcggaggccgcccgcggcgagggcgcgatcctgcgcaacagcgacggcgaacgcttcatggagcggtacgcgccgacgctgaaggacctcgcgcctcgcgacgtcgtcgcccgcgcgatggcgaacgaggtgcgggagggccgcggcgccggcccgaacaaggactacgtgctgctcgacctcacgcacctcgagccggcgcacatcgacgcgaagctccccgacatcaccgagttcgcccgcacctacctcggcgtcgagccgtacacggaacccgtgccggtgtacccgacggcgcactacgccatgggtggcatgcccaccaccgtggagggcgaggtgctgcgcaacaacaccgacatcgtccccgggctgtacgccgcgggcgaggtggcgtgcgtgagcgtccacggcgcgaaccggctcggcacgaactcgctgctcgacatcaacgtgttcggcaagcgggccggcatcaccgccgccgagtacgcggccggcgcgacgctcgccgagctccccgacgacccggccgggcgcgtcgtcgcccagctcgaggcgatgcggacgcgccccgtcggcgagaaggtggccgacctgcgccgggcgctgcaggagacgatggacgtgaacgcgcaggtgttccgcacggaggccagcctcaagcaggctctggtcgacatccagcagctccaggagcgctacggccacgtcgccgtgcaggacaagggccggcggtacaacctcgacctgctcgaggccgccgagctcggcttcctgctggacctcgccgaggtcgtcgtgaccggcgcgctcgcccgcaacgagtcgcgcggcggtcactaccgcgaggactacccgcagcgggacgacacgaacttcatgcgccacacgatggcctaccgggtcgcgacgaccggtgccgagggtgccgaggcggtcgacgccgccgggatcggcccgcacgaggtgcgcctcgactacaagcccgtcacgttgacccggtaccagccgatggagcgtaagttctga

SEQ ID NO: 759 - DNA, 1776 bp, Brachybacterium faecium DSM 4810
atgcagacccatacctacgacgtggtgatcgtcggtgccggcggtgccggcatgcgcgccgccctcgagtcctcgaagcgggctcgcaccgccgtcgtcacgaagctctaccccacccgctcccacaccggcgcggcccagggcggcatgtgcgccgccctcgccaacgtcgaggacgacaactgggagtggcacacctacgacaccgtcaagggcggtgactacctcgtcgaccaggacgccgcggaggtgatggccaaggaggccatcgacgccgtgctcgacctcgagaagatgggcctgcccttcaaccgcacccccgagggcaagatcgaccagcgccgcttcggcggccacacccgcgaccacggcgaggcgccggtgcgccgctcctgctatgccgcggaccgcaccggccacatgatcctgcagacgctctaccagaactgcgtgaagcaggacgtggagttcttcaacgagtactacgtgctcgacgtgctcatgaccggcgacccccgcaccgacgagggcgtgcgcgcctccggcgtggtcacctacgagctggccaccggcgagatccacgtcttcaaggcgaagtccgtggtgttcgcctccggcgggttcggcaagatcttcaagaccacctcgaacgcccacaccctcaccggtgacggccccgcgatggcattccgccgcggcatcccgctcgaggacatggagttcttccagttccatcccaccggcctggccgggctcggcatcctcctgtccgaggcggcccgcggcgagggcggcatcctgcgcaacagcgacatggagcgcttcatggagcgctacgcacccacgctcaaggacctcgccccgcgcgacgtggtggcgcgggcgatggcgaacgaggtgcgtgagggccgcggcgcaggcccgaagaaggactacgtctacctcgacctcacccatctggagccctcgcacatcgatgcgaagctgccggacatcaccgagttcgcgcgcacctacctgggcgtcgagccctacacggacccgatcccggtgttccccaccgcgcactacggcatgggcggcatccccaccaacatccgcggcgaggtgctgcgcaacgcgaccgacgtgatccccggcctgtacgccgccggggagaccgcctgcgtctcggtgcacggcggcaaccgcctgggcaccaactcgctgctggacatcaacgtgttcggccgtcgcgccggcatcgccgccgcggagcacgcggacgaggtggacatgcccgagctgcccgaggacgtcgagctgcccaccgtcgagctgctgcagcgcctgcgcgatcgcccggccaccgaggatcgcatcgccgacatccgcctcgagctgcaggagctcatggacgcgaacgtccaggtgttccgcaccgacgagacctgccgccgcgcgctggccggcatcgccgagctcaagaagcggtacgagaccgtcgccatccaggacaagggccgccgctacaacctggacctgatggaagcggtcgagctcggcttcctgctcgacctcgcggagatcgtcgccctcggcgcgctgcaccgcaaggagtcccgcggcggtcatttccgcgaggacttcgagaaccgcgatgacgtcaacttcctcgagcacaccatggcctaccgcaccctcccggacgaggagggcatcgagggcaccccgatccgcctgggcaccaagcccgtcgtgatcacccgttacgagccgaaggagcgcacgttctga

SEQ ID NO: 760 - DNA, 1788 bp, Micrococcus luteus NCTC 2665
atgcaggtgcacaagtacgacgtggtgatcgtcggcgccggcggcgcgggcatgcgcgcggccatcgaggccggtcagcgcgcgcacaccgccgtcctcaccaagatctaccccacgcgttcccacaccggcgcggcccagggcggcatgtgcgcggccctcgccaacgtcgaggaggacaactgggagtggcacacgttcgacaccgtcaagggcggcgactacctggtggaccaggacgccgcggaggtcatggccaaggaggccatcgacgcggtgctcgacctcgagaagatgggcctgcccttcaaccgcacccccgagggcaagatcgaccagcgccgcttcggcggccacacccgtgaccacggcaaggcgcccgtgcgccgcgcctgctacgccgcggaccgcaccggccacatgatcctccagacgctgtaccagaactgcgtcaagcacaacgtggagttctacaacgagttctacgtgctcgacctgctgctggtggaggaggacgccgtgcgcgaggacggcaccgcctacaagcagaagcgcaccgccggcgtcgtctcctacgagctggccaccggcgagatccacgtcttccaggccaagtcggtcatcttcgccaccggcggcgccgggaaggtgtacaagaccacctcgaacgcccacaccctcaccggcgacggcatggccatcgcctaccgcgcgggcctgcccctcgaggacatggagttcgtgcagttccacccgaccggcctggccggcctgggcatcctgctctccgaggccgcacgcggcgagggcggcatcctccgcaacgcggacggcgagcgcttcatggagcgctacgcccccaccatcaaggacctcgccccgcgcgacatcgtggcccggtccatggccgaggaggtccgtcagggccgcggcgccggccccaacaaggactacgtgctgctcgacctgacgcacctggagccctcgcacatcgacgagaagctcccggacatcaccgagttcgcccgcacgtacctgggcgtcgagccctacacggagccggtgccggtgttccccacctgccactacttcatgggcggcatccccacgaacatcaaggccgaggtcctccaggacaacgacaccgtcgtgccgggcctgtacgccgccggcgaggtggcctgcgtgtccgtgcacgggtccaaccgcctgggcaccaactcgctgctggacatcaacgtgttcggccgccgcgcaggcatctacgccgccgagtacgccgcgcaggcggactgggtggagctgcccgagggcggcgagctgccgaccgtggagcacatcgagaacctgcgctccgccaccgggtccgagcgcgtcgcggacatccgcgccgagctccaggagtccatggacgcggacatgcaggtcttccgcgacgaggactcgatccgccgcgcactggccaagatcgaggagctgcgcggccgctacgagaacgtgtccgtccaggacaagggccaccgcttcaacctcgacctgctcgagggcatggagctgggctacctcctggacatcgccgaggcgatgaccctcgcggccctgggccgcaaggagtcccgcggcggccactaccgcgaggactaccccgatcgcgacgacgagaacttcatggcgcacaccatgatctaccgtgacgagaccgcggagatggagggcgtcaagggcatccgcttcgagaccaagcccgtcgtcgtgacccgttaccagccgatggagcgtaagtactga

SEQ ID NO: 761 - DNA, 1782 bp, Catenulispora acidiphila DSM 44928
atggcacctcagatccacacttacgacaccatcatcgtcggcgccggcggcgcgggcatgcgcgcggcgctggagtcctccaagcgcagccgcacggcggtgctgaccaagctgtacccgacccgctcccacaccggcgcggcgcagggcggcatgtgcgccgcgctggccaacgtcgaggacgacaactgggagtggcacacctatgacaccgtgaagggcggggactacctggtcgaccaggacgccgccgagatcatgtgcaaggaggcgatcgacgccgtcctggacctggagaagatgggcctgcccttctcccggacccccgagggcaagatcgaccagcggcgcttcggcggccacaccaaggaccacggcaaggcgccggtccaccggtcctgctacgccgcggaccgcaccggccacatgatcctgcagacgctgtaccagaactgcgtcaagcaggaagtcgagttctacaacgagttctacgtcctggacctgctcctgcacgaggacgcggacggcaccaagtacgccgccggcgtcgtggcgctggagctggccaccggcgagatccacatcttccgcggcaaggccgtcatcctggccaccggcggcttcggcaaggtcttcaagaccacctcgaacgcgcacaccctgaccggcgacggcatgggcatcgtgtggcgccgcgggctgccgctggaggacatggagttctaccagttccacccgaccggcctggcgggcctgggcatcctgctcaccgagggcgcccgcggcgagggcggcatcctgcgcaacgccgacggcgagcgcttcatggagcgctacgccccgaccatcaaggacctggcaccccgcgacatcgtcgcgcgctccatggtcctggaggtccgcgacggccgcggcgccggtcccaacaaggactacgtctacctggacctgacgcacctgccggccgagcagatcgaggagaagctgccggacatcaccgagttcgcccgcacctacctcggcgtcgagccgaccacggagctggtcccggtgtacccgaccgcgcactacgcgatgggcggcgtgccgaccaacatctccggcgaggtgctggccgacaacgacaccgtcgtcaagggcatgtacgccgccggcgaggtcgcgtgcgtgtccgtccacggttccaaccgcctgggcaccaactcgctgctggacatcaacgtcttcggccgccgcgccggcatcaacgccgccgagtacgcggtcggcgccgagctgcagccgctcccgagcgagccggagcaggccgtggtgtcgatggtcgagggcttgcgcaattccaccgggcacgagcgcgtcgcgcagatccggtcggagctgcagaccacgatggaccagaacgccggcgtgtaccgcaacgacgagacgctggcgcaggccgagaaggacgtcaaggaactgcagcgccggtaccgcgacgtcgcggtccaggacaagggcaagcggttcaacaccgacctgctggaggccgtcgagctcggcttcctgctcgacctggcggagatcctggtcctcggcgcccgcaaccggaccgagtcccgcggcgcgcaggcgcgcgaggactacccgacgcgggacgacgtgaactggcagaagcacaccatggcctaccgggagaaggacggcgagggcgatgctgggtccgatcagaactacaggatccgcctggactacaagcccgtcatcgtgacccgctaccagccgacggagcgtaagtactga

SEQ ID NO: 762 - DNA, 1788 bp, Saccharomonospora viridis DSM 43017
atgcagttccacaaatacgacgtggtgatcgtcggagcgggcggcgcgggtatgcgcgcagcgatcgaagccggtcagcgcgcccgcaccgcggtgctcaccaagctctacccgacacgctcccacacgggtgccgcccagggtggtatgtgcgcggcactggccaacgtcgaagaggacaactgggagtggcacaccttcgacaccatcaagggtggtgactacctcaccgaccaggacgccgccgagatcatggcgaaggaagccatcgacgcggtgctcgacctggagaagatggggctgccgttcaaccgcaccccggacggcaagatcgaccagcggcggttcggcgggcacacccgcgagcacggcaaggccgcggtgcgccgggcctgctacgcggccgaccgcaccggccacatgatcctgcagacgctgtaccagaactgcgtcaagcacggcatcgagttcttcaacgagttctacgtcctcgacatcgcgctcaccgacacggcggacggccccgtggcgtccgccgccatcgcctacgagctggccaccggtgagatccacgtgttccaggcgaagtcgatcattttcgccacgggtggcttcggcaaggtcttcaagaccacctccaacgcgcacacgctcaccggcgacggcatgggcatctacctccgcaagggcctgcccctggaggacatggagttctaccagttccacccgaccggcctggccggcctgggcatcctgctcaccgagggtgcgcgcggtgagggcgcgatcctgcgtaacgcctccggcgaacgcttcatggagcgctacgcccccaccatcaaggacctcgcgccgcgcgacatcgtcgcccgctcgatggtcctcgaggtcctcgaaggccggggtgccggcccgaacaaggactacgtcctgctcgactgcacccacctcggcgaggaggtgctggagaccaagctgcccgacatcaccgagttcgctcgcacctacctgggcgtggacccggtgaaggagccggtgccggtgtatcccaccgcgcactacgcgatgggcggcatccccaccaacgtgcacggcgaggcgctccgggacaacgagaacatcgtccccggcgtgtacgcggccggtgagtgcgcgtgcgtttccgtgcacggcgcgaaccgactgggcacgaactcgctgctggacatcaacgtgttcggcaagcgggcgggcatcgccgccgcggagtacgccaactcgcgcgacttcgccgagttgccggacgacgcggcgaagacggtcgagaccatggtcaaccacctgcgcagttccaccggcggtgaacgggtggtcgacatccgcaacgaactgcaggcgaccatggacgccaacgcggcggtgtaccgcaccgaggacacgctcaagcaggcgttgacggacgtgcagtcgctcaaggagcgctacggccgcatctcgatcatggacaagggccagcggtacaacaccgacctgctggaggccatcgagctcggcttcctgctggacctggccgaggtcctggtgaacgcggcgctggctcggaaggagtcccgtggcgggcacgcccgcgaggactaccccgaccgcgatgacgtcaacttcatgcggcactccatgtcctacaagatccttccggagaaggacgaccccgacgcacagctggggctgcccggcttccgcgcggacctccgcctggactacaagccggtgaccttcacccggtacgaaccgatggagcggaagtactga

SEQ ID NO: 763 - DNA, 1830 bp, Jonesia denitrificans DSM 20603
atgcaattccaccaatacgacgtcgtcatcgtcggcgcaggtggcgccggcatgcgcgccgccctcgaagcatcaactgaggtacgaaccgctgttatttctaagctctaccccacccgatcccacacaggcgcagcccaaggcggcatgtgtgcagcactggccaatgtcgaagaagacaactgggaatggcacacctttgacaccgtcaaaggtggcgactacctcgttgaccaagacgccgccgagatcatggccaaagaagcaatcgacgccgtgctcgacttagaacgcatggggttacccttcaaccgcacccccgaggggcgcatcgaccagcggcgttttggtggccacacccgaaaccacggagaagccgcagtccggcgtgcctgctacgcagcagaccgcaccgggcacatgattttgcagaccctttaccaaaactgcgtgaaacagaacgtggagttcttcaacgagttctacgtccttgacctcattgttgaccacgacctctccgctggagatgtccccgtgggcgaagaagtcaccgcgaccggtgttgtcgcctacgacctcgccaccggtgagatccacatcttccaaacaaaagcagtggtgttcgctaccggtggtgccggcaagatctacaaaacaacctccaacgcccacaccctcaccggtgacggaatggccctggcgttgcggcgcgggctccccctcgaagacatggaattcttccaattccaccccacaggtcttgctggactgggcattttgctgtccgaagctgcacgaggagaaggtgggattctccgcaacggccaaggcgaacggttcatggaacggtacgccccaaccattaaagaccttgcaccacgtgacattgtggctcgttccatggcaaacgaagtccgtgaaggtcgtggagcaggacccaacaaagactatgtcctgttggaccttacccaccttgaacccgcacacatcgacgctaagctgcccgatatcaccgagttcgcacgcacatacctcggcattgagccctacaccgaacctgttccggtttaccccaccgcccactacgctatgggcgggatccccaccacaatcgactctgaggttctgcggaacccgaacgatgttgtcaaaggtctctatgccgctggtgaagtcgcgtgcgtgtccgtccatggcgcgaaccgtctaggcacgaactcactccttgacatcaacgtgtttgggaaacgtgctggacgtgccgcagcagcctacgcaaagacagcgtccttcgttgatcttcccgaccaagcagcatcctgggtcgtgggacaactggaagagttgcgctcacgtcctgacggtgaacgtgtggcggatatccgcaaaacactccaagaaaccatggacgctaacgcgcaggtcttccggaccgaggaatcactcacccaggcgctcgccgacatccgcacccttcaagagcgttacagccgagtttcagttcaggacaaaggcaaaatgttcaacactgacctcctggaagcgcttgaacttgggttcctccttgacattgctgaggtcaccgtcatcgcagcattaaaccgccgtgaatctcgtggtggtcacttccgtgaagacttcccagaccgcaacgacgaggcctacatgcaccacaccatggtgtaccggcgcccgctcgactcttcggtgtctggaaacatcaccgacgaggctttctcccacgtcagcgaatttgacgactacaaggttgtgctcggcgcaaaacccgtcgtgcaaacaaggtacgagccgatggagcgtaagtactga

SEQ ID NO: 764 - DNA, 1752 bp, Nakamurella multipartita DSM 44233
atgcagttccataggtacgacgtggtgatcgtcggcgccggcggcgccggcatgcgcgccgcgatcgagtcgggccagcgggcccgcaccgccgttctcaccaagctctaccccacccggtcgcacaccggcgcggcgcagggcggcatgtgcgccgccctggccaacgtcgaggacgacaactgggagtggcacaccttcgacaccgtcaagggtggcgactacctggtcgaccaggacgccgccgaggtgatgtgcaaggaggccatcgacgccgtcctggacctggagaagatggggctgccgttcaaccgcacccccgagggccgcatcgatcagcgccggttcggcgggcacacccgcaaccacggcgaggccgccgtccgccgggcctgttacgccgccgaccgcaccggccacatgatcctgcagacgctctaccagaactgcgtcaagctcggcatcgagttctacaacgagttctacgtgctggatctgctgctgtccaagaccgacgagggcgagacctgcaccggcgccgtggcctacgagctggccaccggcgagatccacgtcttccaggccaagtccgtggtgatggccaccggcggcgccggcaagatcttcaagaccacctccaacgcgcacaccctgaccggtgacggtctgggcatcgtgttccgcaagggtctgccgctggaggacatggagttcttccagttccacccgaccggcctggccggcctgggcatcctgatctccgaggcggtccgcggcgagggcgggatcctgcgcaacgcgcagggcgagcggttcatggagcgctacgcgccgaccatcaaggacctcgcgccgcgcgacatcgtcgcccgctcgatggtgatggaggtccgcgagggccgcggcgccggcccgaacaaggactacgtgctgctcgacgtcacccacctgggcaaggaggtgctggagacgaaactgcctgacattgccgagttctcgcgcacctacctgggggtggagccgctcgacgagccggtcccggtcttccccacctgccactacgtgatgggcggcatcccgaccaacatcgccggccaggtgctgcgcaacaacaccgacgtggtgcccggcctgtacgccgccggcgagtgcgcgtgcgtgtcggtgcacggctcgaaccggctgggcaccaactcgctgctggacatcaacgtgttcggccggcgggccgggatcgcggccgccgagcacgccctggccagcgacttcgtccaggtgccggacaaccccgaggcgctggtcatcgagatggtgaccaagctgcgggagtccaccggcaaggagaaggtcgccgagatccggaccaccctgcaggccaccatggacctgaacgcggcggtctaccgcaccgaggccaccctcaaggaggccctcaacgacgtgcgggtgctcaaggagcgctactcgcgcgtctcgatccaggacaagggccagcggtacaacaccgacctgctggaggccatcgagctgggcttcctgctcgagctggccgagatcctggtcgtcggggccctggtgcgcaccgagtcgcgcggcgggcacgcccgggaggactacccgaaccgggacgacgccaactggatgcggcacaccatggcctacaagcagggcaacgaactcaccgcggacatccgcctggactacaagccggtggtccagacccgctaccagccgatggagcgcaagtactga

SEQ ID NO: 765 - DNA, 2628 bp, Staphylococcus epidermidis RP62A
atgacacaattcgtttatgcatttaatgaaggaaatatagctatgaaagacttacttggtggtaaaggtgccaatctttcagagatgaagagactcggactaccagtacctgatggttttacaattacgactgaagcttgtattacatatttaaaacaaaatgaagaactacctacagaagtaaagacacaattaattgatcatttagcagctttttctaagcgaacaggaaaagccttttcttctgatgataacttgttattagtatcagtacgtagtggtgcaaaaatttccatgccaggaatgatggatacaattcttaatttaggacttaatgatgataatgtaaaaaagcttgttgacaaaacaaatgatgcacgatttgcatatgattgttaccgtcgtttactacaaatgtttggagaggttgtttatggtattccaatgacagctttcgatacatattttaatgattttaaaacaaagcatcgttatcaaaatgatgctgaaattccggcagaaggactacaaactatatgtgaaagatataaagaaatctatgtagaagaggcatataaaccttttccccaagaaccgttaaagcaattagaagaagcaattgaggcagtatttaaatcttgggataatgatcgtgcacgtgtatatagagatttaaatgatattccacatgatattggtacagctgtaaatattcaggaaatggtatttggtaatagtggtgaaaatagtggtacgggtgtagcatttacaagaaatccagttactggagaaaatcatttattcggagagtacttacttaatgcccaaggtgaagatgttgttgcaggcattcgtacccctaaggatattgacactttaaaacaacaaatgccagatgtacatcaagagtttgttgatgtaaccaaacaacttgaaaagcattacaaagatatgcaagacatagaatttacaattgaaaatggtaaactttatttattacaaacacgtaacggaaaacgtactgctaaagctgcaataaaaattgctgtggatttagttcacgagcaattaattacacgtgaagaagcagtatcaaaagtagaagtaaaatcaatagaccaattattacatcctaattttaatgaagaagcattaaagcaagcgacagtagtttctaaaatgggcttaccagctagtcccggtgcagcaacaggaaaagtagtcttctctgctgaagaagcaaaacttcaagctgaaaatggtaataaagtagtgttaatgcgaccggaaacatcacctgaagatattgaggggatggtagcaagtgaagcaatcgtaacaactcatggtggtatgacatcacacgctgctgttgtagcaagagggatgggtaaatgttgtgtgacaggatgttcgaatgtagagatagatacagtgaacaaaacagtatattatcctgaaggtgaattacatgaaggggatatcatttcagtagatggttcagctggtgatttatatttaggagcaattgaaacagtcaatgctgaacatagtgaagagttcgatcaatttatgacttggtctgaagagattgcaagattgcaagttagaatgaatgctgaaacaccacaagacataaaagctggatatgattttggctctaaaggaataggtttagttcgtactgagcatatgttctttggacctgaacgtttaatagaaatgcgccgttttatcttagcttcaaatcatgacgaacgtgtacaagctttagaaaaaattaaaacataccaagtagaagattttgaaacaattttcagattatctcaagatagacctacgattgttcgtttacttgatccaccgttacatgagttcttgccatcatctgaagaagatataaacaatgtttctcaacagctgaatgtatcttcagagttcttacgcaagcgaatcgttgacttaaatgaggtcaatccaatgcttggtcatcgtggttgtcgtttggctgtgacttatccagagttatatgagatgcaagttgaagctattattgaaagtgttattaagcttcaaaaagagggcgtaacgtgcctaccagaaattatgattcctctagtgtcaacagtagaagaatttacaactttaaaagaacgattagttaatacaattacacatttagaaaaagaatcacaacaagatatacaatatatgataggcactatgattgaaacgcctagagcatgcttgattgcgaatgaccttgcgaaacattgtgatttcttcagttttggtactaatgatttaacgcaattgacatttggtttctctagagatgatgcaggaaaattcataaatgtgtatactgaaaataacattttacagcttgacccattccaaactttagatagagaaggtgtaggacgactaattcaattagccgttgaacaagctaaaaatacaaatccagagataaaaattggtgtatgtggtgagcttggtggcgatgcaaaatcaattcgtcaatttaaccaatgggaaattgattatgtttcatgttcaccatttagagttccgggtgcaattttagctacagctcagagtcaagcggaggaaagcgagcgataa

SEQ ID NO: 766 - DNA, 2655 bp, Moorella thermoacetica ATCC 39073
atggcaagtaagaagtacgtctacctgttcagcgaaggcaaggccgacatgcgcctgcttcttggcggtaaaggcgcgaatctcgccgaaatgaccaacatcggcctgccggtaccccaggggattaccatcacctgcgaggcctgtaacgagtacaatcgtctcggccagcaattcccggagggcctggaagaggaagtcgccgcccgcttaaaggacctggaagccatcaatggtaaaaagctcggcgaccccgaaaacccgctcctggtctccgtccgttccggggcacctgtttccatgcccggcatgatggataccatcctgaacctggggctgaacgacaattccgtcaagggcctggccgcccagacgggcgacgagcgcttcgccctggactgctatcgccgttttatccagatgttcggtaacgtcgtcctgggtatcgaacataacgattttgaagccgtactcgaaaaacataaagaacgcctgggcgtaaagttcgaccatgaactcacccccgatgccttgcgggaagttatcgccgagtacaaggacgtcgtcaagagccgcagcggccgggacttcccccaggacccccgggagcagctttacatggccatccgtgccgtctttgattcctggaacaacccccgggccattgtctaccgcaagatcaacaagatccccgatgacctgggcaccgccgtcaatgtccagaccatggccttcggcaacatgggtcccaccagcggcaccggcgtggccttcacccgcaacccctccaccggcgagaagggtatttacggcgagtatctcatcaacgcccagggcgaagacgtggtggccggtatccgcacacctaagcccatcagcagcctgaaggaagaaatgccggaagtttaccgccagtttgaagacatctgccagctgctggagaaacactaccgcgatatgcaggatatcgagtttaccatcgaaaagggcaagctctttatcctccagacccgcaatggtaaacggacggcggccgcggctgtcaaaatcgccgtcgacatggtcaatgagggcctgattaccaaagaagaagccgtcctgcgcgtcgacgccgatcaattaatccagctcatgcaccggcgtatcgaccccagcgccaaactggaagtggtggccaagggtctgccggcttcccccggtgccgcctccggccaggtggtctttgacgccgacgatgccgaaaaaatgggcctcgacggccagaaggtcgtcctggtacgtaccgagaccactcccgacgatatccacggcattgtccaggcccagggggttctcacggcccggggcggcatgaccagccatgcagccgtagtcgcccggggcatgggcaaaccggcggtcaccggttgcgacgccattaaaatagacgtcgaaaacaaacgcttcttcatcggcgacctggtggtcaaagaaggtgacgtcatttccatcgacggctccaccggcaacgtcatgctgggtgaagtgcccctcatcgacccccagctcacaggggaatttgaaaccatcctggagtgggccgattccttccggcgcctcaaagtccgcgccaacgccgacacgccggaagacgcgaggcgctcccgggaattcggcgccgatggcatcggcctcacccgtaccgagcatatgtttatgcaggtcgatcgcctgcctgttgtccagcagatgattctcgccaagaccaaagaagaacggcaggctgccctggataagctcctgccgatgcagcagggcgacttttacggtatcttgaaggccatggagggcctgccggtcaccatccggctcctcgatccgcccctgcatgagttcttgcccaatattgaagaactcctggtcgacgtcacaaggctccaggcgacaaacggcgactccaaagagctggaagaaaaacaggccctcctgcgggaagtccgggcgcgccacgaattcaaccccatgctcgggcaccgcggctgccgtttaggcatcacctacccggagatctacgccatgcaggtgcgagccatcttccaggcggtggcccagctggtgaaagagggcgtcaaggtcctgcctgaagtagagattcccctggttatccacgtcaacgagttacagcgcctccacgccatggttgacgaggtagccgcggccgtcaaaaaggaaaccggtgtcgatttcgattacaaggtcggcaccatgatcgaaatgccgcgggcctgcgccacagccgatgaaatcgccagggaagccgagttcttctccttcggcaccaacgacctgacccagaccaccttcggcttcagccgcgacgacgctgaaggcaagttcctgcaccagtatgtcgacgagaagatcttgaaagaagaccccttcatcgtcctcgaccgcgacggcgtgggcaaattcatgaagatggccgtcgaactgggccgcagcaccaatcccaagctggaaatcggcatctgcggcgagcacggcggcgaacccagctcggtggagttctgccaccagatcggcttgaactacgtcagctgctcacccttccgggtgccggtagcgagactggccgccgcccaggccgctttgaaggaaaagaaaggaaagtaa

SEQ ID NO: 767 - DNA, 2643 bp, Syntrophomonas wolfei Goettingen
atgtctaagaaatatgtctatttatttgaagaaggtaattctaacatgcgacagttattgggcggcaaaggcgctaacctggctgaaatgaccttgattgggctgccggttcctgctggctttaccataacaactgaagcctgtaatgaatacctgactgcgggtcataaatttcctgatggtgtcctggaacaagtctttacagctttagaaagattagaattggatagtggcaaatcttttgggaaaaaaaataaccctttactggtttcagtaagatcaggggcggcggtatccatgcctggaatgatggataccattctcaacctgggtttgaatgatgagtcagttcagggtttggccagcttaaccggggacagtcgttttgcttatgattgttaccggcgttttatccagatgttcagtgatgtggttctgggagtggaacatgccaggtttgatgaagtgatggaaagatacaaaaggaaactggcgcttatttttgactatgaaattccttccagtgaactacaaagcattattgaagaatacaaggaaatagttgagcaggaaaagggatttgcctttcctcaagatgtacgggagcaattaaccatggccattcaggcagtatttgattcctggaacaaccagagggctatagtataccggcgcttaaacaaaattgacgatgaactgggaaccgcagtaaatgtgcagtgcatggcctttggcaatatgggattggattgcggaaccggtgtagctttcacccgtaacccctccaccggggagcgggaactatatggtgagttcctggttaatgctcaaggtgaagatgtggtagcgggtataagaactcctacccccattgaccgtctaaaggaagaattacctggggttttccagcagtttttggacacctgccaaaagctggagacacattatcgcgatatgcaagacattgagtttaccgtggaaaagggtaaactatacatgctgcaaaccagaagcggaaaacgtacggcccgggcttccgtaaggatagccgtagaaatggtaaacgaaggcctgatcacggtggaagaagccctgttgagagttgatgccgagcaaatcaaccagttgttgcaccggcagattgaccagagtgtaaaattagatgctatcgccaaagggctgcctgcttcaccgggtgccgcttgtggtaaagttctctttgatgcggacctggcggagaaaatggggggagcgggcgaaaaggtcgttttggttagaagtgagaccacaccagatgatattcatggaatcatatatgctcagggagtccttaccgcgcgaggaggaatgacttctcatgctgcagtagtagcccggggaatgggtaaaccctgtgtttgtggttgtgaagctataaagattgatagcggaaaccggcaatttatagttaatgggatagtagttaaagaaggggatgtaattaccatcgatggggctagcggcaatgtaatgctgggtgaagtgcccatgatagaacctaccctttctgatgaatttgctctactgctgcaatgggccaatcaaataaagaaattggccataagggctaatgccgatacccctcaagatgcagcccgagcccgcgaatttggagctgaaggaataggcctctgccgcactgaacatatgtttatggcagcggaacggctccccattgttcaacagatgatactggctgagaacctggaagatagagaagaggccctgagccaacttttacccttccagcgagatgatttctatggaattttaaaagctatggctccgcacccggttactattcgtcttttagaccctccgttgcatgagtttcttcctcatccggaaaccctcttgttggagatagcagagatgaaacaccagcagataaaaggtaaagtactgctggaaaaggaagaattgctaaagaaagtacatagcctgtccgaggccaaccccatgctgggacaccggggatgtagactggggcttacctatcccgagatttactgcatgcaggcccgggctatttttgaggctatggtacagctgcaaaaagaggggatagactgctttactgaagtcgagatacctctggtaatggatattgccgagctatccctattaaaagcagaaataatgggtgtctatgagcaggtgaaaaaggaaaacaactgtgaactggactttacggtggggaccatgctggagcttccccgggcttgcattatggcggatgaaatagcccgtgaagccgagttcttctcttttggtaccaatgacctgacccagacaacttttggctttagccgcgatgatgctgaaggcaaattcattcccatatatctggagaaaaagattatcaaggacaatccttttgcagtgttggatcgtaagggtgtgggaagtctaatgcgcctggcggtggaaaaggcccgcagcgtaaagaaagatatactaatgggcatctgtggtgaacacggaggcgaacccagctctatcgagttttgtcatatagtaggattggattatgtgagctgttcgccttatcgaataccagtagctcgtctggcagccgcccaggccagcttgctgaataattag

SEQ ID NO: 768 - DNA, 2658 bp, Desulfotomaculum reducens MI-1
ttggcaacccaaaaatacgtgtatgctttttccgagggaagagcagatatgaaaagcctgttaggcggtaaaggcgccaacctggcagagatgaccaacattggtcttccggtgccccctggttttaccattaccaccgaggcttgtaaagagttttacatagccggacgtaaattccccgagggacttgagcaggaactagaaacaaaggtagactggttagagcaaaccctgaataaaaaatttggtgatcccaatggtccccttctggtgtctgtacgttctggtgcagttatatccatgcctggtatgatggatacggttttaaacctaggacttaatgaccaaactgtcattggtttggctaccagcagtggcaatgctcgctgggcttatgattgctatcgtcgctttatacaaatgtttggtaatgtggtgctagacatcgaacatcataagtttgaaggcatcttagaagagcaaaagcataaaagaaatgttcagtttgacaatcagttgacttccgaagactggcaggaagttataggaaaatataaagctattgttcagaaagaaaccggtcgtgaatttcctcaggatcctaaggaacagctacacaaagccatttttgctgtctttaattcctgggaaaatgaccgtgccatcgtgtatcgtaaaattcataaaatctccgatgacctgggtacagcagtaaacgtacaggcaatggtatttggcaacatgggggatgattgtggtaccggtgtagcctttacccgcaatccttccacaggcgaaaaactactctatggtgagtttttaaccaatgcccagggtgaagatgtagtggctggtattcgtacgcctcagcccattgcaaaactggccgatgaaatgccagatgtttaccaacagtttgcccgtacttgtactttattggaaaaccactataaagatatgcaggatattgaatttaccattgaacgcaacaagttatggatgctgcagacccgtaacggcaagcgtactgcccaggctgccattcgcattgcggtggaaatggtagaagagggtatcattgataaagaaatggccatcaaccgtgttgatcccaatcagttagaccaactgttacaccgtcgcattgaccccaacgctaaattagaagttgtagccaaaggtctgccggcatcccctggttccgcatctggtgctgtggtctttaatgctgatctggctgaaaaattaaacaaacagggacaaaaagtgatcttagtgggtactgaaaccactcccgacgacatccatggtatggtggctgctcagggtattctaacttccaggggcggcatgaccagccacgctgctgtggtggcccgtggtatgggtaaaccctgtgtgtgtggttgcgaagccattcgcattgactctgaaaataaacagttttttgtaggcaatattaccgttaaaaatggggacattgtatccattgatggttccaccggtgatgttatcctgggtgaagtgcccatgattgagccggatctatcggcggaattcttgaaattgttgcaatgggctgacaacatccgtactttggaagtacgcgccaatgccgataccccggaagatgctgcaaaggctcgggaattcggtgcccaaggtattggtttaaccagaactgagcatatgtttatggcattggaccgtttacccattgtgcaagaaatgattttagccaatgatattgaggagcgtgcagcagcactggctaaattactgccgatgcaagaaggggacttctacggtatcctgaaggccatggaaggcctgccggtatgtattcgactattagaccccccgttgcatgaattcttgcccaatgcagaagaactggctgtggaaattactcagttgaagttgaccaacggtgaaccggctaaaatacagcaaaaggaagatttgttacgtaaagtacgttccttgtctgaatttaaccccatgctgggccatcggggttgccgtctaggtattacctggccggaagtatacgccatgcaggccagagccatcttccaagcaactgctcgtctggtgaaagaagattgcaagatagatccagaagttgaaattcctttggttattgaactaaaagaattagcatacctgcgtaaattggtggaagatgttgctgaggaagttaagaaggaaaccggtgtggacttccattatagtgtgggaaccatgattgaaattcccagggcagctttactggccgatgaaattgctagccaggcagaattcttctccttcggtacgaatgacttgactcaaaccaccctgggcttttccagagatgacgcagagggcaaatttatgcagccctatattgaaaagaaaatccttaacgataaccccttcattgtattagatcgtaagggtgttggtaagcttatgcagtggactgtggaaaatgcccgtcgggtgaaaccagatctgctcattggtatctgcggtgagcacggcggcgaacccagctctgtggagttttgccacatgattgggttgaactatgtaagctgctccccctaccgggtacccattgcacggttggcagccgcccaggcggctgtaatcaacaaagaccaatcgaagtaa

SEQ ID NO: 769 - DNA, 2691 bp, Gluconacetobacter diazotrophicus PAl 5 JGI
atgacgaaatgggtctatagtttcggcggtgccgccaacgagggcggggccggcatgcgcgaccttctgggcggcaagggtgccaacctggccgaaatggcggcgatcggcctgcccgtcccgcccggcttcaccatcaccaccgaggtctgcacccggttctacgaaaacggacgcgcctatcccgaagacctgcgcgcgcaggtcgaagccgcgctggccggggtcgaggcgtcgctgggcctgcgcttcggcgatccggctgcgcccctgctggtctcggtccgctcgggcgcgcgggtgtcgatgccgggcatgatggataccgtgctgaatctgggcctgaacgacgaaacggtcgccggcctggccgccgcgtcgggtgacgcgcgcttcgcctgggacagctatcgccggttcatccagatgtacggctcggtcgtgctgggcgtgtcccatcatcggttcgaggacctgatcgaggaaaccaagcgcgcgaccggcgtgcaggacgacacgaagctgaccgaccaggactggcaggaggtcgtgacgggctacaaggagatcgtgctgcgcgaaaccggcgcaccgttccccacggacccgcacgcccagttgtggggcgcgatcggcgcggtgttcgggtcctggatgaacccgcgcgcccatacctatcggcggctgcacgacattcccgccgactggggcacggcggtgaacgtgcaggcgatggtgttcggcaacatgggcgcggactgcgcgaccggcgtctgcttcacccgcgatccctcgacgggcgaaaacgtcttctacggcgaatacctgatcaacgcgcagggcgaggacgtggtggcgggcatccgcacgccgcagccgatgtcccaggcgcgcgcgcatgacggcgaactgtcgatggaacgcgcgctgcccgaggcgtaccgcgaattgctggcggtgcgcgatatcctggaacgccattaccgcgacatgcaggacatcgaattcaccgttcagaacaaccgcctgtacatgctccagacccgcaccggcaagcggacggccgccgccgccctgcgcatcgccatcgcgatggccgaggaaggcctgatcacgcacgaggaagcgatccgccgcgtcccgccctcgtcgctcgaccagctgctgcatccgacgctggacccggacgcgccgcgcaccatgctcagccgggggctgccggcctcgcccggggcggcggcgggcgccatcgtgttcagcgccgaggacgtggaaatccgcgccgcgcggggcgaggacgtcatcctggtccgtatcgagacgtcgcccgaggacgtgcacggcatgcacgccgcgcgcggcgtgctgaccacgcgcggcggcatgacctcgcacgccgccgtggtggcgcgcggcatggggcgggtctgcgtggccggtgccggcggaatccatgtcgattaccgggcgcggacgctgtcggtcggtgcgacgatgctgcatgaaggcgactggatcaccctggacggcgcgacgggcgaggtcttcgccggccgggtcgcgaccatcgagccgactctgtcgggcgatttctcgaccctgatgggctgggcggacagcgtgcgccggatgaaggtccgcgccaacgccgaaacgcccgacgatgcgcggaccgcccggcatttcggcgccgaggggatcggcctgtgccggaccgagcacatgttcttcgcccccgaccgcatcggcttcatgcggcagatgatcatggccggcgacgcggccgcgcgcatccgggcgatcgacgccctgctgccgttccagcgcgaggatttcaaggcgctgttccgcatcatggcgggcctgccggtgacgatccgcctgctggacccgccgctgcacgaattcctgccgcatggcgaggccgaactggccgaactggccgccgcgctgggcgaaagccccgaggccgtggcggcgcgccgggccgcgctgtcggaagccaatccgatgctgggccatcgcggctgccggctgggcctgacctatccggaactctacgccatgcaggcccgcgcgatcatcgaggccgcgatcgccgtgtccgccgaaagcgggcagccggtggttccggaaatcatgattccgctggtggggatggacagcgaactgcgccgcacccgcgccaccgtcgaacaggcggcggccgaagccctggaagcggccggcgtgtcgctggatttcagcatcggcacgatgatcgaactgccccgcgccgcgctgacggccgaccgcatcgcgcaggacgccgatttcttctcgttcggcaccaacgacctgacgcagacgaccttcggcctgtcgcgcgacgattccggcaccttcatgcccttctacctggaacatgacctgatcccgcgtgatccgttcatctcgatcgaccaggagggcgtgggccagctcgtcgccatgggggcggaacggggccgccgcacccggccggggctgaagctcggggtctgcggcgaacatggcggcgatccggcctcgatcggcttcttcgaatccgtggggctggattacgtgtcgtgctcgcccttccgggtgccgatcgcgcgcctggcggcggcccaggccgcgctggcgggccgcgccgaccctgtcgcgtcctcccgggtcgcgtcgtcctag

SEQ ID NO: 770 - DNA, 2661 bp, Kytococcus sedentarius DSM 20547
atgaccggcggtgccacgaagtacacctacgacctctccgagggcgacatctcgatgaagcccctgctcggaggcaagggggccaacctgtccgagatgatcaagctcggcgtgcccgtgccggacggcttcacggtcaccaccgcggcctgcatcgacaccatgaacaacggggggcagtggcccgccgagctgtggggccaggtcgaggactcgctcgcccgcttcgaggagcgcgccggccgtcgcctgggcgaccccgcccagccgctgctggtctcggtccgctccggtgccgtcatctcgatgccgggcatgatggacaccatcctcaacctgggtgtcagcgacgagaccgtgggctcgctggcctcggagttcggcgagcgcttcgcctgggacacctaccgccgcttcatccagatgtacggcgacgtggtcgagggtgtgccgcaccacgcctacgaggacgccctgtcggccctgaaggccgagcgcggggtcgagaacgacaccgacctctccgccgaggacctcaagggcctggtcgagaccttcaagcaggtctcccgcgaccacatgggcgccgagttccccaccgaccccaaggagcagctgaagcgcgccgtgaacgcggtgttctcctcctggggcaccccccgcgccggcgtctaccgcaaggccaacggcatcccggacgacctgggcaccgccgtgaacgtcatgcagatggtgttcggcaaccgtggcgagacctccgccaccggcgtgtgcttcacccgcaacccctccaccggcgcccaggagctgtacggcgagttcctcgtcaacgcccagggcgaggacgtcgtggccggcatccgcacgccgaagccgctggcggagatggagtccgtcctgcccgaggcctacggccagctgctggacaccatgcgccgcctggaggagcaccacggcgacatgcaggacatcgagttcaccgtcgaggacggcaagctctacctgctgcagacccgcaacggcaagcgcaccgccccggcggccttcaagatcgccgtggacatggtgaacgagggcaagctggacaaggccggcgcgctcaagcgcatcgagccgatgcagctcgaccagctgctgcaccccgcgatcgacccgagccacggccaggagccggtcaccaagggcctgaacgcctccccgggtgcggcagtcggcgaggtcgtcttcgatgcggagacggcggccgagcgcggcaaggccggtgagaaggtggtcctggtccgctgggagaccaccccggacgacatcgccggcgtgatcgtcgcgcagggcgtcctgaccgcacacggcggtatgacctcccacgcggccgtggtggcccgggggatgggcaagccgtgcgtggccggtgcctcgaagatcaagatcgacaccgagggcaagaagctcaccatcggtgacacggtcctggccgagggcgacatgatcaccctcgacggctccaccggtgaggtctacgccgcggcgctggacctggtgccgccgcagctgaacgaggacttcaacaccatcgtgggctgggccgacgagatccgccgcctggacgtgcgcacgaacgccgacaccggcgcggatgccgcgaaggcccgtgagttcggcgcccagggcatcggcctgtgccgcaccgagcacatgttcatggaggctgaccgcctgccggccgtgcggaagatgatcctctcggagtccgatgaggcgcgcacgcaggccctcgcagagatcctgccgctgcagcaggaggacttcgaggcgatcttcgacgcgatgacgggcctgccggtgacggtgcgcctgctcgacccgccgatgcacgagttcctgccgaacctcgtggaccaggccctgctggtgcagcgcctggagatcgagggtcgcggcgacgacgacgccgagctctccgaggcccgcacgctgctcgcccaggtgaagaagctcaccgagcagaacccgatgctgggcacgcgcggtgtgcgcctggccctgctctacccggagatccccgcgatgcagacgcgcgccatcgtgcgcgccgccctggcctccaagcagcggggcaacgacccgcacgtggagatcatggtgccgatcgtggcgtacgccgaggagctcaagcgcatgcgcgccatcatcgaggacacggtggccgaggagctcgaggccgccggcgaggagctggactacaccatcggcaccatgatcgagctgccccgcgctgcggtgacggccgaccagatcgccgagcacgccgacttcttcagcttcgggaccaacgacctgacgcagaccggcgtgggcatctcccgcgacgacgccgagggtgcgttcctcgcgcactacgtggacgacgacatcgtcccgggcaacccctttgcgtcgatcgacgtcgacggcgtgggcggcctggtgcggatcggtgccgagaagggccggtccaccaaggccgacctgaagctcggtgtctgcggcgagcacggtggcgacccggcctccatcgcgctgttcgaggagctgggcctgagctacgtctcctgctccccctaccgggtgccgatcgcccgcttcgccgccgcccgtgcggtcctggacgcccaggagaagtga

SEQ ID NO: 771 - DNA, 2739 bp, Eggerthella lenta DSM 2243
gtgactgaagaagtcaagcgagtgtatgcgttcggcaaggacgcgcagggcaacaacgtaactgagggcaacaccagcatgaaggcgatcctcggcggcaagggcgcgaacctcgccgagatggccaacatcgggctgcccgtgcctcccggattcaccatcacgtgccagacctgcatggagtacgccaatgcgggcaacgcgtggcccgaaggcgcgctcggcaccatccaggagtatcgcgaggatctcgaagcccgcatgggcaagaagatcggcgatgcggaggacccgctgctcgtgtccgtgcgttccggcgcccccatgtccatgccgggcatgatggacaccgtcctcaacctcggcctgaacgatcagtccatcaacgggttgatcaagcagaccgataacccgcgcttcgcctgggattcctaccgtcgcttcatccagatgttctccaacgtggtcatgaacctcgacggcgacctgttcgagaacgccatcacggctatgaagcacgctcgcggcgcggcgtccgacaccgatctcaccgccgaggacctgcaggagctcgtggccgagttcaagcagatcttcgccgagaacgtggatgcagcggcgtatccgagcctcgtcgtggacggtgccgtgcagttcccgcaggatcccagcgtgcagctgcagctggccatcgaggccgtcttcggcagctggaacaacccgcgcgccacgctgtaccgcaagcagaacaagatcgccgacgatctgggcaccgccgtcaacgtgcagtccatggtgttcggcaacaagggcaacacctctgccacgggcgtcgcgttcacgcgcaaccccgccaacggcgagaaggagttctacggcgactacctggtgaacgcccagggcgaggacgtcgtggccggcatccgcaacacctcgccgatcgccgagctcaaggacgtggacggtctggaagaggccggccgcgagctcgaagaggtgttcgtcaccctcgagaaccacttccgcgacatgtgcgacatcgagttcaccatcgagcagggcaagctgtggatgctgcagacccgcgtgggcaagcgtaccgccgccgccgcgctgcacatcgccatcgagatggagaaggagggcctcatctcgaaggaggaggccgtcatgcgcgtcgatcccgagcagctcgaccagctgttgcacccgcagttcgacaagaacgcctcctacgacgttgtcgccaagggcctgaacgcctcccccggcgccgccgtgggcgaagccgtgttctccgccgccgacgcggtggccgtggccgaggcgggccgcaagtgcgtgctcgtgcgctgggagacgaaccccgacgacctcgccggcatgatcgccgccgagggcatcctcacctcgcacggcggcaagacgtcgcacgcggccgtcatcgcccgcggcatgggcgccccgtgcgtctgcggcgtggaggcgctgcgcatcgacgccgagaagaagcaggccagcgtcgtgggcaccgacatcgtcatcaaggaaggcgacatgatctccatcgacggcaccaccggctccgtggtgctgggcgcggtcgagctcgtgctgcccgagatgacgggcgacctcgacaccatcctcgagtgggccgacgagttccgcacgctgggcgtgcgcgccaacgccgacaaccccgaggacgccgagctgtcccgcggcttcggcgccgagggcatcggactgtgccgcaccgagcacatgttcctgggcgaccgcaagcagatcatccagaccttcatcctcaacgaggatccggccgtgcgcgagaaggccgtgggcgagctcttggctgcccagacgggcgacttcctgggcatgttccgcgccatggacgggctgccggtcatcgtgcgcctgctcgacccgccgctgcacgagttcctggagagcccccgcgcgctcgacgtggagatcgccaagctcgaggccgcgggcggcgataaggcgctcatcgccgagaagcgcatgctcatggagcagatcgacggcatgagcgaggcgaacccgatgctgggcctgcgcggctgccgcctgggcatcgtgtaccccatcctgccggtcatgcaggtgcgcgccatcgccaccgcctgcgccgagctgcagaaagagggcttgaacccgaagcccgagatcatgatcccgctcgtgtccgtggtggccgagctcgagaagctgcgcaaggtcgccgaggacactatcgccgaagtcgccgccgagcagggcgtcgagcttgacatccccgtgggcacgatgatcgagctgccgcgcgctgccgtcacggccgacgaaatcggcgcggttgccgacttcttcagcttcggcacgaacgacctgacccagacgacgtttggcttcagccgcgacgacgtggaggccgagttcgtcccgcagtacctggccgagcgcctgctgccctacaaccccttcgccaccatcgatccgggcgtggcgaagctcgtggagatgggcgtcgagctgggccacaagggcaaccccgacctcgtctgcggcgtgtgcggcgagcacggcggcgatcccgattccgtgaagacgttccacacgatcggcctcgactacgtcagctgctccccgtaccgcgtgccgctggcccgtctggccgccggtcaggccgccctggccgagaagatgggcgacggccgcgacaagtag

SEQ ID NO: 772 - DNA, 2712 bp, Cryptobacterium curtum DSM 15641
gtggctgaagaagtgaagcgcgttttcgcatttggcaaggatgcaaacggcaataacgtaaccgagggaaatacctctatgaaggcggtgctcggtggcaaaggagctaacctagctgagatggcaaacatcggcttgcccgtgcctcccggcttcacgatttcctgccaaacatgcatggaatatgccaacgccggcaatgtgtggcctgaaggcgttcttgatgtcattcatgaatatcgctctgacttggaagcccgcgccggtaagaaaattggtgatgcacaggacccgctgctggtatctgttcgatctggcgctcccatttctatgccgggtatgatggacacagttttgaatcttgggttgaatgatgaatccatcaacggtctgattgtgcagaccgaaaacccacgctttgcctgggattcatatcgccggtttattcaaatgtttagcaatgtggttatggggctcgacggtgatctattcgagaacgccatcagcatgaagaagaatctgcgcggtgtgcgcagcgatactgatcttaccgccgacgacttgcaagagctcgtagaggaattcaagcgcatcttcgccgaaaacgttgatgctgcagcgtaccctgaccttgcgcataatggcgttgccacattcccgcaggatcctacagtacagctgaagcttgctattgaagcagtgtttggcagttggaagaatccgcgtgcggtgctgtatcgccagaagaacaaaatcgacgacaatatgggtacagccgtcaacgtacaatgcatggtctttggcaacaagggcgatacatctgcgacgggtgtggcatttactcgtaatgctgccacaggagaaaaagaattttatggcgactaccttgtgaatgcacagggcgaggatgtggtagcgggcattcgcaacacaagcccgattgccgaactcaagcacactcccggtcttgaagaggctggtcgcgaactcgaagaggtgtttgttctgctcgaacagcacttccgcgatatgatggatattgagtttaccatcgagcaaggcaaactgttcatgttgcagacacgcgtaggtaagcgtacagctgccgccgctttgcgcattgctatcgatatggaaaaggaaggtcttattactaaggaagaggctctcaagcgtgttgagcctgaacagctcgatcagctgctccatcctcagtttgataagaatgcttcgtacgatgtactggcgcgcggcctcaatgcatcgccgggtgcagccgtgggtgaaattgtcttttcgagtgctgatgcggtggctgtttcagaagcagggcgcaaatgcgtgctcgtgcggtgggaaacaaatcccgatgacctcgcaggtatgattgctgctgaaggtattcttaccagtcatggtggcaagacgagtcacgcggccgttattgcccgtggcatgggtgcaccatgcgtgtgtggagtggacgcgttgaagatcgacgcagagaagaaagaaattactgttgctggtagtgatgtagtactgcatgagggtgacatgatttcaatcgatggcaccactggtacggttgtttccggtgctgtggaactggttatgcctgaattaactggtgatttggataccattttggaatgggccgacgaagtgcgcgtactcggtgtgcgtgctaatgccgataaccccgaagatgctcagctttcgcgcgattttggcgccgaaggcattggtctgtgccgcacggagcatatgttcttaggtgatcgcaaacagttgattcagcagtttattctgaatgatgatgaagatattcgcacagagtgcgttcacaagctgggtgaactacaaacgggcgattttcttggcatgttccgtgcgatggacgggctaccggttattgtgcgcttgctcgatccgccgttgcatgagttcttggagaacccgcgagcgcttgatgtcgaaatcgctcacatggaagaacagggcgcatcggccgagtcggttgcagaaaagcgtgcgcttatggctcagatcgattcatgggctgaagcgaacccgatgctcggcctgcgtggttgccgcctgtcgattctgttcccgcagctgcctgatatgcaggtgcgtgccattgctaccgccgctgctgctctcaagaaagaggggctcgacccgcatcctgaaattatgattccgctggtttcctttgaatcagagatcgaatcgctgcgtgcaaaagctgaagcggttatcgctgaggttgaagcagagcagggtgtacagttggaaattcctattggtaccatgattgagttgccacgcgctgccctgattgccgatcagattgcacgccacgccgatttctttagttttggaaccaacgatttgacgcagaccacgctgggattttcgcgcgacgatgccgaagctaagttcttgccgcgatatctggaagagcatctgctcaagcgtaatccattcgccacgatcgacgatggtgttgccgaacttgtgcgcatgggttgcgaaaagggttgctctgcaaatcccaaactggcgtgcggcgtctgtggtgaacacggtggcgatcctgagtccatcatgaaattcgcccaggttggccctgactatgtcagctgctcgccgtatcgtgtgccgattgcgcgtctcgcggctgctcaggcggcgcttgtttaa

SEQ ID NO: 773 - DNA, 2631 bp, Anaerococcus prevotii DSM 20548
atgacaaacaaatacgtttataactttaacgaaggaaacatgtcaatgagagccctcttgggtggtaagggtgcaaaccttgcagaaatgaccaaccttggtataagagtaccatatggttttacaataactacagaggcttgtaccagattttacaaagaagataagaagctttgggatgatctaaacaaggaagttacagaacatatcaaagacttggaaaaagcaaacgaaaaaactttcggttctacagaagatccacttctagtttcagttaggtctggagcccctatttccatgccaggtatgatggatactatccttaacttaggtcttaatgacgatgctgttataggtcttgcaaagaaaactgacaacgaaagattcgcctatgactcttacagacgttttatccaaatgtttgctgacgttgctatggagcttgacaaaaacaacttcgaaaaactccttactgccaagaaagaagccaaaggcgttaagcttgatacagaacttgatgcaaatgaccttaaagaattagtagaagaatataaagcaaaatacaaagagcttatgggagaagacttcccacaagagcctagagagcaacttgaccttgcaatctctgctgtatttagatcttgggggaacgaaagggcaatcctttacagaaaactaaacgatatagatgatgctatgggaacagctgttaacgtacaatccatggtatttggtaacatgggcgactcatcaggtactggtgtagccttctcaagaaacccagctactggagaaaatgtcctattcggtgaatacttaatcaacgcccaaggtgaagacgtagtggcaggtgtaagaactcctcaagagatagctaccctagaaaaagctatgccagaagtatacaaagaattctttgaaacatctgaaaagctagaagctcactacaaagatatgcaagatatggaatttactatccaagatggtaagctcttcctccttcaaacaagaaacggtaaaagaactgcccaagcagcggttaaagttgcagttgatcttgtagaagaaggtctaatagatgaaaaagaagctgtcctaagggttaatcctaaagaccttgatggcctactccaccctacctttacaaaagaagctgaagataaaaatgaaccaatcgcaaaaggacttgctgcctctcctggagcagcagtaggtaaaattgccttttctgccaaagaagcagccaaaagagcagctgacggtgaagcagtaatccttgtccgtgaagaaacatccccagaagacctcgaaggaatggtatctgctaagggaatccttacagctcgtggaggaatgacaagccacgctgcagtagtagccagaggtatgggtaagtgctgtgttgcaggtgccggagaacttcacgttgacgagtacgaacacacagtaagaatcggcgatttagtcctaaccggagaagatacaatctcaatcgatggatcaactggtgccatctataagggaagcctagaaacacaaccacctcaactacacggtgccttcggtacatttatgggttgggttgacaaatttagagacatgaaagtaagaacaaatgcagatacaccaagagacgtagcccaagccctaaactttggtgctgaaggaatcggactatgtagaactgagcacatgttctttaaagaagacagaatcttccaagttagaaagatgatcctagcaagcgatcttgaaacaagagaagctgccctagagaagatccttccaatgcaagaagacgacttctatcaaatctactcactcatgaaagaaagaccagtaacagtaagacttcttgacccacctcttcacgaattcctaccaaagggagaaaatgaaatcaaagaccttgcccttgaactaaacattcaaccagcaagagttaaagaaagaatagcagagcttcaagaagtaaacccaatgctcggatttagaggactaagacttgctataatctatccagaaatcgcaaaaatgcaagctcgtgccatcatccaagcagctatccactgccatgaagacggagtaaaggtagttccagaaatcatgattccactatcaagtgacgtagtagaattatctaaagtaaaagaaactgttaaagaagaaatagaaaaagtattcgaagaaaaaggaaagaaaatcgactacctactaggtacaatgatagaaattccaagagcagcaatcactgcagatgagattgcagaagtaactgacttcttcagcttcggtacaaacgaccttacacaaatgaccttcggtctttcaagagatgacgcaggtaagttcctaccagcctatatcgaaaaagatatcttcgaaaaagatcctttccaagtactagaccaaaagggtgtaggattcttagttgaaactgcagtagaaaagggaagaaaagcaaacgacaaactccacatcggtatctgtggtgagcacggtggtgaaccatccacagttaaatacctatacggagtaggactagactatgtatcatgctctccatatagagtaccaatagcaaaactagccgctgcccaagctgcaatagaaaacccaagaaacaaataa

SEQ ID NO: 774 - DNA, 2730 bp, Slackia heliotrinireducens DSM 20476
gtggctgaaaacgtaaagcgtgtctacgcgttcggtaaggacgcgcagggcaacaacgttactgagggcgacaaggatatgaagtacatccttggcggcaagggtgccaaccttgccgaaatggccgttatcggtctgcccgtccctccgggattcaccatcacctgccagacctgcatggagtatgcgaatgcaggcaacacttggcctgagggcgcgttggatgagatcaacaaataccgtcaggacctggaagagcgcatgggcaagcgcatcggcgacgccgatgacccgctgctggtttccgtgcgttccggcgctcctatgtccatgccgggtatgatggacaccgtcctcaacctcggcctcaacgacgagtccatcaagggcctcatcaagcacaccgagaatccccgtttctcctgggacagctaccgtcgtttcatccagatgttctccaacgtggtcatgggcctggacggcgacctgttcgagaacgccatcaccaccaagaagctggtcaagggcgccaagtccgacaccgaccttaccgctgaggacctcgaagagctcgtagccgagttcaagcagattttctccgacaacgtcagcgccgaagattacccgctgctggtcgtggacggcaaggtccagttcccgcaggaccccgacacccagctgcgcctggccatcgaggccgtcttcggcagctggaacaacccccgtgcaaccctgtaccgcaagcagaacaagatcgcggacgacctcggcaccgccgtcaacgtccagaccatggtcttcggcaacaagggcaacacctccgcaaccggcgtggccttcacccgcaacgccgctgacggcaccaacgagttctacggcgactacctggtcaacgcccagggcgaagacgtcgtcgcaggcatccgcaacaccagccccatcgccgagctgaaagaggtcgaaggcctgcaggaggccggccgcgagctcgagggcatcttcggcattcttgagaaccactaccgcgacatgatggacatcgagttcaccatcgagcagggcaagctgtggatgctccagacccgcgtcggcaagcgcaccgcagccgccgctctgaagatcgccatcgacatggagaaggaaggcctgatcaccaaggaagaggccatccagcgcgtcgaccccgagcagctcgaccagctgctgcacccgcagttcgacaagaacgccacctacgacgtggtggcccgcggcctgaacgccagccccggcgccgctgtgggcgaggccgtgttctccgctgccgatgctgtggaagccaaggccgaaggccgcaagaccgttctggtccgctgggaaaccactcccgacgatttggccggcatgatcgctgccgaaggcatcctgacctcccatggcggcaagacctcccacgccgccgttatcgcccgcggcatgggcgccccctgcgtctgcggcgttgaggccctgcgcatcgacgctgagaagaaggaagccgccatcgccggcaccgacatcgtcatccgcgagggcgacatgatctccatcgacggcaccaccggcatcctggttctgggcgcagtcgatttggtcatgcccgagctcaccggcgatctggacaccatcctcgcgtgggccgacgaggtccgcaccctgggcatccgcgccaacgccgacaacccggcagacgctcagctgtcccgcgacttcggcgccgaaggcatcggcctgtgccgcaccgagcacatgttcctgggcgaccgcaagcagatcatccagaccttcatcctcaacgaggaccaggaagtccgcgaagaggccgtggccaagctgttcgaggcccagaagggcgacttctacggcatgttcaaggccatggacggcctgccggtcatcgtccgtctgctcgacccgccgctgcatgagttcctggagagcccgcgcgccctggacgtcgaaatcgccaagctggaagccaccggcggcgacgcggccgtcatcgccgagaagcgtgccctcatggagaagatcgacagcttcgccgagcagaaccccatgctgggcctgcgcggctgccgtctgggcatcgtctatcccatcctgcccgtcatgcaggttcgcgccatcgcaaccgctatggcagaactcaagaaggaaggcctcgatccgaagcccgagatcatgatcccgctggtctccaccgtcaacgagctggccaagctgcgcgccgtcgccgagcagaccatcgccgaggtcgaagaggccgagggcgtgaagctcgagattccgatcggcaccatgatcgagctgcctcgcgccgctgtgaccgctgacgagatcggcaccaaggccgacttcttcagcttcggcaccaacgacctgacccagaccacgttcggcttcagccgcgacgacgtcgagtccgagttcgtgcctcagtacctggctgagaagatcctgccctacaaccccttcgccacggtggacccgggcgttgccaagctggtcaagatgggcgtcgagctcggccatgtgggcaatcccgacatcacctgcggcgtctgcggcgagcacggcggcgatcccgactccgtcaagatcttccattccatcggtcttgattacgtctcctgcagcccgtaccgcgtgccgctggcacgtctggccgccgctcaggcagccctgaaggataccggcaaggacaagtaa

SEQ ID NO: 775 - DNA, 2763 bp, Atopobium parvulum DSM 20469
atgtccgagaagcatgtttacagcttcggaaaggatcacgctggtaacgatgttactgaggtggctggcgcatccgtagaagaggcaaagtggattgttggtggcaagggtgcaaaccttgctgagatgtctaagattggcctgcctgtacctccaggattctcaattacttgccaaacttgcgttgcttattccaacaacggcaacgtctggcccgagggtgtcactgatgagattgacgctgcaatggctacccttgaagagcgcatgggtaagaagctcggcgatgcagaagatccactgcttgtttccgttcgttctggtgctccgttctccatgcctggcatgatggatactgttcttaaccttggtcttaacgatgagtccgttcagggtctcattaagcagactggtaatgagcgctttgcttgggactcttaccgtcgttttgttcagatgttctctggcgttgttatgggtgtatctggacagctctttgaggatgcaattgctgctaagaaggccgagaagggcgttaagcttgatacagagctggatgcaaatgatcttcgtgaccttgtaacttggtttaagggcatcttcgctgcaaatgttgatgttaaggagcatccagaggtttctaagaacggttatgctgtttttccatctgatccttaccttcagctccgccttgctgagcaggcagtttttggttcttggatgaatgaccgcgcaatcctttaccgtaaacagaacaagattccagatgagcttggtactgcagttaatgtccaggtcatggtctttggtaataagggtgagacttctgcaactggtgttgcatttactcgcaatcctgcagacggtaccaacgagcgctacggtgacttcctgattaacgctcagggcgaggatgttgttgctggtattcgtaacactgagcctatcgctgaccttgttaaggtttctgcactcaaggaggcaggcgaggagctcttccacgtctttgagattcttgaggatcattacgcagacatgatggacatcgagttcaccattgaaaatggtaagctttggatgcttcagactcgtgttggtaagcgtactgctctctctgcactcaaggttgcaattcagatgtacgaagagggtcgtattactaaggaacaggcagtttctcgtgttgctcctgagcagcttgatcagcttctgcatccacagtttgatcctaacgctgagtacaagaccattgctaagggtcttaacgcttctcctggcgcagctgttggtgctgcagtcttctcttctgcagatgctgaggcttttgcagaagcaggcaagccttgtattcttgtccgttgggagaccactccagatgacctccacggcatggttgctgcagagggtattctaacttcccacggcggcaagaccagccatgctgcagttatcgctcgtggtatgggcgccccttgcgtttgcggtgttgatacacttcgcattgacgctgctaacaagcgctttaccgttgcagattccggtcttgttgttaatgagggcgatgttatctccatcgacggtaccactggtgacgtcatccttggtgctgttgagcttgttcagccagagctttctggtgaccttcagactatccttgcatgggcagatgaggttcgtcttgacgagtcccgtggtcgcgtcattggtgttcgtgcaaacgctgataacccaactgatgctcagacttccgttgataacggtgctgaggcaatcggtcttgatcgtactgagcacatgttccttggtgagcgtaagcatctcattcaggactttattcttgctgactctgaggatgttaagcagcttgctattgagcagcttggacgtgctcagaagggcgacttccttggtatgttcaaggtaatggacggcaaagacgttgtcgttcgtcttcttgacccacctctgcacgagttccttgactccccacgtgagcttgacgttgagattgctcgtgatgaggagcagggtaaggacaccgctgcaaagcgtgctcttctcgctaagtttgatgctttccaggaggcaaacccaatgctcggcctacgtggctgccgccttggtcttgtctacccagagctcaatgttatgcaggttcgtgcaatcgcaagcgcggctgcagagttgaagcgcgttggtcttgatcctcgtccagagattatggttcctctggttggctttgaagaggagcttatccaggttcgtgaagaggttgagcaaactatcaagcaggttgctgatgagtatggtgttgagctcaacattccagttggtactatgattgagcttccacgtgcagctatcatgtctgaggagattgctaagcacgcagacttcttctcctttggtactaatgaccttactcagacctgccttggcttctcccgtgatgacgttgagtccgcatttatgcctctttatcttgagcgtaagattgttaagaccaacccatttgcaactcttgataagggcgttgcagagcttgtccgcatgggtgtcgagggcggccgtaagggtaatcctaacctcaccattggtgtctgtggtgagactggcggcgatccagagtccattcacatgtattacaaccttggccttgattatgtctcttgctctccataccgcgtgccaattgcacgtcttgctgcagcacaggctaagattcaggctaacggtggtccacagaagattgctaccaagtag

SEQ ID NO: 776 - DNA, 2664 bp, Desulfotomaculum acetoxidans DSM 771
atgtccaagaagtatgtttatctctttaaagaaggaaatgctgatatgcggtcactcctgggtggtaagggtgccgggttggcggagatgtctaatatcggattgccggtacctccgggttttaccattaccactgaggcctgcaacgagtattatgagtcaggtttggattttcctgagggtatgctggggcaggtatgggccagccttaaggttattgaagatcagacaggcaaagagtttggcagccctaccaatcctttattggtttcggttcgttcaggagccgttttttccatgcccggtatgatggatacagtactgaacctgggattaaatgataccacagtacaggctttagtcgctaattctcaggatgagcgttttgctatggactgttaccgccggtttattcaaatgttttctgatatagttatgggtattgagcattatgaatttgagaatgttttagtcaataccaaagaaactctgggtgtaaaatatgataatgaaatagatgccgctactatgcgtggtgtggtggaagaatttaaaaaggtggtcaagcgtgaatcaggtcgtgagtttccgcaggatcccaaagagcagctggtaatggcgataaaagctgtattcagttcgtggaacaacgacagggctatttattaccgtaaaattaacaatattcctggtcacctgggtactgccgtaaacgtgcagtcaatggcctttggcaacatgggcggcgattgtggtaccggggtagcctttacccgcaacccttctacaggggaaaaggctttatatggtgagtacctgattaatgcccagggcgaagacgtggttgccggtattcgcacgccgcagccgattagtaaattaaaagaggaaatgccggctgtctttcagcagtttgtggacacctgcttgttgttggagaagcattataaagatatgcaggacattgagtttaccattgagcggggcaaactttatatgctgcagaccagaaccggtaaaagaaccgctccggctgccttaagaattgccgtagaaatggtcaatgaaggtttgattgataaaaacactgccgttcagcgtattgatcccgctcaattggatcagcttttgcacaggcgcattgaccccaatgccagcgttgaagttttagccaaaggtttgcccgcctcaccgggagcagccagcggtaaagtcgttttcagcgccgatgaggctgaacagatggcggatgatggcgaaaaagtcattcttgtgcgcatggagactactcctgacgatatccatggaatggttaaagctcaggctattcttacttcacgtggcggcatgacttcgcatgctgctgtagttgcccgcggtatgggcaaaccttgtatctgcggttgtgaagctataaagatagattatgccaaagaagagtttgcagttggctcacgcgtgtttaagaaaggtgaactgatttcggttgacggcggcaccggccgggttattgccggtgaaataccgatgattgatcccgaattaaatgatgattttgtaactatgctctactgggctgatgaaatcaggactctgggtgtacgggctaatgccgatactccggaggatgctgaaaaagccagggctttcggtgccgaaggtattggtttgacacgtaccgagcatatgtttatggcacaggatcgcttgccggtagtgcagcagatgatcatgtccgatactctggaagagcgtgaagcagctctggctaagctgctgcctatgcagcagggtgatttttacggtattttgaaggctatgcagggactgccggttactattcgtctgctggatcctcctttgcatgaattcctgcccaatattgaggatttgatggttgaaattaccactttgaaactgactaacggtgacccggaagtaattaaaaagaaagaaactattctcaagaaagccagagcactgcacgaattcaatcccatgctgggacaccgcggctgccggctgggcatctccaacccggaaatttatgctatgcaggtaaaagctattttctatgctactgctcaactgattaaagaaggtgttgatgctaagccggaggttatgattccgctggttatccatgctaaagaattgcaggtattgcgtgaccaggcagcagctattgctgaagagattaaggttgagacaggtgtggatttaccggtaagtattggcactatgatagaaatacccagagctgccctgactgccgatgaggtggctgagtacgctgagtttttctctttcggtaccaatgacttgacgcagactaccttgggctttagccgtgatgatgccgagggtaaatttatgcattattatatcgagaagaagattcttgaggaaaacccgtttgtttctattgaccagacaggtgtcggtaaactggtgaatatagcctgtgaattgggacgcaaggcccgtccgaatattaagctgggtatttgcggcgagcacggcggcgagccaagatctatcgaattctgtcacaataccggcttaacctatgtatcctgctcacctttccgtgtacctatcgcccgtttggctgcggctcaggctgccgctaaagagcgcagtgctgccggtgttgataagtaa

SEQ ID NO: 777 - DNA, 1389 bp, Porphyromonas gingivalis W83
atgcaaaaacaacaaacactgaaagataagttctgtctgcaaggcaaaggcctacacaccggactggatattcatattactttctgtcctgctccggaggaatccggatataaaatcaagcgtgtcgatctggagggacaacccgttatagacgccatcgcagacaatgtgcacagtactcgtcgcggtacggtgctgaaaaaaggcgaagtttccgtcagcacgatagaacacgccatggcagctctctatgcccttggcgtagacaactgcttgatcgaggtggatgcacccgaatttcccatcttggatggtagcgcggaaccctatgtgagcgaaatcaagcgcgtcggcttggtggaacaggaaacaccacgcgattattatataataaaaaaacgcatggaggtgtccgatccggaaagcaattcgaagttgatcctgctgccggatgacgaatttacagtagatgtacacatcgctttccccagcaaggtgcttagcaatcaattcgcttctttggaaacattgtcggatttcgaagagcagattgcaggtgctcgcacctttgttttcgtacgggaggtgcagatgcttctggaggccaatctgatcaaaggcggcgatttggacaatgctttggtgatctacgacgagccattggcacaagatcgactcgatgcccttagtgatatgatgggagtggagcggaagcaggtcaatgaattggggtacatcaacaacaagcctctaatctacgacaatgaaccggcacgccacaagctcctcgacgtattgggcgatctggctttgatcggaaaatatattcgcggacgcattattgccacctgtccggggcacagcatcaacaacaagatggcgcgcctgattcgcaaagaaatcaaacagaacgaagcacaggcccctgtctacaatccgaacaaagagccgatcatggacatcaatcggatcaaagagcttctaccccaccgctatccgttcctattggtcgataagatcatcgaagtagggccggactatatagtcggagtaaagagcgtttccggcaacgaaccatttttccccggtcacttccctggtgagcctgtgatgccgggagtcctgcaagtagaggcaatggcgcaggtgggagggctcttggtactcaataccctgaccgagccttcgagctactccacatacttccttatgatcgacaaagtgaaattccgccgtaaagtggtacccggcgacactttggtgttcaagctcagaatgatttccgagatacgcagaggagtcgctaatatgcgcggcttagctttcgtaggagagcagttagcctgtgaagctgaatttatggcacagataatccagaataaagaatga

SEQ ID NO: 778 - DNA, 1389 bp, Cytophaga hutchinsonii ATCC 33406
atgtatactaaacaacacactataaaagcgcctgtaaaggtttcaggcgttggactgcatactggtgctcaagtaaatcttacatttgttcctgctccgatcaatcatggtattttatttaaacgcgttgatctacccgatcaaccggttgtagaatgtgatgttgataatgtggttgacgtttcaagaggaacttcgattgaaaaaaacggagcccgtatcaacaccgtagaacacgcattagccgctcttgttggtttacagattgacaacattcttattgaactggatggccctgaaattccgatcatggatggaagttcccttccgtttattgaagcgattaatgcaattggtttagaagaacaaaatgcattgcgtaacttttttgaagtaccacacggtatcttcttccaggatgctgaaaaaaacattgaacttgccgctctcccattagatgattaccgggtaaccgtaatggttgattacaattctcctgtacttggaagccagcatgcaaccttaaataatatcaaccagtttgaaaaggaaattgcttcctgccgtaccttctgcttcttacatgaactggaaatgctgcataagcagaacctgattaaaggtggggatctgaacaatgcaattgttattgttgaccgcattgtaaaagatgatgaactggacagcctggcaaaacttttcggtaaagataaagttgaagttaagaaagaaggtattctgaataatatcgaacttcgttataaaaatgaacctgccagacataaattattggatgttgttggtgatttagctttggttggccgtccgttaaaagcacagattatggcagcccgcccgggccatgcctctaacgtagctttcgctaagaaattaaaacgtgtaatgatggattccagacaaaaagccccgcattacgatattacacagccgtctgtgttggatgtaaatcagatttataaattacttccacacagatacccattcaaactggttgataagattgtacaccttgacgagaatatgattatcggcgttaagaatgttaccatcaatgaaccgttttttgaagggcatttcccaggaaaccctgttatgccgggcgtacttcagattgaagcgatggctcaaacaggtggtatctttgtgatgcagtctgtaccggatccggaaaattactggacctatttcctgagtattgaaagtgcaaaattccgtcgcatggttgtaccgggcgatacattggttttcaaatgtgagttaacggcaccaatcaaacgcggcattgcaaaaatgcagggtcaggcttatgtaggaggaaatttagtttgtgaagcaagtttaacagcaagtattgttaaaaagaaataa

SEQ ID NO: 779 - DNA, 1398 bp, Flavobacterium johnsoniae UW101
atggaaataatggttaaacagaagaccatcaaaaatgaaatttcactaacaggagttggattacatactggaaaagaagttactatgacttttaaacctgctcctattaataatggtttcacttttgtaagagtagatttgcaaggccagccagtcattgaggctgacgctaattatgttgttaatacgcaaagaggaactaatttagaaaaattaggtgttaaaatacaaactcctgaacacgttttagctgcagtagttggttgcgatttggataatattattattgaattgaatgcctctgaactacctattatggatggttcatcaaaatattttgttgaagcaattgaaaaagccggaatcgaagaacaagacgcaaaccgtaatgtttatgtagtaaaagaagttatttcgtttacagatgaagcaacaggaagtgaaattcttgttatgccaagcgatgaatatcaagtaactactatggtagattttggtacaaaagttttaggtactcaaaatgcaactttaaaaagtttatcagactttaaagatgaaattgcaagttctagaacattcagctttttgcatgaattagaatcattattagaacacggtttaattaaaggcggtgatttaaataacgcaattgtatatgtagataaagaaatatctgagtctacaatggaaaatttaaagaaagcttttggtaaagatgaaatatctgtaaaaccaaacggcgttttagacaaccttactttacattatccaaacgaagctgcaagacacaaattgcttgatgttattggagatttatctctaattggagttcgtattcaaggaaaaattattgcaaataaacctgggcattttgtaaacactcagtttgctaaaaaactggcaaaaatcattaaaatagagcagagaaatcatgttcctgtttacgatttgaaccaagaaccattgatggatattcacaaaatcatgtcaatgcttcctcacagaccaccattcttgttaattgacagaattatcgaaatgtctgatcgtcatgtggttggtttgaaaaatgttactatgaatgagaacttcttcgtaggacatttccctgaggctccagtaatgccgggagttttaattgtagaggcaatggcacaaacaggaggaattttagttttaagcacagttccagatcctgaaaattacttaacatatttcatgaaaattgataatgttaagtttaaacacaaagtattgccaggtgatacgttaatttttaaatgtgaattgatttctcctatcagacgaggaatttgtcacatgcaggctaatgcttatgcaaatggaaaattagtaactgaggcagaattaatggcacaaattgcaagaaaacaataa

SEQ ID NO: 780 - DNA, 1341 bp, Opitutus terrae PB90 1
atgaaacaacgcaccctcgcgcgtgaggtctcgatcaagggcagcgcgctgcacaccggggatccggttacgctgacgatgaagccggcgccggtggaccacggcattgtgttcaagcgcacggatctgcatggcagtccagagcttcggccgcgggtcgaccaagtcacggatctggtgcgcgccacgaccatccagtcgggtcacgccaagatccacacggtggagcacgtgctgagcgcgctgcatggttgtggcatcgacaacgtgctgctggagatggacgcgtcggagccgccgatcatggacggatcggcgcggccgttcgtgaacctgatcctgcaagccgagccggtggagcaggacaaggatcgcgagtatttcgagctcgatgcgcccgtgtcggtgacgcgcggcaattcctcgatcatcgcgctgccgagcgacgtgctgaaaatctcgtgcacctcggccgacgaccgcggcatccacacgcagcatctgtcgctgacgatcgatccggaggtttaccagacgcaggtcgccgcggcgcggacgttcacgatctacgaggacatcgaggaactgctgaagctgggcaagattcgcggcggttcgctcgattgcgcggtggtgatccggggcgacaagatcatctcgaaggagccgctgcggttcaaagacgagttcgtgcggcacaagatcctggacatcatcggcgacgtgatgctgctcggcctgccgttgaaggcgcacatcgtggcgacgcggccgggccatgcgatcaacgcggagctgaccaaggccatttaccaaaagctgctggagcgaaagcagggcggcacgaagaaaaaggaaaagccggtggcgccgacgatgctgctgaccgacgagacctcgctcgatatccgccggatcctcgacacggtcccgcatcgttacccgttcatcatggtcgatcgggtgctcgagatcaaaggcccggacgaactggtggcgctgaagaacgtcacgatcaatgagccgtatttccaggggcatttcccgggcaatccggtgatgccgggggtgctgcagatcgaggcgatggcgcaggcggcgggcatcctgatgctccgcaaaatttcctcggaagggaagacggcgctcttcatgagctgcgacaaggtgaagttccgccgcgcggtgcggccgggcgaccagctcttgatccaggtgaaaatgacgaagagccgcggcaaccggatcggcgtcgcagaaggccagtgcagcgtgaacggccaggtcgtttcctcggccgagctcatgttcacggtgatcgacgaaacggacgtggagtga

SEQ ID NO: 781 - DNA, 1395 bp, Candidatus Amoebophilus asiaticus 5a2
atgcaaacaaagcaacataccattcaagcacctgtgactttttcaggagtaggcatacactctgattgtacagcaactgtaacatgtttaccagctggacctgaccatggtattaaatttcaacgtaccgatatagaagggcaacccattgttgaagcaattgtagatcacgtagtagatgtaactagaagtacaactttacgacataataacgcttatgtagatactgtagagcatctgctagctgctataggtgggttagagatagataacatgcttatacaattagatggtcctgaagtacctattctagatggaagctccatgccttttgtaaaggcctttcaagaagttgaacttactaatcaaggagtgccaaggcgtttctttcaaatcaacgaatcagtagtatatgctaatgagagccaaggtatcgagctaagtgcttttccgttagatgattacaaaatttcggtgatgattgattatgaagttgataaactacataaccaacatgcttttttaggaaaaatatcagattttgcaaaagaaattgcccctagtagaacttttgcttttttaagcgagatacaatctctatatgaacatggacttatacgcggtggaaatcttgataatgcacttgttataatagataaggaaatgtcagcttctgaattagaaaatttagcaaaaatttttaacaagaaagagatcaagttagcagaagggggtgtgttgaacaatgtaaaaatgtattttcctaatgaacctgctagacataaattaatggatttggtaggagatttactgttagtaggacgtcctatcaaagggcatattgtagcacataaaccaggccatgcctctaatgtagcgtttgccagaaagcttcgaaaaatgatgcttcagcaagagaacgtaaccatacctacgtacgaccctaatatagaacccattttagacattaagaagattactaaaatgttacctcatagatacccttttcagctggtagataagattattcatttagaacagcgtactgtaacgggtatcaaaaatgtaactatcaatgaacccttcttccaaggacacttccccaataatcctgttatgcccggtgtattacaaatagaggccattgtacaaacaggaggtgtattagtccttagtagtgttccagatcctgaaaactattcgacatacttcttagctattgaaaactgccgtttcaggagaatggttttgcccggagatactcttatcatgcattgcgagttgctctcagaaattaaaagaggtattgttaagatgcgtggaagagccttcgtagggaataagttggcttgtgaagctatcatgaccgcacaaattgttaaacaaactgaatga

SEQ ID NO: 782 - DNA, 1389 bp, Capnocytophaga ochracea DSM 7271
atggtaaagcaaaatactttatccaaagaaattaccttagaaggtattgggttacatactggtaaacaagtaaaaatggtgctcaaacctgcaccagtaggcaatggttttacctttgtacgtaccgatttagaaggaaaccccgttgtcgaagcggatgctacctatgtagcaagtactgaacgtggtacagtcttagaaaaaaaaggggtgaaaatccaaacttgtgagcacatcttagcagcgctcgtcggtatggatttggataatgtgattattgagctcaactcctctgaacctcctattatggatggttcttctaaatattttgtagaagctattgaaaaagcgggtatcactcctcaagatgcagagcgtgatgaatatatagtaaaacaagtgattacctacgtaaatgaagaaacaggtagtgagattactctcattcctgccgaggaataccaagtgactacaatggtagattttggtactaagattttgggcactcaaaatgcttacctcaataaactttccgaatttaaaaccgaaatagctgatgctcgtacttttagtttcttgcacgagctcgaagctttacttgatcacggtttgattaaaggaggagatttgaataatgctatcgtatatgtagataaagaaatttctgatagtacgatgcagaaacttaaaaagattttcaacaaagataatatttcagtgaaacctaatggagtgcttgataatcttactttgcattaccctaacgaagctgctcgccataaactattggatgtaataggcgatttggcattggtaggtacacgcattcgtggtaaagtaattgctactaaacctggacacttcaccaatacccaatttgctaaaaaactttctaagattataaaaaatgaacgtcgtaacaacgttccttctatagatattaatcaaccaccgttgctcaacactaccgatataatgaagttgttacctcaccgttcaccattcttgttggtagataaaatctttgaactttctgataaacacgttgtaggtttaaagaatgtaacaatggatgaacctttcttcgtagggcacttcccaggggctcctgtaatgcctggtgtactccaaatagaagcaatggcacaaacaggaggcgtattgatactcagtaccgtccccgaccccgaaaattacctcacttattttatgaaaatagacaatgtgaagttcaaggtacaagtagtgccaggggatacccttatattcaagttagaattgctaacgcctattcgccgtggtatttgccatatgcaagcttacgcttatgtgaacggaaagttggctactgaagctgagctaatggctcaaattgttaaagtaaaataa

SEQ ID NO: 783 - DNA, 1410 bp, Pedobacter heparinus DSM 2366
atgaacgttaaacaaaagaccataaagaatgaagtttcggtacagggcgtagggctgcacaccggggcaaatgttacacttactttttgtccggcacctgaaaaccatggatttaaattccagcgtaccgatcttccgggcaatccggttgtagatgccgattgtgacaatgttacggataccgccaggggaaccactatttctcagaacggggccagtgtaagtactgttgaacatgttatggcctctttggtgggaatggacctggacaatgtgctgatgaaacttgacggacctgaaacgccgattatggatggcagtgccattcagtttttagatgcactggaaagtgcgggcattcagatacaggaaaaagaccgggaatattttcagatcccacacaatattgcttatacagagccggacagaaaggtagaaattgtggcgatgcctttagacgattacaggtttacctgtatgattgattacaattcgccggttttgggcagtcagcacgccgggattaccagtattgctgaatttaaaaaggaaatcgcttcctgccgtactttttgctttttgcacgaactggaataccagctgcaaaataacctgatcaaaggcggcgatctaaacaatgccattgttattgtagacaaagaagtaaccaaggaagaactggaccacctggccaagatatttaaaagaaaggcgattgaagttgcccctcagggtattttaaataatatggagctgaggcaccagaacgaaccggcaagacataaattgctggacatgattggtgatcttgcccttgtgggggtgcatctaaaaggacatattatggcagccagacccggacatgccgccaacgtggcatttgccaaaaaaatcaaagcagccatcaaaaaggaaaaaaacaaaaaggtacagcatgtgtacgacccaagcgttaaaccgctgtacgatacggttcagattatggacatcctgccgcacagacaaccatttttgtttgtcgataaggttttggaattatcgaagacccatgtggttggcgtaaagaacgtgaccatgaacgaggagttctttaaaggacattttccgggagcgccggttttccctggggtgatccagatagaagccatggcacagaccggcgggatcctggtactgagtacggttcctgacccgcagaactaccttactttattcctgaaaatagacaatgtgcgcttcagggctcaggtactgccaggcgataccattatcttcaggtgcgatctgatggagccaataagacgcggaattgcacaaatgaaaggtgtgggcatggtgggcggaaaagtggtggttgaagccgagatgatggcccagatcgtaaaagtaaaagaaaccgaaactacatga

SEQ ID NO: 784 - DNA, 1392 bp, Dyadobacter fermentans DSM 18053
atgaacgaaaaacaacaaaccatttctaagtctgtatccgtaactggagtgggtttacataccggtgtcgtggctaccatgacattcgtaccggcaccagccaaccacggatacaagtttcaacgtgttgatttacccgaccagccgatcgtcgatgccgatgtcgacaatgtagtggatctttcgcgtggtaccaccatcgaacagaatggcgccagaatccacacggtggaacatacactggctgcgctggtgggcttgcagatcgacaacgtgctgatccagctcgatggtcccgaacctccgatcatggacggcagttcgatcaaattcgtggatgcgttgctcgacgccggcattgaagaacagaatgcatatcgcaactatttcgaagttccggaatacgttcattataagaataaagataaggataccgaactggtggcgttgccgctttcggactatcgcctcacggtgatggtggattacaactctaccgtcatcagcagccagcatgcttctttgaatgacattacgcttttcaaagacgatatcgcatcgtgccgcacattcgtgttcctgcatgagctggaagcgctgtacaagcaaaacctgatcaaaggtggtgacctcaccaatgcgatcgtgatcgtagaccgcgaggtgcgggatggcgagctcgatcatctgtcccagcttttgaataagccgaaggtgagcgtcgacaaatcaaaaggcattttgaacaatgtcgacctgcattatcccaatgaaatggcgcggcacaagctgctcgacctcattggtgacctggcgctggtaggccggcctatcaaagcacagatcctggccgcacggccgggacatgcggcgaatgtggctttggcgaaaaagatcaaaaaactgatcaaatcaggcaagggagatatcccgcaatacgacccgaacaaggcgcccgtattcgatatcaaccagataggccagcttctggcacaccgctatccgttccagatgatcgacaaaatcatcgcgctggacgaaaacagcgtggtaggggtgaagaatgtgacgatcaacgaacaatttttcctagggcactttccgggtaacccggtcatgccgggcgtcttgcaactggaagcgatggcccaaacgggcggtatcctggtgctttccagcgtgcccgatccggacaactactggccatacctcatcggcatcgacgcgtgccggttccgccgcaatgtttttccgggggatacagttatttttaaatgtgaattcacatccccgatgaagcgggggatcgtcaaaatgagtggccggggatatgtagccggacagctggtatgtgaagcggatatgatagcaagcctggtaaagaaaaaatga

SEQ ID NO: 785 - DNA, 1416 bp, Chitinophaga pinensis DSM 2588
atggataatcaacagtcgtctaatcaacacacgattaaagacccagttacaatatcgggtgttggtttacacacaggagcccatgtaaatatgactctgaagccggctacccccggttatggtattaaatttcagcgtgtggatctgccaggacaacctgtagtgaaagccgatgtagattatgttgtggatacatcccgcagcacaacgcttgaacacaatggcgcccgcgttagtacgatagagcacatcatggctgccctggttggtaccggcgtagacaatgtgcacattgaaatcgatggtcctgaaatccctatcatggatggtagttcctacccttttatccagaaaatagaggaagcaggtattgcagaacaggatgcgaaaaaaatatggtatacgattgataccaacatcagcttctacgacgataaaaagaacgtagaaatggtagcattaccagctgttgactatcgcatcacctgcatgatcgatttcaactctccgatattaggtacacagcacgctaatcttaacagcctgcaggatttcaaacaggaagtagcgccatgccgcaccttcgtgtttctgcacgaactcgaatacctgatatccaacaacctgatcaaaggcggcgatattaataacgctattgtgatcgtagataaagcggtaagtgaagaacaactgggccatctggcaaaagtgttcaaccgtgaacatatcagcgtagcacagcgggaaggtatcctcaataatattcagcttcacttcccgaatgaaccggcacgtcacaaactgctggacatcgtgggagacctcgcactggtaggtgtgcctattaaggcgcatatcattgcaaaccgtcccggacatgcttccaacgtggagtttgcccgtaagatcaagcaatatatcaagaagaacaagcatatcaaggatatgcctgtatacgatcctagtaaaccagctgtcttcgacgtaccacgtattgaaagaacattgccgcatcgttttccgatgctgctggtggacaagatcatcgatctcaccgatacgcaagtagtaggtatcaagaacgttaccttcaacgaaccatttttccaggggcacttcccaagtaatccggtgatgccgggtgtactccaggtggaagcactggcacaatgtggtggcattcttgcactcagcactgttccggatcctcataattacgatacctactttatcaagatagacaactgtaagttcaagcagaaagtggttcccggagataccatgatcctgaaaatggaattacttagccctatcaggagaggtatagtggaaatgagaggaaccgtatttgtaggtaacaaggtagttactgaaggtgacctgaccgctcaaatcattaaaacaagagaaagctaa

SEQ ID NO: 786 - DNA, 1287 bp, Clostridium perfringens SM101 uid12521
atgtttatagatacggccaagatatttgtgaaatctggagatggtggtcatggttctgtttcttttagaagagaaaaatacgttccacttggtggaccagatggtggagatggtggaaaaggtggagatgttacttttgtagtagatccaggaatgacaactcttttagatttcaaatataagagaaaattcgtagcaggcagaggacaagacggtcaaggttctaagtgttacggaagagatggtgaaaatttaacaataaaggttccaatgggaactataataagagatgttgaaactaacaaggtaatggcagacctttctcatagagatgatacatatacaatctgtagaggaggaaaaggtggtaagggaaattgtaagttctgtacacctacaagacaggcgccaacttttgctgagccaggaatgccaggggaagaaagatgggttgctttagaattaaaactattagcagacgtaggtcttttaggattccctaacgttggtaaatcaacattactttcagtggtaactaaggctaaaccaaagatagctaactatcacttcacaactttaaaacctaatttaggagttgttgctgtaccaggaatagagccatttgttatggcagacgtaccaggtattatagaaggagcttcagagggtgtaggtcttggattagacttcttaagacatatagaaagaacaagacttttaatacacgttgttgatatttcaggagttgaaggaagagacgcagttgaagacttcaagagaataaacgaagaattaaagaactacagtgttaaactttgggatagacctcaaatagtagtagcaaataaatgcgatatgttatttgatgaagaaatttttgaaaacttcaaagctgaagttaataaaatgggatttgataaggtatttaaaatgtcagcagctacttcacaaggagtagaggaagtaataaaagaagcagctagaatgcttaaagatattcctgttactgacttagaaatcccagaagatgaaagattcattccagaggataagaagtttacatatactataaatccaatagaagaagatggattaaaggtttatgtagtagaaggttcatttgtagacagattattattagctgttaatgtaaatgatcctgattcattaagatatttccataaggttcttaataataaaggaatattccatgagttaagagagatgggaatagaagatggagatatggtaagattaaacgactttgagtttgagtacttactataa

SEQ ID NO: 787 - DNA, 1287 bp, Clostridium perfringens ATCC 13124
atgtttatagatacggccaagatatttgtgaaatctggagatggtggtcatggttctgtttcttttagaagagaaaaatacgttccacttggtggaccagatggtggagatggtggaaaaggtggagatgttacttttgtagtagatccaggaatgacaactcttttagatttcaaatataagagaaaattcgtagcaggcagaggacaggacggtcaaggttctaaatgttacggaagagatggtgaaaatttaacaataaaggttccaatgggaactataataagagatgttgaaactaataaggtaatggcagacctttctcatagagatgatacatatacaatctgtagaggtggaaaaggtggtaagggaaattgtaagttctgtacacctacaagacaggcgccaacttttgctgagccaggaatgccaggggaagaaagatgggttgctttagaattaaaactattagcagacgtaggacttttaggattccctaacgttggaaaatcaacattactttcagtggtaactaaggctaaaccaaagatagctaactatcacttcacaactttaaaacctaatttaggagttgttgctgtaccaggaatagagccatttgttatggcagacgtaccaggtattatagaaggagcttcagagggtgtaggtcttggattagacttcttaagacatatagaaagaacaagacttttaatacacgttgttgatatttcaggagttgaaggaagagacgcagttgaagacttcaagagaatcaacgaagaattaaagaactacagtgttaaactttgggatagacctcaaatagtagtagcaaataaatgcgatatgttatttgatgaagaaatttttgaaaacttcaaagctgaagttaataaaatgggatttgataaggtatttaaaatgtcagcagctacttcacaaggagtagaggaagtaataaaagaagcagctagaatgcttaaagatattcctgttactgatttagaaatcccagaagatgaaagattcattccagaggataagaagtttacatatactataaatccaatagaagaagatggattaaaggtttatgtagtagaaggttcatttgtagacagattattattagctgttaatgtaaatgatcctgattcattaagatatttccataaggttcttaataataaaggaatattccatgagttaagagaaatgggaatagaagatggagatatggtaagattaaacgactttgagtttgaatacttactataa

SEQ ID NO: 788 - DNA, 1275 bp, Clostridium thermocellum ATCC 27405
atgtttgttgacagagcgaggatatatataaaagccggggacggcggagacggcgcgatatcctttcacagggaaaagtacataagcaagggcggcccggacggcggagacggcggaaaaggcggggatgtaatctttgttgtggatgaaggattaagaacgcttcaggacttcagatataaaacccgctacagagccgaagacgggcaaaacggcggcagctccaactgttcaggcagaagcggggaagatttgataataaaggtccctccgggaactttggtaaaggatgagcaaacaggcaggattctcgccgaccttgtaaagcccggtaagaaagttgtaattgcaaaaggcggcaagggtggagccggaaatcagcattttgcgactccgacaaggcaggtgccaagttttgcaaaaccgggggagccgggagaagagctgtgggtgatattggagcttaaactcctggcagacgtgggactgataggttttcccaatgtgggcaaatccacaattctttcaatggttacggctgcccagcccaagattgcaaattaccattttacaacaataaaccccaatttgggtgttgtaaacattgacgccgagaacgcctttgtaatggcagacataccgggacttattgaaggtgcgcatcaaggcgtgggattgggtcatgaatttttaaaacatatagaaagaacaaagcttcttattcatgtggtggatatttcaggatccgagggaagagaccctgtccaggattttgaagtaataaatgaagaacttaaaaaatataaccctgtactttgtgaaaggccccagattattgcagcaaacaagatggatgtcacgggagcggaggaaaatcttgaaaaattcaggaaggttatcgaaccaagaggatacaaaattttccctgtatccgcggcatccaacaaaggacttaaggaattgatatattatgccgcacaaaaacttaaggagctgcccgataccgttcttgtaaatgaccaggacaatgaagttgtatatacggcggttgaagaggaaccctttaatatcaggaaggaaaatggtgtttttgtggttgaaggaagctgggtacaaaggctggtaagatcagtgaactttgacaattatgaatctctgcagtatttccaaagagccataaggaggaaaggaattgttgacgccctggaaagtatgggaattaatgaaggggataccgtaagaatgtatgacctggaatttgaatattttagataa

SEQ ID NO: 789 - DNA, 1290 bp, Clostridium phytofermentans ISDg
atgttcgcagatagtgcaaaaatttttatacgctccggaaaaggtggcgatggacatgtttctttccgtcgtgaaatctttgtccctgccggcggtcctgatggaggagacggtggtaagggtggaaatgttatatttgaagttgatgaaggtttaaatactcttggagacttccgtttaaagagaaagtattctgccggtgatggtgaaaacggtcaaaagaaacgttgctctggtaaagatggtgaagatttaatcattaaagttccagaaggtaccattattaaggaaacagaaacgggtaaagttatcaccgatatgtcacatgaaaatcgtagggaagtaatacttcgcggtggtcgtggtggtaagggaaatcaacattatgcaactccaacaatgcaggtaccaaaatatgctcagccaggacaaaaggcgatggaactaaatgttacgttagagcttaaggtaatcgcagacgttggcttagtaggattcccgaacgtaggaaaatctacattattatcacgagttaccaacgcaaaacctaagattgcaaactatcatttcactacactaaatcccaatcttggtgttgtagatttagatggtgcggatggttttgttattgctgatattccaggattaattgagggtgcttccgagggaattggtttaggacatgagttcttaaaacacattgagcgaacaagggtaattatacatcttgtagatgctgcatcaaccgagggtagagatccagtggaagacattgagaaaatcaatcatgaattatcctcctataatgaaggattattattaaaaccacaggtaatagcagcaaataagactgatgttttatatggcgaagaggaagaggaagcaataaataaaatcaaagaagctttcgaatcaaagggaattaaggtatttccaatctctgcagttagcggacaaggagttaaggaattactttattatgtaagtgatttattaaaaactgttgatgctacaccaattgtatttgaaaaggaatacttcccagaagagaatttagtgatgagtgagccttatacagttgagtataatgaaacggaagaagtgtatgtagtagaaggtcctcgtattgaaagaatgcttggatatactaacatagatacagaaaaaggatttgagttcttccagaagttcttaaaagaaaatggtatcttagatcagttagaggagttaggaattggggaaggcgatacagtacgtatgtatggtcttgagttcgactactacaaataa

SEQ ID NO: 790 - DNA, 1275 bp, Desulfitobacterium hafniense DCB 2
atgttttacgatcaggcaaaaatctatgttaaaggtggagacggcggagccggggctgtggcgtttcgccgtgaaaaatacgttcctgagggtggccccagcggtggcgacggggggcggggcggcaaggtcatctttatcgccgatgaaggactcaggacattggtggatttccgttataaacgccattacaaggctgatcgcggggaacatggacagggaaagaatatgcacgggaagagcggggaggatatgagcgtccgcattcctgtaggcaccgttgttaaagatgcggatacaggggaaatcctcgccgacttgattgagcatgggcaaaaagttgtcgttgccaatggcggcagaggcggccgcggtaatgctcgttttatgagcaataccaataaagcccccactgtagcggaaaacggcgaaccgggagaggaacggaacctccttctggagctgaagcttttggccgatgtaggactggtgggatttcccaatgtaggcaagtcgacgatcatttcccgaatctcggcggctaaacccaagattgcggattatcattttactacgctggtgcccaatcttggggtagttgagctggaggatggggaaagtttcgtggtggcggatatccccgggctgattgaaggggctcacaccggagccggactgggtcatgaatttctcagacatacggaaagaacccgtctgattcttcatgtcctggatattgcaggctctgaggagcgggatcccctggaagattttcaaatcattgcggaagagcttcgccaatatagtcaggagctggctaaccgcccgatcttgatcgtggccaataaaatggatattcccggtgcggaggaaaatctgcagcgcttgacagagaagctgggggaagactaccgtatttttccggtatctgcagctacaggagaagggctgaaggaattggtttatgctgccgcgaaagcgttgccggaaattcctgcaccccagatctttgtgcgggatgaggaacagcataaactgactcaggcgtcagctccgcatcgctttgaactgacccgtgaaggggatttctttgttgtctccggtaaggaagttgaaaaacatgtgcagatgaccatgttcgatcgggaggacgggctttatcgcttccagaatatcctcaaggcgatgggaattgaacgcgctttgctggatgaaggtataaaagtgggagataaggttcggatcgccgggatcgagttcgagtgggaagagtaa

SEQ ID NO: 791 - DNA, 1281 bp, Halothermothrix orenii H 168
atgtttgtcgatgaagtagaaattaaagttaaaggtggtcagggtggtaacggggttgtaagtttccgccgggaaaaattcgaaccaatgggaggcccggatggtggtgatggtggtgacggaggcaatgttatattacgggtagatgaaggtttaaataccctggctgattttaggtaccagaggcattatgaagctgaacggggttatcatggttcggggaagaataaacacggcaggagtggggaagacctcgttctcaaggtcccaccgggaactgtagtatatgatgcggataccgatgagctactggctgacttgactgaagatggagaagagtacatagtggcccatggtggaaaagggggccgtgggaatgccagatttaaaaaatcaaccagaaaagccccccgctttgctgaaaaaggggaacccggggaagaaaggtctatcagactggaacttaagctggtggccgatgtgggacttattggttttccaaatgtcgggaaatctacccttatttcagtggtttctgaagccaggccaaagattgccaactaccattttacaaccctgaaacccaatctgggagttgtggccttgagtgaatataaatcttttgttatggcagacatcccgggcctgatagaaggagcccaccagggggttggccttggtgatgaatttttgcgacacattgagagaaccaggttgttgattcatattattgatatatccgggattgaaggtcgagatccccttgaagattttaaaacaattaacagggaattagaaaaatttaatgagaagttatcatcaagaccacagattgttgctttaaataaaatagatcttccaggtgcccgggaaaatgtggaacgggttcaaccggtcctggaggaaaaaggttataaggtttttcctatatctgcagccactaaagaaggagtaaaagagttaatctattataccggtgatttacttaaagaacttccagttgaaaggaaaatagcaaaagaagacaggatagtcataaaacctgattttgctgatgaagaagagaatattgtagttgaaaagaagaatggtatttatgaagtttcagggagactggtagaaaaatatgttattaaaaccgattttaataatgatgcagcagttaagagattgctcagggttcttcaacatcatgatttgaatgaattgttgcgtgataaaggagtaaaaaatggtgatactgtaaaaatcgggccgatggaattcgaatatatggaatag

SEQ ID NO: 792 - DNA, 1278 bp, Clostridium cellulolyticum H10
atgtttagagatagtgctaaaatatatgtcaaggccggtaacggaggaaacggaatggtttcattccaccgtgaaaagtacatagcggccggaggcccggacggcggcgatggcggaaaaggcggagatgttatctttgtagttgatgaagggctcaacaccctgattgacttcagatacaaaaaaaacttcaaggctgagccgggacaggacggcggcacatccaaccgttccggcaaaaacggagaagatcttattatcaaggttcctcttggtaccgtggtaaaggatgaattaactgatatggtgcttgttgatttgataaagcctggtcaaacatgtgttatagcaaaaggcggaaggggcggaaaaggaaatcaacactttgccacacccacaaggcaggtcccgaactttgcgaaaagcggtgatctgggcgaagaatacagcttgattcttgaaatgaagatgattgccgacgtgggacttgtaggatatccgaacgtaggcaagtctacaatattgtccatggtttctgctgcaaagcccaaaatagcaaattaccattttacaactctagttccaaatctcggagtggtacagatagagcatgggaaaagctttgtaattgctgatatccctggtcttattgagggtgcccatgaaggtgtgggacttggtcatcaatttctaaggcatgtagagaggacaaagcttctagtacatgttgttgatgtttccggggttgagggcagagatgcagtggaggattttgatactattaactccgaactccaaaaatataatcaggttttatcaacaagaccacagattgttgccgctaataaaatggatatacccggtgcggaggaaaactacaaggcttttaaggaagagcttgaaaaaagaggatataaagtttttggtatatctgcagcaacaaacaagggcttgaaagaacttttgtatgctgtttcagaaaccttaaaaactcttcctgacactattcttctggatgaaacacagaatgaagaggttgtatacaaggtacaggaggaaaagccttttgaaatacacatagaagacggtgtatatgtaattgagggtaaatggctgagaaaagtactcggttctacaaatattacaaattatgagtcactacagtatttccaaagagcacttaagaaaaaaggtgttattacggctctcgaagagatgggaatacaggaaggtgacacagtcagaatttatgatactgaatttgattataccagataa

SEQ ID NO: 793 - DNA, 1281 bp, Anaerococcus prevotii DSM 20548
atgatagattatgcgagagttagtcttaaggcaggagacggaggaaatggagctgttgcttggagacgagaaaagtacgaaccaaacggcggtcctgcaggtggtgatggaggaaacggtggctctataattataaaagctacaagaaatctttcaactcttgatgaatttagatataaaactaaatataaggctcaaaatggtgaagctggtggtaagaagaagaaattcgggaaaaagggtgatgatttaataataaaagtccctgtaggaaccttagttagggaagctaatagcgaagttataataaaagacctaaacaaggatggggaagagtatgttatagccaaaggtggtagaggtggtagaggaaatgtccacttcaaaaactcaatacgccaggcaccacgctttgcagaattaggtcgaagcggtcaagaaatagaagttattttcgagcttaaaatactggcggatgttggtcttgttggactaccaaatgtaggaaaatcaaccttgatttctgtaattagtaaggctagaccaaagattgccaattatcactttactactatagatccaaatcttggagttgtaaatatcgatagtgaaagatcatttattgtggctgatattccaggtcttatagaaggagcaagcgacggtagtggattaggtcatgacttcttaaaacatgtcgaaagatgtagagttttagttcaccttgtagatatttctggaatagagggtagaaatcctatagaagatttcaaaatgattaatgaagaattgaaattatacaacgaaaagctagcccaaaaaccaatgattatagccatgaataagtcagatcttgattttaataaaaactcggatgaattcatcaatgagttttctgataagtatgatatatacaagatatcagcagctacaactgaaggaatcaaggaattagtagatgctatatcagagctgttggcgaaaagtgatatcaaagaatttgatcctatggaagaagttgacacagaattcttggaaaaatattacgacagagaaattgaatacgacttaaactttagaaaagaaaatgatatttttgttgtcgatgggaaaagagttgataaattactagaaaaggtcgatctagaggattacgatggcaagatgtacttcgagaaaactttgagagagatggaagtttttgataaattaaaagaaatgggaatccaagaaggtgacagtgttgcctttggagacttggtatttgaatactatgaatag

SEQ ID NO: 794 - DNA, 2280 bp, Pseudomonas syringae tomato DC3000
atgctcaatacgctgcgcaagatcgtccaggaagttaactccgccaaggatctcaaggcggcgttgggcattattgtgttgcgcgtcaaggaggccatgggcagccaggtctgctcggtctacctgctcgatgccgaagtgaaccgttttgtgctgatggcctccgaaggcctcaacaagcgttccatcggcaaagtcagcatggcgccgaacgaaggccttgttggtctggtcggtacgcgcgaagaacctctaaacctcgaaaacgccgctgatcacccccgttatcgctacttcgccgagaccggtgaagagcgttatgcctcgttcctgggggcgccgatcatccaccatcgtcgtgtggttggcgtattggtgatccagcaaaaggagcgccgtcagttcgacgagggcgaggaagccttccttgtcaccatgagtgcgcaactggcgggcgttatcgcgcatgccgaagccaccggctcgattcgcggtctgggtcgccagggcaagggcattcaggaagccaagtttgtcggtgtggccggctcgccgggtgccgcagtcggtgtcgcagtggtcatgctgccgcctgccgatctggaagttgtcccggacaagaccgtcacggatatcgctgccgagctgacgctgttccagaatgcactggaaggtgtgcgcaacgacatgcgcaccctgtccgccaagctcgccacgcaactgcgccccgaagagcgcgcgctgttcgatgtctacctgatgatgctcgacgatgcttcgctgggcagcgaggtgaccaatgtcatcaagaccggcgaatgggcacaaggtgccttgcgctcggtggtcagcgagcacgtcaaacgctttgagctgatggacgatgcttacctgcgtgagcgggcctcggacgtcaaggacctgggccgccgcctgctggcgtacctgcaggaagagcggcaacaggcactggtttaccccgataacacgattctggtcagtgaagagctgaccccggccatgcttggcgaagtgccggaaggcaagctggtcggtctggtgtcggtgcaaggttccggcaactcccacgtcgcgattctggcgcgggcgatgggtattcccacggtcatgggcctggtggatttcccgtactccaaggtcgatggcatcgatcttgtggtcgacggctatcacggcgaagtcttcaccaaccccagcgaaatcatgcgtaagcagttcggcaaggtggtggaggaggagcgtcagctctctcagggcctggatgccctgcgcgaattgccgtgcgtgaccctcgacgggcatcgcatgccgctgtgggtcaacaccggtctgctagccgacgtcgctcgcgcccagcagcgtggcgccgaaggggttggcctgtatcgcaccgaagtgccgttcatgatcaaccagcgtttcccgagtgaaaaggaacagctggcgatctaccgcgagcaactggcggccttccatccgctgccggtgaccatgcgcagcctggacatcggcggcgacaagtcgctgtcctacttcccgatcaaggaagacaacccgtttctcggctggcgcggtattcgcgtcaccctcgaccacccggaaatctttctggttcagacccgcgccatgctcaaggccagcgaaggcctgaacaacctgcgcattctgttgccgatgatttccagcacccatgaagtggaagaggcgctgcacctgatccaccgggcctggggcgaagtgcgcgacgaaggcaccgatgtgccgatgccgcctgtcggcgtgatgatcgaagtacccgctgcggtttaccagactcgtgacctggcgcggcaggtggacttcctctcggtgggctccaacgacctgacccaatacctgctggcggtcgaccgcaacaacccgcgtgtggccgatctctacgattacctgcacccggcggtgcttcaggcgctgcaaagcgtggtgcgtgatgcccacgccgagggcaagccggtgagcatctgcggcgaaatggccggcgacccggcagccgccgtgctgctcatggcgatgggcttcgacagcctgtcgatgaacgccaccaacctgccgaaagtgaagtggatgctgcgccagatcaacctcagcaaggccaaggagttgctggcgcaactgatgaccaacgacaacccgcaagtcatcagcagctccctgcaactggcactgaaaaacctcggtctgtcgcggatgatcaacccgggctcggtcaaagggcactag

SEQ ID NO: 795 - DNA, 2280 bp, Pseudomonas syringae pv B728a
atgctcaatacgctgcgcaagatcgtccaggaagttaactccgccaaggatctcaaggcggcgttgggcattattgtgttgcgcgtcaaggaggccatgggcagccaggtctgctcggtctacctgctcgatgccgaggtcaaccgctttgtcctgatggcttccgaaggcctcaacaagcgctctatcggcaaagtcagcatggcaccgaatgaaggcctggtcggtctggtcggtacgcgcgaagaaccgctgaatctcgaaaacgccgcagatcaccctcgttatcgctatttcgccgaaaccggtgaagaacgctatgcctcgttcctgggcgcgccgatcatccaccaccggcgtgtggtcggcgtattggtcatccagcaaaaggagcgccggcagttcgacgagggcgaagaagccttcctggtcaccatgagcgcgcaactggcgggcgttatcgcgcatgccgaagcgaccggctcgatccgcggtctgggacgtcagggcaagggcattcaggaagccaagttcgtcggtgtcgccggttcgccgggtgctgcggtcggtgtcgctgtggtcatgctgccgccagccgatctggaagtggtccccgacaagaccgtcactgacatcgccgccgaactggcgttgttccagaacgcgctggaaggcgtacgcggtgacatgcgcaccctgtcagccaagctggccactcagttgcgtcccgaagagcgggcgctgttcgatgtctacctgatgatgctcgacgacgcctcgctaggcagcgaagtgaccgacgtgatcaagaccggccaatgggcgcagggtgccttgcgctcggtggtcagtgagcacgtcaaacgtttcgaactgatggacgatgcctatctgcgcgagcgggcgtcggacgtcaaggacctgggccgccgtctgctggcctatctccaggaagcgcggcaacaggcgctggtctatcccgacaacacgattctggtgagtgaagagctgaccccggcgatgctcggcgaggtgccagaaggcaaactggtcggcctggtgtcggttcagggatccggcaactcccacgtcgcgattctggcgcgggccatgggcattcccacggtcatgggcctggtggacttcccttactccaaggtcgatggcatcgatctggtggtcgacggctatcacggcgaagtcttcaccaaccccagcgaaatcatgcgcaagcagttcggcaaggtggtggaggaggagcgtcagctctcccagggcctggatgcactgcgcgaactgccttgcgtgaccctcgacgggcatcgcatgccgctgtgggtcaacaccggcctgctggccgacgtggcgcgtgcgcaacagcgaggcgccgaaggggtgggcctgtaccgcaccgaagtgccgttcatgatcaaccagcgcttcccgagcgaaaaagaacagctggcgatctaccgcgagcaactggccgccttccatccactgccggtgaccatgcgcagcctggacatcggtggcgacaagtcgctgtcctacttcccgatcaaggaagacaacccgtttctcggctggcgcggtattcgcgtcaccctcgaccacccggaaatcttcctggtccagacccgcgcgatgctcaaggccagcgagggcctgaataacctgcgcatcttgctgccgatgatctccagcacccatgaagtggaagaagcgctgcacctgatccaccgtgcgtggggcgaagtgcgcgacgaaggcaccgacgtgccgatgccgcccgtgggcgtaatgatcgaagtgccggctgcggtctatcagacccgcgacctggcgcggcaggtagacttcctctcggtgggttcgaacgacctgacccaatacctgctggcggtcgaccgcaacaacccgcgtgtggccgatctctacgattacctgcacccggcggtgcttcaggcgctgcaaagcgtggtgcgtgatgcccacgccgaaggcaagccggtgagcatctgcggcgaaatggcgggtgacccggcagcagcggtactgttgatggcgatgggtttcgacagcctgtcgatgaacgccaccaacctgccgaaagtgaaatggatgttgcgccagatcaacctcagcaaggccaaggaactgctggcgcaactgatgaccaacgacaacccgcaagtcatcagcagctccctgcagctggcactgaaaaacctcggcctgtcgcggatgatcaaccccagctcggtcaaagggcactaa

SEQ ID NO: 796 - DNA, 2271 bp, Saccharophagus degradans 2-40
atgctgaatgatttgcgtagtatcgttcaagaggtatatgccgctacagatctaagctcggtattagagattattgttcgccgagttaaatcagccatgaacaccgaagtgtgttcggtatacctacgcaacgaaactggcgcttacactttaatggctaccgatggcttaaatcgcgaagcggtaggccgcgttacactggctaaaaacgaaggtttggtggggttggttgccgcgcgcgaagagcctataaacctagacgacgccgaatctcaccccaaatatcaatactttgccgaaaccggcgaagagcgcttttctgcatttttaggcaccccaattattcaccagcgtcaggttatgggggtgctggtagtgcagcaggcggctaagcgtcgctttgatgaaggcgaagaagcatttcttattaccatgtctgcccagcttgccggtgtgattgcacatgccgaggctacaggtaccttgcgggcaatggggtctaaatctgcggtgcgttttaacggcgtgccgggggcctcgggtgtggctattggcgaatgtgtggtggtatcgccggttgccgacctaaatgccgtgccttatgccacctgtgacaacatagaagaagagctggccttttttagccgcagtttggcggcggtgcgcgaagacgtaaagcgcttggggcagtccttagaaaacctgttaaacaaagaagagcgggtattgtttgatgcttacctaggtatgctcgacgatacatcgctggcccgcgaggtaaccgaaaaaattagtatgggtttggctgcgccttacgcgtggagcgaggtgattttagatcacgttaaaaccttctctgccatgcccgatgcctacctgcgcgagcgtgcatccgatgtgcgagacttgggcagtcgcgtattagcctacctgcaagaaaccacgcaaaaagaattggtataccccgaaaaaactatattggtgggtgaagatctcacgccatcaatgcttgccgaagtgccggtggggcagctggcgggtttagtgtctgtgcgcggttcgagcaactcccacattgccattttggcgcggtcgatgggtattcccaccattatgggggcggtcgatctgccgtttaccaagcttaatggcagagaaatggtagtcgatggctaccgcgggtcggtctatatcgacccaggcgaagcgttgttgcaaagctatcaagccatattggaagaagatttacagctggttgctggcctgcagtctataaaaaacctgccctgcgaaacctcagaccaccaccgcgttgccctttgggtaaacactggtctattggccgataccatgctttctatcgagcgcggcgccgaaggggtggggttgtatcgcaccgaagtgccttttatgttgcgcgatcgctttcccagtgaggaagagcagcgcttggtgtaccgcgagcagctagaagcgtttgcgccgcacccagtaaccatgcgtacactcgatgtgggcggtgataaatctttaccctacttccctatcgaagaggaaaaccctttcttggggtggcgcggtattcgcgtaaccctcgatcacccagagatttttctaggccaagtgcgcgccatgcttaaagcgagtgtggggttagataacctgcgcattatgctgccaatgattaccaatattgccgaagtcgaaatagcccaaatgcttattcatcgcgcctacgatgaattactagaagagggctacgatgtgcaaatgccgcccttgggggtgatgatcgaagtgcctgctgcggtgtatcaagcaaaagagttggcggcgcgcgtagattttatttctgtgggcagtaacgatttgacgcaatacttgctggccgtagaccgcaacaaccctcgcgtcgccgatttgtatcattcactgcacccggcggtgctgcgcgctttgcgcaaaattgtaaaagatgcccacagccaaggtgtgccggtaagtatttgtggtgagttggccggcgagcctgccgcagcccttttgttggtggcaatggggtatgatgtgctctcgatgaacgccaccaacctgcttaaggttaaatcggttgtgcgggctgtaacgctcgagcaagcggaaaccctattggcagaggtgatgtcgctgcctgatgccgagtcgattaaccgctgcctagaggctgcattccgccatgcggggctcaatcgcatgttgcgcccagaccttggcgatgacgccaacatctag

SEQ ID NO: 797 - DNA, 2247 bp, Serratia proteamaculans 568
atgctcacgcgcttgcgagaaattgttgagaaggtggccgcggcggccagtctgacagatgcgctggatcttttggtcaatgaaacctgtctggcaatggatacagaagtctgttccatctacctggcggacaacgaccgccgctgctattacctgatggcgacacgcgggttaaaaaaaccgcgtgggcgcgctatcgcactggcatttgatgaaggtattgtcggattggtcggacgccgtgcggagccgattaacctggcagacgcgcagagccaccccagcttcaaatacattccccaggtgaaagaggatcgtttccgatccttcctcggcgtgccgatcattcatcgccgtcagttgctgggggtattggtggtgcagcagcgtgaactgcgccagtttgacgaaagcgaagaatccttcatggtgaccctggccacgcaaatggccgggatcctctcgcagtcacagcttaacgccatttttggtcaatatcgtcagacgcgtattcgtgcactggcggcatcgccgggcgtcgcggtagctgaaggctggcaggacagcagccagccgtctctcgaccaggtttacaaagcctcgacgctcgataccgccagcgaacgtgaacgcctgactcaggcactcgaagaggccggcgcggaattccgccgtttcagcaagcgctttgccgccagctcgcaaaaagagagcgcggcgatcttcgatctttactctcacctgctcaacgacgctcgcctcaagcgcgaactctttgccgagattgatgccggttccgtggcggaatgggcggttaaacaggtgatcgaagtctttgccgcccagtttgccagcctgcaagacacctatatgcgtgagcgtgccagcgatctgcgcgcgctcggccagcgtctgctattccatctcgatgacaccacccagggcgctacccagtggccggcgcgttttgtgctggtagccgatgagctgaccgcgactctgctggctgaaatgccgcaggacaggctggtcggcgtggtggtgcgcgacggtgccgccaactcccatgcagccatattggtgcgggcgatgggcgtaccgacggtgatgggcgcggatattcagcctgcgctgctcagccagcgactgctgattgtcgatggttatcgcggcgaacttttggtcgaccccgaaccggtgctggtgcaggaataccaacggctgatcagcgaagagctggaattaagccggttggcggaagatgacgttgagcaaccggcccagcttaaaagcggtgagcgagttcaggtgatgcttaatgccggcctcagcccggaacatgaaaagctgcttggcgggcgggttgacggtgtgggtctgtaccgtaccgaaattccctttatgctacagagcggcttcccttccgaagaggagcaggttgcccagtatcagggcatgttgcagatgtacccgaataagccagtgacgctacgtacgctggatatcggtgccgataaacaactgccttatatgccgatcagcgaagaaaacccgtgcctgggctggcgtggtatccgaattaccctggatcaaccggagatcttcctgatccaggtgcgagccatgctgcgcgccaatgccggtaccggcaatctgggcatactgctgccgatgatcaccagcctggaagagatcgacgaggctcgcaggttgatcgaccgggcagggcgggaagtggaagaggtgctggggtatgaaatcccaaaacccaaattgggcatcatgctggaagtcccttcgatgatcttcatgatcccgcatctggccgggcgtattgagtttatttcggtggggaccaacgacctgacccaatacctgctggcggtggatcgcaacaatacccgggtggcctcactgtacgacagcctgcatccttccatgttgcaggtgctgaagctgatagccgttcaggccagggccgtcgggctgcaggtcagcctgtgtggtgaactggccggcgacccaatgggggcgctgctgctggtggggatgggctaccgcaacctgagcatgaacggccgcagcgtggcgcggataaaatatctgctgcgacacattgagttatccgacgccgaagtgctggcccagcgggtgcttaacgcccaaatgaccaccgaagtgcgccatcaggtggcggcatttatggaacgtcgtggtatgggcggtttgatccgcggcggcaagtaa

SEQ ID NO: 798 - DNA, 2280 bp, Coxiella burnetii RSA 331
atgaatatgctgaaaatccttcgccaaatcacgcaagaagttaacgctgctcccaatttagagcaagcgcttaagctagtggttgttcgcttgtgcgaagcgttgccggccgatgcctgtagtctttttatttgcgatgacgtgcacggtgaatatgtattaatggcaacccaaggattaaacagcaaacaagtgggcaaactacgccttaaattcggtgaaggattaattggattggtgggtgagcgcgaggagccgatcaacctcgctgatgcaccccttcatcctgcctataaacaccgtcccgaattgggggaagaagactatcacggctttttagggattcctatcatcgagcaaggtgaattgttgggaatattggtgatccaacagttagagagccaccattttgcggaagaggaagaggctttttgcgtaaccttagctattcatttagcggctgaaattgcccatgcgcgagccaaaggcgcgctggaaaaattgggagcgcgaaagcgtcggcgtaggaaaacggaaactgttttatacggtgtgcccggttcgtcaggagtcgcgatcggcacagccatgattgtttatccgccggcggatttagacgctgtgcccgatcaagaaattaccgatattgaagctgaagtttctgattttgaagcggcgctggctgcggcgcgtgatgaaattcaaacgttacaagcgcgcgcaaaaaactccttaagcgttgccgaaaatgcgctctttgatgcttatcttcgtctcttggatagtcgcacttttattaacgaagtgatccatgaaattaaagaaggacaatgggctcagggcgcattaaaacgcattatcaaaaaacatgtattgcattttgaatcgttggaagacccttatttgcgtgagcgggcagcggattttcgcgatttaggccgacgtatcctcgctcatttgcagtttagcgagcaagaagaattagagtatcctaaaaacactattttagtgagtgaagaagtgactgccacgtcactcattgaagtgccccaggatcgtttacgcggtgtgatatctggaactggatcaagcaactcacacgtggcaattctagcgcgcgcattagggttgccggccgtgatgggtgttcgcggtacacccctttttaaactgggcgagcaagaaattattgttgacgggtataacgggcaaatttatttgtcgccctcagcggagattaaaaaagaatttaaagcgctagccgaagaagaacaacaattagatgaagaattacaagcgttgcgtgaattaccggctgaaacaaaggatggacacgcgctggcgctctatgtgaatacgggacttgccattgagggaggtttgtcattaagcgtgggcgccgaaggcgttggcttatatcgaacggaaatgccctttatgatccgggatcgatttcccagtgaagaagagcaacgcattatgtatcggcaattattaaatactttcgcaccgcgacccgttattatgcgcacgctcgatatcggtggcgataaaacgcttccttatttttcagtggaggaggacaacccttttttgggatggcggggtattcgagtgactttggatcaccccgaaatttttttacaacaagtgcgcgcgatgttgcacgccagtgaagggctgaataatttatcggtattattaccgatgatcacctcaattaatgaagtggaaacagccacccgcatgattaatcaagcgcgcgatgaattaattgaagaaggtatcaatgtggagctaccttccgtgggattgatgattgaagtgccggcgactgtgtatcaggcttttgaattagcaaagcgtgtggattttctatcggttggcagtaatgatttgattcaatatttattagcggtcgatcgaaataatcctcgggtggccaacctttatgacggattgcatccggccgttttacaagctttaaaaatcgtggtgaaagccggccaccgcgcggggaaacctgtaagtatctgcggtgaaatggccggcgatccgttagcggttattcttttgttagcgatggggtttgacacattaagtatgaacgcccgaatactgccgcgtgttaaatgggtgattcgtaattttgagatggcacacgctaaagaattgttggatgaagcgttaaaaatggatgacccgaaagacatccgcttactgatggagcatacgctggaagaagctggtttaggcggtttaattcgcgccggacggtaa

SEQ ID NO: 799 - DNA, 2241 bp, Yersinia pestis Angola
atgcgtttgcgagaagtagttgagaaagtggcgatggcaaccggcctgacggaggcgttagagctgttggtcaatgaaacctgtctggcgatggacacggaagtctgttcgatttatctggcagacaatgaccgccgttgttactacctaatggcgaccagggggctgaaaaagccccgtgggcgtactatcacgctggcttttgacgaggggatcgttgggctggtggggcgtttggccgagccaattaacctggctgatgctcaaagccatcccagttttaaatatgtcccgcaagtcaaagaggaacgctatcgggcgtttctcggggtgcccattatctaccgccgccagttgcttggtgtgctggtggttaaacagcgtgagcaccgtcagtttgatgagagcgaagagtcgttcatggtcacgctggcaacacagttggcgggcatcctttctcaatctcagctaaatgccatttttggtcagtatcgccaaacacggatccgtgcattggcggcggctcctggtgtcgcggtggcagaaggctggcaagatatctcacagccttcgcttgatctggtctatgaggcctcaacgcttgatagcacccttgaacgtgaacgtctgactcaggccttggaagaggctgcggctgagtttcgtcgcttcagtaagcgctttgccgccagttcacaaaaagagagtgcggcaattttcgatctctactcccacttgctaaatgatgctcgcttaaagcgtgagctatttgcgcaaattgatgcaggcgcggtggctgagtgggcggttaaacaggtggttgaggcgtttgctgcccagtttgccagtctgcaagatacctatatgcgcgagcgtgctagtgacctgcgggcattaggccaacgcttgttgttccatcttgatgacagtacctctggagccagccagtggcctgagcgctttatcctggttgctgatgaacttactgcgacattgctcgccgaggtgccacaggaccgcttggcgggggttgtggtgcgtgatggtgccgccaactctcatgcggctattttggtccgggcaatgggcatcccgacagtgatgggggcggatatccagcctgcattactcagccagcggctgctgattgttgatggttatcgtggcgaagtattagttgatcctgaaccggtactggtcaaagagtaccaacggctggtcaccgaagagattgaactcagtaagctggctgaagatgatgttgagcaacctgcggccctgaaaagtggtgaacggatccaggtgatgctaaacgcgggccttagcccagagcacgaacagttactggggggcagggtagatggtgtaggcctgtaccgcacagaaataccgtttatgttgcaaagtggtttcccgtcggaagaagagcaagttgcgcaataccaaggcatgttacagctttatccacaaaagcccgtgaccttgcgtaccttggatatcggtgcggataagcagctcccctacatgcctatcagcgaggagaacccttgtctgggctggcgcggcattcgtatcaccctggatcaacccgaaatctttttgattcaggtaagagcaatgctcagagctaatgccgggaccggtaatttaggtattttattgccgatgatcaccagtatcgaagaggttgatgaagcgaaacgtttgattgaccgtgcgggtcgcgaagtagaggaaatgctcggttatgtgctgccacaacctcggttgggggtgatgattgaagttccatccatgattttcatgctgccttacttgacgtctcgggtggattttatctcggttggtaccaatgatctgacgcaatatttactggccgttgatcgcaacaatacccgggtggcttcgttgtacgacagcctccacccagcgatgttacaagtgcttcgccaaattctgatgcaggcaacagagtcaggcctgcaagtcagtctctgtggtgaaatggccggtgatccgatgggggcgttactgctggttgggctgggttaccgtaatctcagtatgaacggccgcagtgtggcacgcatcaaatacctgttacgtaatatagaattggccgatgcacaagtgctggcggcacgggtattaaccgcgcagatgaccaccgatgtgcgtcacctaaccgctgcatttatggagcgccgtggtttaggtgggctgattcggggtgggaagtag

SEQ ID NO: 800 - DNA, 2247 bp, Yersinia pseudotuberculosis YPIII
atgctcatgcgtttgcgagaagtagttgagaaagtggcgatggcaaccggcctgacggaggcgttagagctgttggtcaatgaaacctgtctggcgatggacacggaagtctgttcgatttatctggcagacaatgaccgccgttgttactacctaatggcgaccagggggctgaaaaagccccgtgggcgtactattacgctggcttttgacgaggggatcgttgggttggtaggccgtttggcggagccaattaacctggctgatgctcaaagccatcccagttttaaatatgtcccgcaagtcaaagaggaacgctatcgggcgtttctcggagtgcccattatctaccgccgccagttgcttggtgtgctggtggttcaacagcgtgagcaccgtcagtttgatgagagcgaagagtcgttcatggtcacgctggcaacacagttggcgggcatcctttctcaatctcagctaaatgccatttttggtcagtatcgccaaacacggatccgtgcattggcggcggctcctggtgtcgcggtggcagaaggctggcaagatatctcacagccttcgcttgatctggtctatgaggcctcaacgcttgatagcacccttgaacgtgaacgtctgactcaggccttggaagaggctgcggctgagtttcgtcgcttcagtaagcgctttgccgccagttcacaaaaagagagtgcggcaattttcgatctctactcccacttgctaaatgatgctcgcttaaagcgtgagctatttgcgcaaattgatgcaggcgcggtggctgagtgggcggttaaacaggtggttgaggcgtttgctgcccagtttgccagtctgcaagatacctatatgcgcgagcgtgctagtgacctgcgggcattaggccaacgcttgttgttccatcttgatgacagtacctctggagccagccagtggcctgagcgctttatcctggttgctgatgaacttactgcgacattgctcgccgaggtgccacaggaccgcttggcgggggttgtggtgcgtgatggtgccgccaactctcatgcggctattttggtccgggcaatgggtatcccgacagtgatgggggcggatatccagcctgcattactcagccagcggctgctgattgttgatggttatcgtggcgaagtattagttgatcctgaaccggtactggtcaaagagtaccaacggctggtcaccgaagagattgaactcagtaaactggctgaagatgatgttgagcaacctgcggccctaaaaagtggtgagcggatccaggtgatgctaaacgcgggccttagtccagaacatgaacaattactgggagggagggttgatggtgtaggcctgtaccgcacagaaataccgtttatgttgcaaagtggtttcccgtcggaagaagagcaagttgcgcaataccaaggcatgttacagctttatccacaaaagcccgtgaccttgcgtaccttggatatcggtgcggataagcagctcccctacatgcctatcagcgaggagaacccttgtctgggctggcgcggcattcgtatcaccctggatcaacccgaaatctttttgattcaggtaagagcaatgctcagagctaatgccgggaccggtaatttaggtattttattgccgatgatcaccagtatcgaagaggttgatgaagcgaaacgtttgattgaccgtgcgggtcgcgaagtagaggaaatgctcggttatgtgctgccacaacctcggttgggggtgatgattgaagttccatccatgattttcatgctgccttacttgacgtctcgggtggattttatctcggttggcaccaatgatctgacgcaatatttactggccgttgatcgcaacaatacccgggtggcttcgttgtacgacagcctccacccagcgatgttacaagtgcttcgccaaattctgatgcaggcaacagagtctggcctgcaagtcagtctttgtggtgaaatggccggtgatccgatgggggcgttactgctggttgggctgggttaccgtaatctcagtatgaacggccgcagtgtggcacgcatcaaatacctgttacgtaatatagaattggccgatgcacaagcgctggcggcacgggtattaaccgcgcagatgaccaccgatgtgcgccacctaaccgctgcatttatggagcgccgtggtttaggtgggctgattcggggtgggaagtag

SEQ ID NO: 801 - DNA, 2247 bp, Salmonella enterica serovar Heidelberg SL476
atgctcactcgcctgcgcgaaatagtcgaaaaagtggccagtgcgccgcgtctgaacgaggcgctgaatattctggtcacggatatctgtcttgcgatggatacagaggtttgctcggtttacctggccgatcatgaccgacgctgttattacctgatggcgacgcgggggttgaaaaaaccgcgtggtcgaaccgttgcgcttgcgtttgatgaggggatcgtcggtctggtgggcagactggcggaacccattaaccttgccgatgcgcaaaaacatcccagctttaaatacattccttcggtaaaagaggagcgttttcgcgcgtttctcggtgtgccgatcattcagcgtcgccaacttctcggcgtgctggtcgtacagcagcgcgaattgcgccagtacgatgaaagcgaagagtctttcctcgtcacgctcgctacgcaaatggcggctatcctgtcacagtcgcaggtcacagcgctgttcgggcaataccggcagacgcgaattcgtgcgcttcctgcgtcgccgggcgtggctatcgcaacgggctggcaagacgcgaccatgccgctgatggaacaggtttacgaagcgtctacgctggatacctctcttgaacgcgaacgactgaccggcgcgctggaagaggcggcgaacgaattccgacgatacagcaaacgctttgccgccggcgcgcaaaaagagacggcggccattttcgatctgtactcacacctgctttcagacgccagactgcgtcgcgaactcttcgccgaggtcgacaaaggcgctgttgcggagtgggccgttaaaaaaatcatcgaaaaatttgccgagcaatttgcggcgctaaccgataactacctcaaagaacgtgcgggagacttacgcacgctggggcagcggctgttattccatcttgatgattcagttcaggggccaaacgcctggccggaacgttttattctggtcgcggatgagctgtcggcgaccaccctggcggagctgccgcaggacaggctggcgggcgttgtggtgcgcgacggcgcggcaaactcgcatgcggcgattatggtgcgcgcgctcggtatcccgaccgtcatgggcgctgatatccagccttcggtgctacatcgccgtacgttggtggtggatggctatcgcggtgaattactggtcgatcctgaacccgtgcttattcaggaatatcagcggctcattagtgaagagatagaactcagtcgtctggcggaggacgacgtcaatcttcccgcccaactgaaaagcggcgagcgagtcaaagtgatgctgaatgccgggctcagtcccgagcatgaggaaaagttaggcagtcggatcgacggtatcggcctgtaccgtactgaaattccctttatgctgcaaagcgggtttccctcggaagaagagcaggtggcgcagtatcaagggatgctgcaaatgtttaacgataaaccggtgacgctgcggaccctggatgtgggagcggataagcaactgccctatatgccgatcagcgaggagaacccgtgtctgggctggcgcgggatccgcattacgctggatcagccggagatctttttgatccaggtccgcgcgatgctgcgcgccaatgcggcgactggcaacctcagcattttgttgccgatggtcaccagtattgatgaagtcgatgaagcgcgacgtctgatcgaacgcgccgggcgcgaggtcgaggagatgatcggctatgcgatcccgaaaccgcgtatcggcattatgctggaagtaccatcaatggtatttatgctgccgcatctggctaaccggatcgactttatctcggtcggcaccaacgatttaacgcaatatatcctggcggtagatcgcaacaatacccgcgtggccagtatttatgacagtctgcatccggctatgctgcgcgcactgagcatgattgcgcaggaagccgaaaaaaatggcctcgatcttcgcttgtgcggcgagatggcgggcgatccgatgtgcgtggcgattcttatcggtctgggatatcgccatctttcgatgaatggccgttcggtagcgcgtgtgaaatatctgctgcggcatatcgattttgaagacgcgcaaacccttgccagacgcagccttgaggcgcagatggcgaccgaagtgcgtcatcaggtggcggcgtttatggagcgccgcgggatggggggattgattcgcggagggttgtaa

SEQ ID NO: 802 - DNA, 2247 bp, Salmonella enterica serovar Schwarzengrund CVM19633
atgctcactcgcctgcgcgaaatagtcgaaaaagtggccagtgcgccgcgtctgaacgaggcgctgaatattctggtcacggatatctgtcttgcgatggatacagaggtttgctcggtttacctggccgatcatgaccgacgctgttattacctgatggcgacgcgggggttgaaaaaaccgcgtggtcgaaccgttgcgcttgcgtttgatgaggggatcgtcggtctggtgggcaggctggcggaacccattaaccttgccgatgcgcaaaaacatcccagctttaaatacattccttcggtaaaagaggaacgttttcgcgcgtttctcggcgtgccgatcattcagcgtcgccaacttctcggcgtgctggtcgtacagcagcgcgaattgcgccagtacgatgaaagcgaagagtctttcctcgtcacgctcgctacgcagatggcggctatcctgtcacagtcgcaggtcacagcgctgttcgggcaataccggcagacgcgaatccgcgcgcttcctgcggcgccgggcgtggctatcgcaacgggctggcaagacgcgaccatgccgctgatggaacaggtttacgaagcgtctacgctggatacctctcttgaacgcgaacgactgaccggcgcgctggaagaggcggcgaacgaattccgacgatacagcaaacgctttgccgccggcgcgcaaaaagagacggcggccattttcgatctgtactcacacctgctttcagatgccagactgcgtcgcgaactcttcgccgaggtcgacaaaggcgctgttgcggagtgggccgttaaaaaaatcatcgaaaaatttgccgagcaatttgcggcgctaaccgataactacctcaaagaacgtgcgggagacttacgcacgctggggcagcggctgttattccaccttgatgattcagttcaggggccaaacgcttggccggaacgttttattctggtcgcggatgagctgtcggcgaccaccctggcggagctgccgcaggacaggctggcgggcgttgtagtgcgcgacggcgcggcaaactcgcatgcggcgattatggtgcgcgcgctcggtatcccgaccgtcatgggcgcggatatccaaccttcggtgctacatcgccgtacgttggtggtggatggctatcgcggtgaattactggtcgatcctgaacccgtgcttattcaggaatatcagcggctcattagtgaagagatagaactcagtcgtctggcggaggacgacgtcaatcttcccgcccaactgaaaagcggcgagcgagtcaaagtgatgctgaatgccgggctcagtcccgagcatgaggaaaagttaggcagtcggatcgacggtatcggcctgtaccgtactgaaattccctttatgctgcaaagcgggtttccctcggaagaagagcaggtggcgcagtatcaagggatgctgcaaatgtttaacgataaaccggtgacgctgcggaccctggatgtgggagcggataagcaactgccctatatgccgatcagcgaggagaacccgtgtctgggctggcgcgggatccgcattacgctggatcagccggagatatttttgatccaggtccgcgcgatgctgcgtgccaatgcggcgactggcaacctcagtattttgttgccgatggtcaccagtattgatgaagtcgatgaagcgcggcgtctgatcgaacgcgccgggcgcgaggtcgaggagatgatcggctatgcgatcccgaaaccgcgtatcggcattatgctggaagtaccgtcaatggtatttatgctgccgcatctggctaaccggatcgactttatctcggtcggtaccaacgatttaacacaatatatcctggcggtagatcgcaacaacactcgcgtggccagtatttatgacagtctgcatccggctatgctgcgcgcgctgtccatgattgcacaggaagccgaaaaacatggtctcgatcttcgcttgtgcggcgagatggcgggcgatccgatgtgcgtggcgattcttatcggtctgggatatcgccatctttcgatgaatggccgttcggtagcgcgtgtgaaatatctgctgcggcatatcgattttgaagacgcgcaaacccttgccagacgcagccttgaggcgcagatggcgaccgaggtgcgtcatcaggtggcggcgtttatggagcgccgcgggatggggggattgattcgcggagggttgtaa

SEQ ID NO: 803 - DNA, 2247 bp, Salmonella enterica serovar Agona SL483
atgctcactcgcctgcgcgaaatagttgaaaaagtggccagtgcgccgcgtctgaacgaggcgctgaatattctggtcacggatatctgtcttgcgatggatacagaggtttgctcggtttacctggccgatcatgaccgacgctgttattacctgatggcgacgcgggggttgaaaaaaccgcgtggtcgaaccgttgcgcttgcgtttgatgaggggatcgtcggtctggtgggcagactggcggaacccattaaccttgccgatgcgcaaaaacatcccagctttaaatacattccttcggtaaaagaggagcgttttcgcgcgtttctcggcgtgccgatcattcagcgtcgccaacttctcggcgtgctggtcgtacagcagcgcgaattgcgccagtacgatgaaagcgaagagtctttcctcgtcacgctcgctacgcagatggcggctatcctgtcacagtcgcaggtcacagcgctgttcgggcaataccggcagacgcgaatccgcgcgcttcctgcggcgccgggcgtggctatcgcaacgggctggcaagacgcgaccatgccgctgatggaacaggtttacgaagcgtctacgctggatacctctcttgaacgcgaacgattgaccggcgcgctggaagaggcggcgaacgagttccgacgatacagcaaacgctttgccgctggcgcgcaaaaagagacggcggccattttcgatctgtactcacacctgctttcagacgccagactgcgtcgcgaactcttcgccgaggtcgacaaaggcgctgttgcggagtgggccgttaaaaaaatcatcgaaaaatttgccgagcaatttgcggcgctaaccgataactacctcaaagaacgtgcgggagacttacgcacgctggggcagcggttgttattccaccttgatgattcagttcaggggccaaacgcctggccggaacgttttattctggtcgcggatgagctgtcggcgaccaccctggcggagctgccgcaggacaggctggcgggcgttgtggtgcgcgacggcgcggcaaactcgcatgcggcgattatggtgcgcgcgctcggtatcccgaccgtcatgggcgcggatatccaaccttcggtgctacatcgccgtacgttggtggtggatggctatcgcggtgaattactggtcgatcctgaacccgtgcttattcaggaatatcagcggctcattagtgaagagatagaactcagtcgtctggcggaggacgacgtcaatcttcccgcccaactgaaaagcggcgagcgagtcaaagtgatgctgaatgccgggctcagtcccgagcatgaggaaaagttaggcagtcggatcgacggtatcggcctgtaccgtactgaaattccctttatgctgcaaagcgggtttccctcggaagaagagcaggtggcgcagtatcaagggatgctgcaaatgtttaacgataaaccggtgacgctgcggaccctggatgtgggagcggataagcaactgccctatatgccgatcagcgaggagaacccgtgtctgggctggcgcgggatccgcattacgctggatcagccggagatctttttgatccaggtccgcgcgatgctgcgcgccaatgcggcgactggcaacctcagcattttgctgccgatggtcaccagtattgatgaagtcgatgaagcgcggcgtctgatcgaacgcgccgggcgcgaggtcgaggagatgatcggctatgcgatcccgaaaccgcgtatcggcattatgctggaagtgccatcaatggtatttatgctgccgcatctggctaaccggatcgactttatctcggtcggcaccaacgatttaacgcaatatatcctggcggtagatcgcaacaatacccgcgtggccagtatttacgacagtctgcatccggctatgctgcgcgcactgagcatgattgcgcaggaagccgaaaaaaatggcctcgatcttcgcttgtgcggcgagatggcgggcgatccgatgtgcgtggcgattcttatcggtctgggatatcgccatctttcgatgaatggccgttcggtagcgcgtgtgaaatatctgctgcggcatatcgattttgaagacgcgcaaactcttgccagacgcagccttgaggcgcagatggcgaccgaagtgcgtcatcaggtggcggcgtttatggagcgccgcgggatggggggattgattcgaggagggttgtaa

SEQ ID NO: 804 - DNA, 2247 bp, Salmonella enterica serovar Dublin CT 02021853
atgctcactcgcctgcgcgaaatagtcgaaaaagtggccagtgcgccgcgtctgaacgaggcgctgaatattctggtcacggatatctgtcttgcgatggatactgaggtttgctcggtttacctggccgatcatgaccgacgctgttattacctgatggcgacgcgggggttgaaaaaaccgcgtggtcgaaccgttgcgcttgcgtttgatgaggggatcgtcggtctggtgggcagactggcggaacccattaaccttgccgatgcgcaaaaacatcccagctttaaatacattccttcggtaaaagaggagcgttttcgcgcgtttctcggcgtgccgatcattcagcgtcgccaacttctcggcgtgctggtcgtacagcagcgcgaattgcgccagtacgatgaaagcgaagagtctttccttgtcacgctcgctacgcagatggcggctatcctgtcacagtcgcaggtcacagcgctgttcgggcaataccggcagacgcgaatccgcgcgcttcctgcggcgccgggcgtggctatcgcaacgggctggcaagacgcgaccatgccgctgatggaacaggtttacgaagcgtctacgctggatacctctcttgaacgtgaacgactgaccggcgcgctggaagaggcggcgaacgaattccgacgatacagcaaacgctttgccgccggcgcgcaaaaagagacggcggccatttttgatctgtactcacacctgctttcagacgccagactgcgtcgcgaactcttcgccgaggtcgacaaaggcgctgttgcggagtgggccgttaaaaaaatcatcgaaaaatttgccgagcaatttgcggcgctaaccgataactacctcaaagaacgtgcgggagacttacgcacgctggggcagcggctgttattccaccttgatgattcagttcaggggccaaacgcctggccggaacgttttattctggtcgcggatgagctgtcggcgaccaccctggcggagctgccgcaggacaggctggcgggcgttgtggtgcgcgacggcgcggcaaactcgcatgcggcgattatggtgcgcgcgctcggtatcccgaccgtcatgggtgcggatatccagccttcggtgctacatcgccgtacgttggtggtggatggctatcgcggtgaattactggtcgatcctgaacccgtacttattcaggaatatcagcggctcattagtgaagagatagaactcagtcgtctggcggaggacgacgtcaatcttcccgcccaactgaaaagcggcgagcgtatcaaagtgatgctgaatgccgggctcagtcccgagcatgaggaaaagttaggcagtcggatcgacggtatcggcctgtaccgtactgaaattccctttatgctgcaaagcgggtttccctcggaagaagagcaggtggcgcagtatcaagggatgctgcaaatgtttaacgataaaccggtgacgctgcggaccctggatgtgggagcggataagcaactgccctatatgccgatcagcgaggagaacccgtgtctgggctggcgcgggatccgcattacgctggatcagccggagatctttttgatccaggtccgcgcgatgctgcgcgccaatgcggcgactggcaacctcagcattttgttgccgatggtcaccagtattgatgaagtcgatgaagcgcggcgtctgatcgaacgcgccgggcgcgaggtcgaggagatgatcggctatgcgatcccgaaaccgcgtatcggcattatgctggaagtaccgtcaatggtatttatgctgccgcatctggctaaccggatcgactttatctcggtcggcaccaacgatttaacgcaatatatcctggcggtagatcgcaacaatacccgcgtggccagtatttacgacagtctgcatccggctatgctgcgcgcactgagcatgattgcgcaggaagccgaaaaaaatggcctcgatcttcgcttgtgcggcgagatggcgggcgatccgatgtgcgtggcgattcttatcggtctgggatatcgccatctttcgatgaatggccgttcggtagcgcgtgtgaaatatctgctgcggcatatcgattttgaagacgcgcaaacccttgccagacgcagccttgaggcgcagatggcgaccgaggtgcgtcatcaggtggcggcgtttatggagcgccgcgggatggggggattgattcgcggagggttgtaa

SEQ ID NO: 805 - DNA, 2247 bp, Dickeya dadantii Ech703
atgctcacgcgactgcgagaaatcattgaaaaggttgcggcaacagccaggctgagcgatgcgctggagattctggtgaacgagatttgcctggcgatggatacggaagtctgttccatctatctggcggatcatgatcgtcagtgttattacctgatggcgacgcgcgggctgaagaaaccgcgcggacgcaccattaccctggcgtttggccaggggatcgtggggctggtgggggaacgcgctgagcccatcaatctagcggatgctcaacgtcatcccagtttcaagttcattcctgccgtgcgcgagcagcatttccgttcatttctcggcgtgccgattatccaccgacgccagttgttgggcgtgctggtggtgcaacagcgtgagcaccgtcagttcgataaaaacgaagaatccttcatggtgacgctggcgacccagatggccgccaccctgtcgcaatcacagatgaaagccctgtttgggcaatatcgtcagacgcgcatcaaggcgctgcctgctgcgcccggcgtagcgattgccaccggctggcaggatcgcagtcaaccctctttggaactggtctttcccgcctccagtctggacagcgatcgggaacgagcccggctactggcggcgattggcgaggcgggcgttgaatttcggcgttttagcaagcgtttcagcgccagtgcgcagaaagaaagcgccgctatcttcgatttctacattcatctgttgaatgatgcgcggctgaaacgcgagttgctgcaggagattgataccggcagtgtcgcggaatgggcggtaaaagtcgtgatcgagcggtttgccgcccagttcgccagtttgcaggatacctacctgcgggaacgggccggcgacttgcgggcgttggggcagcggttgcttttccatcttggcgataatgcacaaaatagcgctcaatggccggaacgattcattctggtggctgatgaacttacggctacgctgttggctgaggtgccgcatgatcgtctggccggtgttgtcgcctacgatggcgccgctaattcccatgccgccattatcgtgcgtgccatgggcattcccaccctgatgggggcggatattcagcctgacttgttgcatcagcggttgctgattctggatggttatcgcggcgaactgttggtggatccggaacccgtgctggtgcaagagtatcagcgtttactcagtgaagagaatgagttgacccggctggcggaggacaatgtttcatgcccggcggaactgaaaagcggcgaacgggtcgaggtgatgctgaatgccggtttgagctccgagcatgaaaagcgctttatcaatttggtggatggcgtggggttgtatcgcacggaaatccctttcatgctgcaaaacggctttccttctgaagaagaacaggtcgcccagtatgaggcgatgctgcggctgtatccttcccgtcctgtgatgctgcgcacgctggatatcggcgcggataagcagttgccttatctttccatcagcgaagaaaacccctgcctggggtggcgtggcatccgcgttacgctcgatcagccggagatcttcatgatccaggtgcgggcgatgctgcgcgccaatgctcaggtcggcaatctgagtatcctgttgccgatgatcaactgcatggatgagatagacgaagcccggcggctgatcgaccgtgccgcgcgggaagtcgaagagatgcttggggttccgcagccacggccgcgcatcgggatcatgattgaagtgccttcggtgctgtttatgttgccgcatttggcttcccgcatcgatttcgtctccgtgggaacgaacgacctcacgcagtatttgctggcggtggatcgcaataatccgcatgtggggtctttgtacgacagtttgcatcctgctgttttacaggcgttaaacatggtggtgacgctttgccggcagcatgggctgtcggtatccgtatgcggcgaactggcgggggaacccatgggggctttgctgctgattggcctcggttatcggacgctcagcatgaacggtcgcagcgtggcccgcatcaaatatctgctgcggcgcatcggtcagcatgaggcgcagcaactggcactcaaggtgctgaatgcgcaaactgccagcgaagtgcgtcaatgggtatccatctttattgaggaacgtggtctgggcggtttgatccgcggcggccgctaa

SEQ ID NO: 806 - DNA, 2247 bp, Pectobacterium carotovorum PC1
atgctcacgcgcttgcgagaaattgtcgaaaacgttgcggcaacggcccgccttagtgatgcgctggacattctggtcaatgagacctgtcaggctatggacacggaagtctgttccatttatctggccgatcacgatcgtcaatgctattacctgatggcaacgcgcgggttgaaaaagccgcgcgggcgcacagtaacgctggcgtttgggcaaggtattgtcgggctggtcgggcaacgtgccgagcccatcaatctggccgatgctcgcgctcatcccagtttcaaatatatccccgccgtgaaagagcaacatttccgctcttttcttggtgttcccattatccaccgtcgccatctgctcggcgtactggtggtgcagcagcgtgaacatcgtcagtttgataaaaacgaagagtcgttcatggtgacgctggccacgcagatggccgcgattctttccctttcgcagatcaaaacgctcttcggtcaataccgtcagacgcgcgttaaagcgctggtggccgcccccggtgtggcgattgcccctggctggcaggattgtacccagccttctttggagcaggtttttcccgcgtcgagtctggatagcgagcgtgaacgctctcgcttaacgcaggcgctggaagacgcaacggcggaatttcgccgcttcagcaagcggtttagcgccagtgcgcagaaagagagcgcggcgattttcgatttgtactcgcacttgctgaatgatgcgcgactcaagcgtgaactttttcaggaagtggatgcgggcaatgccgccgagtgggctgtgaagctggtgatcgaacgttttgctgcgcagttcaccaatttgcaggatacctacttgcgtgaacgtgcgggcgatctgcgcgcgctcgggcagcggctgctgtttcatcttgatgataacgcgcaaatcatggggcaatggcctgagcgctttatccttgtggcggatgaactaacggcgacgctgttggcggaactaccgccagagcggctggcgggtgttgtcgtgtatgacggcgccgcgaattcgcatgcggcgattcttgtacgggcgatgggcattccaacgctggtgggcgcggacattcagcctgatttgctgcaccagcgtctgctgatcatcgacggctatcgcggtgagttgctggttgatcctgaaccggtattggtacaggaataccagcgcctgctgacggaagaaaatgagctaacccgtttggccgaaggcgaaatggaacagcctgccgtgttgaaaagcggcgaacgtattcaggtcatgttgaatgcggggttaagtgccgaacacgaaaaacgctttatcaatcaggttgatggcgtgggtctgtaccgtacggaaataccttttatgctgcaaagcggttttccgtccgaagatgaacagatggcgcaatatcaaagtatgttgcagctttatcctacgcgcacggtgatgctgcgcacgctggatatcggcgcggataagccgttgccttatctgccgattagcgaagagaacccgtgtcttggctggcgtggtattcggattacgctcgatcagcctgaaatctttctgattcaggtgcgcgccatgctgcgagctaacgcgcatatcggcaacctcagtattctgctgccgatgatcagcagtctggatgaaatcagtgaagcacgtcgcctgatcgatcaggctgcgggtgaggtcgaagaattactcggcttcccacagcccaaaccgcggattggcatcatgatcgaagtaccgtcgatgctgttcctgcttcctcatctggcttcccgcatcgattttgtttcggttggcaccaacgatctgacgcagtacctgctggcggtagatcgtaataatgcccacgtggcatcgctctatgacagtctgcatcctgccatgttgcaggcgttgaatatgatcgccgtggagtgcgaacggcataacattccgctttccgtgtgcggtgaaatggcgggagaggcgctcggcgcactgctgctgaccggcctgggctatcgctcgctcagtatgaacgggcgcagcgtggcgcgaattaaatatctgctgcgtcaaattacgctggctgagtcgcaggcgttagtgcagcaattgctgggcgcacagagtgcggcggaagtccgccagtgggcggcgatcttcatggaagagcgcggattaggcggcttaattcgcggcgggcgctaa

SEQ ID NO: 807 - DNA, 270 bp, Rhodoferax ferrireducens T118
atgacggaagctaaaaaatccctcaagcgcaccttggttggcaaggtggtcagcgacaagcgtgccaagactgtgactgtgctgattgagcgtcgtgtcaaacacgagctctatggcaagatcgttggtaagtccagcaagtaccacgcccatgacgaaacgggcgagtacaaactgggtgacatcattgagatcacggaaagccgtcccatttctaaaaccaagaactgggtggcaacccgcctggttcaaaaggcggctgtggtttaa

SEQ ID NO: 808 - DNA, 270 bp, Polaromonas JS666
atgacggaagctaaaaaatccctcaagcgcaccttgatcggcaaggtggtcagcgacaagcgcgccaaaaccgtgaccgttctggttgagcgccgcgtcaagcatgagctgtacggcaagatcgtgtccctgtccagcaagtaccacgcccatgacgaaaagggcgagtaccacacgggcgacgtgatcgagatcaccgaaagccgtcctatttccaagaccaaaaactgggttgtgacccgtttggtggagaaggccgctgccgtctaa

SEQ ID NO: 809 - DNA, 270 bp, Acidovorax avenae citrulli AAC00-1
atgacggaagctaaaaaatccctcaagcgcaccttggttggcaaggtggtcagcgacaagcgcgaaaagaccgtgacggtgctcgtcgagcgccgcgtgaagcacccgatctacgacaagatcgtgatcaagtcgagcaagtaccacgcgcacgacgagaacagcgagtacaagctgggcgacacgatcgagatcacggaaagccgcccgctctccaagaccaagaactgggttgcgacccgcctggtccagaaggctgccctggtctga

SEQ ID NO: 810 - DNA, 270 bp, Acidovorax sp. JS42
atgacggaagctaaaaaatccctcaagcgcaccttggttggcaaggtggtcagcgacaagcgcgccaagaccgtgaccgtgctggtcgagcgccgtgtgaagcaccccatctacgacaagatcatgatcaagtcgagcaagtaccacgcccatgatgagaatggcgagtacaagatgggcgacaccatcgagatcacggagagccgtccgctctccaagaccaagaactgggtggccacacgcctggtgcaaaaggccgggctgctctaa

SEQ ID NO: 811 - DNA, 270 bp, Polaromonas naphthalenivorans CJ2
atgacggaagctaaaaaatccctcaagcgcaccttgattggcaaggtggtcagcgacaagcgcgccaagaccgtcacggttctggtcgaacgccgcgtgaagcacgagctgtacggcaagatcgtgtccctgtccagcaagtaccacgcccatgacgaaaagggcgagttcaagacaggcgacgtgatcgagatcaccgaaagccgtcctatctccaagaccaagaactgggttgtgacccgcttggtgcaaaaggctgaaatcgtttaa

SEQ ID NO: 812 - DNA, 270 bp, Verminephrobacter eiseniae EF01-2
atgacggaagcccaaaaatccctcaagcgcaccctgatcggcaaggtggtcagtgacaagcggcaaaagaccgtgaccgtgctggtcgagcgccgtgtcaagcacgagctctacggcaagatcattgcccgttcgagcaagtaccacgcccatgacgaaaagggcgaatacaagctgggcgacatgatagaaatcaccgagagccgtccgctgtccaaaaccaagaactgggtggccagccgcctggtgcaaaaggccggcctgctgtaa

SEQ ID NO: 813 - DNA, 273 bp, Methylibium petroleiphilum PM1
atgacgactcaagagaccgtcaagaacacgcgcaccctcgtcggccgcgtggtcagtgaccagcgttccaagacgatcaccgtgctggtcgagcgtcgcgtcaagcacgagctctacggcaagatcgtggcgcgttcgcgcaagtaccacgcgcatgacgagaacaacgaatacaagctcggcgatctggtcgagatcgccgaaggccggccgatctccaagaccaaggcctgggtcgtgacccgactggtcgagaaggcccgcgtggtctga

SEQ ID NO: 814 - DNA, 270 bp, Delftia acidovorans SPH-1
atgacggaagctaaaaaatccctcaagcgcaccttgattggcaaggtggtcagcgacaagcgtgccaagaccgtgacggtcatggttgaacgccgcgtcaagcacccgatctatgacaagatcatgatcaagtccagcaagtaccacgctcacgacgagcaaggtgaatacaagctgggcgacgtggttgaaatcacggaaagccgcccgctgtccaagaccaagaactgggttgctacccgcttggtgcaaaaggctgctctggtgtaa

SEQ ID NO: 815 - DNA, 297 bp, Leptothrix cholodnii SP 6
atgagcgaagcccaaaccgcagttgcggctgccgcgcctgctgtcaagaacacccgtaccctcgtcggcaaggtggtgagcgacaagcgcgccaagaccgtcacggtgctggtcgagcgtcgcgccaagcacgagctgtacggcaagatcgttgcccgctcgcgcaagtaccacgcgcacgacgaaaacggcgactacaagatgggcgacgtggtcgagatctccgagagccgtccgctttcgaagaccaagaactgggtcgtcacgcgtctggtcgaaaaggcccgcgcggtctga

SEQ ID NO: 816 - DNA, 270 bp, Diaphorobacter TPSY uid29975
atgacggaagctaaaaaatccctcaagcgcaccttggttggcaaggtggtcagcgacaagcgcgccaagaccgtgaccgtgctggtcgagcgccgtgtaaagcaccccatctatgacaagatcatgatcaagtcgagcaagtaccacgcccatgatgagaatggcgagtacaagatgggcgacaccatcgagatcacggagagccgtccgctctctaagaccaagaactgggtggccacgcgcctggtgcaaaaggccgggctgctctaa

SEQ ID NO: 817 - DNA, 270 bp, Variovorax paradoxus S110
atgacggaagctaaaaaatccctcaagcgcaccttgatcggcaaggtggtcagcgacaagcgtgccaagaccgtgaccgtgctggtcgagcgccgtgtgaagcacgagctctacggcaagatcgtggccaagacgagcaagtaccacgcccacgacgaaaagggcgagtacaagctgggcgacaccatcgagatcacggaaagccgtccgatctccaagaccaagaactgggtcgtgacccgcctggtcgagaaggccgtgctggtctga

SEQ ID NO: 818 - DNA, 744 bp, Chromohalobacter salexigens DSM 3043
atgaccggcgctcccttcaccgggctgttgttgttgctgcttgcccacctggcgggcgactttctcctgcaaagcgcggcctgggtacacgacaagcaggtgcgcggccaccgctcgacggcgctttatctgcatgccggcattcacggcgggctggcctgtctggcgctcctcgtcgggggacagcccgtcggcgcggccatcctgggtgcggccttcatcaccgtgacgcatttcggcatcgatgtgctcaagagccaggcacccagcgagcggatcgggtatttcatcgccgaccaggcactgcatgtcggggtactggtcctgacctggctgtggctgaccggcgacgcggcatggctggcgctcgccactggctggctgctgcgccccgaggtcttgctggtggcgctggcctatggcgtcgtcatgcgtcctttctcgatcctcatcgccatgatcatgcgacgctggagccacggcgtggacaacagcggcaccctggccgacgccggcgcgcgcatcggcatgctcgagcgctttctggtgctgaccttcgtgctcgccgaccagctggtgcccatcggctttctgctcgccgccaagtccgtgctgcgtttcggcgatctgcgcgaggatcgcgatcgcaagctcaccgagtacgtgctgctgggcaccatgctgagcttctcgttgaccatcacgctgggcatactggtcgcacagtggcgtcacgcgatgtga

SEQ ID NO: 819 - DNA, 720 bp, Pseudoalteromonas atlantica T6c
atggtattgtttttattgatgattgcagctcacatactgggtgatttttatattcagaaagatagctgggtaacctgtcgaaataatcatcattttgcctcatgggggctaggtaaacatgtactgtctcatgttgttctgctcactactgccatatggttggccggcttcttaactgcacaaggctggatagccattgtcgtgataggcttttcacatctgcttatcgatgtatggaagtcttatcaaccaaacaaactgagctacttcttattagaccaattctttcatatcgtgatcatcgctttggctgcactagcgcttagtggtattggcttggccgagataaaaacacagctatatttgctcctaaaagtgaaatatgtagccataacgtgtgcctatgtgattgcgtgtcggccggtatcgatagccataacaatcgctctggataattacaccgcacaattagcggataaacaaacgggtcttgcatctgcagggcgctggatcggctatatagaaaggtgcttaattatctcgtttgtgttgattggccaatttgcgggtgtaggctttttgctagcagccaaaacgatttttcgatttggcgacttaacaaaagaaaaagacatgaagctaactgagtacatgatgctgggcaccttattaagcttctcatgtgcgttattactgggctggtgggtcaatagactctga

SEQ ID NO: 820 - DNA, 738 bp, Cytophaga hutchinsonii ATCC 33406
atggataactatgtattttttacagaagagcagggcaatatattgatccggttattgcttgcacacttgctgagcgactttgtatttcagacaaagaaaatggtagcaggcaaaagctggttctccaggtatttaatagcgcatgctgccattgtatacctgtgcacggcattgtttacgggctggtgggttattgccttcgtgatcgcagcttcacattatattattgacggacttaaaatagaagctcaaaagaaaatgtttgccggcgaattagttttatttgtaaccgatcagatactgcatattgctatattgatttttttgtgggcatatcaattcgatttgatgcatctcctctttaatatgtttacggcttcgctgaatgattatactataagtctggttatgttgggttatctgatcgtaacaacgcctgccggctatgttatcgcctttacaacaaaaaacatgatgaaagaaaattccgaatcgggaaataatgaacgtggcggaaaaaatatcggcatctatgaacgcattattattctgacctttgtattgctcgggcaatatgaagctattggctttttgattacaggtaaaagtattattcgttttgtcaataaagatgaacacattcgaagtgaatatgttttgttaggtactatgatgagctatatgtttgccattgttacaggtgtactgattaaattactgctggcagattataactaa

SEQ ID NO: 821 - DNA, 819 bp, Shewanella frigidimarina NCIMB 400
atgtttgattttttcagcgtgctcattccatttttattaattcacaccatctgtgacttttatcttcagaccgatcggtgggtagaagctaaaaaagctcgcacttaccgttcacctgagttgtaccttcacgcgactttacagggcgttgcattattagtgcctgcgatggcactaggaattgattggcgttcaacggtttgcttaatcgttattgtcgcggtaagtcattttattatcgatttatggaaggtcactacaccaaagggagataagttagcctactttgttattgatcaggctttgcatgtttcggtactggctgcgattgcttttcatgtcgcagatggcgcatcgattgaggcagtgttacagcatgaacgtttctccgatggcgtgttggtggtgtttgcttatgtactcattctaaagccaacttcaattgtgattggcgctgtgttgaataagtatcccatcgttaactcagcaatggatactgacacagacgccgttaccgacaccgatggtgttgcagaacctgttagtgataagacagcaaatgtgagcggccttgttgcgggtggcgagttgattggttacctagagcgattattaatactgacgtttatgttggtgggcagctatgccgctgtgggttttgtattagccgctaagtcgatattcagatttggtgagttaaatcaatcagccaatcgaagcatgactgagtatgtactgattggctcactgatctctgtggtcatcacaaccttaatcggggtgcttgtctcattgggtgtaggtataaaatttaagtga

SEQ ID NO: 822 - DNA, 717 bp, Flavobacterium johnsoniae UW101
atgattttattcgtaaaactgtttttaggacatttattaggcgattttatctggcagcccaattcctgggtagccgataaagagattaaaaaacataaaagtatttacttatatgttcacatttttcttcatggaatcctggccgcaattttggctggagaaatcagttttattccttatgcagttttaattgctgttacacacggtatcatcgatttaatcaaattaaattttcagaaaaagaaaaataaacgcacctggtttgttgcagaccaaattgcgcatattttaattttaattggtgttgtgtttttatacgaaaacaaaacggttcctaatttctggacgaataatgaattctggatttttttaaccgggattttactgcttactaaaccagcatccatttttatcaaaacgataatttcgatctgggctccagaaagtaaaatcgacaatcaggacaattcattaattgcggccggaaattatattggtattctggaacgtttatttgttttcggatttatcctaactaatcattttgaagccatcggattccttttagcagccaaatctatttttaggtttggagatttaaaagaagccaaagaccgaaaactaaccgaatatgttttaattggtactttaatcagttttggagccgcaattctcgccggattaatcgttcaggcacttcttttacaactgccctaa

SEQ ID NO: 823 - DNA, 774 bp, Serratia proteamaculans 568
atggatttaagctacctgcccctgctgatctggttgctgatagcccacttgcttgccgacttcccactgcaaccgcgtagttgggttgaggataaaatacgtcatcgggccggctctcgcttcctgctgctgcatgccctgctgcacggcgtgctggctgcctgggtcgtggccgtttttgctctgttgtatggcgggatctcttccgctcaagtgctgttcgccctgttggttattgccatcagccactggctgaccgacctgctgaaagtcaccctgttaacccgcctcagccaggcacgtggttttttgctcgatcaaggcctgcacctgacggtgattgttttgctgtggctgttgcttacgccgaatgccctcgctctgattagcgtgctggctagcgccgcggctcgctggcaatccgggctgctgctactggcttatttattgatttatatgccgatgggcattctgatggggcaattgctggcgcgctggacgccacagatgccgccgtcagccaaagcggataacgattcgctgttacgcgcaggcaaacaaatcggttatctggaaagaacgctgatcctgacctttgtgctgatagggcagatcccggctatcggttttttgctggcggccaagtcaatctttcgctttggtgatttacgccagagtgatgacaaaatgcgtaccgagtatgtgctgctcggtacgctgttttcctttacgctgaccatcatgctgggtctgttggtgaagaaactgctgtag

SEQ ID NO: 824 - DNA, 726 bp, Caulobacter K31
atgcttgagaccctcgtcgctctgttgaccgcgcacgtcctcgccgacttcctcgttcagacagacgccatggtcgcggctaaagacacgccaaagggaatggcgcagcacatcgcctgcgttgtcatcttggccgggcttgctatcggttcgctcaatccgcctgtgctcggcgtgatcttcatcacccatctagcgatggatctgaccaagacgcacctgatgcagaagatggccggttggctttccttcacgctggatcaagtcgtccacctggccgtcatcgtggccctggccgtcatatggcccgatgtcgcccgtcagggcttttgggggcaattgcccgctgacctccagtcactctactacagcgggctgatcatcgccgccggcctgactgtcgccgtcctcgtcggcggcatcgtcatggacatgatgatgcgatccatcgtcacgaagatcggcgaaacgccaaaggggatcgacggcggcggtcgcttgatcggctggctggaacgggccctgatcttcttctttatcgtctacggtcagccagagggcgttggcttgctacttggcgcaaaatcgattctgcggtttggcgacattcagcaggccaaggagcaggcccacacggaatatgtgatcatcggcactatgctgagcttcggctgggccctcatcgtcgccgtcgtgagtaaggcggcggtcgcacactggcggtag

SEQ ID NO: 825 - DNA, 843 bp, Alteromonas macleodii  Deep ecotype
atgctagctgataacctagataccagcatggtgacgactatagagcagcccgaattgctggtggggctattattggcacatatccttgctgacttttattttcagccctttgcatgggtaaagcaaagaaatgaacgccatgctttagcgttacctctatacatacacacccttatacacggcgtttttgctggagctgtactgctactgttatctgaaaatataagcttaaccacaataggtgttggcgctattattatcgcggtatcacattttaaaattgatgttatcaaatcgtattgtgtgcaaagcacgacagcgtttgttattgaccaaatagcgcatgtggtcgttcttttaggcgtatttttatacgctaccgatcagtggcagtatgttcttagtgcgttaaggcagcttagcgctggcgacttggtgataacgttggcgtatctggctgtacttaaacccagctccatcgttattaaacagctgttatcgccgtggagtagtgaagtattatcgagcaacacacaaaccactcaccccaacgacccgccaaccattagcaccgaagcgcagcaaaccctgtctttagctgggcagcgcatagggtatctagaaagggtattaatgctgacttttgtattattaaaccagttttccgcaattggattccttattgctgcgaaatctattttccgctttggcgatctcactaaacaccaagacagaaagctcactgaatacgtgctgctaggcacctttactagcgtagcaatgacccttgttataggtttactatgcgctgccgcattagggcgattacccattaaaccctga

SEQ ID NO: 826 - DNA, 834 bp, Pedobacter heparinus DSM 2366
atggaattaaatttattattgagactcctggtagcacatttgcttacagattttatttttcagccaaaaagctgggtaaaagaccgtgaagaaaagcaaggtaaatccattaaactatatcttcatgtacttgttacaactgtatttgcctatattttttcaggtcagtacaacaattgggtcattcctctggtcatatttgtgagccacctgatcatagactatatcaaatccaaagtaaataaggataactttaattattttattgcagatcagctggcacacctgctggtcatagtgctactttctgtgtctttcagctggaactgtaaggctgtactgtcttttgcaaatgataccttcggaaattataagttctggatactggtggcaggttacctgtttgtaagctggccacttggtataattataggaaaggccacgcaaaagtggcgcgatcagattaccagggaaagcatcttaaattcggctcccacattgccagggattgatatttcagagcctgcagaaaatcaatctgaagagcaaccccagcctctagccgaagtaattaaaagcggtgaagagcaggaacttggactggccagtgccggtaaatggatcggcatttgtgaacgggtcatgatcttaacctttgttttgatgggtcagtacaccgcaataggatttcttatgacagcaaaatcgattttacggtttagcgaaaaggaagccaatacacaattaaaaacagaatacgtattggtaggaaccctggtcagttttgcaacatcagctatgattggtgtactgatgaacctcactttaaagtaa

SEQ ID NO: 827 - DNA, 744 bp, Dyadobacter fermentans DSM 18053
atgaaagaatttttgctgctgcttctggcccatattctcgtagatttctactggcagccgacccgctgggtaaccgacaaaaaagagaaaaagtacaagtcgcgctacctgtatttccatacattgctggtcatcatcgtgtcgtatattgccctgcatcagtggaaaaacccgcttccggcgattttgctgggcattgcccacggggtaatcgaccttgttaaaatctcattcgacaaaaagggctcgcttacatggttcatcgccgaccaggctgctcacctggccacaattgcgctcactgcagtgattctgacaagcagcattcccattggttttcagtcatttattacgtggatcaacactcccaaaacccttgcaacggtgtccggtgcgctgctttcgctgtctccggtgtcgtttctggttggtatcctcaccaggccctggcgggaagaactcagcaaactggccccggacgccgacgataacctcgccaatgccggccgttggataggtatgtctgagcgtctgctcatttttgtttttgtattagtaaaccaatattcagccatcggcttcctgatcgccgccaaatcgctcctccggtacaatgataaagcgaccgatacgggcattccaccggcgtacatcagcaagaaatccgaatatgtgctcgtgggaacgctcatgagctacacctgcgccattgccgtggcactggccgcgaagatgcttcggtaa

SEQ ID NO: 828 - DNA, 384 bp, Candidatus Methanosphaerula palustris E1 9c
atgttgtaccagtatcttctctatctaattttattggtggggtatatcatcatactgtggccaagtggttatgcaatacgtcgatttttagaaaattttgaatttgagaataaatttaaaaaagatgagaccgggctcaattcttcacagaaacatgcaggaacctacatcggttatttcgaacgttttttaatactcatctttatgttaacggatcagtttgtagctattggctttctgatcactgccaaatcgatattcagatttgaaaaaagtccacgaggcatcgttgaatattttttgatggggacgcttatgagttatgcgatagcgatttcagttggagaaattatgcaatatctcattattatgatccaatcctga

SEQ ID NO: 829 - DNA, 231 bp, Shewanella sp. MR-7
atgagcaacataaccataaacattgatgcgccttttttgcgttatgccgaatacgccaaaagaacgggtacaaccgttgataacgttcgctatttagtaaaagttggcaagttgccaatccgcccaaaacagtcaccaaaagaagacccgatgatcaacatggtggcgctgtttgctgaggccgcagcactgtgtggcactcaaacgatacaggcaaaccatattagctaa

SEQ ID NO: 830 - DNA, 201 bp, Shewanella baltica OS155
atgaaccagattgcattacagatcgcaacgccttatgtgacatttgagcaatacgccacgttaagtggcattcctttcaacaccgtgcgcgagatggccaagactggccgcttaccactacgccccaaagaccgtcccaaagaaaaaccgcttatcaatatgttagccctgactcgtgaggcgatggagcagaagtactga

SEQ ID NO: 831 - DNA, 222 bp, Enterobacter sp. 638
atgacccctaatatttcaatcactctgaacacaccgcacgtcacaattgaacgttacagcgagctaactgggctgcctgttgacaccataaacgacatgcttgcagatggtcggttgcctcgtcatcgcctgcgtaaagataagaagcgtgaaaaggtaatgattaacatcgttgctttaaccgttgatgcactctcagattgcaacgtgactatcaactag

SEQ ID NO: 832 - DNA, 213 bp, Vibrio cholerae O395
atgctgacatatgaggtagcacccgaaagcccatacgtgacctgtgaaaagtattccgtcatttccggtttaccgatgggcaccattcgccagtacatcgcagaagggcgaatcatcatcaaacccaaaaccaaaacgaaagaaaaacccttagtcaacatggttgcgatgcacgaaatcgcagcgcgtgaagctatgcaggtgctggggtaa

SEQ ID NO: 833 - DNA, 222 bp, Escherichia coli HS
atgagacctaacatttcaatcactcttaccacgcctcatgtgactattgaacgctatagcgagctgacagggctatccatcgataccatcaatgacatgttggctgatggacgccttatccgtcaccgtctgcgcaaagataaaaaacgcgaaaaagtgatgatcaacatagcagcaatgaccgttgatgcgctttcagaatgcaatctaaaccttaattag

SEQ ID NO: 834 - DNA, 222 bp, Escherichia coli C ATCC 8739
atgagacctaacatttcaatcactcttaccacgcctcatgtgactattgaacgctatagcgagctgacagggctgtccatcgataccatcaatgacatgttggctgacggacgccttatccgtcaccgtctgcgcaaagataaaaaacgtgaaaaagtgatgatcaacatagcagccatgaccgttgatgcgctttcagaatgcaatctaaaccttaattag

SEQ ID NO: 835 - DNA, 231 bp, Yersinia pseudotuberculosis YPIII
atgccaagcaacattacaatctctcttacaaccccgcatgtgactaaagaacgatattcagaacttaccgggctatccattcgcgttattgaaagcatgttggacgatggacgattatctacttatcgccatcgtttaaaaaaggatggggggcgcgaaatagttctgatcaatctagccgccttaactattgacgctatttccagccatgaaattaagttctctcattga

SEQ ID NO: 836 - DNA, 420 bp, Methanosarcina barkeri fusaro
atgaattcagaactcattaattcaggactcatgaatcttatgattcttctgcctttccaggtctttgccgaaaagaaaggcgtatcacgcatagtcgcagaaggccgtgagggttcatttgggctcttgccacaccgacttgattgtgtcgcggctctggagcctggaattctcacttacgaaaccgaattagagggtgaggtttatgtggcagtcgatgaaggcgtactcatcaagactggtcaggatgtacttgtctctgtacgtgatgccattttcgggacagagttaagccagttgcaagaggcagtagagaaagagttcttaactttagatgaaaccgagcaaaaaattcgttcagtaatggtaaaattggaaaccgggcttatacgccgtttagcggagtttcagaatgtctga

SEQ ID NO: 837 - DNA, 456 bp, Burkholderia pseudomallei 1710b
atgggcgctgagctgcgcgtgacgatcgcgacgccggcgcgcgtgtgcgtcgacgatctgccgatcgtgtcgctgcgcgccgaggacgcgagcggcgcgttcggcatccgcgcgggccacgtcgatttcgtcacgctgctgcgcgcgtcagtcgtgcgctggcgcaccgccgacggcgcgacgcattacgcggcgcttgacggcggcgtgctgcgcgtgacgcgcggcgcgcgcatcgagatcgcgtgccgcgacgcggtgctgggcgagtcgctcgccgagctcgaggcggtggtgcgcggcgtgcgcgcgacgcagctcgacgagaagcgccgcgcgcgcgtcgacgagacgcggctgcatgcgcaggcggtgcggcggctgctcacgtatctgcggcccgagcacgcgaaggacggcgtgcacgcgccgctgaagccggagacgctcgaatga

SEQ ID NO: 838 - DNA, 381 bp, Pelobacter carbinolicus
atgaggctaagggtccagacgccggcggagcggatcctcgattgccccgtaaccaaagtggtggccgaaggtttgaacggttcgttctgcctgcggccacggcacgtcgatctggtatcggcggtggtgccgggcctgttctattacgaaacggcagagggccaagggcactacatcgccctcgatcgtggtttgctggtgaaacgcgagacgctggtgtcggtgtcggtgcgcaatgccgttgcagccggggagctggaggatttgctcgaagtcgtacagctgcgcttcaaggccctggatgagcaggaacgggtggttcgcagtgccgtggcgcgtctggaatccgactttttacggcgctttatggagctatcatga

SEQ ID NO: 839 - DNA, 390 bp, Chlorobium luteolum DSM 273
atgcgccttgagctcctgcttccatttggcgtcttttccgtgacggaaaaggtcacgcgaatcgtcgcggaaaccaactgcggctcatgggggtttctccccggaaggcgcgactgcgtcgcctcgctcgtgccgggaatccttgaatacgaaaccctggagtcgggtgtctcgttcgtcgccgtcgattgcggaatcctcgtcaagaaagggtccgacgtcgtcgtttccgtccgccaggcggtgggcggtgtcgagctcggggccctcgaaaaggccgtaaaggaggacttcctggagcttgacgaacatgaacgcaccatgcattcggctcttgccaggcttgaaagcagtttcatccgacgctatgttgaattctaccatgactga

SEQ ID NO: 840 - DNA, 393 bp, Nitrosospira multiformis ATCC 25196
atggaccttaagatactactgccctttagtgtctttatggaaaaggccagggtggaccgcattgtcgtcgaaaccgttgatggatcgcttgggctgctgccccaccgtctcgattgcgtggccgctttggttcccggcatcctgatattcgaaaccaggagcgaaggtgagatttatgtggcggtggacgagggcattctggtaaaggtcagtgctcaggtaacagtatcggtgcgcaacgccgttgaggggaccaacctggctgtcttgcatgagactgtggacagggagttcctgaacctcgatgagcgggccaagagcatccggcggacaatggcaaaaatggaaagtggcttgatccggcgcttcatcgagcttcatcatgaaagatga

SEQ ID NO: 841 - DNA, 456 bp, Burkholderia thailandensis E264
atggccgctgagctgcgcgtgacgatcgcgacgccggcgcgcgtgtgcgtcgacgatctgccgatcgtgtcgctgcgcgccgaggacgcgagcggcgcgttcggcatccgcgcgggccatgtcgatttcgtcacgctgctgcgcgcgtcggtcgtgcgctggcgcaccgccgacgacgcgatgcattacgccgcgctcgacggcggcgtgctgcgcgtgacgcgcggcgcgcgcatcgagatcgcgtgccgcgacgcggtgctcggcgagtcgctcgcggagctcgaagcggtggtgcgcggcgtgcgcgagacgcagctcgacgagaagcgccgcgcgcgcgtcgacgagacgcggctgcatgcgcaggcggtgcggcggctgcttacgtatctgcggcccgagcatgcgaaggacggcatgctcgcgccgatgaagccggagacgctcgaatga

SEQ ID NO: 842 - DNA, 390 bp, Rhodoferax ferrireducens T118
atgaatcttaaggttctgctgccatttcacatcttcgccgaaaaaagcggggtgtcgcgcatcgttgcggagacgcgcgagggttcatttggactcttgccacatcgactcgattgcgtcgcggcgctcacaccgggcattctgatctttgagaccgcagcggagggcgaggtttacgtagccgtggatgaaggcgtgctggtcaagatcgggccggacgtgctcgtttcggtgcgccgagcgctgggcggaaagaacctcgacaaattgcgcgatgccgtggaacaggaatttctgaccctggacgagcgcgagcaaagcgtgcgctcggtcatggcgaaattggaagccggttttttgcggcgcttcgcgagctttcaacatgaataa

SEQ ID NO: 843 - DNA, 456 bp, Burkholderia xenovorans LB400
atgagcaaggatgccttgaggctcaccatcgcgacgccgtcgcgagtctggttcgacgctgtcgaaatcgtctcgttgcgggcggaagacgcaagcggttcgttcggcatccgtattggtcatgccgatttcgtcacgcagctgacgtcgtcggtggtccgctggacgggtacggacaacgtgttgcgctactgcgcggtgaacggcggcgtgctgctggtgtcgggcggcgcgacggtgtccatcgcgtgccgcgaagcgattccgggcgattcgctggaaggcctcgaagcgatcgtgcgcagccgtcacgccgacgaagacgaggcagcgcggcgcgcccgcgtcgaccagatgcgactgcatgcgcgcgcggtgcgtcagatgctgcgctatttgcggccgcgagccggggccgatggcgcaaatccggccggcacgggagcaacgctgtaa

SEQ ID NO: 844 - DNA, 420 bp, Burkholderia xenovorans LB400
atgagcccgacgctgcgcctgacgatctccacgcccgcgagcctgctcgtcaatgcgcaagccatcgtcgcgctgcgcgcggaggacgggagcggcagcttcggcatcctgccgggacacgcggacttcctgaccgtactgacgccgtgcgtgctgcgctggcgcggaacggaaaatatcaggcgtttctgcgcggtggaagaaggtgtcctgagagtgtcggagggccatagcgtcaccattgcatgccgcagcgggatgctcggcgattcgctcgcggcgctcgaagcgcagatcgaaacggcgcgagcacgcacgctcgacaccgcccgcaacgcacgcgtcgaacagacccggctgcatgcgcaagcggtccggcagttattgcgctatctgcgcccgagccggggtgacgcgtga

SEQ ID NO: 845 - DNA, 390 bp, Pseudoalteromonas atlantica T6c
atggacgttaacattctactgccctatcaggtgttcgccacgcttggcgatgtaacaaatttggtgatagaaacgccctctggcagccatggcattcttcctcaacgcttagactgtattagcccattagtccccggcattttgacttatcaacaaggtgcccagcagtctcagtttattgccatagaccaaggcataatggttaagacgggtgcccaagtgatgatttcggtacgccgcgccattcggggcagttcattgcaaaaattacaacaagccgtcaagcaagaatttttagcgctggatcaagaacaacaagcgctgcgcactgtcttggcgaaactagaaagcggctttttgaaacagttttcagcattgtcgaagcactaa

SEQ ID NO: 846 - DNA, 441 bp, Rhodobacter sphaeroides 2 4 1
atgagcctgacgctccgcgtgaccacgccgcttgcggcggtgctcgaggaggaggggctggcctcgatccgcgccgaggatgcctcggggggcttcggcctcctgcccgggcatgtcgatctgctgacggtgatcgaggcgggggtgctgcgctttcgccgccccgaggggccctggcacttctgcgcgatccgggggggcgtgctgcgcgccacgggcggacggctcgtcaccgtcgcctgccgagaggcggtgccgggcgaggatctggcccggctcgaggccgggctgaagcggcaggccgaggccgccgatcaggccgcgcgccgcgcccggggcgagcaggtgcgcctccatgccaatgcgatccgcagcctgatgcgccacctcgaccgcgcgccgggcgccgacctttccggcatcgtggaggccttcgaatga

SEQ ID NO: 847 - DNA, 411 bp, Shewanella frigidimarina NCIMB 400
atgcagtctgcacacatgaaccttaaaattttgctgccttataaggtttttgctgagcagaaaaatgtggtgcgcattgtcgcggttacgcatcaaggttcgtttggcatcttgccacatcggcttgactgcgtggcgtcactgacagctgggttattggtgtttgagtacgatggtgctgatgaagtgtacgttgctattgatgaaggtgtactggttaaaacgggctttgatgtactgatttcggtgcgtaatgccataggcggtttggcgttgagcgaattacatcaagccgttgagcaagaatttatgcacttagatgaacaagaacagcaattgcgttcggtactgatcaagatggaaagtaatttcatgcgacgcctgactgagttccatcatgacagagtttag

SEQ ID NO: 848 - DNA, 402 bp, Psychromonas ingrahamii 37
atggcagcacagatccaacttaaaattttattaccctatgccaccttcgctgaaaaattagatgtagagcgtatcgtggccgaaacaaacctgggttttattggtattttgcccaatcgcctggattgttctgccgtattaacggcaggtattttctgttaccaatgcaaaaataaagcggaagtttttatcgcggtggatcaggggattctggttaaaaccggatttaatgttttggtctcggtgcgacgtgctattggccaggcagatctcagtcgactccatgctttagtcaaaaaagaatttctggtggtcgatgaaaatgagaaacggttgcaggcgaccatggtgaaattagagactggatttttgcgccagttaggtaattttcagcatcagtga

SEQ ID NO: 849 - DNA, 396 bp, Polaromonas naphthalenivorans CJ2
atgtccatgaatcttaaaattctgctgccgttcaggatttttgctgaaaaaacagcggtctcgcgcatcgtcgccgaaacccaggcgggctcgtttggcttgctgccgcagcggctcgattgcgtggcggcgctgacgcccggcatcctgatctacgagaccgcctctgacggagaggtgtttgtcgccgtggacagcggcgtgctggtcaagagcggcgcggaggtgctggtttccgtgcggcgggccatgggcggcgcaaaccttggcgagttgcgccaggccgtcgagcaggagttcttgacgctggacgagcacgagcaaaacgtgcgcgcggtcatggccaaactcgaaaccgggtttttgcgtcgcttcgcgacttttcagcatgactga

SEQ ID NO: 850 - DNA, 441 bp, Rhodobacter sphaeroides ATCC 17029
atgagcctgacgctccgcgtgaccacgccgcttgcggcggtgctcgaggaggaggggctggcctcgatccgcgccgaggatgcctcggggggcttcggccttctgcccgggcatgtcgatctgctgacggtgatcgaggcgggggtgctgcgctttcgccgccccgaggggccctggcgcttctgcgccatccgggggggcgtgctgcgcgccacgggcggacggctcgtcaccgtcgcctgccgagaggcggtgccgggcgaggatctggcccggctcgaggccgggctgaagcggcaggccgaggccgccgatcaggccgcgcgccgcgcccggggcgagcaggtgcgcctccatgccaatgcgatccgcagcctgatgcgccatctcgaccgcgcgccgggcgccgacctttccggcatcgtggaggccttcgaatga

SEQ ID NO: 851 - DNA, 456 bp, Burkholderia mallei NCTC 10247; identical to SEQ ID NO: 837

SEQ ID NO: 852 - DNA, 456 bp, Burkholderia pseudomallei 668; identical to SEQ ID NO: 837

SEQ ID NO: 853 - DNA, 456 bp, Burkholderia pseudomallei 1106a; identical to SEQ ID NO: 837

SEQ ID NO: 854 - DNA, 453 bp, Bradyrhizobium BTAi1
atgaatctcacggtcaccacaccgctggcgatcatcgcaaaggccgaccacgtcgtgtatgtgcgcgccgaggacgacaccggcgccttcggcattctgcgcgggcatgctgattttctcacggcattggcaatctcggtcctgagctggcgcgatgagggcggcggcgagcatcacatcgcggtgcgcggcggcatgcttgcggtgcacgacgggaacgcaatcaccattgcgacgcgcgaagccgtggctgatgatgatctgcaccgtctcgaaaccgaagtgctcgcaagctttcggcggcgcagcgaagatgaggttacggcgcgcactgatgcgcagcgcctctatctcgcagcgatccggcagatctaccgcttcctgcggcccgaccgtcccgtccccgtgccgcggctggccggcccgatgtcacaagaggggctggagtcatga

SEQ ID NO: 855 - DNA, 417 bp, Marinomonas MWYL1
atgccacaagcctacatgacgcttaaagttttgctgcctcataaagtatttagcgaagaacaaaaagtgctgcgaatcgtggcgactacaccacaaggagcgtttggcattttgccgaatcgattggattgtgtggcgtctttgtcggcgggcattttagtgattgaagtggaaggcgaagaagaagcttatattgctgttgatgaaggcgtattggtgaaaactggagccgatgtgcggatttccgtgcgcaacgctatgaatggcatgggactagaagatttacgtcacgcccttgaagatgagtttattcagcttgatgagcaagaacaaaaaatgcgttcggcattgaccaagatggaaagcggttttgttcagcgtttagtggcctttaagcaggatgcgagtttgtcatga

SEQ ID NO: 856 - DNA, 411 bp, Dinoroseobacter shibae DFL 12
atgaccatggcgaccgagatgcgtgtctatctgcgcctgccctcgaggatcatgttcgacggatcggcggtgcggctgcgtggcgaggccccgaatggtagtttcggcatcctgcccaaccatgtcgacctggtcacgccgctggtgtcttcggtgcttctgatcgcgcaggccgacgggacggagcggattttcgggatcgacgaggggctgttggtcaagaagggtcaccgggtcgaggtggcggtgcgccgggcggtggagaccgacgacctggaccagatgcgcgacatcgtgcgcgacagtttcgcgggtctcgaagacgaggagcgcgccgcgcgcgccgccctgtcgcggctggaggccgatatggtgcggcggtttgcaagcctgagaaaggcgcagggatga

SEQ ID NO: 857 - DNA, 462 bp, Beijerinckia indica ATCC 9039
atgagcgcggcgctgcatctgagcattacgacgccttcggcggtccttatcgatcaggcggatatcgtctctctgcgcgccgaagatgaaagcggcggctttggcattctgccaggccatgccgatctcctgacggtcctgcgggcgtctgtcgtccgctggcatgccagggatgacatcatccattattgcgtggtgcgcagcggtgtactcacagtcacggaagggcagcgcatcgccatagcctgccgccagggtacaacgggcgatgatctgacacggctggaggaagatgtcgcggccatgcgggctgaggaagtggatgccggccgccgcgcgcgcgtcgagcagctccgcctgcatgcccatgccgtgcgtcagttgatgcactatctgcatcccggtcaaactgtggacgcagagatcatgggagcagcagttcaggacacggaggagatatga

SEQ ID NO: 858 - DNA, 432 bp, Burkholderia phymatum STM815
atgacggacccaacgctcgatttgaccatcgcgacaccggcacaggtggtggtcgatggcttaccgatcgcctcattgcgcgcggaagacgaaagcggcggattcggcatccacgcgggacatgaggacatggtgacgctcctcagcgcatccgtcgtgaggtggaccacgccggacggccacgcgcattgctgcgccgtggatggtggcgtactgatcgtgtcgaatggcgcggccgtttcgatcgcatgcagggaagcggtgcaaggcgaatcgctgcaacggctggaggcgaacgtgcacggcgtgcgcgccgcacaactggatgcgatgcgtcgtgcacgtgtcgagcagacgcgtctgcatgctcacgctgtccggcagatgttgcgttacctgcgtccacagagggcgcgcggagtaggcgaatga

SEQ ID NO: 859 - DNA, 459 bp, Burkholderia phytofirmans PsJN
atgaccggcgcgcgtctcaccttaaccctcgccacgccgtcgcgcgcatggttcgacgcagtcgaaatcatttccctgcgcgcggaggacgagagcggctcgttcggtatccatgtcggccatgctgatttcgtgacattgctgacgccatcggtggttcgctggatctgcgccgacggcgtgacccgctattgcgcggtggacggcggcgtgctgctggtgtcgcgcggcacgcaggtgtcgattgcctgccgcgaagcgattcccggcgattcgctggagagcctggaggaggccgttcgccgacaccacgccgttgaggacgatgcggcacggcgcgcccgggttgaccagttgcgcctgcatgcccgggccgtgcgtcagatgttgcgctatctgtgtccacgttcgggcgcggacggcgccgacgacgccgccacgggagtcatgccgcaatga

SEQ ID NO: 860 - DNA, 420 bp, Rhodopseudomonas palustris TIE 1
atgaggctccgcattgtcacgccgctctcggtcgtcgtcgaggaagacggcgtcctcgtcgtgcgcgccgaagacgccaccggcagcttcgggatattgccgggtcacgcggacttcctcacgaacctcgcgatttccgtcgtgagctggaagaacggcaatgggatccggcactgctgcgcggtgcgccgtggcgtcctctcggtcagcggcgggcaggacgtcgccgtggcgacgcgcgaggcggtgcttggggacgatcttgcgaccttgggcgagacggtcctcgctcgcttccgcgccgatatcgaggccgaacggacggagcatgtcgagaccacacgcctgcaactcaacgcgatccggcagatcatgagccatcttcgttccgaccgacgcggtgcaagaatattctcatga

SEQ ID NO: 861 - DNA, 405 bp, Prosthecochloris aestuarii DSM 271
atgagcagtgattcgatgagggttgaacttctgctgccgttcagaatttttctcagaagagacagggtcaggaggattgttgttgaaacgtcgaaaggatcatacggccttctgccgaaccggcttgattgcgttatgattctcgttcccggtatttttacctatgaaaccgaagcagaaggggaggcctatgtcgctgtcgacagaggtatactggtcaagacaggacctcaagtcttcgtgtcagttcatcatgcaacaggtggcgttgatctcggagagctcgaggaggcggtcaagcgcgacttccttgccatcgatgagcgagaacagagcgtccggacggttctggcaaagcttgaaagcggatttatccgccagtttgcagaatttcacaatgagtga

SEQ ID NO: 862 - DNA, 441 bp, Azotobacter vinelandii DJ
atgagccttcccctgcgtctgcggatcgtcactccgcagcaggtgctggtcgactgcacggacgtggtggcgtttcgcggcgaggatgccagcggcggcttcggcctgctgccgggccatgtcgactatctcaccgtgctggtgcccacggtgctgcgctggcgccgcgcgggcggcgagcaaggcttctgtgcggtgcacggcggcgtgctgagcctgagcggcggcgagttgcgcgtcgcctgtcgcgaaggcatcgtcggcgagcgcctcgaacagctcgaggcgcaggtgcgcgaggcccgcgagacccggcgcgacagtgcccggcgggcgcgggtcgaacatctgcgcctgcacacccaggcggtgcgccaactggtgcgctacctgcgcgccgagggcgagacaccattcgatcccgagggagagccccgatga

SEQ ID NO: 863 - DNA, 408 bp, Desulfomicrobium baculatum DSM 4028
atgccgcagccgacattcatgcgccttaaaattctcctgccgtttggaatctttgccgagaaaaccggcgtttcccgcatcgtcgcagagacccgcgaagggtcgcttggactcttgccgcaccggctcgactgcgtcgcggccctcgcacccgggattctggtctacgaaaacgaagccgagggcgaggtttacgtagccgtcgatgaaggagggctggtcaagacggggcctgacgtatttgtctctgtgcgtaacgcggtcggaggcaaggacttggcgcttttgcgcgaaacggtggagcaggagtttctggacatcaacgaacgcgagcaggtcgtccgctcggtgatggcaaaaatggagagcggtttcatccgccgcctggcggagtttcatcatgagtga

SEQ ID NO: 864 - DNA, 1479 bp, Flavobacterium johnsoniae UW101
atgaaaaatataaaaataacactttcattattattggtgataagtcttagcagctgtgatgaatttctttctgaaattccagacaatagaacacagattgatacaccagaaaaaatatctgaattattagttacagcatatccaagtaaaagctatgcagtaattggagaaacaatgtctgataacgtatttgacagtgagatgacatcatctgatgttgataacagacaaagttttaactgggaaatgcagactcaattaggaccagataccgaagctgacttctggaatgcatgttatgaggcaattgcagcttcaaaccaggcattagttgcaattgatgaacttggaagcccggaaagtttaaatccgcaaaaaggagaagccttaattgcaagagcttacaatcattttatgctggtttcatactggtcacaaagatacaatccttcaagtgcagcaacagatttaggtgttccgtatgtaacaaaaccagaaggtgcattattggctcaatacaaacgtaactctgttaaagaggtatttgatttaatcgagcaggatattatcgaaggaatgaaatacataacaaacaattacaaagagcctaaatatcactttaatattgatgcagcaaaagcatttgcatgtcgtttttatttaataaaaggagattgggataaagtacttgaatattctaaaggattaggttctaaaccaacaactcttagagattatgtagcttttaatgctgcagcttctgctcaaaaaccgctagaatattcaaaagcagaacagcctacaaacttattagtagcttatccaaactcaactgcaagaagaggatacacaaatagattttacctttctgataacagatcagatgaaatcttaggatcagatactaacatttggggaaaaccatggttaatttatacatcatcattttatgaaaacaatgtacttatccctaagttttatgaatactttaaatatactaacgtaacagctggtattggagaagcttacacaggagtagttcttttaagtaatgatgagtttttcttaaacagaattgaggcttatgtaatgaaaaatcagtttgcagaagctaatgcaggattagaatatctcttcagtcttagaacacaaggatataatgcggcaactgataaaattacagaagcaaacattgcagctatgtatccggttattgcagacgagtacacaccattctatactttaagtcctttgcaggcatcatacatcaaagcaattgcagaagcaagaagaagagagtatatccaggaaggattaagatggtttgatattaaacgttttaaccttgtagtagaacatattactaaagaaaatggaaaagcagttaggactaatgttttagttaaagatgacaaacgaagagcgttgcaaatacctcaaagagcatctgataacggaatcgaaaaaaatcctagataa

SEQ ID NO: 865 - DNA, 1494 bp, Capnocytophaga ochracea DSM 7271
atgaatacaccgatgaaaaatatactatataccaccacaagaatagtagccataggattactattcgcttcttgtgataaattcttagacgaagtccctgatactcgtaccgaaatcgatactcccgaaaaagtacaagaactcttggtaagtgcctatcctgatgctttgtatatggatattgccgaaacaatgagtgataatgcaggtgataaaataagtcttaccgaaacttctatcttaaacacagaactctatcagtggaaagatagcaaagaaacccgacaagatgctcctactttctattggggggcagcttggggtgccatagcctctgctaaccacgccttagaagccgtagaaaaactaggtggaggttcctctcttaattacctcaaaggagaagcactcgtagcacgagcttacgcccattttatgttggggctgttgtggtgtaagccctacaaccctgctaccgcctcttccgatttaggattaccttatgtaaccgctgccgagaaagtagtatttgctaaatacacacgcttgtcggtagaagaatactataaggctatcgaaaaagacctcgaagagggcttacctcttatcgataatacctcgtatagcaagcccaaattccactttaccaaagaagctgctcatatttttgctactcgtttctacttagtaaaaggagaatgggctaaagttattgcacacgccaatgaagctcttggtagtaatcctgctgccaaagtacgcgatataaacaagataaacacccttactactttacaacgtcaagcgcaatacagtagtaccagtgagccttccaacgctttgattacaggagcctcttctgtatatcaaagaaaccttagtcgtaataaatacgggatgacggctactttatctgtctatttgtcgcaaagaagcttacacccacttgatatgccttgggcatatgatttccaaggaggtaatgagaatatacagaatattcctaaatatcaagaatattttaaagtaaacaacgtctcagcaggtacaggttacccctacggaatggctaccctcttgctttatgacgaagccctgcttaaccgtatggaagcctatgtaatgacaggacaaacagctaagtttatcgaagacctaaaagtgtatttaccttttaaaacaggagaaacgctcgatgtaaataacattaccgaaacagctcttaataccaaatacaacggaaaaggtactgagctctcccctgcttatacacttaacacccctcagcgccaaatgttgcaatgtctgctcgatttgcgccgtatagaatttgttttcgaaggattgcgctggttcgatattaaacgttttggtttaaaagtaattcaccaaaaggggaaccaaaccttagaactcaacaaaggcgatttgcgtcgtgagttgcaaatacccgaagacgccttggctgcaggtattactcctaatccaagataa

SEQ ID NO: 866 - DNA, 1446 bp, Pedobacter heparinus DSM 2366
atgaaaaaatatacgatatacttcttccttttcatggccattgccggtgttggatgtaataaatatcttgatcatgctcctgatgatcgtaccaaattaaatacgcccactaaagttgctgagctattggttactgcttatccacgaggtaatgctgttttattgtccgaatctatgtccgatattccggcatttgtgagtgcccttggaatagacttcccggtaaaccagaatggctattactggaaggatgtagaggctgttgatcaggatagcccaacatattactggaacgcttgttacactgcaattgcaacggccaatcaggccttggatgcaattgaaaaagcctcggatccccagcaatatgctgcgcaaaaaggtgaggccctggttgcaagggcgtatgcacattttatgctggtaacgtttttctcgaaatgttatgaccctgcaacagcagaaaccgatcccggtattccttacgtcaccacgccggaatcggttgtttttaaaagctacgagcgtaaaacagtggcttatacttatcagcaaattgaaaaggatctgttggagggtattccactgatacaggataaatacacggttcctgcttaccattttacccgtaaggccgcctatgcttttgcctgccggtattatctgtttaaaaaaaatatggacaaagtgattgagtatgccaaccttacctttccggcaaataattttgcagataatgtaaggccatggaaatcttatgctgcctacaatgtccaggaattggaaacggcttatatgaatgctggtaatcctggcaacctcttgatcggggaaactgtctcgcgtttggccagaaactataaaaggccgatatattcgatcagccagaaccgtttaaggatcatattggcacctgtaggggtaacatttactgcattacctatttattccaacagctcaacctattattacctgatcaaatttgctgaacattttgtgcgtaccagcatcaatgcttccagtggcaccggctatactatggtacctttgttaaccaccgaagaggttttgttaaaccgtgctgaggcttatattgtacagggtaaatatacagaggcgctggcggatatgaatacaatgatcagtacccgcgtaactgcctatagcccgtctgcaaatgacttaaccgaagcaaaaataaaaagctattatgccaatgtaaccactgataccaagcaggcctatatcaatgcgctactggatattaaaaaagctgaatttgtacatgaagggatgcgctggctggatattttaagacataaattaccggtagttcaccgtgatgccgctggtaacgaatttaatttagctgccgaggataaacggaaagtattgcagatcccttcacaggttactttatcaggtgttgaacaaaatccacgttaa

SEQ ID NO: 867 - DNA, 1491 bp, Dyadobacter fermentans DSM 18053
atgattattcggaatgatatgactaccatcaaaaaaataaagacaatcgtgctcatcctcccactgctggcgctggccggctgtgaagatttcctttcgaaagaaccggacagcaccagggcaattatcaacacgccgaagcaggtgtcgcagttacttacaacggcttatccacaggctggctacattgtattttcggaaggaatgagtgataatgtggccgataagggcgtcggggaggatgacaagaccaaccgcgcttcgttctttttcgaagtggtggaagcgactgtggatgaacaggattcgccagaccagtactgggcagaatgctaccgcgcgatttccgtagcgaatgaagcgctcgatattatcagcaaagtggccgaccccgacaaatacaatgcacagaaaggcgaggcattgctggccagggcgtacgcgcattttatgctggtaaactactattgccagttttttgacccgcaacaatccaacaatagccccggcgtaccttatgtaacggtaccggaggatgtcgtgatcaagcaatacgagcgcgggacggttgccggcgtgtaccagatgatcgaaaaggacctgctggaaggacttccgttgatcagcgacggctcttataccgtgccgaagtaccatttcaatatcgcggctgcgaatgcatttgcaagccgtttttatttggttaaaagagattatcaaaaggtgctgcaatatgcaaatgcggcaattcccgccaatagtttggctgaaaacctccgtccttggaacaccacttattccagtctttcgccggaagagttgttcaggctctattcccgtgcaaatcagaatgccaacttgctgctcatcgaaacgtcatcgacctatggacgttatgtagccaattacagatatggcctgacatatccgaaatggcaggagatttcggacagtgaacgcattatcacaggaaatgcgggatggacttatccgctttactatcgcggggagaacaactactttattccaaaattgacagaatatttcgttcgcgagtctgttaatgcagagatcgggcttccttatgtgatgttgcctgcttttacggtcgaggaagtactcttcaataaggtcgaagccaatgcatatctcggcaactctgccgcttccctggcggacctgaatacttatgtcagtaagcgggtcgataactacgatgcgtcagagcataaggttaccgccgccagtatgcagagttatttccggaaaaataacgtgagggacaatattgtcgaaaccgtactggccttcaaacgcgtcgaatttgtacaggaaggaatgcgctggtttgacattcagcgttacaagagaacggtgacacacgaagcccgtaacggatcagttatttcggttccggcgggggataatcgcagggtattgcagattccgcagacagccgcactttcaggtatagcacagaatcccaggtaa

SEQ ID NO: 868 - DNA, 1449 bp, Chitinophaga pinensis DSM 2588
atgcaaagaaaagcgctatatatactcctggctattctcccgtccgtaaccggatgtaaaaaatatctcgatcagcaaccggatagtacctggacacaactggatactcctgaaaaggtgagtcagttgctgggtactgcttatccgcaggctaactatatgactttctgtgaagccatgtcagataacgtagccgataaaggtactggtgtcgacgtacgtaccaatagagaccctttctattttgatgatgtgcagaacatcaaccaggattctcctgaatattactgggcggctgcctataccgctatcgctgcagctaacaatgccctgatcgcctgtgaaaatgcaaaggatacagctgcttatagtcgtcagaaaggggaggcactcgtagcacgcgcatatgcacattttatgctggtgaatatcttctccagaagttatgatgcaacaaccgctaatgcagatatgggcatcccatatgttaccgagccggaagaagtagtattcaaacagtacgacaggaaaacggtcgcttatgtatacgatcagattgagaaagacctgctggcaggtttaccattgatccgcgatgataagtacaaggtgcctaagtaccatttcaaccagaaagcagcgtatgcttttgcggcaagattttacctctacaaacgcgactatcagaaagtgattacctatgcggatatggctttcacaacaggccaggcagtgagctatctgcgtccatggaatacttcctacgtattcctttctccactggaattgttcaacatctattctaactccagcgagaacgccaacttcctgctggtagaaaccaattccagctacggccgtaacctggcgcaataccgctttggtatgaactttccgatgtacagagcaatcatggggagcaacgtaaccggtggagactggtgctttccggcatatacctatggtactgccgattacttcatccctaagctgagtgaatattttgtaaaggaatctgtgaatgcgaccattggttacatatacaccatggtgcctttgttcactgcagaagaagtactgtttaacagggcagaagcaaatgcacaactggggaataccaccgctgttcttgctgatctgaatacctacgccggtacccgtatcaccaattacgatgcaagtgctgatgttgtgacactggcgaagtgcaaaagttactatggtctttcagatagtaaaggcgcactgttaaatgccgtactggatttcaaaagagcggaattcgtacaggaaggtacgcgctggtttgacctgatgcgttacaaagtacccgttacacatgtaaccagtcagggacagacgatgatactcggagcagacgatccgcgcagggtcttccagataccggtatctgcaaaaacatccggacttccattaaatccccgctaa

SEQ ID NO: 869 - DNA, 1455 bp, Chitinophaga pinensis DSM 2588
atgacgaaattttttacaagagcatctattatcgcaggatgtttgatagccatggccggatgtaataaatatctggataagtcgccggatagtacctggacagaactggattcacctgcaaaggtatcccagttactgggtaccgcttatcctcaggccaactatattgtgtttgcagaagccatgtctgacaatgtggaagataagggcgccggtgttactgacagaacgaacctcgatccttatttcttcaatgatgtatccgctacggaacaggattctccggaatactactggcaggcctgctatgctgctatcgcggcggcaaacaatgcattgaaagcctgcgaggcagctcccgataaaagccgttacaccgcacagaaaggagaagcactggtggcaagagcctatgcacactttatgctggtaacgtttttctctaaattctacgacgaagcaaccgccgctactgatccgggtattccctacgtaacggaaccggagaaagtggtgaataaacaatatgagcgtaagacagtcgcctatacttatcagatgatcgagaaagatctgctcgcaggtctggcactgatcagtgatgaaaattatgcagtaccgcgctatcatttcaataagtcagccacttacgcattcgctaccaggttttatctctttaagaaagactaccagaaggtgctggaatatgctaaccaggtattccctaacaatgacctggccagcaatatgcgcccatggaatacgacctataaaacactcagtcctgctgccatctgggatacctacgctaaggcaacagaaaaggcgaacctgctgctggtagaaacccagtctatgtatggcaggtatgtagcccaatacagatacggactgacctataataaacagattgaaatactgggtagtaatgtaagcggtggcagctatgcatatccattatactactacggtacaagagattacttcgtaccaaaactgacggagtatttcgtaaaagcatccgtaaacgcaacgatcggagatccttatgtaatgataccgctgttcactacagaagaagtattgtttaacagggcagaagccaatgcttatctcggtaacaataatgacgtactgactgacctgaatctcttcgccagcaaacgtatcactaactacaacgccgcttcacacagaattacacaaactaaaatcaggacctactacggtattaccgatgtaaggggcggtctgctgcaaaccatacttgatttcaaacgtgcagaatatgtacaggaaggacaccgctggtttgatattcaacgctacaaagcagctgttacccattataccgacaaaggtgcaaagatggtactggaaacaggtgataaacgccgtgtattacagatcccgtcttctgctactaattcaggtatcacattgaatccaagataa

SEQ ID NO: 870 - DNA, 1455 bp, Chitinophaga pinensis DSM 2588
atgaaaaagataacttactatataattgctgcaacactgatcacggccgccggttgtaagaaatacctggagcagtcgcccgaccagcgtacacagcttaattcggtggagaaagtagccgagttgttagctactgcttatccgcaggcagactatgccaccttcaccgaagcggcgtctgataatgcagccgacaaaggcaccggtggtttccttacagaacagatcaataccaatccttacttcttccgggatgtgacagaacgggaacaaggctctcctaccaactactggaatgcctgttaccagtctatcgcagcctgtaatcaggcgctggaagcgattgctaaagcagacaatccggaagattataacgcacagaaaggcgaagcattggtggcccgtgcatacaaccactttatgctggtgaccctgttctccaaagtatacaatgccacaacagcagcacaggatcccggtattccttatgtgaccacacctgagaaaattgtcaatgcgaaatatgaaaggaagaccgtcgcctttgtatatgagcagatcgaaaaagacctgttaacgggtttaccgctgctggacaatactgcttataaggtaccaaaataccatttcaacaaagccgcagccaatgccttcgctgcccgtttctacctgttcaaaaaggattatcagaaagtgatcacctattcgaacaatgtattccccggcggaaacttcaaaaccaatctgcgtccctgggtaacggtatacagtcagctgaccggtacagaaatggaggccatctataccaaagcatctgaaacagccaacctcctgctggtagaagcgccttccaactgggcccgttctgtagccagctatcgctatggtttgagaacagacctggtatatggattatatggtgacccgaatgtaacgacaggcagctgggtacagccgctttactaccggggcagtaccgaaaactggctaattctgaaattccgtgaacatttcgtacgctccagcgccaatgctgatatcggggtaccatataccattttcccactcttcacagcggaagaagcattgtttaaccgggcagaggccaatattcacctgggcaacaacacggctgccaaaaaggacctggatgattacgccagcatgcgtatagaaaactataacagtgacttcaggatcacagacacgaagttgaggaccttctacaaaacctccgatataaaaacagcgctgattaatgcattactcgacttcaaacgggcagagttcatgcaggaaggtacccgctggtttgacatcttacgctatgacctacctgttacacataccagtgtaaccggggaatcagctactctgaccgccaatgatccacgtcgtctcttccagttaccacaggaagttgtactggccggcattcaacagaacccccgttaa

SEQ ID NO: 871 - DNA, 1276 bp, Dehalococcoides ethenogenes 195
atggaaatcgggcaatttgagctgagtgaacttgagaagaagactcgtgaagagcttctggatattgccaaggaaatgggtgtaaacggggttactgcccttaaaaagcaggatttggtgatgcgccttattcaggtgtataccgaatcacaggggaatgtattctgttcgggtattctggaaataatgccggacggatacggctttctgcgccaggcatctttactgcccagttcgtcagacatatatgtgtctcagtcccagataccgccgtttcggtcttcgtaccggtgacatggtaatagggcagggacgccctgccaagccgggtgaaaaatattacagtcttctgcgggtggaagccatcaatgaccttaaccctgaaatggccaaacgccgccccaattttggtgctttagttcccactttccctgaccgccttataaacctggaaactacgccgcacgaacttgccacccgccttataaacctgatagcccccatcggccggggacagcgcggccttatcgtttccccgcccaaagccggcaagaccaccattttgaaaaatatagccaatgcaaccgctaccaattataacgatatacatataatggtagtccttataggtgaacgccctgaggaagtaaccgatatgcgccgccacgtacggggtgaagttatggccgccacctttgacgaaccggtggaaaaccagacccgggtagccgaactggcactggaacgggcaaagcgtatggtggaaagcggcaaagacgtctttatcctgctggacggtattacccgccttacccgtgcctacaatctggccatgccttcatcaggccgcaccctttctggcggtattgacccggtcgccctccaccccgccaagaaattcttcggggctgcccgcaataccgaagagggcggttcgcttaccatcattgccacctgtctggtagaaaccggcagccgcatggatgaccttatttacgaagaattcaaaggcaccggcaacatggaacttcatctggagcgccgcctggccgaacgccgtgtcttccctgccctggacatctcccgttcaagcacccgccgtgaggaactcctgctgggtgaaaactacaagcaggtacagcttttgcggaggatggtggctatcatcgctgatgacgccaaccactatacagaggttaacgagcgcgtgctggaccgcctgcgccgctccaagaataatgctgacttcctggctaacctccagaaagaaatgtaa

SEQ ID NO: 872 - DNA, 1278 bp, Deinococcus geothermalis DSM 11300
gtgaccgaaccccagaccgttccccttccctttcacgaactccagcagaagatcctgccggagctgcatctgatcgccgctcagaacggcatcgagaactaccgcaagctgaaaaaggaggctttggccctcgccattctggagcggcaggcggaagccgaggggcaggtgctggcgcgcggcttcctcgacatcagccccgacggctacggatttctccagtcagacctcctggaccccgcctcgagaagcgtgctggtcacggctggggtgatcaagcagtttcacctgcgcaccggcgacgaggtgattggccgcgcgcgtcgcccacgcgagaacgagcgctacggcacgctggtgcaggtggaggcagtcaatggcctggatccggagacagcgcgcaagcgtccgcggtttgacgacctgacgcccacctttccagaccggcaattggtgctggaagacccgcagatggatgacggcctctcgctgcgggtggtggacctgctcgtgcctatcgggcgcgggcagcgggcgctgattgtcgcgccgcccaaagccggcaagacgaccctgctcaaaaagattgccaactcgatcgtcaagaactatcccgacgtgacggtgatggtgctgctggtcgacgaacgccccgaggaggtcaccgactttcgcgagagcgtgcagggcgcgcaggtgatcgcctccaccttcgacgagccgccgcagcaccacgtgcgcgtggcagagtttgtgcatgaacgtgcccggcgcatcgtggaggaaggcggccacgtggtgattctgctcgactcgatcacccgcttggcgcgggcgaacaacctggtgacgccgcccacgggccgcaccctctcgggggggctggactccaatgcgctgcactggcccaagcgcttcctgggtgcggcccgcaacatccgcgaggggggttcgctcaccatcttggcgaccgcgctggtcgagaccggctcgcgcatggacgacgtgatctttgaggaattcaagggcaccggcaatgccgaactggtgctttcgcgccgcctggaggagcgccgcatcttccctgcgctcgacatcctgaagtccggcacccgccgcgaggaactgctgctgcagccggaagtcctgaagaagatgtggctcctgcgcaaggtgatcagcgatatggatcccgccgacgcgatggagatgctgctctcgcgcatgggcaagacgcgcaacaacgtcgaattcctgcagtcgttggcgggcggctga

SEQ ID NO: 873 - DNA, 1290 bp, Moorella thermoacetica ATCC 39073
ttgaatacggccgaactagaaagcaagaccatggtagagctctaccggatagcccgcgagttaaacttgagcggctattcccggatgcggaaaaaagagctggtatttgagattgccaaggccctggcccagaaagagcagcaagaacaccaggaggaggccagggaagaacaactccaggcccagggcatcctggagatactcccggatggttacggatttttacggcccttcggctacctggccagcggcgacgatatctacatctccgcctctcaaatccgtcgcttcgacctgcggaccggggataaggtggccggcctggtccggccacccaaggacaatgaacgcttttttgccctcctgcgggtggagaaggtcaacggggaaaacccggaaacagcagcagaacgccttcactttgatgccctgacccccatctatccctcagagcgctataccctggagacggccaacggcgacccatcggcccggattatcgacctgatagcccctataggcaaaggccagcgggccctcattgtctccccgcccaaagccggcaagacggttctgctcaagaaaatagccaacgccatcaagaccaactaccctgaagtcgaattgatgatcctgctaatcgacgaacgcccggaagaggtcaccgacatcgagcgttcggtccggggcgaggtcatcagttccacctttgacgaattccctgaaaaccacgtcaaagtagctgacatggtcctggaacgggctaaacgcttggtggagcataaaaaggatgtcgtagttctcctggacagcatcactcgcctggcccgggcccacaacctggttgttccccccagcggccgcaccctctccggtggcgtcgatcccacggctctttataaacccaagcgcttcttcggtgccgcccggaacatcgaagagggtggcagcctgaccattgtggccaccgccctgattgagaccggcagccgcatggacgaggttattttcgaagaatttaaaggcaccggtaatatggaactcatcctggaccggaggttggccgagcggcggattttcccggccatcgatgttaaacgttccggcacgcggcgggaggaattgctcctcagccgggaggagctggaactggtctggaacttccggcgggtgagcagcggaatgggcccggtagaggtcaccgagaccctcatcgacgccatgaagaaaaccaagagtaaccaggacctcctgcgcgccctccccgcccttttcccccgggaacattaa

SEQ ID NO: 874 - DNA, 1353 bp, Desulfotomaculum reducens MI-1
ttggctgaaaatgatagacctgtcatgacacaggctcaactggaagcaaagaccatgcaggaattgtatggtattgcccgtgaattagagattccaggttattataaatttcgcaaaaaagaaattatctttgagatatcgaaattacaatcgaagcaaagcggtgtttcctatgccggaggggtactggaaatcctccctgacggatatggctttttaagaccatcaacctatgtacctagcaacgacgatatttatgtatctaactcccagatacgacgatttgatctaagaacaggggatatggtctatggccaggtaaggaagccaaaggataacgagcggtactacggtctgctaagagtagagcaggttaatggtgcaagacccgaacttgcggcggagcgtatgcactttgccggacttacacccctttacccccaggatcgcatccgattacaaaccacccctgataagatttcaactcgcatcatagacctcatttcacccttgggaaaaggacagagaggcttgattgtggctcccccaaaggcaggtaaaaccattttaattaaagaaattgccaatagtattacggctaatcaccctgagattgaattgtttattctactaatcgatgagaggcctgaggaagtaacggatattgaacgatccgttaaagcggaagtagttagttccacctttgatgaaccaccggaaaaccatgtaaaggcctcggatatggttttggagcgggctaaacggctggttgagagcggtcgtgatgtagtgatattgttggatagcatcactaggctggccagggcccataaccttgtcattccccccagtggacgtaccctttcaggcggtgtggatcccgctgcattgcataaacccaaacggttctttggtgcggcccgtaatatggaagaaggcggtagcctgaccatcttagccactgcactaattgaaaccggcagtcgtatggatgatgtaatctttgaagagtttaaaggaaccggcaatatggaactgattttagaccgcaaattagccgatcgcaggttgtttccggccattgatatacaacgttccggcaccaggcgggaagatttgcttttatccaaagaagagttggattatgtctggagccttcgcaaggtcattgccggtatgagttccattgaggcactggaaagtttactggatcgtttgaaaaatacccgggccaatgatgagatactgcatgattttaagcccaagacaagggtacaacccctaaaccctaatttagatgtgtcacagccgccgggacaaaaacgtccctatagaaggaaaatacaggaatag

SEQ ID NO: 875 - DNA, 1275 bp, Dehalococcoides BAV1
atggaaatcggacaatttgaactgagtgaacttgaaaagaagactcgcgaagagcttctggacattgccaaagaaatgggtataaacggggtaactgcccttaaaaagcaggacttggtgatgcgccttattcaggtttataccgaatcccaagggaatgtattttgttcgggtattctggaaataatgccggacggatacggattccttagacaggcatctctcctgcccagctcatcagacatatatgtgtctcagtcccagatacgccgtttcggacttcgcaccggtgatatggtaataggccaagggaggccggccaagccgggtgaaaaatattacagccttctgcgggtggaagccataaatgacctcaaccccgaaatggccaaacgccgcccgaattttggtgctttggttcccacttttcctgaccgcctgataaatctggagacctctcccaccgaacttgccacccgcctcataaacctgatagcccccataggcaggggacagcgcggtcttattgtttccccgcccaaggccggcaagaccaccattttgaaaaacatagctaatgccaccgctaccaattataacgatatacatataatggtagtccttataggtgaacgccctgaagaagtaaccgatatgcgccgccacgtgcggggcgaggtaatggccgccacctttgacgaaccggtagaaaaccagacccgggtagccgaactggcactggaacgggccaagcgcatggtagagagcggcaaagacgtctttatcctgctggacggcattacccgccttacccgtgcctacaacttggccatgccctcatcaggccgcaccctttccggcggtattgacccggtagccctccaccccgccaagaaattcttcggggcagcccgcaataccgaagaaggcggctctcttaccatcatcgccacctgtctggtggaaaccggcagccgcatggatgaccttatttatgaagagttcaaaggcaccggcaatatggaacttcatctggaacgccgtttggccgaacgccgtgtattcccggctttggatataccccgctcaagcacccgccgtgaagagcttctgctgggtgacaactacaagcaggtacagctcctgcggagaatggtagctattatcgctgatgacgctaaccactttacagaggttaacgagcgcctgctggaccgcctgcgccgctccaagaacaatgctgaatttttggctaaccttcagaaggaaatgtaa

SEQ ID NO: 876 - DNA, 1479 bp, Candidatus Desulforudis audaxviator MP104C
ttgtccgcaactgcactggagaataagacgcttgccgaactccaaaatctcgccaaagaactcaaaatcccagcctactaccgttaccggaaaaaggagctgatcgctgaaatagaacggattcaacaagatctccggccgactcgagaggcgtccccgccggaagcagaaccggttccggtgccccccaccgcgctggtggagcagcgacgccaggaaccccgggaggcggcactgcattaccacccgcagactcaaccctacccgcctccgcaccacgacaccggccggatgttaccggaccggagccggttgttccaggcgcaaggctatctggagatcctgccggagggctacgggttcttaaggccgtcccagttcctgccgtcgaacgacgatatctacgtgtcggcctcgcagatccgcaagttcgacctgcgtaccggcgacctggtttcggggcaggtgcggccgcctaaggacaccgagaaatacctggccttgttgcgggtggagaccgtgaacggggaagaggctgccctggccggccggcgccggcacttcgatgagcttacgccgctgtatccccaggagcggctcaccctggagacctctcccgaccgaattgcggcccggatcatcgacctgatctcgccgcttgggaaagggcagcgggggttgatcgtcgcgccacccaaagccggtaagaccacgctcttgaaggagatcgctaacagcatcacgagcaatcacccggaagtggtcctgatgattctcctgatcgacgagcgtcccgaggaagtaaccgatatccagcgttcggttaaggccgaagtcatcgcctccaccttcgacgaaccggcggagaaccacgtccgggtgacggaaatggttctggaacgggccaagcggctcgtagagcacaaaaaggacgtggctatcctgctggacagcatcacgcggctcggacgggcgtacaacctggtggtgcccacttccggccggaccctgtcgggcggggtagacccggcggcgctgcacaagcccaagcgcttcttcggcgcggcccgcaaaatcgaggagggcgggagcctgaccatcctcgcaacggcgcttatcgaaaccggcagccggatggatgaggtcattttcgaggagttcaagggaaccgggaacatggagttgattttggaccggcggatctcggaacggcgcatcttcccggcgattgacgtgcagcgttccggcacgcgtaaggaggaactgctgcttaccagcgatgaactggaactcatgtggtacttccgcaaaaccacaaaccagatgtcctcttcggatgcgatggaacacctgattgaagagatgcggcgtacccgatccaaccgcgatttgctgcgcaacttccaggccttcaagcaggcggccggcgggccgccggaagggtggatgatgccgggccccccgatccaccgcaaatag

SEQ ID NO: 877 - DNA, 1641 bp, Eggerthella lenta DSM 2243
atgagcgaaaccgaagcaaccacggaggctcctgcggccgctcccgtcaagcgacgttccaccagcgtgaaggcgaagacgcagggcaaggccgagggcgcagccactccgggccgcaactcgtcggccacgcgcacgccgcgcaaatcggtgaaggcgggcggcgcgcagcagcaacagccgcagggcggttcgaacaaccgccgccagaacgcctcgaacgccggcaagcagaacaacggcggcagcaatcgccagaagcagggcggcggccagaaccggcagaacaacagccagaaccagcgtcgtcagcgtcgccagcacgacaacaaccgcggcaaccgcgaagtgcagcccagcgtgtcgcgcgaggagctggcgaagctcaaggtggccgagctgcgcgagaaggccgccgagctcaacctcgacgtgacgggcctcaagaaggccgagctggtggaggccgtgttcgaagccagtgtcaaggccgagggcttcatcgaggtgtcgggcatcctcgacatcctggccgacggctacggcttcctccgcacgcagggctacctgcccagcgagacggattgctacgtgggtctttccaccatccgccgcaacggcctgcgcaagggcgatctcgtgtccggtcagacgcgcccggcgcgcgagaacgagaagtacgccgccatccagaaggtcacggccgtcaacggcacgcccgtcgaggagctgggcagccgcgtgcgcttcggcgacctcacgccggtctacccggacgaatgcctcgtcatggagcacggcaagaacaccgtcaccgcccgcgtcatcgacctcgtgtcgcccatcggcaagggccagcgcggactgatcgtcagccccccgaaggcgggcaagaccaccatcctcaaggacatcgccgccgccatcagcgcgaacaaccccgaagtgcacctcatgtgcctgctcgtggacgagcgtcccgaggaagtcaccgacatggagcgctccatcaagggcgaggtcatctcctccacgttcgatatgcccaccgagaaccacatcgccgtgtccgagctggtcatcgagcgcgcgaagcgcctcgtggaatgcggcaaggacgttgtcgtgctgctggactcgctcacgcgcctcgcgcgcgcctacaacctggcgcagccggcatcgggccgcatcctgtcgggcggcgtggactccacggcgctctacccgccgaagcgattcctgggcgctgcgcgcaacatcgagcacggcggtagcctgaccatcctggcctcagccctggtggacacgggctcgaagatggacgaggtcatcttcgaggagttcaagggcaccggcaacatggagctcaagctggatcgcaacctggccgaccgccgcatcttcccggccatcgacccggtggcgtcgggcacccgcaaggaggatctgctgctggagccgcaggaggcgccgctcatctgggccgtgcgccgcatcctcgcgaacacgaacagcaccgaacgcgccatggacatgctgatcaagtcgctcaagcagaccgagacgaaccaggagttcctcgtgcgcacggcgaagaaggcccagcacacaaaggccgacggctcgctggagttctag

SEQ ID NO: 878 - DNA, 1917 bp, Cryptobacterium curtum DSM 15641
atgagcgattctgaaactaccgattctgtgccggaaaaacctgctactccaacacgtcgcaagcgaacaacagcttcaaagtcaaaggatgagtcaccgtccacccagactcgacgccgtcgcacaggcacagaagatctgtctgacgcagcaccttctccttctcgacgtcgccgcagtagtgctgctgatgaaaatgcctctgctgatgcggcatcggcgcgttctacccgtcgtgctgctagtaaagacgctgatcaatctgctccaaataaagtcgatgaaggcacttcaccgtcacaaccagcgcagcagcatcgtcgccgtacgcgccgtatcgaaacaggaactgatgcgccagcagctcatgagtcagcaataccagcttcagagcgtcaggattcgtcttctacaggagaaagacgtccaaaaggccgcgtgaagcggcatcaaagccaaaaccgttttgaacggggcgataatcgtagtgataaccgtacgggtaatgcagctcgttccggtactaattcttctcgttccaacggcaatggtaatcgccaacaaggtaatgggaatggacagaaccgtcggcagcagcgttataaccgtcccgataatgcgtctgcttctcccaagctttcgatagaagacctttcaaagcttaaggttgccgagttgcgtgagaaggctgatgcgctcgatattgactggaaaggcctgcttaaagccgatcttgtcaaagcggtctacgacgcaacgctcaaaaaggatgggttcgtcgaagcagaaggcgttctcgatgtgctggctgatggatatggcttcctgcgcactgaagggtatttgccaagcgagcatgacgtctatgttggcacttcgctcattcgtcgacagcatcttcgtaagggcgatcgcatcacgggtcaaattcgtcccgctcgttcgggcgaaaagtatggcgccctgcagcgtctttacacggtcaatggcattcccgctgatgaagtgggcgaacggccgcgattcaaagacctgacaccggtatatcctgatgagcgacttgtgatggagcatggtcgcacgtctatcacttcgcgtgttatcgatttagcggcgcccattggcaagggtcagcgcggactgattgtctcgccgcccaaggctggcaaaacaaccgttttgaaacagatcgctgcatctattgcgcagaacaatcctgaatgtcacctgatgtgtctgcttgttgatgaacgccccgaagaagtgaccgatatgcagcgttcggtacatggtgaagtaatttcttcaacctttgatatgcctgctgaaaaccacattgcggtggcagaaatggttattgaacgggcaaagcgtctggttgagatgggcaaagatgttgttatcctgctcgacagcatcacgcgtcttgcgcgcgcctacaaccttgcgcagccagcgagtggtcgtattctgtcaggtggtgttgattcaaccgcactgtatcctcccaagcgcttccttggcgcggcgcgcaatatcgagttcggcggcagcttaaccattcttgcttcagctcttatcgataccggttcgaagatggacgaagttatcttcgaagagttcaagggcacaggcaatatggagctcaaactcgaccgcaatctcgccgaccgtcgtatttacccagctatcgatccggtggcttccggtacgcgtaaggaagacttgctgcttgaccagcaagaggcacctcttatttgggcggtgcgtcgtattctggcgaatatgaacaataccgagcgttcgatggatatgctgattaaatcgcttaagcagacggaaaccaatcaggaattcctcttgcgcaccgcgaagaaggcacaggggcgccgtctggaagataatctcgaactgtaa

SEQ ID NO: 879 - DNA, 2058 bp, Slackia heliotrinireducens DSM 20476
atgtctgacaatctgacaccggaagagactgcccccgaggccgtcgaggctcctaagaagcgcactgcccgccgcaccgccaagaaaactgcggaagccgttcccgaggcaaccacgcaggaggtgtctgccgacgccgaacctgtgaaaaagcctcgccgccgtacggtgaagaaggccgacgaggcctccgcggcggaaacgcccgcaacggaagcccctgccgaagaggcgcccaagcgtcgcggacgtccccgcaaagccgtcgcggagcccgcaacggcacctgccgccgaggctcctgcgaccgaaacccctgccgaagaggcgcccaagcgtcgcggacgtccccgcaagacggccgtcaaggagaacccgacagccgaggctgcgcctgaagccgcgcccgaggttgctcccgaggctgcgcctgccatggccgagcctgcagcccagcccgaaactgcagccgactccgccgacgtcgcccctgctcccaccgctgccgaggccgaggccgaagagcggccgctgcccaagcgccgcccccgtgcgcgcgcccacaccgtcgaaaccaagagctccgaagccgctgcagatgcgcaggcccagggcgaatcgcagcccgctgcggattcctccgacggcaagcgccagcagttccagaaacaaaacaagcagaacaagcagcagggcaagcagaacaacaaacagcagcaaaacggcaagcagcagcgccgccagcgccgcaacaacgcccagcccaccggcccctccgtctctctggaagagctcaacgagctcaaggtggccgagctgcgtgagaaggccgagctgctcggcgtcgatttcgctgggttgaagaaggcgtctttggtggaggccgtgttcgaagccacgaagaaggctgaaggcatcttcgaggtcgagggcattctggatatcctccaggacgggtacggattcctgcgcaccggcggctatctgcccggtgagaacgacatctacgttggcacggcactcatccgccgcaacggcctgcgcaaaggcgactacgtcaaggggcagacgcgtccggcgcgcgacaacgacaagtatgccgcgttgcagaccatccactccgtcaacggcaagtccctggacgaccttgcgggacgtccgcgcttcggcgatctgaccccggtgttcccggacgagattctcaagatggagcacggccgcaataccaccacggcccgcgtcatcgatttggtgtcgcccatcggcaagggccagcgcggtctgatcgtgtcgcctccgaaggccggcaagaccaccatcctgaaggatatcgccgctgctatcagcgtgaacaaccccgaggtgcacctcatgtgcctgctcgtcgacgagcgtcccgaggaagtcaccgacatgcagcgctccatcaagggcgaggtcatcgcatccaccttcgacatgcccaccgagaaccacatcgtggtgtccgaactggtcatcgagcgtgcgaaacgcctggtggaggacgggcaggacgttgtcatccttctggacagcctgacccgtctggcccgcgcctacaacctggcgcagcctgcgtctgggcgcattctgtccggtggcgtcgactccgcagccctgtatccgcccaagaagttcttgggcgccgcccgcaacatcgaaggcggcggcagcttgaccatcctggcatcggccctgatcgaaaccggctcgaagatggacgaggtcatcttcgaggagttcaagggcacgggcaacatggagctcaagctcgaccgcaacctggccgaccgtcgcatattcccggccatcgacccggtgcagtccggcacccgcaaggaggacctgctgctcaatccgcaggaggccccgctcatctgggccgttcgccgcattctggccaacatgaacaacaccgagcgtgccacggacatgctcatcaagtcgctgcgccagaccaaggacaaccaggagttcctcatccgcaccgccaagaaagcgcagaccacgcgcaacatggacaacatggagctttag

SEQ ID NO: 880 - DNA, 1311 bp, Desulfotomaculum acetoxidans DSM 771
ttgaaccagtctgatttagaagctaaaacaatggttgagctgtataaaatagccaaggaattggaaatagtcggttactcaaagcttcgcaagaaagaattaatatttgaaattattaaaattaagacggaaaaaaccggattgttgtttgcttccggcgtgttggaaattttacctgacggttatggttttttaagaccgtttaaatatcatccaagttatgatgatatctatgtatccgcctctcagatcaggcgttttgatctgcgaacgggtgaccgcgtaggcggccaggtaagaaagcctaaagataatgaaaggtattttgcgttattgagggtagaacaggttaacgggattgatccccaggttgctgctgaaagaattcattttgacggtttaacccccctatatccccaagaacgaattactctggaaacttcttcggaacgaaaatctacacgaataattgatctaatagctcccttgggtaaaggtcaacgcggcctgattgtagctcctcctaaagcaggtaaaactattctgctgaaaagtatagctaatagcataaccaccaaccatcccgagatcgttctcataatcttgcttattgatgaacgaccggaggaagttacggatatagaaagatctgttaatgcggaagtcgtcagctctacttttgatgagcctccggaaaatcatgtaaaagtggctgatatggttttagagcgggctaaacgcttggttgagcataaaaaagatgtggtaattttgatggacagtattactcgcctggcccgtgctcataacttgattgtgcctcctagcggcagaaccctttcagggggtgttgatccggcagctttgcataaacctaaaaggttttttggtgcagcaagaaagctggaggagggtggcagcctgactattctggctactgcattggtggaaacaggaagtagaatggacgatgttatctttgaagagtttaaaggaaccggcaatatggagctggtattagatcgccgattggctgagaagagaattttccctgccatagatgttcaacgttccggaaccagaaaagaagaacttttgttgacaaaagatgaactagagttaacgtggttcttccgcaagaatattcacgggttgaatccctgggacgcgatggaaatgatgatggaaaaaataagaggcacccagaacaatgcggagttgttgcaaaacttcaagcagtccaggaaagccacccccggccgattaaataaccccgaaatccccaccaataataccagaaagatattataa

SEQ ID NO: 881 - DNA, 1305 bp, Alicyclobacillus acidocaldarius DSM 446
ttggacattcgagaacttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 882 - DNA, 264 bp, Ralstonia solanacearum
atgaagaagcgtctggttttgctgatttccgctgggatgtttctggccggcaatgcactggcacaggacaccatgaagaaagacgagatgggaaaggatgcgatgggacaaagcggaagcatggcgaaagacacgatggggaaggaccataagagcaagagccacaccaagaaaatgcatgagaagggtggcatgagcaaagacgccatgggcaaagacgccatgggcaaggactccatgggcaaggactccacgaagcagtag

SEQ ID NO: 883 - DNA, 282 bp, Dechloromonas aromatica RCB
atgaaaacgatcacttccagcattttcgccgcctgtttgatgcttgtcggcagttccgcttttgccgacgacatgatgaagaaagatgcaatgagcaacgacggcatggccaaggatggcatgaagaaagaaacgatgtccaaggaccatatggccaaggacggtatgaaaaaagatgcgatgaccaaggatgggatgaagaaggacgccatgaagaaagatggcatggcgaaggacccaatggccaaagacgccatgggcaaggacgaaatgaagaaataa

SEQ ID NO: 884 - DNA, 282 bp, Polaromonas JS666
atgaataagctcaccgcaactctgctcgcaacctgcatggccattggctctgtctcggccttcgccgcggacgaaatgaagaaggacgccatgggcaaagatgccatggccatggacgggatgaagaaagacgcgatgtcgcacgacgcgatggcgaaggatggcatgaagaaggatgccatgggcaaagatgccatggccaaggacggaatgaagaaagatgcgatgtcgcacgacgcgatggcgaaggatggcatgaagaaggacgaaatgaagaagtaa

SEQ ID NO: 885 - DNA, 252 bp, Polaromonas JS666
atgaaaacactgaccgcctccctcctgtctgcctgcatgcttttcgccggcgccagcgccatggcacaggacgccatgaaaaaggatgacatgaagaaagatgccatgggcaaggatgccatggctaaagacgccatgaaaaaggatcacatggccaaagctggcatggccaaggacggcatgaaaaaagacgcaatgggtaaagatgctatgggtaaagacgccatggccaaggacgagatgaaaaagtaa

SEQ ID NO: 886 - DNA, 324 bp, Serratia proteamaculans 568
atgagagaaggaaataccatgaaaaagttattcgcagtgatgatgtgcagcgcgttgatgttgggttctatcggtgccaatgctgcagacagcatgagcaaagacgcgatgaaaaaggacaatatgggccagatgtctcatgacggcatggctaaagacggcatgaaaaaagacgccatgaagaaagactgcatgggcaaggattgcatgaagaaagacagcatgagtaaggatgcgatgaaacatgacggcatgaaaaaagacagcatggccaaagacggcatgaagaaagatgaaatgaaaaaggacgccatggggaaataa

SEQ ID NO: 887 - DNA, 315 bp, Delftia acidovorans SPH-1
atgaccaagctcaccaccaccctgctcgccacctgcctcgccctggccggtgccaccacggcattcgctgcggatgagatggcgaaggacggcatgtccaacggagccatgtccaaggattcgatgtccaaggacggaatgaagaaggactccatggccaaggacggcatgaagaaagactccatgtccaaggacgggatgaagaaggactcgatgtccaaggacggcatgcacaaggatggcatgcacaaggacggcatgtccaaggatggaatgaagaaggattccatgggcaaggacgccatgtccaaataa

SEQ ID NO: 888 - DNA, 234 bp, Burkholderia phymatum STM815
atgaaacgactgatgacggcggtatgcttcgccacgctggcgatgggcacgacggctgcatttgcgcaggcgagcggcgcgatgtcgaacgatgcgatgagcaaggacgccatgtcgcatgatgcgatgaaaaaggacaccatgtcgcacgacacgatgaagaagaacagcaagacgaagaagcatgatgcgatgggtatggatcatcccgcatcgggggcgatgtcgcagtaa

SEQ ID NO: 889 - DNA, 303 bp, Gluconacetobacter diazotrophicus PAl 5 JGI
atgtctattcgcaatatcgccattgccgccgctttctcgtccgtcgtcgctctgggtggcgtcgctcacgcacaggacgccatgtcgcacgatgccatggccccgaaacagatggcgccaaactcgatggcacatgacagcatgccgaagaacggcatggcgcataacacgatggccccgaatgcgatgtcgcataacggcatgtctcatgatagcatgaagaagcatggcggcatggcgcatcacggtatgaagaaggacgcgatggccgctccgcaggacagcatggccaagccgaactaa

SEQ ID NO: 890 - DNA, 297 bp, Gluconacetobacter diazotrophicus PAl 5 JGI
atgtccattcgtcatctcatggtcgccgccgcaatatggtccaatatcgccgtcgtcggtacggcagtcgcgcaggacagcatgtcgcgcgatgcgatggcgcatgacggcatggccaggaatgccatgtcgcatgacaaaatggcaccgaatgccatgtcccaagacgccatgcggaaacatgcggacacgacccgccacggcatggagaagaatgcgatgtccggagagtcgatgagccatgacggcatgatgatggcgccgtcgcatgaaaacggcatgtccaggcccaactga

SEQ ID NO: 891 - DNA, 252 bp, Variovorax paradoxus S110
atgaacaagctcactgcaaccctgttcgcaacctgcatcgcctttgccggcgcctcggccttcgccgccgacgacatggcgaaggacggcatggccaaggattccatggccaaggacggcatgaagaaggattcgatggcgaaggacgccatgtccaaggacggcatgaagaaagacggcatgtccaaggacggcatgaagaaggacggcatgtccaaggacgcgatgggcaaggacgagatgaagaagtaa

SEQ ID NO: 892 - DNA, 903 bp, Acidovorax sp. JS42
atgccggtgatgcgcagcacgccggatgcgggcagcagccagcgtgccgtgcacgcctggctgctgctgcttccggcactggtcctgttggtggccttcacgcactggcccacgctggccacgctgatcgacagcttccattccacgccccgcggcggccgtgcgggggtgtgggtggggctggagaactatgcggccatggtggacgaccccgtgttctggcaggccgtgcgcaacaacctgtggttcgctggcgcgaccattccgctgtccatcggcttggcgctgatcatggcgctgtgggtgaacgaacggatggtggggcgcacctgggtgcgcatggcgtacttcacgcccaccgtgctgccgatgatcgccgtggccaacgtctggttgttcttctacacgccgcagtacgggctgctggagcagatcaccagcctgctcgggctgccgtcgcgcaactggctgggcgacccggccacggcgctggcttgcgtcacggtggtggcggtgtggaaggaggcgggcttcttcatgatcttctatctggccgcgctgcagacgctgaaccccagcctgaaggaggccgcggccatcgagggcgcgtcgcgctggtacttctttcgccgcgtgcagtggccgctgctcatgcccaccacgctgttcgtgctggtcaatgccgtgatcaacgccttccgtctggtggaccatctcttcatcctcacgcgcggcgggccggacaacgcttccacgctgctgctgtaccacctgtacgaggtgggcttcaagttttgggacacgggctatgccgcggcgctcacggtggtgctggtggtggcgctggccggcgtggcgctggtgcagttcttcgtgttcgacaaacgggtgcattaccagtga

SEQ ID NO: 893 - DNA, 873 bp, Mycobacterium tuberculosis F11
atgcgcgacgcgccacgtcggaggacggcactggcatatgccctgctggcgcccagcctggtgggcgtggtcgccttcttgttgctgcccatcctggtggtggtatggctgagcctgcaccggtgggacttgctgggcccactgcgctacgtcggcctgaccaactggcggtcggtgctgaccgattccggcttcgcagactcattggtggtcaccgccgtcttcgtggcgatcgtggtcccggcgcagacagtactgggactgctggccgcgtccctgctggcccggcgactgccgggcaccggcctgttccgcacgctgtacgtgctgccctggatctgtgcaccgctggcgatcgcggtgatgtggcgctggattgtggcgcccaccgacggcgcgatcagcactgtgctcggacaccgcatcgaatggctcaccgatccaggcctcgcgcttcctgtggtttcggccgtcgtggtgtggaccaacgtcggatatgtctcgttgttcttcctagccggattaatggcgattccgcaggacattcacaacgccgcacgcaccgacggcgccagtgcctggcagcgcttctggcgcatcaccctgcccatgttgcggcccaccatgttcttcgtcctggttaccggaatcatcagcgccgcacaggttttcgacaccgtctacgcgctgactggcggtgggccgcagggcagcaccgacctggtggcccaccgcatctacgccgaggcgtttggggccgcggcaatcgggcgggcatcggtgatggcggtggtgctgttcgtcatcctggtcggtgccaccgtggtgcagcatctgtatttccggcggcggatcagctatgagctcacctag

SEQ ID NO: 894 - DNA, 891 bp, Opitutus terrae PB90 1
atgatcgcctggaaacaatcacagcgccgcgcggcgccctggtttctcctgccggcgctggcactgctcggcgtgttcgtcgtctggccgctgctgcgcgcgctcgggtggagtttcaccaacgccgacctgctcgccgtcgagcgcgccacgtgggtcggagccggcaactactccgatctgctgacggatccgcggtttcgccaggccttcgccaataccgctcttttcgccgtgatggtcgtgcccgtgcaaaccgcgctcgcgttcgcgctcgcgctgtgggtgaaccgtcccgagccggcgtggcgctggctgcgcaccgcgtttttcgtgccggtgatcgtcgcgatgccggtactcgcggtgctctggaccatgctgtaccagccaacgcagggcgatcagacaggactgatcaacgcggcgctcggctggctgggcgtgcccccacaagcctggctgcgtgatcccgcgctggcgctgccggcgctggcgttcatgtccgtatggcaaggcgtcgggctgcagatgctcgtgtttgttgccggactgcagcaagtgccgcgcgagttgctggacgccgcgcggatcgacggcgcgggcggctggcagcggctggtgcatgtggtgctgccgtcggtgcgcaacacggtggtcttcgtggtcacggtcaccaccatcctcgcgttccggattttcgtgcagccgtatctgatgacacgcggcggccccggcaaccgcaccgtctcgatcatacagtcgatctacgagatgacgtttctcgatcaggatctgggccacgcctgcgccgccgcgctgctgttcctgttgctcgtcgccgcgctgacgctgctgcagcggcgctggctgaaggaggatcgcggatga

SEQ ID NO: 895 - DNA, 867 bp, Methylobacterium sp. 4-46
atgcggccgtcgctccgcccgctcctgccctacgggctcctgctcccctcgctgatcttcctcgccctcttcacctactggccggtcgccgaggtgctgtgggacgccacccacgcggtctcgcgccggaccacccgcttcgtcgggctcgacaatttcgcggcgctgttcgccgatccctcgttccggacctcgctcctccagaccgggctctacgccctcctgacagtggtcccgagcctcgtcctggcggtcgccctcgccctcgccctcgacggcggcgggcgcctgcgggcgctcctgcgcgccgcgttcttcctgccggtgatgatcccgctcgtcggcgcggcggccctgttcctgttcctgcccggcaccgggctgatcgactaccatctcgccaagctcggcctctcgggcgccaactggctcggcgacccggacctcgcgctcctgtcgatcgccgccctgacggtgtggaagaacgccggctactacatgctcttcgtcctggcgggcctgcaggcgatcccggcggagctgcgcgaggccgcgctcctcgacggggcggggccctggcagcgcctgcgcttcgtcatcctgcccgccctgcggccgacgctcgccttcgtcctcgtcatcgccctcctcaacgtggtgacgcaggtcgaccacgtcttcgtgctcaccaggggcgggccctcggacgccaccaagctcttcctgttgtacatctacgagcaggccgtggagcgctacgacggcggccgggccgccgccgcgaccgttgtgatgctggcgatcctgatcgcgctcaccgccgcctccctgcgccgggtcgagcgccggtcggaggaggcgccgtga

SEQ ID NO: 896 - DNA, 903 bp, Diaphorobacter TPSY uid29975
atgccggtgatgcgcagcacgccggatgcgggcagcagccagcgtgccgtgcacgcctggctgctgctgcttccggccctggtcctgttggtggccttcacgcactggcccacgctggccacgctgatcgacagcttccattccacgccccgcggcggccgtgcgggggtgtgggtggggctggagaactatgcggccatggtgcacgaccccgtgttctggcaggccgtgcgcaataacctgtggttcgctggcgcgaccattccgctgtccatcggcctggcgctgatcatggcgctgtgggtgaatgaacgcatggcgggacgcacgtgggtgcgcatggcgtacttcacacccaccgtgctgccgatgatcgccgtggccaacatctggctgttcttctacacgccgcagtacgggctgctggagcagatcaccagcctgctcgggctgccgtcgcgcaactggctcggcgacccggccacggcgctggcctgcgtcacggtggtggcggtgtggaaggaggcgggcttcttcatgatcttctacctggccgcgctgcagacgctgaaccccagcctgaaggaggccgcggccatcgagggcgcgtcgcgctggtacttctttcgccgcgtgcagtggccgctgctcatgccaaccacgctgttcgtgctggtcaatgccgtgatcaacgccttccgtctggtggaccatctcttcatcctcacgcgcggcgggccggacaacgcttccacgctgctgctgtaccacctgtacgaggtgggcttcaagttttgggacacgggctatgccgcggcgctcacggtggtgctggtggtggcgctggccggcgtggcgctggtgcagttcttcgtgttcgacaaacgggtgcattaccagtga

SEQ ID NO: 897 - DNA, 879 bp, Beutenbergia cavernae DSM 12333
gtgagcacacggcggcgcgccgacaccgcggccgcgtacgccctgctcacgcccagcctcatcggcgtcggactcttcctcctggtgcccgtcgtcatcgtcatcggcatctcgttcacccggtgggacctcgtctcgccgccgcagtgggtcgggctcgacaactacgtctacatcttcggctggccaacgttccggaactccctgtgggtctccgtcctgttcacagcactgaccatcccgacgacgatcgcgctcggcctgatcctcgccgtcgccatcaaccgccgcctcccgggcacgaacgcgctccgcgtgctgtacgtgctgccgtgggtctgcgccccgctggcgctcggcgtcgtctggcgctggatcttcgaccccacgaacggcgcgctcaacgccctgctcggccggcgcgtcgagtggctgaccgacctcaacctcgccctgccgtccgtggcgttcgtgcaggtgtggtcgagcgtcggctacgtctcgctgttcttcctcgctggcctgcagcagatcccgaaccaggtgtacgaggcggcgcggctcgacggcgcgagcgccccccgcaccctgtggtcgatcaccgtgccgctcctgcggccgaccatgttcttcgtcctcgtcacgagcatcatcagctcgttccaggtcttcgactcgatctacgccatgacgcgcggcgggccgggcgtcccgggccgcaccgacgtcatcgcggcccgcatctacgacgaggcgttcgtcgcccttcgcctcggccgcgccgccgcgatggcggtcgtgctgttcgccgtcctcgtgacgatcacgctgctgcagcagcgctacttccgccgccgcatcacctacgacatgtcgtga

SEQ ID NO: 898 - DNA, 864 bp, Brachybacterium faecium DSM 4810
gtgaactctcgcagacctctgctgggctggctgctcgtcggccccagcctgatcggcgtcgccgccttcatgatcctgcccgtggtgctggccttcgtggtctccctgttccgctgggacctgctgggcacgcggcggttcatcggcctggagaactaccagacgctgatcaccggcggcgcgctcggcaactcgctgctggtcaccgggatcttcaccctcatctcggtgccggtctcgctcgcgatcgggctgctgctggccacccagctggtgcgcaccctgccgggctcggcgatcgtgcgggtgctggtggtgatcccgtgggtgtgcgccccgctcgccctcggcgtggtgtggaagtggatcttccagccgtcggtgggggcgctgaaccagatcctgggcgtgcgcatcgaatggctgaccgatccgagcctcgccctgccggcggtggcgttcgtggcgatctggcagaacgtcggctacatctcgctgttcttccaggccgggctcacccgcatcccggattcgatctacgaggccgcccggatcgacggggccgcgccctggcagtcgatgctgtacatgacgatcccgctgctgcgccccaccacgttcttcctcgccgtcacccaggtggtggcgagcttccaggtgttcgacatggtcttcgccctcaccggcggcgggccgcagcaccgcaccgaggtcatcgcctcgctgatctacaacgaggccttcgtggccagccgcctgggccgcgcgagcgccgtcgcggtgatcctgttcctcctgctggtggtgatcacgctgatccagcagcgctggttctccaagcgcatcacctacgacatgagctga

SEQ ID NO: 899 - DNA, 1251 bp, Ralstonia solanacearum
ttgaaatttccatacgaatggcagatcggctggcgttacacgcgcgcgagcaagcgcgccagccgcaacagcttcatttccttcatctcgctcatctccatgctcggcatcgcgctgggcgtggccgcgctgatcgtcgtgctgtcggtcatgaacggcttccagaaggaggtgcgcgaccgcatgctgtcggtgctgtcgcacatcgagatcatggcgccgggcagcctgcccgactggcagcgcaccgcgaatgaggcgatgcagaacaaggaggtcgtgggcgcggcgccgtacgtgggcgcgcaggccatgatcacgcgcgacgacgcggtgcgcggcgtgctgctgcgcggcgtgtcgccggccgacgagcccaaggtgtcggacatcgccaaggatttcaagtcgggcaccatcgacgatctccggcccggcgaattcggcatcgcgctgggcgccgagatggcgcgcggcctgggcgtgcgccagggcgacaaggtcacgctggtggccccgcagggcaccatcacgccggcgggcgtgctgccgcgcctgaagcagttcaccgtgatcggcacgttcgaatccggccactacgagttcgacagctcgctcgccctcatcaacatggaggatgccgagcggctgttccggctgaccggcccgaccggcgtgcgcctgaagctggtcgatatgcagcgcgcgccgcaggtggccgaggcgctgtcgcgcacgctgaccggcgagctgtacatccgcgactggtcgcgccagaacaagaactggttcgccgccgtgcagaccgagaagaagatgatgttcatcatcctcacgctgatcatcgcggtggcggcgttcaacctggtctccacgctggtgatgacggtgaccgacaagcaggccgacatcgccatcctgcgcacgatgggcgcgcagccgggctccatcatgaaaatttttattgtgcagggtgtggcgatcggctttattggtacccttttgggcgtgctgttcggcacgctgatcgcttacaacatcgacgtgatcgtgccggccatcgagcatctcttcggcgtgcaattcctgcccaaggacatctacttcatcagcgaactgccctcggacccccgcgtgaacgacatcgcaaccatcggcctcatttccttcgtgctcgcctcggtggcgacgctgtatccgagctggcacgcctcgcgcgtgaacccggcggaggcgctgcgctatgagtga

SEQ ID NO: 900 - DNA, 1251 bp, Ralstonia eutropha JMP134
ttgaaatttccctacgagtggcagattggctggcgatacacccgcgcaagcaagcgcgccagccgcaatacgttcatatcgttcatctcgatgatctcgatgctcggcatcgcgctgggcgtggccgcgctgatcgtggtgctgtcggtgatgaacggcttccagaaggaagtgcgcgaccgcatgctctcggtgctgtctcacatcgaggtgatcggcccgtcggcgctgcccgactggcagcgcaccgcggcagaggccatgcggaacaaggaagtcatcggtgccgcgccgtacgtggccgcccaggccatgctcacgcgcgaggacgctgtgcgcggcgtgctgctgcgcggcgtggacccggcggaagaaccgaaggtctcggacatcggcaagcagttcaaggctggccatatggaaagcctgcagccgggtgagttcggcattgcgctcggcaatgaactggccaacgccatgggcgtgcaggtcggcgacaagatcacgctgctggcgccgcagggcaccatcacgccggccggcgtgttgccgcggctgaagcagttcaccgtggtcggcgtgttctcttcgggccatttcgaattcgacagcgcgctcgcgctcgtcaatatccgcgatgccgagacgctgttccgcatgaccggcccgaccggcgtgcggctgaagctcgcggacatgcagcgtgcgccgcaggttgccaacgaactggccggcacgatgtcgggcgagctttatctgcgcgactggtccaagcagaaccgcaactggttcgcggccgtgcagaccgagaagcgcatgatgttcatcatcctgacgctgatcatcgccgtcgctgcgttcaacctggtgtcgacgctggtgatgaccgtgaccgacaagcaggctgacatcgccatcctgcgcacgatgggcgcgcaacccggttcgatcatgaagatcttcatcgtgcagggcgtggccatcggctttatcggcacgttgctgggcgtcgcgggcggcacgctgatcgccaccaatatcgacgtgatcgtgcctttcatcgagcggctgctgcacgtgcagttcctgccgcgcgacatctatttcatcagcgaactgccttcggacccgcgtgtgaacgatatcgccaccatcggcatcatttccttcgtgctggccacgctggcaaccctctacccaagctggcgcgccgcccgcgtcaatccggcggaggcgctgcgctatgagtga

SEQ ID NO: 901 - DNA, 1251 bp, Cupriavidus metallidurans CH34 uid250
ttgaactttccttacgaatggcagatcggctggcgctacacccgcgcgagcaagcgcgccagccgcaatacgttcatttcattcatttcgatgatttcgatgatgggcatcgcgcttggcgtggccgccctgatcgtcgtgctctcggtcatgaacggcttccagaaggaagtgcgcgatcggatgctgtcggtgctgtcgcacatcgaagtcatcggcgccgcgccgctgacggactggcagaagacggccgccgaggccctgcgcaacaaggaagtggtgggcgccgcgccgtatgtggcggcccaggccatgatgacgcgggaagacgtggtgcgcggcgtgctgctgcgcggcgtggaccccgccgaagagcccaaggtgtcggatatcgccaaccaatttcgcgccggcagcatgaacgcgctggcgccgggtgggttcggcatcgcactcggcagtgaactggccaatgcactgggcgtgcgcgtgggcgacaaggtgatgctggtggtgccgcaaggcacgatcacgccggccggaatgctgccgcgcctcaagcagttcaccgtggccggcgtgttctcgtcgggtcactacgagttcgatagcgcgctggcgctgatcaacatcggcgatgcggaaacgctgttccgccagagcggacccacgggcgtgcgactgaaactgcaggacatgcagcgcgcgccgcaggtggcccaggagctggcgggcaccatgagcggcgacctctacctgcgcgactggtcgaagcagaaccgcaactggttcgccgccgtgcagaccgaaaagcgcatgatgttcatcatcctgacgctgatcatcgccgtggccgcgttcaacctggtgtccacgctggtcatgaccgtgactgacaagcaggccgacatcgcgatcctgcgcacgatgggcgcccagccgcgctcgatcatgaagatcttcatcgttcaaggcgtggccatcggcttcatcggcaccttgctcggcgtattgggcggcacgctgatcgccaccaatatcgacgtgatcgtgcctttcatcgagcggatcctgcatgtgcagttcctgcccaaggacatctacttcattagcgaattgccttcggacccgcgcatgaacgacatcgctaccatcggtatcatttccttcgtgctggcgtcgctggccacgatctacccgagctggcgcgcctcgcgcgtgaacccggcggaggcgctgcgctatgagtga

SEQ ID NO: 902 - DNA, 1284 bp, Ruegeria sp. TM1040
atggctgcgactgcgcctttttcccgtttcgaatggatgattgcctggcgctatctgcgcgcccgccgcagcgaaggcggtgtctcggtgatgacctggatttcccttattgggatcacactggcggtctttgcgctgatcgccacccttgcggtgcgctcgggctttcggtcggaattcgtgggcaccattctgggcgccaatgcccatgccacggtctatgctcatggcacggtcacggcggctggcacgctggatcgacgcatcaccgattatgcggcattggctgaggcagtggggcaggtgcccggcgtgttgcaggccgcgcccttgatcaaggggcaggtgatggccagccggggggatcgcaacgccggcgtgcaggtctatggcatccacgccgaagacctggccaaaattccgggtgttgcccaaagcgacgtggcctatggcgatcttggccgctttgacgacggcatcgcgcttggctccggtgtggcccgcacgctgggccttgggatcggggacaaggtcaagctgatctcacccaacggggtcaagaccgcctttggcaccagcccgcgcgtgaatgcctatgaggtggtctatgtctttaccgcagggcgctatgacatcgacaacacccgcgcctatctgccctttgccgaggcgcagagctatttcaaccgcgaaggtgttgccgacgagatcgaggtcatggtggccgatcccgaagctgtcgatcaatatgtgctgcctttgctgcaggccgcagggcagggatatggcgtctggagctggcgcgacagctccggcgggtttctgcgcgccctggaggtcgaggacaacgtgatgttcgtgatcctgtcgatcctggtgctgatcgcgacgatgaacatcgtctctggcctcatcatgctggtgaaaaacaagggccgggacatcggcatcctgcgtaccatcggcctcagcgaagggtcggtgatgcgggtgttcttcatctgcgggtcgatcaccggcgtgatcggcaccgtgctgggcgtgatcctcggctgcctttttgcgatatatatcgacccgatcttttcttttgtgaactatgtgatgggcggcggggtctgggatccgtcgatccggggcatctatgcactgcctgcggaactgcgcgcaggcgatgtgatctcggccgtgagtctgtcgctgggcttgtcgtttgtcgtgaccatcttcccggcccgacgtgcggcacggctcaacccggtggaggcgctgcgctatgagtga

SEQ ID NO: 903 - DNA, 1287 bp, Rhodobacter sphaeroides 2 4 1
atggctgaccggacgcggccctttgcggccttcgaatggatgatcgcctggcgctatctgcgcgcccgccgcgccgagggcggcgtctcggtcatgacctggatcagcctcgtggggatcacgctcgccgtcttcgcgctgatcgcgacgctctcggtccgcgcgggcttccgcgccgagttcgtggacacgatcctcggcgcgaatgcccatgtcaccgtctattccgccggccgcatcaccgagacgggccagctgatccgcggtttcgaggactacgatccggtggccgcgcgcgtggccgccgtgccgggcgtgctgcgggcggcgccggtggtgaaggggcaggtgatggccaccgccaatggcgcctcctcgggggtcgaggtgttcgggatgcggcaggccgaccttgccaccatcccgcgcatcggcatcggggccgagcatgtgggagacatcgagcgtttcgacgagggcatcgcgctcggctcgggcgtggcgcaggagctgggagtgagcgtgggcgaccgcgtgcggctgatctcgcccgacggggtgaagacggccttcggcacctcgccccgcgtctcggcctacgaggtggtctatgtcttcaccgccgggcggtacgacatcgaccgcacccgggtctacatgccgctcgccgaggcgcagagctacttcaaccgcgagggcctcgccgacgagatcgaggtgatggtcgaggatcccgaggcggtggatgcgatggcgcccgcgctgatgcaggcggcgggcgagggctcgatgctctggacctggcgcgattcggcgggctcgttcctgcgcgccctgaccatcgaggacaatgtgatgttcgtgatcctgtcgatcctcgtgctgatcgcctcgatgaacatcgtctcggggctcatcatgctggtgaagaacaagggccgcgacatcggcatcctgcgcaccatggggctgaccgagggctcgatcctgcgggtcttcttcctctgcggcgcctcgaccgggctgatcggcacggcggcgggggtggcgctgggctgtctcttcacgatctacatcgatccgatcttctcgctcgtgaactacctctcgggaggcggcgtctgggatccctcgatccgcggcatctatgcgctgcccgcgaagctgcaatgggcggatgtcttgtcggcggtggcgctgtcgctgggcctgtccttcttcgtcacgctgatccctgcgcgccgtgcggcccgcatgaacccggtcgaggcgctgcgctatgagtga

SEQ ID NO: 904 - DNA, 1302 bp, Paracoccus denitrificans PD1222
atggccagcaccgccccgttttcgcgttacgaattcatgatcgcctggcgctatctgcgcgcccgccgcgccgagggcggggtcagcgtgatgacctggatcagcctgatcggcatcaccctgggcgtgatggcattggtcgccacgctggcggtgcgcgccggtttccgggccgagttcgtcgacaccatcctgggcgccaatgcccatagcaccgtctattacgcgcccacgcaggtctataacgagctgaccgaagagacctatgtcacccagggccggatcgaggattacgacgcgctggccgccaggatcgcgcagatccccggcgtgacccgcgccgttccggccgttcgcgcccaggtcatggcgcggcagggcgatgcggccgccttgggcgatgtgcatggcatcacgctcgatgcgctcggggggatggcgggcattgccgatcccgagagcgcgtcgggcagcctggacgatttcgaccaaggcatcgccatcggcatcggcatggcgcgcaacctgggcgttcggatcggcgaccggctgcaactggtcgcgcccgatggtgccaagacccccttcggcaccacgccgcgggtcgaatccttcgaggtcgtctatatcttctcggcgggacgctatgacgtggaccaggcccgcatctacatgccgctggccgaggcgcagagctttttcaaccgagaggggcttgccgacgagatcggggtctatgtcgccgatcccgagcgggtcgacgactggaccatgccgctcttgcaggtcctgggcgagcgggggcagatctggacctggcgcgatgcttcgggatcgttcctggccgcgctcgacatggaggatgacgtgatgttcatcatcctgtcgatcctggtgctgatcgcctcgatgaacattacctcggggctgatcatgctggtcaagaacaagggtcgcgacatcggcatcctgcgcaccatggggctgaccgagggctccgtcctgcgggtctttttcctctgcggcgcctttaccggggtgatcggcaccatcgccggcgtggtgctgggcgtgcttctgtcgctgaatgtcgatcacatcatggcggcgctgaacatgctgaccggcggcaatgcctggcagcccgaggtgcgcggcatctaccagctgactgccgaattgcggggctgggacatcttccgggcggcggcgctgtcgctggccctgtccttcatcgtcaccatcttccctgcgcgccgcgctgcgcgcatgaacccggtagaggcgctgcgctatgagtga

SEQ ID NO: 905 - DNA, 1254 bp, Burkholderia mallei SAVP1
ttgaaactcccgtacgaatggcagatcggctggcgctacacgcgcgccggcaaacgcacgaccggcaacggcttcatttccttcatcgcgctcgtgtcgatgctcgggatcgcgctcggcgtcgcggcgctcatcgtcgtgctgtcggtgatgaacggcttccagaaagaggtgcgcgaccggatgctgtcggtgctcgcgcacgtcgagatcttctcgccgacgggctcgatgcccgactggcaactgaccgcgaaggaagcgcgcctgaaccgctcggtgatcggcgcggcgccgtatgtcgacgcgcaggcgctgctcacgcggcaggacgcggtgagcggcgtgatgctgcgcggcgtcgagccgtcgctcgagccgcaggtgtccgacatcggcaaggacatgaaggcgggcgcgctcacggcgctcgcgcccggccagttcgggatcgtgctcggcaacgcgctcgcgggcaatctcggcgtgggcgtcggcgacaaggtcacgctcgtcgcgccggaaggcacgatcacgccggccgggatgatgccgcgcctgaagcagttcacggtggtcggcatcttcgagtccgggcactacgaatacgacagcacgcttgcgatgatcgacatccaggatgcgcaggcgctcttcaggctgcccgcgccgacgggcgtgcggctgcgcctcacggacatgcagaaggcgccgcaggttgcgcgcgagctcgcgcacacgctgtcgggcgacctgtacatccgcgactggacgcagcagaacaagacgtggttctccgcggtgcagatcgagaagcggatgatgttcatcatcctcacgctgatcatcgcggtcgcggcgttcaatctcgtgtcgtcgctcgtgatgaccgtgacgaacaagcaggcggacatcgcgatcctgcgcacgctcggcgcgcagccgggctcgatcatgaagatcttcgtcgtgcagggcgtgacgatcggcttcgtcgggactgcgacgggcgtcgcgctcggttgcctgatcgcatggagcattccgtggctcattccgatgatcgagcatgcgttcggcgtgcagttcctgccgccgtcggtgtacttcatcagcgagctgccgtccgagctcgtcgcgggcgacgtgatcaagatcggcgtgatcgctttcgcgctgtccgcgctcgcgacgctctatccgagctggcgcggcgcgaaggtgcgcccggcggaggcgctgcgctatgaatga

SEQ ID NO: 906 - DNA, 1287 bp, Rhodobacter sphaeroides ATCC 17029
atggctgaccggacgcggccctttgcggccttcgaatggatgatcgcctggcgctatctgcgcgcgcgccgcgccgagggcggcgtgtcggtcatgacctggatcagcctcgtggggatcacgctcgccgtcttcgcgctgatcgcgacgctctcggtccgcgcgggcttccgcgccgagttcgtggacacgatcctcggcgcgaatgcccatgtcaccgtctattccgccggccgcgtcaccgagacgggtcagctgatccgcggcttcgaggactacgacccggtggccgcgcgcatgggcgccgtgccgggcgtgctgcgggcggcgccggtggtgaaggggcaggtgatggccaccgccaacggcgcctcctctggtgtcgaggtgttcgggatgcggcaggccgaccttgccaccatcccgcgcatcggcatcggggccgagcatgtgggcgacatcgagcgtttcgacgagggcatcgcgctcggctcgggcgtggcgcaggagctgggggtgagcgtgggcgaccgcgtgcggctgatctcgcccgacggggtgaagacggccttcggcacctcgccccgcgtctcggcctacgaggtggtctatgtcttcaccgcgggccgctacgacatcgaccgcacgcgggtctacatgccgctcgccgaggcgcagagctacttcaaccgcgagggccgcgccgacgagatcgaggtgatggtcgaggatcccgaggcggtggatgcgatggcgcccgcgctgatgcaggcggcgggcgagggctcgatgctctggacctggcgcgattcggcgggctcgttcctgcgcgccctgaccatcgaggacaatgtgatgttcgtgatcctgtcgatcctcgtgctgatcgcctcgatgaacatcgtctcggggctcatcatgctggtgaagaacaagggccgcgacatcggcatcctgcgcaccatggggctgaccgagggctcgatcctgcgggtcttctttctctgcggcgcctcgaccgggctgatcggcacggcggcgggggtggcgctgggctgtctcttcacgatctacatcgatccgatcttctcgctcgtgaactatctctcgggcgggggcgtctgggatccctcgatccgcggcatctatgcgctgcccgcgaagctgcaatgggcggatgtcttgtcggcggtggcgctgtcgctgggcctgtccttcttcgtcacgctgatccccgcgcgccgcgcggcccgcatgaacccggtcgaggcgctgcgctatgagtga

SEQ ID NO: 907 - DNA, 1254 bp, Burkholderia mallei NCTC 10247; identical to SEQ ID NO: 905

SEQ ID NO: 908 - DNA, 1254 bp, Burkholderia pseudomallei 668
ttgaaactcccgtacgaatggcagatcggctggcgctacacgcgcgccggcaaacgcacgaccggcaatggcttcatttccttcatcgcgctcgtgtcgatgctcgggatcgcgctcggcgtcgcggcgctcatcgtcgtgctgtcggtgatgaacggcttccagaaagaggtgcgcgaccggatgctgtcggtgctcgcgcacgtcgagatcttctcgccgacgggctcgatgcccgactggcaactgaccgcgaaggaagcgcgcctgaaccgctcggtgatcggcgcggcgccgtatgtcgacgcgcaggcgctgctcacgcggcaggacgcggtgagcggcgtgatgctgcgcggcgtcgagccgtcgctcgagccgcaggtgtccgacatcggcaaggacatgaaggcgggcgcgctcaccgcgctcgcgcccggccagttcgggatcgtgctcggcaacgcgctcgcgggcaatctcggcgtgggcgtcggcgacaaggtcacgctcgtcgcgccggaaggcacgatcacgccggccgggatgatgccgcgcctgaagcagttcacggtggttggcatcttcgagtccgggcactacgaatacgacagcacgcttgcgatgatcgacatccaggatgcgcaggcgctcttcaggctgcccgcgccgacgggcgtgcggctgcgcctcacggacatgcagaaggcgccgcaggtcgcgcgcgagctcgcgcacacgctgtcgggcgacctgtacatccgcgactggacgcagcagaacaagacgtggttctccgcggtgcagatcgagaagcggatgatgttcatcatcctcacgctgatcatcgcggtcgcggcgttcaatctcgtgtcgtcgctcgtgatgaccgtgacgaacaagcaggcggacatcgcgatcctgcgcacgctcggcgcgcagccgggctcgatcatgaagatcttcgtcgtgcagggcgtgacgatcggcttcgtcgggaccgcgacgggcgtcgcgctcggttgcctgatcgcatcgagcattccgtggctcattccgatgatcgagcatgcgttcggcgtgcagttcctgccgccgtcggtgtacttcatcagcgagctgccgtccgagctcgtcgcgggcgacgtgatcaagatcggcgtgatcgctttcgcgctgtccgcgctcgcgacgctctatccgagctggcgcggcgcgaaggtgcgtccggcggaggcgctgcgctatgaatga

SEQ ID NO: 909 - DNA, 1254 bp, Burkholderia pseudomallei 1106a
ttgaaactcccgtacgaatggcagatcggctggcgctacacgcgcgccggcaaacgcacgaccggcaacggcttcatttccttcatcgcgctcgtgtcgatgctcgggatcgcgctcggcgtcgcggcgctcatcgtcgtgctgtcggtgatgaacggcttccagaaagaggtgcgcgaccggatgctgtcggtgctcgcgcacgtcgagatcttctcgccgacgggctcgatgcccgactggcaactgaccgcgaaggaagcgcgcctgaaccgctcggtgatcggcgcggcgccgtatgtcgacgcgcaggcgctgctcacgcggcaggacgcggtgagcggcgtgatgctgcgcggcgtcgagccgtcgctcgagccgcaggtgtccgacatcggcaaggacatgaaggcgggcgcgctcaccgcgctcgcgcccggccagttcgggatcgtgctcggcaacgcgctcgcgggcaatctcggcgtgggcgtcggcgacaaggtcacgctcgtcgcgccggaaggcacgatcacgccggccgggatgatgccgcgcctgaagcagttcacggtggtcggcatcttcgagtccgggcactacgaatacgacagcacgcttgcgatgatcgacatccaggatgcgcaggcgctcttcaggctgcccgcgccgacgggcgtgcggctgcgcctcacggacatgcagaaggcgccgcaggttgcgcgcgagctcgcgcacacgctgtcgggcgacctgtacatccgcgactggacgcagcagaacaagacgtggttctccgcggtgcagatcgagaagcggatgatgttcatcatcctcacgctgatcatcgcggtcgcggcgttcaatctcgtgtcgtcgctcgtgatgaccgtgacgaacaagcaggcggacatcgcgatcctgcgcacgctcggcgcgcagccgggctcgatcatgaagatcttcgtcgtgcagggcgtgacgatcggcttcgtcgggaccgcgacgggcgtcgcgctcggctgcctgatcgcatcgagcattccgtggctcattccgatgatcgagcatgcgttcggcgtgcagttcctgccgccgtcggtgtacttcatcagcgagctgccgtccgagctcgtcgcgggcgacgtgatcaagatcggcgtgatcgctttcgcgctgtccgcgctcgcgacgctctatccgagctggcgcggcgcgaaggtgcgtccggcggaggcgctgcgctatgaatga

SEQ ID NO: 910 - DNA, 1287 bp, Rhodobacter sphaeroides ATCC 17025
atggctggccggacgcggccctttgcggccttcgaatggatgatcgcctggcgctacctgcgcgcgcgtcgcgccgagggcggggtctcggtcatgacctggatcagcctcgtgggcatcacgcttgcggtcttcgcgctgatcgccacgctctcggtgcgggcgggctttcgggccgagttcgtggacacgatcctcggggccaacgcccatgtcaccgtctattcggcggggcaggtgagcgagacggggcagctgatccgcggctttgacgacttcgatccggtggccgagcggctgcgcacggtgcccggagtggtgcgcgcggcgcccgtggtgaaggggcaggtgatggccaccgccagcggccggtcgagcggcgtcgaggtcttcgggatgcggcaggccgatctggcgaccataccgcggatcgggcatggctcgggtcatgtcggcgacgtcgggcgcttcgacgagggcatcgccatcggctcgggcgtggcgcaggagctgggcgtgacggtcggcgaccggatccggctgatctcgcccgacggggtgaagaccgccttcggcacctcgccgcgggtctcggcctatgaggtcgtctatgtcttcaccgccgggcgctacgacatcgaccggacgcggatctacatgccgctggccgaggcgcagagctacttcaaccgcgagggccgcgccgacgagatcgaggtgatggtgacggaccccgaggcggtcgatgcgatggggcccgcgctgatgcaggcggcgggcgagggctcgatgctctggacatggcgcgattcggccggtgccttcctgcgggcgctgaccatcgaggacaacgtgatgttcgtgatcctgtcgatcctcgtgctgatcgcctcgatgaacatcgtctcggggctgatcatgctggtgaagaacaagggccgcgacatcggcatccttcgcaccatgggcctgaccgagggctcgatcctgcgggtcttcttcctttgcggtgcctcgacgggcctgatcggcacggccttgggcgtggtgctgggctgcctctttgccatctacatcgacccgatcttctcgctggtgaactatgtctcgggcggcggggtctgggatccgtcgatccgcggcatctacgccttgccggcacggcttcagtggcaggatgtgctgtcggcggtgtcgctgtcgctcgcgctgtcgttcttcgtcacgctgatccccgcgcggcgggcggcccgcatgaacccggtcgaggcgctgcgctatgagtga

SEQ ID NO: 911 - DNA, 1263 bp, Geobacter lovleyi SZ
ttggcgctgccgtttgaactgaaaataggattacgttatctgaaggccaaacgtaaatccaccttcatctcgatcatcaccttcatctctacagccggtgtgaccttgggagttatggcgctgattgttgtacttgccgtcatgaccggatttgaacgtgatctgaaggaaaaaatactgggaaccaacgcccatctggtggtgatccgcagcggtgctccgatggatgattatcgctccatgatggagcgtctgcaacagctgcccggcgtggaggcggtaacaccatttatttacaatcaggtgatgctgtcaaccgggcggcatgtgtccggtgtggtgttgcgtgggatcgatcccgcgtctgacaaaaaagtcacgaggctttcccggacgatagtgcagggtacgatggactcccttgatccaccgcgtggctctgatgccgatccaggaattatgatcggccgtgagctggcaaaacatctgaatctgtttctcggtgaccgggtcaacgtggtctctccgaccggcaccatcaccccgctggggatgatgcccaagctgaagccgtttaaggtgacaggcatttttaataccggcatgtttgagtatgattcaacgctggcctatgtcagtatcaatcaggctcagaaattttttgacctcggggatactgttaccggtattcagctcaaggtcgcggatgtgtacgcaacaactgaacttgcaaagaagatcaatcggacctacggtcctgatctgtatgcccgtgactggatgcagatgaacaggaacattctttttgcgctcaagacggaaaaagtagttatgtttattatcctgaccctgattgtactggtggccgcgttcggaatcgcctctacactgtttatggtggtgatggaaaagacccgcgatattgcaatcctgaaaaccatgggagcccgttccggcagtatcatgaaaatatttgttttggaggggctgattatcggtgtggttggaacggtgttgggggtgctgtccggccttttgatctctttcaacctggaaccgatcataaatctggtgcaaaaagtaaccggcaagaacttcttcagcaaggagatctactacctggatcacttcccttcccatgtagtgatgtcggatgtcctgatcatttcagtaactgcaatcctgatttcctttttggccacgctctatccggcctggcaggcatcccgcatgctgccggcagaggcgctgcgttatgagtag

SEQ ID NO: 912 - DNA, 1134 bp, Pseudomonas syringae tomato DC3000
atggacagcagcgcagctttttccaaccctacaaagcttcgtgctgatctgcttcgtggtcgcctcgacgtcagcgtcgattcgtccaccattgccccggattcactgttcggcttcgccgagcggcgcaatcccaaacgcgcgtttctgttcgtttcgcgggtgctcgggcgtcatatcccggcgcgcccgagcgtaatgctcaagagttttcaggacctggcgcacaagattccggtagacctgccaggcccggtgctggtcatcggtatggccgaaacagccgtgggcctgggtgccggtgtgcaccgtgcctacagcgaaacgcattccgatgcgctgtacttggtcagcacgcgccatccaaccggcaccgagctgttcgcccgttttgaagaagagcacagccacgccagcgcgcacttgattcacttgcctgccgatcctgcgctgcgcgacatgatgctcggtgcacgttcgctggtgctggtcgatgacgaagcgtcgacgggcaagacgttcatcaatctgcatcaggcgctggtcgaggccgggctgagcaagatcgagcgggtggtgacctgcgtgctcactgattggtcggcaggtgcggtcagcacgtcgatgggcgcggtggctgagcaggtgtcgctgttgcagggctcgtattcctttgacgaggacgtcagcgcgccgctgccggacatgccggaagtcggcaccgttgcgatgggcgactggccgttgctgaccgccaacgactgggggcgcatgggcgtgctggcggttgccgatacgctggcgcctggccttacggtaaacaagggcgagcgcgttctggtggtcggcaccagcgagtttgtctggcgtccttttctgttggccgagcgcctggaaaaagccggggctgatgtgcatttcagctccaccagccgttcgccgatcgcgctggggcatgccatcgatcacgcgctgtcgttctcggacaactacgggctgggcatccccaactttctttacaacgtgcgaccgggtcagtttgaccgagtgctgatctgcaccgaaacccccaggcaggccgtccccgccgagctgattgaagcgctgaacgccgaggtgatttgcgatgagtaa

SEQ ID NO: 913 - DNA, 1134 bp, Pseudomonas syringae pv B728a
atggacagcagcgcagctttttccaaccctacaaagcttcgtgctgatctgcttcgtggtcgcctcgatgtcagcgtcgattcgtcgaccatcgctccggattcgctgttcggcttcgctgagcggcgtaaccccaagcgcgcgtttctcttcgtgtcccgagtgttgggacgccacatccctgcgcgcccgagcgtgatgctgaaaagttttcaggacctggcgcacaagatccccgcagatctgcccggtccggtgctggtcatcggcatggccgaaacggctgtcggactcggcgctggcgtacaccgtgcctacagcgcaacgcgcgcggatgccttgtacatggtcagcacccgccatccgaccggcagcgcactgttcgcccgctttgaagaagagcacagccatgccagcgctcatctgatccacctgcccgttgatccaacgctacgcgagatgatgctcggcgcgcgttcgctggtgctggtcgatgatgaggcgtcgacgggcaagaccttcatcaatctgcatcaggcgctggtcgatgccgggttgagcaagctcgagcgggtggtgacctgcgtgctcactgactggtcggcgggcgcggtcagtacctcgatgggcgcagtggcagagcaggtctcgctgctgcaaggctcgtactcctttgatgaagactcaagcgcgccgctgccggagatgccggaagtcggcaccgtcgccatgggtgactggccgctggtcacggccaacgactgggggcgcatgggtgtgctctcggtggccgatacgctggcacccggcatcaccgtcaaaaagggcgaacgcattctggtagttggcaccagtgaattcgtctggcgtccgttcctgctcgccgagcgtctggagaaggccggagccgacgtgcatttcagttccaccagccgttcaccgattgcactcggccatgccatcgaccatgcgctgtcgttctccgacaactatggcctgggcatccccaatttcctctacaacgtgcggccggggcagttcgaccgggtgctgatctgtaccgaaacgccaaggcaggccgtgcctgccgagctgatcgaagcactgaacgccgaggtcatctgcgatgagtaa

SEQ ID NO: 914 - DNA, 1272 bp, Psychrobacter arcticum 273-4
atgtcaaataagcaacacagcacgaccatcaccttacctcgcggtacgcttgatctaacctatcagactaacgctgctagtggtaacaatgaccttaaagaaagtagccgttatcagcttgaagatttgcttgattttgctcaacgtatcaacccaaaacgggcgtttttatttgtgtcaaaagtcttaggtcgtcatattccggtggcaccgagcaccatgcgtgacgcctttactgatttggcaaacctagtacctgatgatttgcctgagccaattttggtcatcgggatggcagagacagcggttggcttatctgcgggtgtgcatcaagcgctacaaacgcgctatccacaggctttattattgaattctacccgtcacgcccaacacgataatgataataccaataatttgttaactacctttagcgaagaccacagtcatgccagtcagcatctgatttatcaaagtgccgacaaagtgacccaagcgcagctgcttgctagcaaaaccctaattatggtcgatgacgaagcatcaacgggtaatacttgtgttaatgtcgtcacggcgctacgcaatgcgggactgatgcaattgcagcaagtgcatctcacaaccttggttgattggtccctaaatcagaatcagactgatgctaaagccgatgatacgattgccagccgcttgccaaatattgatttttaccgccatcatctgctatctggcgcttggaaatggaccgacgcgcccaatcctgagcctattattatgccatcagttgatacgactgaggctggcagtcaagcattagctcatactggtcattggggacgctttccaacgctagatagcacggatggctttgctaattacctagcaagttttcaaactacatttgcaatttttgatggtcaaaccgcgtttgataacgctcaattgccacaaaaaatattggtattgggcagtaatgaattcgtatggttgccatttttattagcggaatggcttgaacaaaatgccgataccgttattgataatcaagtgattaaatttagtgcattaacccgctcaccgattgcacttggtggcggtattagcacgatgttaagctttcatgataattacgggcttggtatgaccaactttgcttataacgttgaccctagcaactgggatttgattgtattgtgtgtggaaacgtccgccgatggtgttgatgcaatgtggcaagatttagacaatgtactgatagtgagccctaaatag

SEQ ID NO: 915 - DNA, 1119 bp, Nitrosococcus oceani ATCC 19707
atgagccatactattcatcttgctgcggggactttgaccattgaagtccaccaagcccttcttccgctgcatgatttattagattttgctagccgaattaaccccaagcgcggatatttgtttgtttccaaggtgcttggcaagcatattccctgccagccttcgagaatgcgggatatttacaatcgcttagccctgtctcttttagagatacccggccccgctatttttatcggtatggctgaaacggctacgggcttgggcgctggggttgcagatagtttagttcgaagaacacagcgctgtgatattgttttccaacacacaacccgccatagcctgccggtcagcgaatggatgcgttttgatgaagcgcacagccatgcgcctgagcatatcctctatctgcctttgccggtttttcgtgaacgattctcccaagcacaaaccttggttcttgtggatgatgaaatcagcacagggcggacgctgagagagctaagctacagagtgatacaagcgttaccccatattcggcaaattatgctggtgtcaattgtcaattggctttcgcccgctcaaaagcaggtatttcaagaaaatgttaaccggccggtgtcttttgttagtttgttagaaggcgtgttttcgtttattcctaatttggaatttagcccttccttgccaggaaaagctaggctatttcagccggcgcggcatgcttgccagcagaccggccggcggggaatagagataggagaaaagttccaggtgtcgaacggtccttatccaaaggagcgtaaggtgtctgtggtggggaccggtgagtttcaatttcaaccttttttatgggcggagcagctggaaagaaaaggctttgatgttctgtttcagagcactacccgttcccctattcgggtgggcggacccattggcgaaagtcttagcttcaaagatgaatatgggggaggcatccatacctatcttcataatcctcctcgcggcagggaagttattattgcctacgaatttgccgaattagcacgtaatcacaatcttccggagcagcttggtggaagtatttggggagcggctgccaatacgggatgggatggctga

SEQ ID NO: 916 - DNA, 1128 bp, Burkholderia 383
atggaaagccacgtaggaccaacgtgcctgcgcgcccaactcaagcgggggttgctcgagatcagagtcgacgccgccgccctgcctcctgcgaacctgttcggtttcgcagagcgccggaatcccaagcgagccttcctcttcgtatccaaggtcctgggccgtcacatcccggcgcgcccgtcgatcatggccgccagcttcgagcgcctggctgccggaattccggcggacctgcccggaccagtactggtgatcggcatggccgaaaccgccgtgggtctcggtgccggcgtgcaccgcgcctatcgtgcggaccgccccgacagcgtgtacctcaccagtacccgtcatccgctcggtaccgaagtcttcgctcgattcgacgaagaacacagccatgcgagcgctcatctgatccacgtgccggtcgatcccgagattcgtgacctgatgctgaaggcgcgatcgctggtcctggtggatgacgaagcctccaccggcaagaccttcctgaacctgcaccgcgcactggtcgaagcaggtctgagcaacgtcgagcgagtggtcacctgcgtcctgacggactggactgccggtactgttcgtcaatccatcggggaaccggtcaccgcggtatcgctgctgaccggctcctaccggttccacgaggatcagtccgcgcccctcccggatatgccgaacgtcggcgccgtttccatgagcgcatggcctctctcgccccgccatgactgggggcgcctgggcgttcgggatgtggacgacacgctcgcgccggacgttcaggtccagcccggcgagaaagtcattgtcgtcggtaccggcgagttcgtctggcggccctttctgctggcggagcgcctggagcgatccggcgcggatgtccatttcagctcgaccacccggtcccccatcgccctgggccacgcgatcgagcacgcgctgtcgttccccgacaactacggcctctgtattccgaacttcctctacaacgtgaagcccggccagttcgaccgggtcctgatctgcacggaaacgcccgctcaggcactacctgcagcgctcgtcgaggcactgaaagccgaggtgatcgtcgatgagcggtaa

SEQ ID NO: 917 - DNA, 1161 bp, Rhodospirillum rubrum ATCC 11170
atgacgttcatcgacagtcccctctcgcagacgatcgccctggcggggggcgaccttcatgtcgcggtggcgcgcagcgatcttcccctgggcgcgctctgcggcttcgccagccggcgcaaccccaagcgccccttcctgttcgtcagcaaggtgctggggcggcatctgcccgtccgcccccaggtgatgaggatggttcaccgccggctggcggcgaagctgccggcaaatcttcccggaccggtcgtcgccatcggcatggccgaaaccgccatctgcctgggacagggggttttcgaagcgtggcgggggggaagcggccgcgaggacgggctgttcatccattcgacccgctaccggctgcgtcaggggttgctgtcgaccttcgaggaaagccacagccacgccaccagccacctgatccaccagcccgccgccgcccttgatcgcgccctctgcgccgcctgccggaccctggtgctcgtcgatgacgaagcctcgaccggtgcgaccttcgtcgccctagtcgaagccaatcgcgccgcgatgcccaacctcgcccggatcgtctgcgtcaccatcaccgactggatgggcgcggcgaagcgggccgagatcacggcggccatgccggtgcccacgaccttcgtctcccttctggaaggcggctataccttcgaggcgcgcaccgtcaccccgccggccatgcccaatgtcaccggcgacggcgccttcaaggacgatctgatcccggtgaactgggggcgccttggcttgcgccgcccccggccgctacccgccgccgccctggcgatcagggcgaaggccggcgagcgggttctggtgctgggcaccggcgaattcgtctttccgccctttcagctcgcccgccggctgtcggcgatgggcgccgatgtccgggtgcaggcgaccacccgctcgccgatcctggaaggcggcgatatcgacggcgtgatcgacttcgccgacgcctatggcgacggcattcccaattttctgtattccacccgtccgggagactacgaccgcgttctggtctgctacgagacgccaccatcgaccgcccaaacggccctgatcgccgccctgggcgccgaaccggtttttttcaatgccatcgggggcccgcggacatga

SEQ ID NO: 918 - DNA, 1083 bp, Psychromonas ingrahamii 37
atgaattacaattttgaaactcaagcgggacttatttcacttgatgtactaaagacaaaaaaaccagttgaagaattattaacctttgcttgcagacaaaatccgaagcgaagttttatgcttgtcagcaaagtgcttggtcgttatgttcccactaaacctaatgtaatgagggaagtttatgattcattatctgagtctcttggggaagatcaattaacttatgttgtgagtcttgctgaagctgcaacgggactcgggggaggggttgcagatagcttagcgcgagcgcaacaagaaaatgtctattttcagcatacgacgcgtcataaattgaatcgacctttgtggttttctcttgatgaagcacatagtcatgcggtcaatcatatgttctatgcacctaaaacagcgttgcttgaaggcatcattcaaagtaaacgtttagtgattgtggatgacgaaataactacaggccgcaccattaaattacttatcagcggattattaaaatatttaatgaatatcgaagaaattgtcattatttcattagttaatttggttgatagaaaacagagtttatccatcacagattttaatattcccattcgttatgtgtccttaatggaagctcaaatatcaatggtgaaaaaagatacttttaagcccgaattgccaggaaatgcagatacaggattatgtgaagcacaatcatcggatgaactcgggcgctgcgctatgttaatgccctattcaggtggtttgccaagtattacttcatcaaaagagatgaccattatcgctaatggtgaacatcaatatattcccttcctgattgctgaaagacatgaacaggcaggttgtaatgtgctctatcaatcaattaatcgctctcctttactcctaggggaatctattgagaagaagctatctttttcttttgacagcagtaaagttgaacattatctttataattttgaagaaggtaatagagacgtttacgtattgctggaaaatgaaagtgcaagagagtcgcatgagtttgcaagtctataccccttaacaaagtgtgaggtcttctaa

SEQ ID NO: 919 - DNA, 1155 bp, Polaromonas naphthalenivorans CJ2
atgcggcgcgtcacgttacccacgggcctgatggaaatcaaagtcgatgccgggccgtttcgcctggacgatctgatcggctttgctgcgcgggccaacacccggcgcggttttctgtttctgagcaaggtactgggcaagcactggccggtcacgccgcgcctgatgcatgccatccacaccgagctggcggcgcgagtgccagccaatttgccgggaccagtgatttttattgccatggccgaaacagcaatcggattgggacaaggcgtttttgaagcgtacaaaaccatgcatccgcagcgcgaggccctgtttctgcacaccacgcgttaccacgtcggcggcatgcccatcatcgaatttgaagaggcgcacagccacgcgccgaggcagtttttgcaccggccgggcgacgtggggctgcaacacatattgctgagcgcgcgcgcgctggtgctggtcgatgacgaagccagcacagggaacacatttttgaacttgagcgccgcctgccgtgccctcaatccagcgattgagcatatccatctcgcggccatcaccaatttcatggggcgcgaggtcaacgaagccctgtccgggcgcttcggcctgccggtcaccgtgggcgcggcgctcagcggcgaatatgcattcaccgtcggccagctacagcaggccgacggtgcagcccagcggttcgaagcccatgttgataggggtgccagcgcctgttttggcaggctgggccttgatcgcccgctcaaccagccagccgcgctggccgggcgtctgagcgcaggcatcgccccgagcgagcgggtgctggtgctgggcacaggcgaatttatgcacatggctttcctgctggggcgtgcgctggaagcctgcggtaccaacgtcgttgtgcagtccaccacccgctcgccgatcctgcaatggggcgcggtcggccacatcctgaagttttccgataactacggcgaaggtgtggaaaattttgtatacaacgtcgagcctggccagtatgagcacgttttcatctgccacgaaacgccacccaacgcggcgctgcagcaactggccaaggccgtcaagggccgcctattccactttttatccgagagccattgtgaagaaattcctgttcgttga

SEQ ID NO: 920 - DNA, 1281 bp, Psychrobacter PRwf-1
atgacctgcgatagcaaacatcccccaactgattcactgtcttatcaacaaaagcgggtagagctgcccagaggcacgcttgacttaagctatcggctaagtggtgagcacagctatcagcttgatgacctgctgggatttgcgcagcgtatcaatccgaagcgggcgtttttgtttgtctccaaagtactgggtcgacatattccggtatcgccccagatcatgcgccaagcttttagccatttggctcatacggtgccggataatttgcctgagccgatagtggtggtgggtatggctgagaccgcagtgggactgtcagcaggcgtgcatcaagcgttacaggcacgttatcccaatgcgttgctgctcaactccacccgtcatgctcagcagcaagcaagcctactgaccacctttagtgaggaccatagccatgcgagcacccatctgatttatcaaagcgatgagccgcacatacaggcgcagctaatggccagtaagactttgattatggtggatgatgaagcctcaaccggaaatacttgtgtcaatgtggtcagtgccttacgagaggcggggctcactgagcttgagcaggtacatttggtaactttggtggattggtcgttaggacaagcagacaatgatgaccatatcgctcttcgcttagaagggatagcctttgagcgtcatcacttgatggctggcgactggcaatggaccgatgcgcccgatccacagccgattactatgcccagtgtcgataccactgacgccggcagtcagccgctgttagcaactggcaactgggggcgtcaacctaccttagacagcaccgagggctttgctcattttttagcacgctttaagcaggcttaccaaagagcacgtggcattgatgtggtcagcgatccgtttattaaggatagcggcaccactgataatgctcagtctacgcgaattttggtgctgggaagtaatgagtttgtgtggttgccttttttgttggcagagtggatagagcagcaggcgctgacgacatcacaaagccgtgcacaggtgagctttagcgctttgacccgatcaccgattgctttgggcggtgccattgacgcagtactaagcttccaagataattatggcctaggtatgaccaactttgtgtataacgtggtccctgagcagtgggatattattgtgctgtgtgtcgagacacccactgagagtgtcgatgcgctgtggcataacttagataacgtgattgtggtgagtccctaa

SEQ ID NO: 921 - DNA, 1137 bp, Yersinia pseudotuberculosis IP 31758
atgatgacaacccaaccgccggtttatcgccgggaattgtcagggggcacgttgacggtgatacctaacagtagcaatatcccgctggattcgctctttgatattgccgaacgccgtaaccctaagcgcgccttcctttttgttagcaaagttctggggcggcacatccctgttagccctgccaccatgcgcaatgtctatcgccaattggcggagagatttcccgcagacctaccaggccccgttctgtttattggcatggctgaaactgcagtaggtctggctgctggtgtatttcaagagctacgcggcacggtcgctgaaccggtttttttgacgtcaacccggcatccggttgatggcgatttgctgtgcgaattcaaagaaaaccatagccatgcaacggatcacctgctctatttgccgtctgaccccgtgttgcgcgcacgcctgcaacgcgcccgttcagtggttcttattgacgatgaggctaccacggggaacacctttatcaaccttcttcaggcattacgtgatgccaatctgaatggccttgaaaaggtggttgccgtcaccctgaccgactggagcggtagcgcactgacggaacggtgccctttgccagtcaccaccgtttcacttatcaccggggagtggaactggtcacccatccctgatgccccggtgcccgtgatgcccgcctgtaatgtcactgcccgtggcaaggttgccatcaccgataaacaaaattggggccggctcggcatggatgaaacccgtgctgatatcggccataaggtccatgtactggccggtgaaaaagtgctggtccttggtaccagcgagtttgtctggcaacctttcttattggctgagaggctggaacatgccggggctaacgtcaaatttagctcgataacccgctcaccgattgcacaaggccatgctattaactcaatcatcgcgttcagcgataactacggtctagggatccccaatttcctctataacgtcgctcatcagcattttgatcgcattatcgtttgtgtcgaaacaccagccgaatctattgatcccacgctgattgaacagcttcgcacggtggcaccttgtgtggaggttattgcttatgaataa

SEQ ID NO: 922 - DNA, 1137 bp, Yersinia pestis Angola
atgatgacaacccaaccgccggtttatcgccgggaattgtcagggggcacgttgacggtgatacctaacagtagcaatatcccgctggattcgctctttgatattgccgaacgccgtaaccctaagcgcgccttcctttttgttagcaaagttctggggcggcacatccctgttagccctgccaccatgcgcaatgtctatcgccaattggcggagagattccccgcagacctaccaggccccgttctgtttattggcatggctgaaactgcagtaggtctggctgctggtgtatttcaagagctacgcggcacggtcgctgaaccggtttttttgacgtcaacccggcatccggttgatggcgatttgctgtgcgaattcaaagaaaaccatagccatgcaacggatcacctgctctatttgccgtctgaccccgtgttgcgcgcacgcctgcaacgcgcccgttcagtggttcttattgacgatgaggccaccacggggaacacctttatcaaccttcttcaggcattacgtgatgccaatctgaatggccttgaaaaggtggttgccgtcaccctgaccgactggagcggtagcgcactgacggaacggtgccctttgccagtcaccaccgtttcacttatcaccggggagtggaactggtcacccatccctgatgccccggtgcccgtgatgcccgcctgtaatgtcactgcccgtggcaaggttgccatcaccgataaacaaaattggggccggctcggcatggatgaaacccgtgctgatatcggccataaggtccatgtactggccggtgaaaaagtgctggtccttggtaccagtgagtttgtctggcaacctttcttattggctgagaggctggaacatgccggggctaacgtcaaatttagctcgataacccgctcaccgattgcacaaggccatgctattaactcaatcatcgcgttcagcgataactacggtctagggatccccaatttcctctataacgtcgctcatcagcattttgatcgcattatcgtttgtgtcgaaacaccagccgaatctattgatcccacactgattgaacagcttcgcacggtggcaccttgtgtggaggttattgcttatgaataa

SEQ ID NO: 923 - DNA, 1137 bp, Yersinia pseudotuberculosis YPIII
atgatgacaacccaaccgccggtttatcgccgggaattgtcagggggcacgttgacggtgatacctaacagtagcaatatcccgctggattcgctctttgatattgccgaacgccgtaaccctaagcgcgccttcctttttgttagcaaagttctggggcggcacatccctgttagccctgccaccatgcgcaatgtctatcgccagttggcggagagatttcccgcagacctaccaggccccgttctgtttattggcatggctgaaactgcagtaggtctggctgctggtgtatttcaagagctacgcggcacggtcgctgaaccggtttttttgacgtcaacccggcatccggttgatggcgatttgctgtgcgaattcaaagaaaaccatagccatgcaacggatcacctgctctatttgccgtctgaccccgtgttgcgcgcacgcctgcaacgcgcccgttcagtggttcttattgacgatgaggccaccacggggaacacctttatcaaccttcttcaggcattacgtgatgccaatctgaatggccttgaaaaggtggttgccgtcaccctgaccgactggagcggtagcgcactgacggaacggtgccctttgccagtcaccaccgtttcacttatcaccggggagtggaactggtcacccatccctgatgccccggtgcccgtgatgcccgcctgtaatgtcactgcccgtggcaaggttgccatcaccgataaacaaaattggggccggctcggcatggatgaaacccgtgctgatatcggccataaggtccatgtactggccggtgaaaaagtgctggtccttggtaccagtgagtttgtctggcaacctttcttattggctgagaggctggaacatgccggggctaacgtcaaatttagctcgataacccgctcaccgattgcacaaggccatgctattaactcaatcatcgcgttcagcgataactacggtctagggatccccaatttcctctataacgtcgctcatcagcattttgatcgcattatcgtttgtgtcgaaacaccagccgaatctattgatcccacgctgattgaacagcttcgcacggtggcaccttgtgtggaggttattgcttatgaataa

SEQ ID NO: 924 - DNA, 1143 bp, Escherichia coli O157 H7 EC4115
atgtctgatatcctcgaagatatgatttatcgccgtaccctctcatgcggtacgattcaggtaacccgtgaccagggtgaagtttcgctcgatgacctgtttgacatcgctgaaagacgtaacccgaaacgcgcctttctgtttgtcagcaaagtactcggcaggcacattcccgtgccaccctcagtcatgcggcaggcctacagacagcttgccagccagttcccctcgacactgacaggacccgtactgtttatcggtatggctgaaaccgccgttgggcttggggccggtgtatttgatgaagtgcgccaccagcatcgtgaatctgtctatctgacctctacccgtcacccggttgatggcacgttgctttgcgagttcaaggaagaacacagccacgccaccgatcatctgatctatctgccagatgatgaagagaaaagacgtcgtgttaccaacgcacgaacgctggttttgattgatgacgaggcaaccaccggtaatacctttattaacctgctttctgccctgcgtaataccggcaagcttcaacatattgaacaggttatcgccgtaacgctgaccgactggagtggcaatgccctgtcggagcgcacccccttgcccgtcacttcggtttcgcttgtaagcggtcagtggggatggaccccattacctgatgcacctgtcccggacatgccgaaagtcaacgtaacttcacgaggagaatgggacatccaggggaaacagtcatggggccgactggggatgctcgcacctgcggccgatctcggccatgaggtctccgtccacaagggggaacgtattctggttctcgggaccggggaattcgtctgggagccgttcctgcttgctgaacggctcgaagctgccggagcacaggcattttatggatcgaccacccgctcccctgtcgccgttggttatgccattgagtccgccatttcctttacggataactacgggctgggcatccccaattttgtctataacgtcgcccaccagcagtttgaccgcattcttgtgtgtactgagacacccgcagaaagtattgacacgcagcttcttaaagcgctggctgaggttgcgcccgtcgtggagattgttacctatgaataa

SEQ ID NO: 925 - DNA, 363 bp, Thiobacillus denitrificans ATCC 25259
atgcgtaagttgcaccagctaatcacggcctgcgcgctcggcaccatcgcgctgacgggcaacgcgctcgccgcggagcccgccaaggaaccgagcggcaaggaactcgcattcaacaacaagaaaggcaactgcctcgcgtgtcacggcatgccgacggtgcccgacgcagtctcgaccggcatgtacggtccaccgctgatcgcgatgagcgcacgttacccggacaaggccaagctgcgggcccagatctgggacgccaccgtggcgaacccttccaccacgatgattccctttggcaagcacggggtgttgacggaagccgaaatcgataaggtgaccgacttcgtgtacggtctgtaa

SEQ ID NO: 926 - DNA, 435 bp, Magnetococcus MC-1
atgaagccatttcgatttttggcacttgtactggcggtgttgctgctgggtatcggtggcatgaccggcgcacaagcggaagagggcattgcacaaccgcttacggacaaaccaggggatccagccaacggcaaagcattggcaatggcccgctccaagggcaactgcattgcctgtcactggctgcccgaagcgacctttccaggcaatgcaggtcccaatttgtacgaagcgatccgtcataacgagcgctccacagcctggatccggcagaagattgtaaaccccaaggtggataatcccgacaccctcatgtttaccttctacgacagtaccggcaaacaaaatctgctcaaagcatgggaaggcaaacctgttttggaggctcaagaggtggaggatgtcatcgcctacctgttaagtctgcgcaactga

SEQ ID NO: 927 - DNA, 474 bp, Paracoccus denitrificans PD1222
atgagcagccatctatggcatgcggcggtggtggcgatggccatcgccacgcctgccatctgtgaaacggcaccgaaggacgtggactatgccgagggcgcggtcgaggcttccctgaccggcgttccgggcaatcccgaggaaggggtccgggtcatgaccaccaacgcgctgggcaattgcgtggcttgccaccagatcggggcgctgccggatgtcgagtttcccggcaccatcgcaccgccgctggacggcgcggcggatcgctggaccgaggcccagctgcgcggcatcgtcgccaacgcgaagatgaccttcgaagggacgttcatgccggccttctacaagggagagggctttgtccggcccggcgacggctttaccggcaaggccgggaccgagccgctggcccccatcctcaatgcccagcagatcgaggatgtcgtcgccttcctggtgacgctgaaagagtga

SEQ ID NO: 928 - DNA, 453 bp, Polynucleobacter necessarius asymbioticus QLW P1DMWA 1
atgagaagggggcgcgcattagcagtactcatgctagtcgccctcaatctcagtcaggtagcagcacaaggtaattcgagcattgttgctggtgagattacaaaccctttaactgcaagtcctggggatccgttacgcggtcgtaccattgtggcgagtcgtcaaactggtttatgtcttttatgccatagcgggccatttccggaagagcgttttcagggcaatttagcgccagaactcagtcagagtgttgcgcgttatacggtgccgcaactgagagccagaatagtggatgcaagttactttaattcacaaacaatcatgccagcgtattaccgtaccgagcatttaaatcgcgttgctcctaagtttgcaggtctcactattctgaatgagcaagagattgaagatgtagtagctttcttagcaaccttaaatactagcaagccatga

SEQ ID NO: 929 - DNA, 471 bp, Rhodobacter sphaeroides ATCC 17025
atgaggcaccagtatctgctgggcgtggtggcggcttgcctggcgctgccggcgctggccctgaccggaccgcatgacctgcaattcgcggatggcgcgctggcggagtcgctgaccggccagcccggcgaccccgccgccggggcaacggtgatgaccacgcgcccgctgggcaattgcgtcgcctgccacgagatccccaccatggccgatgtgccgttccagggcgatgtcggcccctcgcttgcgggagttgccaaccgctacagcgaggcgcaactgcgcgggatcgtggcgaacgccaagatgaccttcgagggctcggtcatgccggccttctacaagaacagcggctacatccgaccgggcgatggcttcaccaccaagcccgcgcccgccgacctgcagccgatcctgaccgcgcaagagatcgaggatgtcgtcgcctatctcctgacgctgaaagagtga

SEQ ID NO: 930 - DNA, 408 bp, Bradyrhizobium BTAi1
ttgctgtcggcaaccgcgcgaggtgacgagccgatcaggctcgacatcgtcgactatgcgattccaaaatccctgacgggtgcgcccggcaatgccgaggccggcaagaaggtgtttctgacgcggacgctgggtaactgccttgcctgtcatcaggtctcggcgctgaagtcggaagagtttcacggcgagttcggtccgtcgctggatggcgtcgcgacccgctacaatacggcgcagctgcgcctgatcgttgccgatcccaagcgcattttcaccgacacggtgatgcccgccttctacaaaaacgacggactcaatcgggtcaggccggaattcgtcggcaagtccgtcctcacggccgcgcaggtcgaggacgtcgtcgcgtttctcgaaacattgaaataa

SEQ ID NO: 931 - DNA, 483 bp, Dinoroseobacter shibae DFL 12
atgaagcgccaagcgttgatcggcaccattgccggtctggccttcgccaccggacccgccacggctgagatcatggcggaacaggttgcatttaccgagtatggcgagatcgagcagtcgctttcgggcacgccgggcgatcccgccgcggggcgcgaggtcatggcctcccgggccctgggcaattgcgtggcctgccacatggtctccgacatgagcgacattcccttccacggggaagtcggccccatgctcgacggcgccggggaccgctggaccgaggcgcagctgcgtggcatcgtggcgaatgccaagatgacgttcgagggcacgatcatgccctcctactacaagaaatccggctacatccggcccggcaacgcgttcaccggcaaggcggcaacgcccgaacagcttgaaacgcttctgaccgcacaacaagtggaagatgtggtcgcctacctgatgaccctgacggagtga

SEQ ID NO: 932 - DNA, 477 bp, Methylobacterium populi BJ001
atgcgtaggccgatcacagcctttgcgctcgcaggactttgcgtcctcgcgaccgccgccggagccgagacggcttcaaccgggcttgcaccgttcaaggtcgtggccgtcgacggcagcgacgcgatccccgagccgcttaccgacaagccggggaatgcggcggccggcgccaaggtcgtggtgaaccgccgccagggcaactgcctcggctgccatcaggtctcttcgctgagcaccgagtcctttcacggcgagatcggaccctccctcgacggcgtcgccgaacggtgggacgcggcgcatctgcgcatgatcgtcgtcaacccgaagcacgtcttcaccgaggcgaccgtgatgcctgccttctaccggatcgagggccttcatcgcgtgcgtcccgagttccagggcaagccgatcctgaccgcgcagcaggtcgaggacgtcgtcgcctacctcacgaccctgaagtga

SEQ ID NO: 933 - DNA, 546 bp, Methylobacterium nodulans ORS 2060
atgaagcacccgtccccgatgcgaagccgccccgcccccggatcgatgcgcgaaccctcctgtctccatcggcagaggggaaccgcgcgtctcgggccggtggggtcccggcacggaacgccggcgcttgccgccctgcttctcaccctgctcccggccctggcacccgccacgatcgagggcgacgcgatcccggagccgctcgcgggcgcacgcggcgatccggtccgcggccgggccatcgccaccgatccgcgccgcggcctgtgcacgctctgccatgcggggctcggcggccgggccgagggcgatgtcgggccgaacctcgccagggttggcgcgcggctcacgccgggccagctgcgcctgcggctggtggatggccgcgtcttgaatccggacacgatcatgccctcgtattaccgcgtcgaggggttgacccgggtcggcgccgcctggcgcggcaagccgatcctggaggcggacgagatcgaggacgtgatcgcctatctggcgacgctccgcggcgaaggggagacgcgatga

SEQ ID NO: 934 - DNA, 459 bp, Yersinia pseudotuberculosis IP 31758
atgcagatttgggtcgatgcggacgcctgtcccaatgtgattaaagaggtcttatttcgcgccgctgatcgtaccggcatgatggtgacattggtcgctaatcagccactgaaaaccccgccgtcgaaatttatccgcacagtgcaggtggcttccggttttgatgtggctgataacgagattgtgcagcgggtggaaaaaaatgatctggtgatcaccgcagatatcccactggcagcagaagtgattgaaaaaggggggattgccctaaaccctcgtggcgagcgttataccccagatactattcgtgagcggctgaacatgcgtgattttatggatactatgcgcgccagcggtattcagaccggtggcccaaataccttgaatcagcgtgaccgccagcaatttgccaatgagctggataagtggttgcagcaagcccgtaaccaagcaaaataa

SEQ ID NO: 935 - DNA, 459 bp, Serratia proteamaculans 568
atgatgcagatttgggttgatgcggacgcctgtcccaacgtaattaaagaagtgctgtttcgggcggcggagcgtaccgcaatgtcggtgacgctggtggcgaaccagccgctgagaacgccgccgtcaaagcacatccacaccctgcaggtggcggccggttttgacgtggcggataacgaaatcgtgcgccgctgcgagaaaggcgatctggtgatcaccgccgatatcccactggcagcggaagtgatagaaaaaggggcagtggcgctgaacccacgcggtgaacgctacaccccggacaccattcgtgagcgcctgaacatgcgtgactttatggacaccctgcgctccagcggcatccagaccggcggcccgaatacgctgaaccagcgcgatcgccagcagttcgccaatgagctggacaagtggttgcagcaggcaaaacgggcgcagtaa

SEQ ID NO: 936 - DNA, 459 bp, Yersinia pestis Angola
atgcagatttgggtcgatgcggacgcctgtcccaatgtgattaaagaggtcttatttcgcgccgctgatcgtaccggcatgatggtgacattggtcgctaatcagccactgaaaaccccgccgtcgaaatttatccgcacagtgcaggtggcttccggttttgatgtggctgataacgagattgtgcagcgggtggaaaaaaatgatctggtgatcaccgcagatatcccactggcagcagaagtgattgaaaaaggggggattgccctgaaccctcgtggcgagcgttataccccagatactattcgtgagcggctgaacatgcgtgattttatggatactatgcgcgccagcggtattcagaccggtggcccaaataccttgaatcagcgtgaccgccagcaatttgccaatgagctggataagtggttgcagcaagcccgtaaccaagcaaaataa

SEQ ID NO: 937 - DNA, 459 bp, Yersinia pseudotuberculosis YPIII; identical to SEQ ID NO: 934

SEQ ID NO: 938 - DNA, 450 bp, Dickeya dadantii Ech703
atgccgagtatctgggtcgacgctgatgcatgccccaacgttatcaaggaagtgctgttccgcgcagcggaacggacatccacccagttgacgttggtcgccaaccaacccctgaaggtaccgccctccagatttatcgctaccttgcaggttgcggccggtttcgatgtggccgacaacgaaatcgtccgccgtgcagaacccggcgatctggtgattaccgccgacattcctctggccgccgcggtcatcgaaaagcacgccgtggcgcttaatccgcgcggcgaacgctatacgccggataccattcgtgaacggctgacgatgcgcgattttatggatacattgcgcgccagcggaattcagactggcggcccggccgcgttaaaccagcgcgaccgtcagcagttcgccaatcaactggataaatggctgcaacaacaagcgtaa

SEQ ID NO: 939 - DNA, 453 bp, Dickeya zeae Ech1591
atgaccgccatctgggtggatgccgacgcctgccccaacgtcataaaagaggtgctttaccgtgccgccgaccgtaccgcaacccgcctgacgttggttgccaatcagccgcttagaacgccgccgtcgccatatattcacagcttgcgggtatcggcagggtttgatgtggcggataacgaaatcgtgcgccgtgtgcagccgggcgatctggtgatcaccgccgatattccgctcgccgcagaagtgctggcaaaacacgccatcgccctcaacccgcgcggtgaacgctacaccccggataccatccgtgagcggctgaccatgcgggatttcatggatacgctgcgcgccagcggcgtgcaaaccggcggcccggccgcattaaaccagcgtgaccgccagcagttcgccaacgagctggaaaagtggttacgccagcaacaggcgtaa

SEQ ID NO: 940 - DNA, 453 bp, Pectobacterium carotovorum PC1
atgcagatttgggtcgatgccgacgcctgtccgaacgtcatcaaagacgtgttatttcgcgcagcggatcgcacacaaacacaggtcacgttggttgccaaccagaccataaaagtgccgccgtcgcgttttatccgcacgctgcgcgtctcatcaggttttgatgtcgccgacaatgaaattgtacgccgcgttgaagcgggcgatttggtgatcaccgccgatattccgctggcagcagaagtgatagaaaaaggcggtgccgcgttgaacccgcgcggcgagcgctatacgccagataccattcgggaacggctgaacatgcgggattttatggacactatgcgcgccagcgggatacaaaccggtggccccagcgcattaagccagcgggatcgtcagcagttcgctaatgaactggacaagtggttacaccaggcgaaaaaaccgtaa

SEQ ID NO: 941 - DNA, 1284 bp, Desulfovibrio desulfuricans G20
atgaccagatacgcagttatcgccgacgacctgacaggcgcaggtgacaccggcgtgcagtttgccaaagccggactgcgtacgcgcattctgacgcacaactggtcggcggaagacctgaacggtgtggacgtggccgtggtgcagacagaaagccgcgccatgcccccacaggaggcatatgcggccgtgaaacaggctgcacagcggctgcaggcggccggagtacaaccgctgtataaaaaggtggactccactctgcgcgggcagatagggcctgaaattgatgcggtcatggacgtatgggggctggaactggccctcctgtgtccggcatttccggaaaacggaagaactctcatcggcggttatctgctggccggaggcgagccggtatcacgcacctccatcggagcggaccctgtatcgcccgtacggcagagccatatccccagcctgcttgccgctcagtcctcgcgtcctgccatagggctttcgctggcagaaatgaccagaggcgacagttatctggagagcatattcacagaagcgcggcgcaggagcgccatcattgtggccgatgcagcagacccgcaggatattgccctgctggaaagccttgtggcccgctttgccccgcgggcgctgtttgtgggctccgccggacttgccgctccggtggcggcccgtctggcacaatcgtcagcaggcaggcgccccgttgtcacggtggtgggttcggtcaaccccgtatcacgcggacagctgaagcagctgcagcacgaaggaacgggactgctgctggttaccgccgacgagctgctgcttgacgacaggcactggcagacggcactgcgcgccaaggccgagacgctggcggccatgctgcgccggggcgaagacgtggcggtggccacaccgggcaaccgggaagaagtacaggacctgctggaaagaggtgccggcatcgggctggagcgccgcccccttaccgcgcgtgtggccgcgcgcaccactcaggtggtgcacgaggcgctggccttgctgcaggacggagaaaaaccgtccggccttgtgctcacagggggcgacatggcccacgccatgctggcccacctgaacacggcaggcatggaccttattgccgaagtcagccccggcatacctgtgggcagactcagcggaggacatgcggacggcgtcaaagtggtcaccaaagcaggcggcttcggcacgcagggcgctctggtgcaggccgtgcgcaccctgcgtgaactggactga

SEQ ID NO: 942 - DNA, 1230 bp, Rhodoferax ferrireducens T118
atgtccgcgctcgccgactctttgttcatccttgcagatgacctgtcgggagcggccgattgcgcgatgggtgcggccaagtccgggttgaaaagtatcgttcttttcaaccctgcaattgccgagcaagcccaagtcatcgcgatcgatgccgattgccgctaccggcctgctgcggaggcaggtgcgatcaacgtcgcgctgtggcaagctcaagccacttccgagcgcctgttctacaaaaaaattgattcgacgctgcgcggcaattttgcagcggaaatggcagcactcacgcgagccggcgtggccatcgttgcgccagccttccctgccaccgggcgcacaacgcaaaacggccgcgtgtttgtaaagggcgtgccgctcgaacagaccgagatttgggcaaatgagagcatccctgggcaagccgatatcgtggccatgttacgcagtgcaggcatctctgcgacgaacatcaccttgcccggcgtgcgcaacaagttacgcgacgagatttcccgcttggtggccggcaaaacagtccaggcgatagtctgcgacgccgaggaggaggccgatctagccgccattgctgccgcgtcggtcggactgcccgtctattgggtcggttcggccggattggcgactcacttgccacaagccgccggacttgtcggacaggcggcctcgccccggctcgcggtatccggcccgattgtcacagtggttggcagcctttccgctgtatcgcgccagcaggcgcaggtactcgagtcccatgccgacttcgccgtattcgtgcccacgcccgccttgcttcgcaccggcgaaacccatccgctttggcaatcactgcgcgaccaaataggcgaagccttgagtgcaggcagggatgtcatgatccggaccggcctggaggaacataacgaccttacctacggacatgccctgtgtgaatccctcggaagcctggtattgccactggcacccgctatcggtgccctcatcgcgaccggtggcgagacggcacgcgcgctgctgccgacatttggcacccatgccctgcaactcatcaaggaagtcgagccgggcgttcccctctcactggccttgggcaaacagcagattcccgtcattaccaaggcaggcgcgtttggctcgccggccgcactcctcaaaagctacagcgagctcgcccgcatccgcagcggcaacgtggtcgcttaa

SEQ ID NO: 943 - DNA, 1251 bp, Rhodopseudomonas palustris BisB18
atggcgcatggctggttgatcctcgcggacgatctcaccggtgccgcggactgcgcgatcgccttcggtcgaaggggacgcgcggctgcggtgacctggggagaagccgacgccgcgcaggatcaccagctgccggtgctggcctatgacgcagcgagccgcggcctcagcgccgcggacgccgcccgccgccacgccgaggtgctgacgcagttggccgcggcggagcgtatcctgttcaagaagatcgactcgacgttgcgcggccagcccgccgcggaaaccgcggcgacgctgtcctatctgaagtcccgcctgggcggcgcgttcggcgtgttcgcgccggcgtttccggccaccggccgcaccacgatcgacggccgtatcgtggtcggcggccagccgctcgagcaggccgaagtctggcagcgcgatcactcctatccgactgccgatctggtcgacgtgctggcgagtgccggcgtgcgcggcgagaaagtaacgttggctgccatccgcggcggcgagctgcgcgcggtgttcgcgaagctttcgcgccagggcgacgtcgtcgcggtgtgcgatgccgagaccgaccaagatctgcatctgatcgcggacgcgagcctgccggcgtcgccatccaccttcttcatcggcagcggcgggctggcgcacgcgctggccgggctcgaggccgagcatgcggttgcgccgttgcgaatcccgaccagcgcccacggcaccctgatcgtggtggggtcgctcgccggcgcctcgcgctccgccgcctgcaagctggtggcgaccggcaccgtggcgcatttcccggtgacgccgcagacgctgctcaacgacggcggcggccgcgccgaactggcgctcgccgtcatgcaacgcttgtccggcggcggcgatgcgctggtcgagatcgtgatgaacgatcatcccgacatggcgctcggccccaagctggcgcagcgactggccgaaacgctgcaaagcgtcgcgccgtcgatcggcgcctttgccgccaccggcggcgaaaccgcggcggccctgttggcgcgtttcggcgtcaacggcattcggctcgccgacgaaatcgagccgggcgtttcgctcggccttacgctgggccgattgtcggtcccgatcgccaccaaggccggcgcgttcggcgacgaacagagcttgatccgtatcagcgaacggcttgccgccgttcgaaccaaaggaagcttctcatga

SEQ ID NO: 944 - DNA, 1233 bp, Cupriavidus metallidurans CH34 uid250
atgacctggctgatcatcgccgacgacctgtccggcgccgctgactgcgcaatcggctttgccgcgcacggcgcgcgcgcggtggtcacactcgacgtggccgattccgtcggcatcgccgatgcagaaatcgtggcggctgatgtcgatagccgccgcatgacgcccgaagatgccaccacgagcaacatcgacgcctggcatcgcggcgacggccggcaccggcggctgtacaagaaaatcgactcgaccctgcgcggtaactgggccgccgaaacggtggcattgcaaccgctggcggggctggcgatcatcgcgccagcgttccccgcgacagggcgcaccacacgcggcggccgtatgttcgtcaacggccagccattggaagacaccgacatctggcgcctggaaggcctgaacggtcacgctgacatggtggcgctgctcgccgcgcgcggactggccacggcgctactgccgctcgacgtcgttcgggcaggcgcgccggccgtgctcgccgagttgcgtgcgcgacaggcggacggcatcgcggccgttgtctgcgacgccgaaaccgaacaggatctcgtgaccctggccgacgcctcgaatcagctcgacacgccggcgtactgggtcggctccggcggactggcgcgctcgctgtccaccgtggcgcaggtcacgcgcgcggagacgacatctccggtcacgtatcaccagggaccggtgctgacgatggtcggcagcatgtcgggcatttccggcaagcaagccgcctacctgtgcgagcgggcgcgaatggaagccctggtcgtggcgccgcagacgctacgcgatggcccgggccatcctgcatggaccaccacgcggcaatcgatcacgaactgcctgagcgccggccgcgacctgctgctcagcatcggccgcgacgatgcattcgacccggccgaagggccgcggctgtcgaccgcgctcgcgcaactggctctgccctccttcgaacatgttggcggattgatcgccaccggcggcgaaaccgcgcgcgccatgctcggcgcggccggtattgcggcgctggcattgcggcacgaggtcgaacccggcgtgccgctgtccgacaccattgaatccctccctggcgcgccggcgcgccgcgtggccaccaaggccggtgcattcggcaccgaagctgcgttgtggctggcgtggcaagccatgcgccagaactga

SEQ ID NO: 945 - DNA, 1278 bp, Burkholderia cenocepacia AU 1054
gtgaacgcgctcgccccgcacgcagcacggctgctgatcgtcgccgacgacctgtcgggcgcggccgactgcgcggttgccgggttgcgtcacggcctgacggccatggtcgtgctcgatgccgcgcacgcggcggcggcgccacatggggtcgacattctgtcgatcgacgtggattcgcgccgcttgccgaaggacgtggccgcgcgacgcaccgtcgatgcggtcgcgtcgttgtcgaatgccggcacgcgcctctacaagaaggtggactcgacgctgcgcggcaacttcgcggcggaagtcgccgcgctgacgtcgcgcgccggaatggcgatcgtgtgcccggcctacccggcctcgggacgcacgaccatcgacggccgccaatgggtgcgcggcgtgcccgtggaagcgagcgaatactggcgcaacgaacacatcccgggcacggcagatctcgttgcattgctgtccgccgaagacctgcgtgtcgcctacacggcaatcggtacggtgcgcgacaacgcaaacgcgctcaccgcgcatctgcgcgagctgcaatccgaccgcgtgcaagccgtcgtgtgcgacgcggaatccgacgacgacctgcaacgcatcgcgcgtgcatccgcggcgctcgacggcgtgttctgggtcggctcggccggcctggcccccggcgtcatcgaagcgctggggccaccgcatggcgcgagcgggccgacggccggcggcccgcattcgaaaggccccgtgctgacggtcgtaggcagcatgtcgagcatttcgcatgcgcagctggactgcctcaaggcgaacgcgggcacccatctcgttgcgctcgaagtcagcgtctgcgcgctggacgacacgcgaagcgacgtcacgaccgtggcaagcgacgcgctgcgtggcggccggcatgtcgtcgtctcgttgagccaggcacggcgcggcgacgtcaatgacgggctgctgttctccacgcgcctcgccgcgctgctcgcgccagccgtgcgccacgccggcgcaatcatcgcgaccggcggcgaaacggcacgcgcgctgctcaccgcggccggcgcgagcgcgctgcgtgtcgtcgacgaaatcgaggacggcatgccgctgctcgaatgccggctgcacggcaacgcactgcccgtcgtgaccaaggccggcggtttcggccagcccgaatcgatttatcacgcctggcgccggcttgcgaacacaggcgagccggccgacacggcccaacccaatcagtga

SEQ ID NO: 946 - DNA, 1173 bp, Rubrobacter xylanophilus DSM 9941
gtgcgcttcgcgatagtggccgacgacctcaccggggccatggactccggcgtccagctcgccgccgccgggtacgccacggcggtggcgctgcagggcgcgccgcttccccccgcaccggacctcgacgcggtggtcgcggagaccggctcccgggcgctccccccgggggaggccgcagcgagggtgcgggcggccgtcggcgccctgcggaaagcggcgatcctctacaaaaaggtggactccaccctgcgggggccggtcggcgcggaggtggaggcggcgctcgccgcctcgggccgggagcgcgccctgatctccccggccttccccgccgccgggcggacgacccgcggcggggtccagctcctgtgcggggagccggtggagcgcaccggcttcgcccgcgacccccgcaccccggtccgcgcctccgggctgcggcgcctgatcccgggggtgggggcggtgctcgggacgggcgagctcgcggatccctcccgcgtgcgccgcgcgctccgccgccaccgcctgctggtggccgacgcggagaccgacgcccacctcgaggcgctggtgcgggccgtcccggatccctcgcaggtgctctgggtgggctccgcggggctcgcccgggcgctcgccgcgcgctatcccggaccccgtcccgcccctgaggggccgctgcccgcggcggagcgtgtgatcgcggcggtcggcagcaggaacgaggtcgccgtcgggcagcgggagctgctcgccgccgcgcccggggtggtggaggcggtggtcggggagggcggcgggggggcggtgcaggaggctgcccgggcgctcgaggcgggggcttgctgcgcgctgctgcgccccccggaggccgcgggcgggccggaggccgtgctccgggcgctgggcgaggccgccgccgggctcgtgcgctccctccccggcgcggggctcatcctcaccgggggcgacacggccgccgcggtcgcgcgcgagctcggggcgggcggcatccgcgtcctgcgggagctcgagcccggcgtcccggtcggggtgctcctcgggccgcacccctgcccggtggtcaccaaggccggggggttcggccggcccgggacgctgctggaggccctgggcctcctgctgggcgagaggagcccggcgtga

SEQ ID NO: 947 - DNA, 1293 bp, Moorella thermoacetica ATCC 39073
atggaacagatatccatcatcgccgacgatttaaccggagccaacgataccggcgtccagttttgccagcacggtttccgcaccatggttattatagatgctgccaacgtagagcgggtggggcaggataaagatgtctgggcgatcaataccgacacccgccacctggcagcacctgaagcctaccagcgcgtttatgagatcactttaaaactaaaaaaagctgccatcagccgggtttacaaaaagattgattccaccctgcgcggccaccccggcgccgagctggaggctgtgatggacgcctggcaggcggacctcgccctggtggtgccggcctacccggccaaccggcggttagtggttgacggccacctgttgataagcgagggcatggagacggccgcggcttccgtaagccttactcctggcgatgccagggcagccctttgccacatccctaccgtcctgcagggggagatgggccgtcgggtaggccagattaacctggcgactgtgcgccagggagtgaaagaactggtagctgccctggaggccgctcgtacaaacagccaggtgctggtccttgatgccgccgacgaagaggacctaaggaatatcgcccgggcaatcagccgcttccagcgggatgtcattgtggccggcgccgccggcatggccgcccatttacctctggcctggaacctaaaaccagtgcctaataatccattaaataaaaagggggctattctcctggttgccggctcgcgtaacccggtcactgccgcccaggtgcaacgcctggctgaggttagcgcgtgtcaggctgtaaaggtagagacggaagctatacttaccggagaaccggctgttgaaatagaaagggtgttgcaggaagttacaactcaagatgcaggcgcaggtttaattattatagccgtagatagccttttccagacaattgacagagatagggtttccaactcaggaagcaaagctatagctttagcccttggcactatcaccagccgcctcttaaatatgcgaaggataagtgccctggtagttactggcggagatactgccgttcacgtttgccgggctctggaagccagaggaattaacctggcggccgatctgttgccgggtatccctttggggtacctggaaggggggcggggtgatggactaccaatcgttactaaagccggcggttttggttcccccgattccctgatcaaagtaaatgaatttcttcaacagagaatgaaaagtgaaatggagttggtatga

SEQ ID NO: 948 - DNA, 1278 bp, Burkholderia cenocepacia HI2424; identical to SEQ ID NO: 945

SEQ ID NO: 949 - DNA, 1299 bp, Burkholderia multivorans ATCC 17616 JGI
atgagcatgctgatcatcgcggacgatctgtcgggcgccgccgattgcgccatcggctttgcgagcgccggctatcggacggtcgtcacgcttgacgtgcccacgcaaggcctcgacgcaaccgtcgccgacgtgatcgcagccgataccgacacccgccgcctcacgccggccgaggccgcgcagcgcacgtcggccgcgtggcgggcgttgcgcgaaccgggccggcgcctctacaagaagatcgactcgacgctgcgcggcaattgggcggccgaagtcgccgcgttgcagccgctcgcgggtcttgcgatcgtcgcgccggcgtttccggcgacgggccgcaccgtcctcggcggccgtgtgttcgtgcgcggcgagccgctcgaaaccaccgatacatggaagctcgaaaacgcgggccgcactgcagacctgcacgcgatgctcgcgcaaaacggtgtttcgaccgcccaactcgacgtggatgcattgcgcgaaagcagccagacgctcattgcgcgaatcgccgccgtggcggcgagcggcaccgaggcgctggtggtcgacgccgagacgaacgacgatctgatcgcactcgcacgggcgacggcacagatggacgacgcgctgttctgggtcggctcgggcgggctcgcgcgcgaaatcgcgagcgtggaaagtctgttcgacgcgcgcgcggcgcgaacaggcgctgccgcttcgcaacggcagccacgacacgcgcccgtgctggcgctggtgggcagcctgtcggcggtgtcggagcggcagtgcgcgatgctgcgcgaacgcgccggcatgatggaactgacggtaccgcccgccgtgctgcgtggcggcgagcgccacgcggacgtaccgcaatggcaggcgcgcatcggcgacgcgctgcgaacgggcgcggacctgctgctgcgcatcggcagcgacgacgcgttcgatccggcggaaggcgcgttgctgtcggccacgcttgccgcgctcgtcaagccgcatttcgcggtgctcggcggcttgatcgcgacgggcggcgaaaccgcccgcgcgatgctgagcgccgttggcgtcggcagcgtcgaactgattgaggagatagaggccggcgtggccgtcggcaagccgatcggtgcctccgtttgccagcctcatctgcgtatcgtcacgaaggccggggcgttcggcaccgatcacgcattgttcgccgcgtggcgctatctccgcgaaacgccggcagcgagcgtcagggcgggcgcccgctcacacggttcggcctga

SEQ ID NO: 950 - DNA, 1278 bp, Burkholderia cenocepacia MC0 3
gtgaacgcgctcgccccgcacgcagcacggctgctgatcgtcgccgacgacctgtcgggcgcggccgactgcgcggttgccgggttgcgtcacggcctgacggccacggtcgtgctcgatgccgcgcacgcggcggcgccgccgcatggggtcgacatcctgtcgatcgacgtggattcgcgccgcttgccgaaggacgtggccgcgcgacgcaccgtcgatgcggtcgcgtcgctgtcgagtgccggcacgcgcctctacaagaaggtggactcgacgctacgcggcaacttcgcggcggaagtcgccgcgctgacgtcgcgcgccggcatggcgatcgtgtgcccggcctacccggcctcgggacgcacgaccatcgacggccgccaatgggtgcgcggcgtgcccgtggaagcgagcgaatactggcgcaacgaacacatcccgggcacggcagatctcgttgcgttgctgtccgccgaagacctgcgtgtcgcctacatggcaatcggtacggtgcgcggcaacgcaaacgcgctcaccgcgcatctgcgcgggctgcaatccgaccgcatgcaagccgtcgtgtgcgacgcggaatccgacgacgacctgcaacgcatcgcgcgtgcatccgcggcgctcgacggcgtgttctgggtcggctcggccggcctggctcccggcgtcatcgaagcgctggggccgccgcatggcgcgagcgggccgacggccggtggcccgcattcgaaaggccccgtgctgacggtcgtaggcagcatgtcgagcatttcgcatgcgcagctggactgcctcaaggcgaacgcgggcactcatctcgttgcgctcgaagtcagcgtctgcgcgctggacgacccgcgaagcgacgtcacgaccgtggtaagcgacgcgctgcgtggcggccggcatgtcgtcgtctcgttgagccaggcacggcgcggcgacgtcgacgacgggttgctgttctccacgcgtctcgccgcgctgctcgcgccagccgtgcgccacgccggcgcaatcatcgcgaccggcggcgaaacggcacgcgcgctgctcaccgcggccggcgcgagcgcgctgcgtgtcgtcgacgaaatcgaggacggcatgccgctgctcgaatgccggctgcacggccacgcactgcccgtcgtgaccaaggccggcgggttcggccagcccgaatcgatttatcacgcctggcgccggcttgcgaacacaggcgagccggccgacacggcccaacccaatcagtga

SEQ ID NO: 951 - DNA, 1284 bp, Burkholderia ambifaria MC40 6
atgaacgcgaacgcggtcgcacagcacgcggcacggctgctgatcgtcgccgacgacctgtcgggcgcggccgattgcgcggtggccgggctgcatcacggcttgacggcgatggtcctgctcgacaccgagcacgcgccggcgccgacgaatggcgtggacatcctgtcggtcgacgtggactcgcgccgcgcatcgaaggacgaggccgcccgacgcaacgtcgctgccatcgagtcgctgtcgcattccgacacgcgcatctacaagaaggtggactcgacgctgcgaggcaatgtcgcgacggaggtggccgcgctggcgtcgcatcttggcatggcgatcgtgtgcccggcctacccggcatccggccgcaccacccgcgacgggcggcaatgggtgcgcggcgtgccggtcgaagccagcgaatactggcgcaacgagaacatccggggcaaggcggacctggttgcgctgctctgcgccgaacatctgcgcgtcgcctacgcggcaatcggcacggtgcgcgccgaaccgggcgcgctcgcggcgtgcctgcgggaaatgcaatccgagggcgcgcaggccgtcgtgtgcgatgcggagtccgacgatgatctgcaacgcattgcgcgcgcatccgcgacgctcgacaacgtgttctgggtcggctcggccggcctggcccctgcagtcatcgaagcgctggagccgcgccgcggcatcgccgaaccggcggccgccggtgacgatccgcaaggaccggtgctcacgatcgtcggcagcatgtcgagcatctcgcatgcacaggtggagtacctcaaggccaacgccggtgccagtctcgttgcgctcgaggtcgccgtctccgcgctggatgatccgcgcagcgacgtcacgacggccgtatgcaacgcgctacgccacggccggcacgtggtggtctcgatgagccagacgcagcgcggcgacgtgaacgacggcctgctgttctgcaatcgccttgcgtcgctgcttgcgcctgccgtgcgccacgcaggcgcgatcatcgcgaccggcggtgaaacggcgcgcgcgctgcttatcgcggccggcgcgagcgcattgcgcgtcgtcgacgaaatcgaggacggtatgccgctgctcgaatgccggctgcagggaaagaccttccccgtcgtgaccaaggccggcggcttcggccagcccgggtcgatccatcacgcgtggcgccggcttgcgaatgaaggcaagacggccaataccgctcaaaccaatttgtga

SEQ ID NO: 952 - DNA, 1071 bp, Opitutus terrae PB90 1
atgatcgtggtgctggcggatgacatcagcggggcggccgaactcgccggcgcggcgctccgccgtggattcagcgcggaggtgcagaccagtttccagcccgacaccgaggccgaagtcgtgtgcgtcgacacggactcgcgctctctggcgccgcaggctgcggaagcggtcgtcgccgcgatcgcgcgccaggttgcggcggcgcgtccggactgggtctacaagaaatgcgactcggtgctgcgcggtcacgtgcggcgcgaaacgcaggcggtcatggcggcgctgaaccggcggcgcgccgtgctggtgccggcaaatccgtcgcgcggccgcgtggttcgcaacggcgagtattttgtcggcgagcaaccactggatcagacggagttcgcccgtgatcccgaacacccgcgcacgaccgcgcgtgtcgccgagttgctgggtggagagctcaccggggtggtggtgccgaacaccgagactccgggcgacgtcgatgcccatgcgttcggattggatgaaaccacgctcccggtgggcggcgtggatttctttgaggcgctgctgcgtcgtcgcggcgcagcgcgcgcggcggtgagcgcaggctccgcggcatctgcgggcaacggctcggtcctggtggtgtgcggcagcgcggcggcgtggagcgtgcggcgggccgaggcgcgggcgcgcggcgtcgcggtgtttccgcagccgcacgacgtggcggcgatctgtgcggcgtggcgcgcagcgcggacggcgttgatcggcatcggcgatggtccggcgacgagcggccgcagtccgggcgagttggtcagcgcgctggccggcaccgtcgtcgaggtcgtgcgccgaatcgagaccgaccggttgctgcttgaaggcggcgccacggcggccgccgtggtacgcgcgctcggctggacgcggctgcgcgcgtgcgaggtggcggccagcggcgtcggcgtgtttacgccggcgggcaccgtgcggccgcgcgtggccatcaagccgggcagctatagctggccggtggagatctggcccggccgctga

SEQ ID NO: 953 - DNA, 1260 bp, Burkholderia phymatum STM815
atgaagattctgatcattgcggacgacctgtcgggtgccgcggactgcgcgatcgggttcgcgagcgccgggcatcgcacggtcgtcacgctggaggcgacgtgcatgccggcgcacgacggcgcggacacgatcgccgtcgataccgacacgcgccgtctcacgccgcaggatgccgcgacgcgcacggcagcggcgtatgcggagatgagcgcgcgcggccagcgcctgtacaagaagatcgattcgaccttgcgcggcaactgggccgctgaagtggccggtcttcaggcgcttgccggcatggcgatcgtcgcgcccgcgtttcccgccacgggacgcacggtgcgcgacggccgcgtgttcgtgcacggcgagccgctcgaacagacggcgacatggaagctggagcacgcgggccagcctgccggcatcgcggcgcaactcgaagcggtggggctgacgacggaacgcctcgacgcgcaagcgctcgccgacgaaccggaaacgctggccgtgtgcatcggcgcgatggccgcgaacggcgtgcaggccctgatcgtcgatacgcacagcgagcgggcgctgcgcgcgctcgcgcgtgcgacgctgcgtagcgatgcaccgtttttctgggtcggctcgggcggactggcgcgcgaaatcgcggcgctcgattcgcgggtcgacccggccgggcgcggcccgggcaatacgacatttcccggcggcccgatcctgattctggtcggcagcctgtcggccgtcagcgagcggcaatgcgcaatgctgcgcgaacgcggcggagtgaaagaactgatcgtgccgcccgccgtgttgcgcgcaggcgcgacgcatcgcgactggcacgtgctgcaggagcagatcggcgtatcgctgaaggcggatgtggatctgctgctgcgcatcggccgcgacgatgcattcgatcccgcagaaggcgcgcaactgtcggcggccctcgcagcgctggtcgagccgcacttcaccaggacaggcggggtgattgcgacgggaggcgagaccgcacgcgcgatgctcgccgccgcgcgcatcggcaatctgcaattgctggccgaagtggaagcgggcgtcgccgtcgcacggccgctcgatgcgacgcgcacgcattgccccggcgtggtgacgaaggcaggcgcattcggcaccgatcacgcgctctacgccgcatggctgacgctgcgcaaccaaactgaacgggacgtcgtgccgcattga

SEQ ID NO: 954 - DNA, 1272 bp, Salmonella enterica serovar Newport SL254
atgaaaatgatggttatcgccgatgattttaccggatcgaatgataccggcgtccagttggcgaagaagggggcgagaacggaagttatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcggccatgcgcgccagtcagcgaaaactggccgttatcgccgccgcgatccctgcggccggacgcacgacgcttgaaggaaaatgtctggttaatggcgtcccgctactggaaaccgaatttgccagcgatccgaaaacgcccattgtctcttcccgcattgccgagatagtggcgttgcaaagtgagatccctgtgtatgaagtctttttgcaggatgtccgacgcggcgggttaagcgccttacttacggcttatgcggctgagggcgaagggattatcgtcgtggatgcggtggaagagcgggacctgacgttgattgcgcaagcggcgtgtgaacaaccgtcgatgccgctgctcgtcggcgcagcgggtctggcgaatgcgttgccggttgaactttttatgcaagaccggcagcggctgccggtgctggtggtggccggttcgatgagcgaagccacgcgacgtcaggtggataatgcgctgtgccggggacgtgcggaggtcgtggatattgatgccgcgcgcatggtgtcggatagcgcggaacaggaaatcgcgtctgtcgtagagcaggcctgcgcgctgttaagtcagcatcgacatacgattttacgcaccagccgtcgcgcagaagatcgacagttaatcgacgcgctgtgcgaaaaatccgcgatgagtcgtcagcaattgggcgagcgactgagtcagcggcttggcgtcgtcacgttaaacattatcgagcaggcgcggattggcgggttgtttctgaccggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaa

SEQ ID NO: 955 - DNA, 1272 bp, Salmonella enterica serovar Schwarzengrund CVM19633
atgaaaatgatagtcatcgccgacgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactctacatttcgcggcaatatcggagccgaagtgacggcggctatgcgcgccagtcagcgaaaactggccgttatcgccgccgcgatccctgcggctggacgcacgacgcgtgaaggaaaatgtctggttaatggcgtcccgttactggaaaccgaatttgccagcgatccgaaaacgcccattgtctcttcccgtattgccgagatagtggcgttgcaaagtgagctccctgtgtatgaagtctttttgcaggatgttcgacgcggtgggttaagcgccttacttacggcttatgcggctgagggcgaagggattatcgtcgtggatgcggtggaagagcgggacctgacgttgattgcgcaagcagcgtgtgaacaaccgtcgatgccgctgctcgtcggcgccgctggtctggcgaatgcgttgccggttgaactttttatgcaagaccggcagcggctgccggtactggtggtggccggttcgatgagcgaagccacgcgacgtcaggtggataatgcgctgtgccggggacgtgcggaggtcgtggatatcgatgccgcgcgcatggtgtcggatagcgcggagcaggaaatcgcgtctgtcgtagagcaggcctgcgcgctgttaagtcagcatcgacatacgattttacgcaccagccgtcgcgcagaagatcgacagttaatcgacgcgttgtgcgaaaaatccgcgatgagccgtcagcaattgggcgagcgactgagccagcggcttggcgtcgtcacgttaaacattatcgagcaggcgcggattggcgggttgtttctgaccggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaa

SEQ ID NO: 956 - DNA, 1272 bp, Salmonella enterica serovar Agona SL483
atgaaaatgatggttatcgccgatgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcggccatgcgcgccagtcagcgaaaactggccgttatcgccgccgcgatccctgcggccggacgcacgacgcttgaaggaaaatgtctggttaatggcgtcccgctactggaaacagaatttgccagcgatccgaaaacgcccattgtctcttcccgcattgccgagatagtggcgttgcaaagtgagatccctgtgtatgaagtctttttgcaggatgtccgacgcggtgggttaagcgccttacttacggcttatgcggctgagggcgaagggattatcgtcgtggatgcggtggaagagcgggatctgacgttgattgcgcaagcggcgtgcgaacaaccgtcgatgccgctgctcgtcggcgcagctggtctggcgaatgcgttgccggttgaactttttatgcaagaccggcagcggctgccggtgctggtggtggccggttcgatgagcgaagccacgcgacgtcaggtggataatgcgctgtgccggggacgtgcggaggtcgtggatattgatgccgcgcgcatggtgtcggatagcgcggaacaggaaatcgcgtctgtcgtagagcaggcctgcgcgctgttaagtcagcatcgacatacgatattacgcaccagccgtcgcgcagaagatcgacagttaatcgacgcgctgtgcgaaaaattcgcgatgagccgtcagcaattgggcgagcgactgagccagcggcttggcgtcgtcacgttaaacattatcgagcaggcgcggattggcgggctgtttctgaccggcggcgatatcgctaccgccgtcgccggcgcgcttggcgctgaaggttatcgcattcaaagtgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaa

SEQ ID NO: 957 - DNA, 1272 bp, Salmonella enterica serovar Dublin CT 02021853
atgaaaatgatggttatcgccgatgattttaccggatcgaatgataccggcgtccagttggcgaagaagggggcgagaacggaagttatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcggccatgcgcgccagtcagcgaaaactggccgttatcgccgccgcgatccctgcggccggacgcacgacgcttgaaggaaaatgtctggttaatggcgtcccgctactggaaaccgaatttgccagcgatccgaaaacgcccattgtctcttcccgcattgccgagatagtggcgttgcaaagtgagatccctgtgtatgaagtctttttgcaggatgtccgacgcggcgggttaagcgccttacttacggcttatgcggctgagggcgaagggattatcgtcgtggatgcggtggaagagcgggacctgacgttgattgcgcaagcggcgtgtgaacaaccgtcgatgccgctgctcgtcggcgcagcgggtctggcgaatgcgttgccggttgaactttttatgcaagaccggcagcggctgccggtgctggtggtggccggttcgatgagcgaagccacgcgacgtcaggtggataatgcgctgtgccggggacgtgcggaggtcgtggatatcgatgccgcgcgcatggtgtcggatagcgcggaacaggaaatcgcgtctgtcgtagagcaggcctgcgcgctgttaagtcagcatcgacatacgattttacgcaccagccgtcgcgcagaagatcgacagttaatcgacgcgttgtgcgaaaaatccgcgatgagccgtcagcaattgggcgagcgactgagccagcggcttggcgtcgtcacgttaaacattatcgagcaggcgcggattggcgggctgtttctgactggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaa

SEQ ID NO: 958 - DNA, 1200 bp, Methylobacterium nodulans ORS 2060
atgagcatcaaggtcgccgttcttgccgacgatctgtcgggcggcaacagcgtcggcgccgagttcgcgcgccaggggctcgcgaccctggtcgcgcgggtctccgaggtcgacgccgccgtgaggtacggccccgagatcatcgtcgtgaccacggatacgcgcaaccgctctcctgaggaggcggatgcgatcacgcgcgacgccctgacgcgagcggtgaccctgcagccggcctacctgttcaagaagctggacagcctgctacgcgggccgatcgccgtcgaggcggccgccacaatggcggccgccggcgcggacagcgcgctggtcgtgacggcctcgcccccgacgggaaggacgacgcgcgcgggccgccaactggtcgacggtaggccgctactggacgtcatcgccgcgctcgatccgggagcgtccctcgccaccgacgaggtcgggagcttcttcctggcctgcggacggccgttgcggcatctcgacctcgataccgttcgggctggcgagatcaagacgggcgagtggtccggccgcatcacgatcgcggactgcgagacgcaatcggatctcgaccggactgtctcggcggcaattgccgccgacgtgcggcttttcttcggcacctacgggatgggcgcctcgatcgctcgcctcctcggtcgcaacgcgggcatgcccgtgctcgttatcgccggctcgctcagcgaggcgacgcaccgtcaggtgctcgcccttcgtgaggagggcgaatgtacgctcctgtccgtcgatgccccgtcaacgtcggaggaggcccgccgcgccttgtccgccggccgcgacgtggtgctgtgcgcgcgcccggacactctcgggccatcggccgcccgcctgcttgcgccaccgacccgcgcggccgcgtcggcgatggaggagaggatcgcgcgttgcgccgaaccgctcctcgggctcgtgtccggtctcatcgtctccggtggctcgacggccgacaccctcctcgtcctcatgggagcgcatggactcgtcctgtcaggcagcgagctgctgcccggcgtgcctgtcgcccgcatcctgggagggagccacgacgggctgcgctgcgtcaccaaacccggttccttcgggaccgacgatgccctgtgtgtcgcgcggcgcttcgtgagggatcgtcggatgagctga

SEQ ID NO: 959 - DNA, 1167 bp, Pedobacter heparinus DSM 2366
atgatagcagttattgcggatgattttacaggagcggcagaaattgggggaattgctttaagacagggttggaatgctattatagatacacgcgtacaaaaaggcacggaaacagatatcctgatcattgcaacaaataccaggtcaaaacctccgcaggaagcaagaaaaaccattcgtgagcttactttacagctcctcagtcttagtccggaaatcatttataaaaaaatagactccgtattgaggggcaatgtaggggaagagcttttagagcagatggctgtttcccagaaaagaagggctttattgattccggccaatccatctttaaaacgtgttattaaagatggaatatactattatgaagggctgcctttaaaagactcaacctttgcccgcaatgtgaaacaccagattggctcttccagggtgatagatctgatgggtgatggggctggtaaggatactgttgtcatttcaagagctgaacttatgccagacaagggcttgattattggcaatactactgatgaggccgacctggaccattgggcgggccgggttgatgaggaaaccataatggcaggcggatccagttttttcaatgcgctactgagaaaaattaaagtacatccgtataccgaccctgccggttttgcatttggaaagaaggtaatttatgtatgtggaagtgcttttccattgagcagaagtgtagtagaggatgcccgtcaggcagggcaatatgtttcatacatgccctcaaggatgttttgcaagccagcagaaaaatcggcatacatggcgcattgggaaagagaaattctaaaaggggttcagcagtcgggaacagtgatagtagccattaatgttattgaagaacccagggtagaaaatctttcgtccgagctgggaaaaacaattgcaacagtaatagccaatgtcatgcaaggtgttcagctggaggaactggtgatagaaggaggggcaacagcatctgccatcatagagaaactggaatacagaaaatttcatcctacacaagaactggctcctggtgtgatcagaatgaaggttgaagaaaataaaagtttacacctaacaatgaaacctggcagctacacctggccatcttccatatggaagtattcacataaaccctaa

SEQ ID NO: 960 - DNA, 1269 bp, Dickeya dadantii Ech703
gtgctggttgtggctgacgactttaccggtgcaaacgacgccggcgtagggctggcgctttacggcgctcaggtcaatgtgctgtttgacgccgcgaggatcggtgccgtttcatcgggcgacgccatcgtcatcaataccgacagccgtgcgcttgacgccgcagtcgcgggagagcgcaccgcgcaatcggtgcggggctggcgggagcatggcgtcgaaggctggatggtcaaaaaggtggattccacgttacgcggcaatcccggcgcggagaccgaagcggcgctgcatgccgccggtgtgtcgctggcgctggtggcgccggccgcgccgtcactaggccgcgtgacccgcggcggtaatgtgtgggtgcacgaccgtctgttgacggatacggagttcgccagcgatccgaaaacgccggtgcgctcttcttccgtcggtgaacggttggcggaacagaccgcattgcggcaggcgcgggtttcattgagcgagcttcgtcaaaatggactggcggcacgtctacaacggttgagcgatcagggcgtgcggctggtggtgctggatgcggaaaatcagcaagatctcgacctgatcgtgcaggccgccgggcagctggctgcaaagccgttgttggtgggatccgccgggttgagcgatgcgctggcccgtcatctgtatcggcgcgtaggtaacgcctcgcgtgcgttgctggcggtgattggttctatgagcgaaatcgctcaaaaacaaattcaaatggcctgtcggcggccggatgtggcgctggtggatatcgatatcgacgcgctgctggcggtgtcgtacccggctgcgctggcgcgctggtgcgaacaagcggcggccacgctggcgtccgggcaccattgcctgattcgtacctgcctggacgatagccagcgtttcgagatcgacggtttgtgccagcgtcatggtatggcgcgtcagcaactgggcgataccatcagccagcggctgggggaactgactcgccagattgttggtcgccagcaaccgggcggtctctatttatccggcggcgatatcgcgattgccgtcgccaatgctttgcaggccaacggttttcatatcaaagggcaaatcgcttcctgcgtaccctgggggcggtttctggacagtgttgtcggtgatatccccgtaatgaccaaagcaggcggttttggtgacgaggctaccctgctggacgttttacgttttattgaggagaaggtgagtgagtaa

SEQ ID NO: 961 - DNA, 1287 bp, Dickeya zeae Ech1591
atgccggacgggcgtgatctcacccgcatcatggtggtggcggatgactttaccggcgcgaacgatgcaggcgtcgggttggcgctgcaaggggcgcgggtgaatgtgatgtttgacgctacggcgatccataccgggcaggcggatgacgcgttggtggtcaataccgatagccgtgcggttacggcgtcgctggcggcggagcgcaccgcgcaggcggtggcgctgtggcgtaaaaccggcgcccgcggctggatcgttaaaaaagtggattccaccctgcgtggtaacccaggtgcggaaattgaagcggcattgaacgccgccgatttatcgctggcattgattgcccctgccgccccggcgttgggccgcattacccgcgacggtcaggtatgggtgcatggcgtcttgctgacggataccgagttcgccagcgacccgaaaacgccggtgcgttcggcatctatcggtgagcggttggcggaacaaacggcgctggctcaggcgacgctatctctgcacgaggtgcgcgctgactctctggccgcgcaactgcaacaactcagcgatagcggagtccggctggtggtgctggatgcagagtgtcagcaggatcttgagcggattgtcgaggccgccgcccggttggcagaaaagccgttgctggtcgggtcggctgggttgagcgaggcgctggcgcagtcgctggcgtttccgacgccgtgccgtgctttgttggcggtcattggttcgatgagcgaaatcgctcaattgcagattaaggcggtcagccagcggcctgatgtcgagctgatcgatctggatatcgccgggttattagcggccgatgaagggatgctggcgcagaccggtcggcaggcggcggcggtgctggcggcggggcgtcactgcgtgattcgaacctgccgcgacgataatcagcggtttgaggtagacagtctgtgtcagcgctacggcatgagtcgccagcaactgggcgagaccatcagccgtcgtctgggagaattgacgcggcgcattgtgcagcggcaacgaccgggcgggctctatttatccggcggggatatcgccattgcagcggcgaccgcgctacgggccagcggattccgcatcaaaggacagattgcttcctgcgtcccctggggacgtttgctggacagtctggtgggcgatattccggtaatgacgaaagcgggcgggtttggcgatgaagccaccctgctgaatgtattgcgttttattgaggagagcgtgtgtgagtaa

SEQ ID NO: 962 - DNA, 1329 bp, Pectobacterium carotovorum PC1
atgtcaaacgtgcagcaatcagcagaacaggtcttagtggtcgctgatgactttacgggtgccaatgatgcgggcgtcggtctggcgcagcatggcgcacgggttagcgtcgtctttgacgttaataaactgcacgcggacttactgggtgatgcggtggtgatcaataccgatagccgtgcggcgcgtgacgacgtggcgtctcaacgtactgcagaagcggttgcagcctggcaggcagcaggcggacaaggctggattatcaagaagattgactcgacgttgcgtggaaatctgggcgcggaaattgccgctgcgctgtctgcggcagaggtgcccgtcgcgctgattgccgctgcgtcgccgatgctgggacgcgtgacctgcaaaggcgaagtctgggtgaacgggcgtttgcttaccgatacggagtttgccagcgatcccaaaacgccggtgacctcggcttctatcgctgctcgtctggcggagcaaaccgcgttaccgatggcggaaatacaccttgatgacgtccgtcaggccaatttagctcaccgtttgcagcagttggcggacgagggcgtacgtctgattattcttgatacggatgtgcaggacgatctggagaagatcgtagatgccgccagcgcattaccgtttcgtcctttgctggtcggttcggcaggcctgagcgaagcgctggcgaatgcgcaggattttacgcgcaaaacggcgaagccgttgctggctatcgtcgggtcaatgagtgatatcgctcaaaaacagattacggccgccaaactgctcagcaatgtcacgctggttgagatcgatatcaacgcgctcttttcaccccattcatccaccgtcatggcatctcagtgtgaggaggcggtgacggcgctgctgaacggccaccattgcattattcgtacctgtcacaacgaaaatcagcgcttcgaaatcgacgcgcggtgccagcagcttgggcttagccgacagcagcttggcgaaacgatcagccactatctgggggaacttacgcgcaaccttgttcaggcgctagacagcctgacagcggacggtactcaccagcgcgagctgggaggactgtatttatccggtggtgacattgcgattgccgtggcaaccgcactgggtgctaccggctttcagattaaggggcaaatcgcatcctgtgtgccctggggatacctgctgaacagcgttgtcggcacgacccctgtgatgactaaagcggggggttttggcaacgaaactactttgctcgacgttttacgttttattgaggagaaggtcagtgagtaa

SEQ ID NO: 963 - DNA, 1641 bp, Shewanella oneidensis
atgaccattaagaaaaaggttttagctgccgccactgcggtagcgttagctataacaccaacggcaaacagttttgatcccacgtatgaggctagttgcctaagtcgctttgatcctaaagaggtgctgctcggttatcaaaagcgctggattgccgatgagtcacccttaaaaattggtgaaaagtcacgtcgcaccggcttaacgtgggcagaagccgccgacgcttcactgactgcaggggccgcccgtggccaaggcggtaccaaccatttttacgtgggcagtaacaaagagatggcccgcgagtttattgatgctgcggccatgtgggcgaaggtatttgataaagcagcgggcgaaatccaagaggaaatgtttgtcgatgatggtcaagaaggtaaagagatcctgaccttcgccatttacttttcttctggctttaaaatccaggcgctatcttccaatccctcaaacctgcggggtatgcagggtaacgtcaccatagacgaggccgcattccacgaacgcttagccgaagtacttaaggccgctctggcgctaacaatgtggggcgcaaaagtgcgccttatctctacccataacggtatcgataacctgtttaacgagctaattaacgattcccgcgcaggcaaaaaagactacagcattcaccgaatcaccttggacgatgcctgtgccgaggggctttaccagcgcatctgccaaatccgcggtattgagtggagccaagcggccgaagatgactggaaagccaagctacttaaggccaccgctaccgaagaggacgcgctggaggaatacttctgcgtgcctaagtcgggtggaggttcgtaccttagccgtgctttgattgaatcgcgcatggcaagtgttgaacacagtggccctgtggttcggcttgagaaaaagaacgactttggtgaatggcctgaggggttacgaactgccgagatcgctgactggtgcagtagtgagctactgcccatactgcttactctcgaccagtcacgcccccatgtctttggagaggactttgcccgcagtggcgacttaaccgtgatcgatgtgggtgaaatcgcccaagatttgcacattaaaaccaagctacaggtcgagcttaaaaatattccctttcgccaacaagagcagatcctgttctacattgttgaccgtctgcctcgattgcgcggtggtgcaatggatgcgcgtggtaatggccaagcattggctgaatacgccagagaccgttatggctcagaggtgatcgagtgcgtgatgctgagtgagagcttttaccgcgaacagatgccgcgctttaagtcccactttgaagatgcactgctcaccatcccccgtgatgacgacacccgcaccgacttacaagccttggtgataaataaccgtggtactccatgcctaggtgatgtgcgtacaggcaaagaaaaagaacgtcacggcgatgctgcgattagtttattcctgatggtctatgccaccacgctcgatggtgcgcccatcgaatttacccctatccctaagagtgatcaccgcaatccaaatgcccatgcaagtgcccatgaggatgatgatcatcaactgcagcgaggttgctggtaa

SEQ ID NO: 964 - DNA, 1788 bp, Methylobacillus flagellatus KT
gtggctgaaaactccatcaatagcgagccagtcgagatcagccagggcgaaaaaaaagacctcctcgacctggttgtggagaagcaacaggatcgagggctgggtcatgcgggttctgatattcctcacatcctactgccttaccaggctagatggcataccgatatgtcaccagtccggctgggaagaaaatctcgacgtattggttggagctggggatgtatggccgctgaaggcgcgcttgaagctgccagggatagcggcggcatgtcccaatactacatgggctacaacctgggcatggcagccgagaacatcggcgatgcgctcaagtttgcccagatttacggtgtggccgcgagctccatctcggtattccgtgaccgggaaaccatgaccgtcaaggaccaggagcgcggcgtgattggcgaaagcaagcaggacatcacacgcttcaagattaccttcaagtctggccatgtgtacgaggcgctgagttccgcaccctggaactggcgtggccgtcagggtcatgcgcggatcgatgaggcagctttccaccgtaacttgcgtgaagtggtcaagggtgcgctggcgttcctgatgtggggtggccgggttgacatcgttagctcggagaacggcgaagacagcgagtttcatgccctggtgcgtgatattgaagctggcaagctggactggagcatgcacaaggtcgacttcgacgaagccgtggccgagggactctatcagcgcatatgcctggtcaagggtgaagtctggacccgcgagaaagaacaggaatggcgcgacaagattttttccagctacagcaaccaggaagacgccaacgaagagctgctgtgcatcccgaaaaaaggcagcggcctctatatgccgcgcttcctggtggagcaatgccaggacgacagcattccccgcttgagcctggccaagggcgaggcttacgtcaccgacccgaatcgcctggtcgagaccgagcgctggtgcaaggaggtgctgaagccggtgatcgacaacatggaccacggcaagcgctcggtgtatggccaggatttcggccggtccggcgacttgtccgtgatctgggtgcttcaggagaaaagcgccagtgaatggacgacggctttcgagctgagcctgcgcaacttgccgttcgatgtgcaggcgctgatccgcgattacatcctggacaacatcccgcacttccagcacgcctcttttgatgcacgtggcaacggccagagccacgccgaaggtgccgtgcagcgctacggtgaatatcgcatcacttgtgtcatggctaccgcttcctggtacgccgaatggttccctcgttacaaatctgcttatgaggccaaggcgatcacggtggtcggcggtgaggatgtcattaccgaccatcgccgtgtgattctccaggctggcaggcccaagatggacgacgggcgcgacaaaggcacggatggcggataccggcacggcgattcggccattgccggtgtgatggcctggcatgcagccagccaggaaggccagccagcggcgggcgcaacggtggaatctcagcccgaaatatttaaagcgccacggataggtcgcctgggccggtggctgcacaaaaccctgctgatcgatttaaggcccgtagcgcgttttttatcgcttgggcgggcatgtgtagccaatttgttttttaacggctttatgaaccttcataaagcggtatttgcgggacaggaaaggtcggctgatgggcttgtttga

SEQ ID NO: 965 - DNA, 1578 bp, Polaromonas JS666
ttgcatcccttgggtcatagggctcattttggtgagcctcgttcgggctttatcttgagcaccacgcccccgctccttcaaagcgacgcgaacagtacggacgcgccgccacctgtcctgttgccgtatcaacagcgctgggtcgccgacgattcgcaattcaagatcggcgagaagtcgcgccggattggttttacctggggcgaggcgtctgacgatgtattgattgctgccaaagaaggcggcacgaacgttttctacatcggcccgactcaggacatggcgctcgaatacatcgaagcctgcgccatgtgggcgcgggttttcaacttcgcggccagccaggttcaggaaggcatcttcgacgacgaagataaggatataaaaacctacaaaatcgacttcccggccagcggccgccgcatcctcgcgctcagctcgcgtcccaccaacctgcgcggcaagcagggcgtgatcgtcattgacgaagcggcctttcatcccgatttgcaagggcttttaaaggccgctatggccatgttgatctggggcgacaaagtccgggtcttttccagccacaacgggctggacagcccgttcaatgaactgatcatcgacgtccggtcgggccgacgcaagggcgtggtccaccgcgtgacgttcatggaggccgtcgccgagggcctctataagcgcgtttgcatgcgccgccgaattccctggactgccgagggcgagaaggagtgggtctccgacgtgtatggcttttacggcgacggtgcgaccgaagagctggacgtggtgccatcgcaaagcggtggtgcctacctgacgatggccttgatcgaacggcaaatgagcgccgagaccccgctgattcgcggcaagtggaagtccgagttcaacatccagcccgactgggagcgcgaggccgagatacagcgctggtgtgaagaacacctggagccagtgctcatggcgctgcccaagcacctgtggcacagcttcggcgaagacttcggccgcgtgggcgacctgaccgtgatgatcgtgctgcaggagcagcccaacctggacaaacgcgtggtgctgcacgtcgagctgagcaactgccccttcaagcagcaggagcaaatcctcaagttcatcatcgaccggctgtaccgctttcgcgcgggcgcgctggaccgcaccggcaatggtgcatacctgtctgaggtggccgtgcagaagtacggcgccacccgtatcgagggcatccacctcagcgagacctggtatctcgaaaacctgccgcgcaccaaggcggcacttgaagacaacacgctcagcggcatccccaaagacagccaggtgcgcgacgatctgcgggcgctgcgcgtcatcaacggcatccccaagctgccagccgtcaaaacgcaaaaaggcgacggcgaaaagctgcagcgccacggcgactcagccgttgccctggtaatggccgactacgccatgcgccgcgaggtggtgccgattgaattccaggccctcggcgtagcgcgcgccagcagcagcatggccgattacatgggaggctga

SEQ ID NO: 966 - DNA, 1566 bp, Vibrio cholerae O395
atgaactatgaattccgcgaacaagatgtgctgctgccttaccagaagcgatggattgctgatgaatctccgctaaagattgcggagaaaagccgccggacgggtattacttgggcggaagcggccgatgctgcgctcacggcttctaagtcaaaggccgcaggtggcactcaccatttctatgtgggttccaacaaagagatggcgcgcgaattcattgatgcggtagcgatgtgggccaaggcgtttaactatgcggcgcaagatgttcaggaagaagtctttctcgatgacgatggcaacaaagaaatcttaacctttgtggtctatttcgcttctggctttaaggtgcaagcgttatccagcaacccttctaacctgcggggtatgcagggctgcgtaaccattgacgaagccgcattccatgaacggcttgcagaagtgctcaaggccgcgttggctttaaccatgtggggcgcaaaggtgcgccttatctctacccataacggggtggacaacctatttaaccagctcattcaagacagccgcgcaggcaagaagcgttactcgatccataccatcacgttggatgatgcctgccgcgatggtctgtataagcgtatctgtcaggtcaaaggcaaaacatggacgcaagaagccgaagaccaatggaagcgtgacctactgcgtgacaccgccaccgaagaagatgcgctggaagaatactactgtgtgccgaagaacggcggcggcgcatacattagccgtggtcttcgtgagcgtgcggcctctttggctgatgcgcccgtaatcagctttactggcagcgcagcattcaacaatgcaggcgaagccgagcgcatgcgtactatgcaagagtggctagtggagaacgttggcccacaactgcaagccttgcctaaagggttgcgccatgcactcggtgaagactttgcccgtaacggtgacttaacgtcgtttgctccgattaccgtcgagacagataccaagcgaacggttccgttcctagtcgagcttaagaacgtgccattcaagcagcaagagcaagcgctgtactacatctgcgatcgcctgcctcgccgcgacggcatcaagctcgatgcgcgtggtaacggccaataccttgccgagcaggcccgataccgttatggcgcggaagttgaagaggtcatactctctgtcgcctactaccgtgagaacatgccgaagttcaaagccgctttcgaagatgacgaaataaagctgcctaagcatgaggatgtgatcaccgaccttgggcaaatcaaaatctatcgtggtgtgcctggcatcgatgacagccgaaccaaaggcagcgatggtaacaagcgccacggtgatagcgcggtggctatcttccttgcttatctcgcttctaaagccgacatcacccgttacgaactgcacaccatcaaagcgaatgccgatgaaacacagcgccgcttctttggtacagcagaagaaaacaaccgatttgacgacatgccgcacgccagtgatctgcgcggcaaaggaattcgactatga

SEQ ID NO: 967 - DNA, 1641 bp, Shewanella baltica OS185
atgaccattaaaaaaaaggtgttagtggccgcgactgcggtagcgctagccatcacgccaacagcaagcagctttgatcccacgtatgaggcaagttgcctaagtcgctttgatcctaaagaggtgctgctcggttatcagaaacgctggatagccgacgagtcaccgctgaaaattgccgaaaagtcgcgccgaaccggactcacttgggctgaggctgccgatgcttctcttaccgcaggcgcagcccgtggccaaggggggactaaccatttttatgtgggcagtaacaaggagatggcacgggaatttatcgacgctgcggccatgtgggccaaagtatttgataaagcagcaggtgaaatccaagaagaagtgtttgttgatgaaggccaagacggtaaagagatcctgacctttgccatttactttgcctcaggttttaaggtgcaggcgctatcgagtaatccctcaaacctgcgtggtatgcaaggcaatgtgactatagacgaagcggcgttccacgaacgcttggccgaagtactaaaagcggcattggcgctgaccatgtggggcgcgaaggtacgcttgatctccacccataatggcattgataaccagttcaatgagctgattaacgattcccgtgcgggtaaaaaagattactccattcaccgcgtcaccttagatgatgcctgtaatgaggggctgtataagcgtatttgccaagtgcgcggcatcgaatggagccaagcggccgaggatgactggaaagcaaaattactcaaagccactgccactgaagaggatgcgttagaagaatacttctgtgtgcctaagtctggcggtggtgcctatcttaaccgcgcgttaatcgaggcccgcatggcgagcatcgctgatagcggccccgttgttcgccttaaaaaagacgatgcttttggacaatggccagagggtttacgagcggcggagctccttaagtggtgtgaggatgaactgaagccggttctcgatagcttagaccctgcacgccctcattgctttggtgaagactttgcccgtagtggtgacttaaccgtgattgacgtgggggaaatcgcccaagatctccacattaaaaccaagttacaggttgagcttaaaaacattccctttcgccaacaagagcagatcctgttttacattgtggaccgcttaccacggctgaggggcggcgcgatggatgcgcgcgggaatggtcaagcgttagcggaatacgcccaggataaatacggcagtgaagtgatcgcctgtgtgatgctatctgagtccttttaccgcgagcaaatgccacgctttaaaagccactttgaagatgggctgttaactatcccaagggatgacgacacctgtactgacctgcgggccttaagcattaaccgccgaggtacgccatgccttggcgatgtgcggacaggccaagaaaaagaacgccatggtgatgccgcgatcagcctgttcttgatggtatacgcctcaaccttagacggtgcccccatagagttcacccccattcctagaagtgatcaccgtaatccgaatgccgcagcaagtgcccatgaggatgatgatcatcaaacgcagcgaggttgctggtaa

SEQ ID NO: 968 - DNA, 1641 bp, Shewanella baltica OS195
atgaccattaaaaaaaaggtgttagcggccgcgactgcggtagcgctagccatcacgccaacggcaagcagctttgatcccacgtatgaggcaagttgcctaagtcgctttgatcctaaagaggtgctgctcggttatcagaaacgctggatagccgacgagtcaccgctgaaaattgccgaaaagtcgcgccgaactggactcacttgggccgaagctgccgatgcttctttaactgcaggcgctgcccgtggccaaggcgggactaaccatttttatgtgggcagtaacaaggagatggcgcgggaatttatcgacgctgcggccatgtgggctaaggtatttgataaagccgcaggcgaaatccaagaagaagtgtttgttgatgaaggccaagacggtaaagaaatcctgacctttgccatttactttgcctcaggttttaaggtgcaggcgctatcgagtaatccctcaaacctgcgtggtatgcaaggcaatgtgaccatagacgaagcggcgttccacgaacgcttggccgaagtgttaaaagcggcattggcgctgaccatgtggggcgcgaaggtacgcttgatctccacccataatggcattgataaccagttcaatgagctgattaacgattcccgtgcgggtaaaaaagattactccattcaccgtgtcaccttagatgatgcctgtaatgaggggctgtataagcgtatttgccaagtgcgcggcatcgaatggagccaagcggccgaggatgactggaaagcgaaattactcaaagccacggccaccgaagaggatgcgttagaggaatatttctgcgtgccaaagtctggcggtggtgcctatcttaaccgcgcgttaatcgaagcccgcatggccagcgtgacagatagcggccccgttgttcgccttaaaaaagacgacgcttttggacaatggccagagggtttacgggcggcggagatccttaagtggtgtgaggatgaactcaagccggttctcgatagcttagaccctgcacgcccccattgctttggtgaagactttgcccgtagtggtgacttaactgtgattgacgtgggggaaatcgctcaagatcttcacatcaaaaccaagttacaggtcgagcttaaaaacattccctttcgccagcaagagcagatcctgttttacattgtggaccgcttaccacggctgaggggcggcgcgatggatgcgcgcgggaatggccaagcgttagcggaatacgcccaggataaatacggcagtgaagtgatcgcctgtgtgatgctatctgagtccttttaccgcgagcaaatgccacgttttaaaagtcactttgaagatgggcttatcactattccaagggacgatgacaccagtactgatctgcgggccttgagcattaaccgtcgaggtacaccatgccttggcgatgtgcgaacaggtcaagaaaaagaacgccacggtgatgccgcaatcagcctgttcttgatggtatacgcctccaccttagacggtgcccccatagagttcacccccattcctaggagtgatcaccgtaatccgaatgccgcagcaagtgcccatgaggatgatgatcatcaaacgcagcgaggttgctggtaa

SEQ ID NO: 969 - DNA, 1554 bp, Thioalkalivibrio HL EbGR7
atgaacgtgcccgcccgcgtgcccgccacccacgaagccgccgcgccgccgccggtgctgctggactatcagcaggcgtggatcgccgacgacagccagctcaaggtcagcgagaaaagccggcgtaccggcctgacctgggccgaggccgccgacgacgtgctgatcgccgccgccgccaagcgcgcgggcggcatgaacgtctactacatcggctacaaccaggacatggccatcgagtacgtggaggcctgcgcgatgtgggcgcgggccttcaaccacgccgccagcgccgtcgaggaggggatctgggacgacgccagcgacgacaagcacatcaagacgttcaccatccgctttcccgacagtggccaccgtatcgtggcgctctccagtcgcccggccaacctgcgcggcaagcagggggtggtggtgatcgacgaggcggcgttccacgacaggctcggcgagctgctcaaggcggccctggcgctgttgatctggggcggcaaggtgcgcgtgatcagcacccacaacggcgacaagaacccgttcaaccagctgatcgacgacatccgcagcggccgtcggcgcggcagcgtgcagcgcatcaccttccgtgaggcggtggcccaggggctctatcggcgggtgtgcctgcgcctgggcgagacctggagcgccgaggccgaggccgagtgggtggccggcgtgtacgccttctacggcgaggcggcgcgcgaggagctggacgtggtgccgtccgagggcgagggcaactacctgcccagggcgctgatcgagtcgcgcatggtgccggccccggtgctgcgcctgcgcaaggacgacgagttcaagcactggcacaaggcggcgcgcgaggcggagatccgcgactggtgcgaggagcagctaaagccgctgctgctggccctgcccgacgatctgtggatcgccttcggccaggacttcggccgcaccgcggatctctcggtgatcatcccgctggtgatcggccaggacctggtgcgccgggcgcccttcgtggtggagctggccaacatgccgttcgagcagcagcgccaggtgctgttctacctgtgcgatcgcttcccgcggttccaggccggcgccctggatgccaccggcaacggcgcctacctggccgaggtgacggcccaggcctacggcgcccaccgggtagaggagatcaagctgtcgcagggctggtaccgggagaacatgccggtgctcaaggcggccttcgaggatggcgacatcgagctgccccgcgacagccacctggtggatgacctgcgggcgatccgcaaggtggatggcgtggccatggtgccgcgcaatagccgccaggaggggcgtcacggcgacgccgccattgccctggcgctggcctactacgccagccgccgcgacccggcgccgatcgagttccaggcggcgccggcccggcgcgatcgctgggacgaggtggccggcgacggcttcgacatgctggacgacatcaacgctgcaggaggggatggcgcatggtag

SEQ ID NO: 970 - DNA, 1644 bp, Agrobacterium vitis S4
atgaccggtcctgtcagcaaggaagaatgggcgaaagctcgacggttttctacagatgccgtcctcggcttggtcgggaaggaaggccttggcaaggcactattgccgtatcagtcgcggacagttggtctccttgaaagctcggcttgcaaggttctcttcgttgagaaaagccgtcgtatcggtctgacatggggctttgcctcctatgccgcattgcgcgccgccagggcaaagagcgccggtggcatggacgtgatgtatatctcctatagccaggagatgacccgcgagtttatcgacgcctgcgcgatgtgggctcgtgcctactcgttggccgccatggaaatggaagagttcgtcttcgaagataagaccgaagacggtgatcgctctattcaggccttccgtattcgctttgcctcagggttcgaagtgctggccctttcttcagcgccacgcactctgcgcggtaagcagggtgtggtgatgatcgatgaggcggcgttcgtcgatagcttgccggagctgctgaaggccgcactggcgttcctgatgtggggcggccaagttgtcgtttgctccactcacaatggcgcggaaaacgagtttaacctccagatccaaaacatcctcggcggtcgtaacaaatacgatcacatcaagatcgactttgacgacgcgctgcgggatggcctctacgagcggatttgcctcgtcaccaatcaggaatggtcccctgaaaacgaagccgactggcgcgaagacatcatcgacttttacggcgatggtgcggacgaagagttgttctgtgttgcctccatggggtctggcgcctggttgacctcgcccctgatcgaagcgcgcatgacgtcggatgctccggtcctgacgcttgatcttcctgacaactatttgcatctgtcggaacttgaacgcgcaaaattgctagctccattcatggaggagctggacgaggcgctggacaagcttgatccggcattgatgcatgccttcggttttgactttgcgcgcgttgctgacctttcggtcgggaaactgttggcgattgacaagaagctcaatcgcaaaagcgcgttgaccgtcgaactgcgcaaggtgccgggcgacgaacaaaaacaaatcacagagaaaatccttcgacgtgccccgcgtttggtcggggcggccttcgacgccaccggcatgggttggacagttgccgaagacatggggcggctttttggcctgagggataaggacaatgaaggtggtctggttcacgcgatcaagttttcgcaggactggtatcgtatccatatgccgccgcttaaaaccgcgtttgaagacgcggcaatttccatttccaagaacgcagaccatctttccgatcttcgcttggtcaaagtgatacgcggcattccaatggtgccggaagcgcgtacgggcgagaaaaacaagaaacgccacggggactatgcgatcgcgctggccttggcccatttcgcaagccgtatgcagtggtgtgaattcgattaccaaccagcaccgccgtctgcgtcccgctcgtcagaaacaccctccagagacgatgagcgaccgtttcgcatgtcgtcgctcagaaacaaacgtggaggcttttga

SEQ ID NO: 971 - DNA, 783 bp, Desulfovibrio desulfuricans G20
gtgaaacaggtattttttgtttttctggtattttttttcggtctgcctgtggttgtgctggcactgtatgccgcggcaccgggctggagctggccgcatctgctgccgcaggatttttcggcacgcgcagtacagtacctgtggcagcagcgggcggaaataggcagacacataggcacgtcgctgtggtatgccctgctgacaacggggctgagttttgtgctgtgccttgctccggcgcggcatttcgcccggtgcacgttcagggggcgggccctgctggaagctttgcttcttgcgcccgcgctggtgccggtgatgacattctccatgggagtgcaccatgtctttatcatcaccggtctggcagataccgtcaccggcgtggtgctggttcttaccgtgttctgttatccgtacatgctgcgggcgctgacggccggttttgcctcgttcggcgaagggtatgacctgtgtgcgcgcaatctgggtgccggatggtggctgcggctgacccgcgtggaactgccgctgctggctcctgccgtggttgccggagcctctgttgtttttctggtggcgttttcagactattttctggtgtttcttatcggcggcggggtggtgccttcattcacgggctatctgtttccgctgctcgcttcttctgacagggcgctggcatcggcgttgtcactggtgtttcttgttattcccgttgttctttttgttctggtggaactgcttgtggcgcgtgtttaccgcagacgcggcatgtactag

SEQ ID NO: 972 - DNA, 837 bp, Yersinia pseudotuberculosis IP 31758
atgagccgcaccaccaatggccgcctggtggtcacgatttcgctggtttttttcgccattgccaatctactgtggctggggctaccgttcggtatggcgatcctctggtcactggttgaccctcagtatccctggagctatccagatattttcccacaggtgctgtcatttaaccgctggctgctggtctgggaaaaaacctcactttccgaagcactgattaacagttacaccatcgcgcccgtggtggcagccaccagcctactgctatcgctacctaccgcgtatgccttcgggcgcatgagatttcgcggcaaggcagtggcggagatgctaaccctgatcccgctagtgatgccgggaatgattatcggtatcttcttcagcgccatgctaatgaacctcaatatcagcaacccgtttttcagcatcgtgttgggccataccgtgctgacgctaccctactccatccgcattatgtccgcggggtttaaagcagtaccgcaggatctgatcgatgccagccgcgatctgggtgctggcatatggggcaccttctgcaacgcctacctgccgctgctaaaaccgagttttttggcagcgctgattttctgcttggtgaaaagtctagaagaattcagcatcgcttatgtccttggcgcaccagattttattaccgttccgaccattctttattccttcctcggctactcctttgtccgcccagatgcagcggtggtatcaatgattctggtgatcccaaatgtcattttgatgatcatcattgagaagcttttgaagggtaattatctgtcacagtccaccgggaaagcctga

SEQ ID NO: 973 - DNA, 837 bp, Yersinia pestis Angola
atgagccgcaccaccaatggccgcctggtggtcacgatttcgctggtttttttcgccattgccaatctactgtggctggggttaccgttcggtacggcgatcctctggtcactggttgaccctcagtatccctggagctatccagatattttcccacaggtgctatcatttaaccgctggctgctggtctgggaaaaaacctcactttccgaagcactgattaacagttacaccatcgcgcccgtggtggcagccaccagcctactgctatcgctacctaccgcgtatgccttcgggcgcatgagatttcgcggcaaggcagtggcggagatgctaaccctgatcccgctagtgatgccgggaatgattatcggtatcttcttcagcgccatgctaatgaacctcaatatcagcaacccgtttttcagcatcgtgttgggccataccgtgctgacgctaccctactccatccgcattatgtccgcggggtttaaggcggtaccgcaggatctgatcgatgccagccgcgatctgggtgctggcatatggggcaccttctgcaacgcctacctgccgctgctaaaaccgagttttttggcggcgctgattttctgcttggtgaaaagtctagaagaattcagcatcgcttatgtccttggcgcaccagattttattaccgttccgaccattctttattccttcctcggctactcctttgtccgcccagatgcagcggtggtatcaatgattctggtgatccccaatgtcattttgatgatcatcattgagaagcttttgaagggtaattatctgtcacagtccaccgggaaagcctga

SEQ ID NO: 974 - DNA, 837 bp, Yersinia pseudotuberculosis YPIII
atgagccgcaccaccaatggccgcctggtggtcacgatttcgctggtttttttcgccattgccaatctactgtggctggggctaccgttcggtatggcgatcctctggtcactggttgaccctcagtatccctggagctatccagatattttcccacaggtgctgtcatttaaccgctggctgctggtctgggaaaaaacctcactttccgaagcactgattaacagttacaccatcgcgcccgtggtggcagccaccagcctactgctatcgctacctaccgcgtatgccttcgggcgcatgagatttcgcggcaaggcagtggcggagatgctaaccctgatcccgctagtgatgccgggaatgattatcggtatcttcttcagcgccatgctaatgaacctcaatatcagcaacccgtttttcagcatcgtgttgggccataccgtgctgacgctaccctactccatccgcattatgtccgcggggtttaaggcagtaccacaggatctgatcgatgccagccgcgatctgggtgctggcatatggggcaccttctgcaacgcctacctgccgctgctaaaaccgagttttttggcagcgctgattttctgcttggtgaaaagtctagaagaattcagcatcgcttatgtccttggcgcaccagattttattaccgttccgaccattctttattccttcctcggctactcctttgtccgcccagatgcagcggtggtatcaatgattctggtgatcccaaatgtcattttgatgatcatcattgagaagcttttgaagggtaattatctgtcacagtccaccgggaaagcctga

SEQ ID NO: 975 - DNA, 846 bp, Desulfovibrio vulgaris  Miyazaki F
atgccggtgggccgggcagattcgcgtcccggatcacgtccgggatcacgtccggcgtcgcgttcgggatcgcgcctgttcctgacgctgctgtggctgctgttcggcctgccgctgccggtgctggccctgtgggccgccgcgcccggctgggcctggcccgacctgtggcccgccgtccttggcgggcgcacggcggccttcgtgctggcccaccggcagtccatcgccggggtgctggcctcgtccaccgtgtattcgctggccgtggtggcggtaaccctgtgcacctgcctggccccggcgcggctgctggctttcgggcggttccgggggcgggcggcgctggaggggctgctgctggctccggccctgctgcccgccatgggctttgccctcgggctgtacggcaccctggtgcgccttggcctggcggacaccccggcgggcgtggtgctggtgctgtcggtggtgtcgtacccgtacatgctgcgggcgctggcctccggcttcgaggccgtggggccggactatggccgttgcgccgccaacctgggtgccggtccgctgctgcgtctgctggccgtggaattgccgctgctgctgcccgccgccgtggctggggggtcggtggtgttcctggtggccttttccgactattttctggtgcagcttgtgggcggcggggtggttgcctcgttcaccgggtatctgttcccggtgttgcaatcgcccgacagggggcttgcggccatgttgtcgctggtattcctggtggtgcccgtgacgctgttcgtgctggtggaagggctggtgctggccgtgtaccggcggcgcggcatgtag

SEQ ID NO: 976 - DNA, 867 bp, Agrobacterium vitis S4
gtgatggccgttcttgaactcgccccgcctgccacagcacgacgccgcatgttccgacccgaagaccgcattctcgttactattggcctgttcggttcgctggcccttgccatcgccctgccgctcgccctgatgtttatctggagcattgccgatggctggcagccgccgcatgtgctgccgcaagtctatacggccagccgctgggccagcgtgctgagtgatcaaggcctgctccaagcgatggcaaccagcctcggcatcgccttcacggtcacgttcgcaacggcacttatcgccttgccgaccgcctgggcgatggcccgctttcccttccggctgaaacggctggtggagatcttcattctcgcgccagtcatcattcccggtctggtggtcgcggtcggcattggccaggtgtttctggcgctgggccttgcctattcggtggctggcgtcatcattgtccagatcgtcggcaccctgccgctgatgatccggctgatgaccgcaacgcttgagaccattcccgacgaattgatccatgcggcccgctcgctgggtgcaggaacagttggcattgtcgcgcatatcatcctgccgctggccgtgcccgggctgctggcgggcgggttgatgtcgttcattggcagtttcgaggaattcgacaaatccttcattgtcggcgcgcctgtggtccagaccctgccgatcaagctttacatgtatctcgacccctattcgatgcagctgccgctggccgccatcgtctccttcatcctgcttttgccagccctcatcgtcttcatcatcgccggtcgcatcctgcgcgacgacctgatggcggcaggcatgggcaagatctaa

SEQ ID NO: 977 - DNA, 837 bp, Dickeya dadantii Ech703
atgatgggccgcgacaacatggcgtgtgtgaatcgggtgctgctggtggcgctcttactgctgggcgtggtgtggatggtgttgccgttcgcgatggcgatcctgtggtcgttggtggatccgtctcatccttgggcctaccccgatgtgctgccgcgggtattgtcgctggcgcgctggcggttgatgtggaacagcacatcgctgcccgacgccatgataaacagctacctgttggcgccggcggtggcgctggcttccctgctgctggcgttgcctgccgcctatgccttcggccgtcttgatttccccggcaaatcgctggcgcaactgctgacattactaccgatcgcctggccgggatttgtgattgccatatttctttccgcgctgctgatgcggttggggctctattcgcgattcctgggcattttcatcggtcacacggtgctgtttctgccttacgccatccggattttgagcgtggcattcgcgctggtgcgccaggatctgattgacgcagcccgcaatctgggggcgccgcggcgcatcgtgttatgcacggcatactggcccacgctgaaatccggcgtgctggcggcgctgatcatggtgtttatcctgtctatcgaggaattttcggtgtcctacattatcggcgcgccggatttcattaccgtgccgaccattctctattcatacctgggctacaactttatccggcccaatgccgccgtcgtttcgctcattctggtggtgcccaacgtactgttgatgctggtgatggagcgcctgatgcgcaacgtctccacctcggtttttgtcagcaaagggtaa

SEQ ID NO: 978 - DNA, 834 bp, Dickeya zeae Ech1591
atgcagcaaacggccgttaaccgactcaatcgtctgctggtggcgttgtttctgttgctggggtgtgtgtggtttattctgccgtttgccatggcggtgctgtggtcgctggtggaccctgcgcatccctgggcttacccggatgtgtttccgccggtgttgtcactgctgcgctggcgcgatctctggaataatacctcattgcctgatgcgctgttgcacagctacctgctggcgcccttagttacgctgacttgcctgttgttggcgatgccgaccgcgtatgccttaggccggttgtcgtttcccggtaaaggcgtcgcgcaggtattgacgctgttgccgatcgtattgccgggattcgtggtggcggtcttcttctcttcattgctcatgcaactgggcatctattcacgatttctggggatttttctcggtcacacggtgctgttcctgccatatgccattcgaatcatgagcgtctccttcagccaggtacggcaggatttgattgatgcggcgcgtaatatgagggcgtcgcgctggcgcgtcttccgggtagcttattggccgtcgcttcagtctggtgcaatggcatcgatgatcatggtgttcatcctgtcgattgaagaattttccgtttcttacatcgtgggggcgcctgatttcatcaccgttcctaccatcttgtattcctatcttggctataacttcatccggcctaatgccgccgtagtgtcactgatcctggtgctccccaacgtggtgttgatgttactgatggagcgctgtctcaagcatgtgccgacatccgcattcgttaataagggatag

SEQ ID NO: 979 - DNA, 816 bp, Desulfohalobium retbaense DSM 5692
atgcgaccattagcaaagcagaaccgctggtaccatatcctctttttcctgggggtggttgtcctgttttgctcccctgtcgtggtcctggtgctctccagcatcggcccgcactggcagttcccccacctctggccgcaggaggtgtcctgggagccgctcaacacgctttggaaccagcggcttcccctgctgcgacatctgtcgagttccataggctattctctggcaacggtggcgaccacattgcttatgtgcctgacgcccgcggccaccctggcccacagccattttcggggcaagacgcttctcgaaggattgttgctcaccccagccctggtcccgccgatgacctatgccatggggttgcacgtcgcgtttttgcacaccgggctcgccgacaccttcgctggcgtggttttggtcctctcccttttcagctttccctatatgctgcgtccccttgtggccggatttgaacagatggggaccagttatggccaatgcgctcgcaatctcggcgcttcccgcctgcgcacggccctggaaatcgaactccccctcttgctgccttccattctcgccggaggcagtgtggtctttctggttgcgttctccgaatatttccttgtctttttgattggaggcggttcggtcgaatcctttaccggtttcctggtccccctcctgcaatcttcaaaccgcgctctggcttcggcctgcacattgctctttctgctcgttccgctcatgttgttcgccgccagtgaaggcgtcgtggccgcctattggcgcaaacggggcgccccgatctga

SEQ ID NO: 980 - DNA, 1293 bp, Enterobacter sp. 638
atgaaagtattagtcattggtaacggcgggcgcgagcacgctctggcatggaaagctgcgcagtcgccgcgggtgagcaccgtttttgtcgcgccgggtaacgctggtacggcactggaacccactctgcagaatgtggctatcggtgtgaccgatattccggcgctgctgaattttgctcagagcgagaaaatcgatctcaccatcgtcggtccggaagcaccgctggtcattggcgtggttgatgcattccgcgccgctggcctgacaatctttggtcctacagaaggcgctgcacagctggaaggctctaaagcgttcactaaagatttcctcgcgcgtcataaaatcccgacgggcgaatatcagaacttcactgaagttgaacctgcactggcttatttgcgtgaaaaaggcgcaccgatcgtcattaaagccgacggtctggcggccggtaaaggcgttatcgtcgcgatgacgctcgaagaagccgaagccgcggttcaggatatgctggcgggcaacgcttttggcgatgcgggtcatcgtatcgtgattgaggagttcctcgacggtgaagaggccagctttattgtcatggttgacggcgagcacgtgctgccgatggccaccagccaggatcacaaacgcgttggcgatgcggataccgggccgaataccggcggaatgggcgcttactctccggcaccggttgtgactgatgaagtccaccagcgcaccatggaccgcatcatctggccaaccgtcaaaggtatggcagcagaaggcaacacctacaccggtttcctgtacgccggtctgatgatcgacaagcagggcaatccaaaagttatcgaattcaactgccgcttcggtgacccagaaactcagccaatcatgctgcgtatgaagtccgatctggttgaactgtgtctggcagcatgcgaaggcaagctggatgagaaaacatccgagtgggacgatcgcgcttctctgggcgtggtgatcgctgcgggcggttatccgggtgattatcgcaacggtgacgagatccacggcctgccgctcgaagaagtcgatggcggtaaagtgttccacgccgggacgaaactcgcagacgacgatcgtgtattgaccaatggcgggcgcgtactgtgcgcaacggcgctgggaaatacggttgctgaagcgcagaaacgtgcgtatgcactgatggctgatattcactgggacggcagctttagccgcaacgatattggttatcgtgcgattgcacgcgagcaaggcgagtaa

SEQ ID NO: 981 - DNA, 1287 bp, Yersinia pseudotuberculosis IP 31758
atgaatattttgataattggtaacggcggtcgtgaacacgctctgggctggaaagccgcccaatctcctttagcggacaaaatttatgttgcaccaggtaatgcgggtacagcactggaaccgaccttagaaaatgttgatatcgccgccactgatattgccggtttactggcctttgctcaaagtcatgatatcggcctgacgattgttggcccagaagcccctttggtgatcggcgtggttgatgcgttccgcgctgctggtttagctatttttggcccgactcaggctgcggctcaattagagggttctaaagccttcaccaaagatttcctggcccgtcacaacattccctctgcggaataccaaaactttacagatgtcgaggccgcattggcctatgtgcgtcaaaaaggtgcgccaatcgttatcaaagccgatggtctggccgccggtaaaggcgtgattgttgcgatgacgcaggaagaagccgaaaccgccgtgaatgatatgttggccggtaacgcttttggtgatgcagggcaccgtatcgtggtggaagagttccttgatggcgaagaagccagctttatcgtgatggttgatggcgaaaatgttttgccaatggcgaccagtcaggatcataagcgagttggcgatggtgataccgggccaaataccggcggaatgggtgcttattccccagcccccgtggtaacagatgatgttcaccaacgggtcatggatcaggttatttggccgaccgtgcgtggtatggcggcggaaggtaatatttacaccggtttcctctatgctggcctgatgatttcagccgatgggcaacccaaagtcattgagttcaactgccgctttggcgatccagaaacgcagccaatcatgttgcgtatgcgctccgatttggtcgaactgtgtttagccggtacacaaggcaaactaaatgaaaaaacctcagactgggatgagcgcccatcactgggggtcgttttagccgctggcggttatccagcagattaccgccagggtgatgttattcatggcttaccacagcaagaagtcaaggatggaaaagtcttccacgcggggaccaagctgaatgggaatcatgaagttgtcaccaatggtggccgcgtcttgtgtgtcactgcactcggtgaaaccgtcgcgcaggcgcaacaatatgcctatcagttagctgaggggatccagtgggaaggggttttctgccgtaaagatattggttatcgagcgattgctcgcggtaagtaa

SEQ ID NO: 982 - DNA, 1284 bp, Serratia proteamaculans 568
atgaatattttaattatcggcaacggcgggcgtgaacacgcgctggcctggaaagccgctcagtcaccgttggcagataaagtctatgtggcgccgggcaatgccggtaccgcattagaaagcaatctcgagaacgtcgcgatctccgctaccgatattccggcgctggtagcctttgcccagagccatgacattggtctcaccatcgtcgggccggaagcgccgctggtgattggcgtggttgatgccttccaggccgccggcctgaaaatctttgggccatctcaggcagcagcccagctagaaggctctaaagcctttaccaaagacttcctggcgcgtcataacatcccaagcgccgaataccaaaactttaccgaggttgaaccggcgctggcttatctgcgcagtaaaggcgcacctatcgtcatcaaggccgacggcctggccgcaggtaagggcgtgatcgtcgccatgacgctgcaggaagccgaagacgcggtgcaggacatgttggccggtaacgcttttggcgatgcaggtcaccgtatcgtgatagaagagttccttgaaggtgaagaagccagctttatcgtgatggtcgacggcgagaacgtggtgccgatggccaccagccaggatcataaacgcgtcggcgacggtgataccggcccgaacaccggtggcatgggcgcctactccccggcaccggtagtcaccgatgaaatccaccagcgcgccatggatcagatcatctggcctaccgtacgtggcatggctgcggaaggtaatacctacgtcggtttcctttacgccgggttgatgatctccgccgacggccagccaaaggtgattgagttcaactgccgctttggcgatccagagacccaaccgatcatgctgcgcctgcgttctgatctggtcgagctgtgtctggccggtgcagaaggtaagctgggtgagaaaacgtccgagtgggatgaacgtcctgcgctgggcgtagtgttggcagccggtggctatccgggtgattacaacaacggtgaagtcatccaaggtctgccacagcaagaaagtgccgacggtaaagtgttccacgccggtacccgcatgcagggcaatgacgtggtcaccagcggtggacgcgtgctgtgcgtaaccgcactgggtgagtcggtggctcaagcgcaacaacgcgcctatcaattagcggaaggtattcagtggccggggagtttcagccgcaaagacattggctaccgtgcgattgcgcgcggcaaatga

SEQ ID NO: 983 - DNA, 1287 bp, Yersinia pestis Angola
atgaatattttgataattggtaacggcggtcgtgaacacgctctgggctggaaagccgcccaatctcctttagcggacaaaatttatgttgcaccaggtaatgcgggtacagcactggaaccgaccttagaaaatgttgatatcgccgccactgatattgccggtttactggcctttgctcaaagtcatgatatcggcctgacgattgttggcccagaagcccctttggtgatcggcgtggttgatgcgttccgcgctgctggtttagctatttttggcccgactcaggctgcggctcaattagagggttctaaagccttcaccaaagatttcctggcccgtcacaacattccctctgcggaataccaaaactttacagatgtcgaggccgcattggcctatgtgcgtcaaaaaggtgcgccaatcgttatcaaagccgatggtctggccgccggtaaaggcgtgattgttgcgatgacgcaggaagaagccgaaaccgccgtgaatgatatgttggccggtaacgcttttggtgatgcagggcaccgtatcgtggtggaagagttccttgatggcgaagaagccagctttatcgtgatggttgatggcggaaatgttttgccaatggcgaccagtcaggatcataagcgagttggcgatggtgataccgggccaaataccggcggaatgggtgcttattccccagcccccgtggtaacagatgatgttcaccaacgggtcatggatcaggttatttggccgaccgtgcgtggtatggcggcggaaggtaatatttacaccggtttcctctatgctggcctgatgatttcagccgatgggcaacccaaagtcattgagttcaactgccgctttggcgatccagaaacgcagccaatcatgttgcgtatgcgctccgatttggtcgaactgtgtttagccggtacacaaggcaaactaaatgaaaaaacctcagactgggatgagcgcccatcactgggggtcgttttagccgctggcggttatccagcagattaccgccagggtgatgttattcatggcttaccacagcaagaagtcaaggatggaaaagtcttccacgcggggaccaagctgaatgggaatcatgaagttgtcaccaatggtggccgcgtcttgtgtgtcactgcactcggtgaaaccgtcgcgcaggcgcaacaatatgcctatcagttagctgaggggatccagtgggaaggggttttctgccgtaaagatattggttatcgagcgattgctcgcggtaagtaa

SEQ ID NO: 984 - DNA, 1287 bp, Yersinia pseudotuberculosis YPIII
atgaatattttgataattggtaacggcggtcgtgaacacgctctgggctggaaagccgcccaatctcctttagcggacaaaatttatgttgcaccaggtaatgcgggtacagcactggaaccgaccttagaaaatgttgatatcgccgccactgatattgccggtttactggcctttgctcaaagtcatgatatcggcctgacgattgttggcccagaagcccctttggtgatcggcgtggttgatgcgttccgcgctgctggtttagctatttttggcccgactcaggctgcggctcaattagagggttctaaagccttcaccaaagatttcctggcccgtcacaacattccctctgcggaataccaaaactttacagatgtcgaggccgcattggcctatgtgcgtcaaaaaggtgcgccaatcgttatcaaagccgatggtctggccgccggtaaaggcgtgattgttgcgatgacgctggaagaagccgaaaccgccgtaaatgacatgttggccggtaacgcttttggtgatgcagggcaccgtatcgtggtggaagagttccttgatggcgaagaagccagctttatcgtgatggttgatggcgaaaatgttttgccaatggcgaccagtcaggatcataagcgagttggcgatggtgataccgggccaaataccggcggaatgggtgcttattccccagcccccgtggtaacagatgatgttcaccaacgggtcatggatcaggttatttggccgaccgtgcgtggtatggcggcggaaggtaatatttacaccggtttcctctatgctggcctgatgatttcagccgatgggcaacccaaagtcattgagttcaactgccgctttggcgatccagaaacgcagccaatcatgttgcgtatgcgctccgatttggtcgaactgtgtttagccggtacacaaggcaaactaaatgaaaaaacctcagactgggatgagcgcccatcactgggggtcgttttagccgctggcggttatccagcagattaccgccagggtgatgttattcatggcttaccacagcaagaagtcaaggatggaaaagtcttccacgcggggaccaagctgaatgggaatcatgaagttgtcaccaatggtggccgcgtcttgtgtgtcactgcactcggtgaaaccgtcgcgcaggcgcaacaatatgcctatcagttagctgaggggatccagtgggaaggggttttctgccgtaaagatattggttatcgagcgattgctcgcggtaagtaa

SEQ ID NO: 985 - DNA, 1287 bp, Dickeya dadantii Ech703
atgaatattttgattattggtaacggtgggcgtgaacacgcgctggcctggaaagcagctcagtcgcctctggctgataaagtctacgttgcgccgggcaatgccggtacggcattggaacctgcgctggaaaacattcatattccggccaccgatattccggcgctgctgaattttgcgctccagaacgacatcggcctgactattgtcggcccggaagcaccgctggtgataggcgtcgtcgatgcattccgtgcagcaggacttaaaatttttggcccaacgcaggcggccgcacaattagaaggttccaaagccttcaccaaagattttctggcccggcatcagatccccactgcggaataccagaatttcactgaaatagaacctgcgctggcctatatccgccgcaaaggggcccccatcgtcatcaaggccgacggactcgccgcaggtaaaggcgttattgtcgcgatgaccctggaagaagcggaaaacgccgcgactgatatgctggcgggcaacgcattcggtgatgccgggcaccgtatcgtagtggaagagtttttggatggcgaagaagccagctttattgtgatggtggatggcgagcacgtcctgccgatggcaaccagccaggatcacaagcgcgtcggcgacaacgataccggcccgaataccggcggtatgggagcctactcgccagcccccgtcgttactgatgacatccaccagcgcgtcatggaacaaatcatttggccgaccgtgcgcggcatggcatccgaaggcaacatctataccggttttctctacgccgggttgatgatttcggcggaagggcagcccaaggtgattgaatttaactgccgctttggcgatccggaaacccagcccatcatgttgcgcctacgttccgatctggttgaactctgtctggcggcctgcgacggtaaactggacgaaaaaacctctgattgggatgaacgcccgtcccttggcattgtgttggctgctggagggtatccggctgaatatcgtaccggtgatgtgatctctgggctgccgacacaggatatggcagacggtaaagtgttccatgccggtactagactgaacggcgacgatgtcgtgaccaatggtggacgtgtactgtgcgtgactgcgctcggtaacagtgtggcgcaagcgcaacaacgcgcttatgaactggcgaaccccatcaagtggcaaggcagcttctgtcgaaccgatattggctaccgcgctatcgaccgggaaaaagcctga

SEQ ID NO: 986 - DNA, 1290 bp, Dickeya zeae Ech1591
atgaatatcttgattattggtaatggcggccgcgagcacgcactggcctggaaagcggcacaatcgccactggccgataaagtatacgtcgcgccgggcaacgcagggacagcgctggaacccgcgctggagaacgtgaacatcaccgcaacagacatcccggcactgctggatttcgctcgccagaatgcgattggcctgactatcgtcggcccggaagcgccgttggtcattggcgtggtagacgctttccgcgcagcaggcctgaagattttcggcccgacgcaagctgcggcgcagttggaaggctccaaagcctttaccaaggattttctggctcgccagcatattccaacagcggaatatcagaacttcaccgagattgaaccggcgctggactacatccgtcgcaaaggcgcgccgattgttatcaaagccgatggtcttgcagccggcaaaggcgtgattgttgccatgacgctggaagaagcggaaaacgccgctaccgatatgctggcaggcaatgcgtttggcgatgccggtcaccgtatcgtggtcgaagagtttctggatggcgaagaagccagcttcatcgtgatggtggatggcgagcacgtgctgccgatggcgaccagccaggatcacaaacgtgtaggtgaccaggattccggccctaacaccggtggcatgggcgcttactcaccagcaccggtggtgacggatgacgtccaccagcgggtcatggaccagattatttggccaaccgtacgcggcatggcagccgaaggcaacgtctataccggcttcctgtacgcaggtctgatgatttccgcagatggtcaaccgaaagtgattgaattcaactgccgttttggtgacccggaaacccagccaatcatgctgcgtctgaaatccgatctggtggagctctgtttagccgcttgcgacggcaaactggacgagaaaacctctgactgggatgctcgcccgtcattgggtgtagtactggccgccggcggttacccaggcgattaccgtaccggcgacgtcatttccggcttgccgacccaggaagcaaccgacggaaaagtgttccatgccggtactaagcttaatggcgacgatgtgatgactaacggcgggcgtgtattgtgtgtgacggcgctggggcacagcgttgccgatgcgcagcaacgcgcttacgagctggctaaacccatcagttgggagggcagcttctgccgcagtgatattggctatcgtgccattgctcgcgaacagaaagcctga

SEQ ID NO: 987 - DNA, 1287 bp, Pectobacterium carotovorum PC1
atgaacattttagtaattggtaacggcggacgcgagcacgcgctggcctggaaagccgcacagtcaccactggcgaaacgcgtttatgtcgctccgggaaatgcgggcaccgcacttgaagccgcgctgaccaacgttgatatcgccgcaactgatgttccagcgctcgtcgcttttgcgcaagagaaccacatcgatttaaccatcgttggcccggaaacaccgttagttatcggtgtggtggatgcgtttcagagcgcaggtctaaaaatctttggtccgtcgcaggccgcagcacaactggaaggctctaaagccttcaccaaagattttctggcacgccacaatatcccgacagcggaataccaaaacttcactgaagttgaacccgcgctggcctatgtacgcagcaaaggtgcgcctatcgtcatcaaggcagatggattagccgcaggtaaaggtgtaattgtcgccatgacgttgcaggaagcagaaaacgccattgaggatatgctggcgggcaatgcattcggcgatgccggacaccgtatcgtggtggaagaattccttgatggtgaagaagctagcttcattgtgatggtggatggcaagaatgtgctgccgatggcaaccagtcaggatcataaacgcgttggggataaagatacgggaccgaatactggtggtatgggcgcttattcgccagccccggtcgttaccgatgaaatccaccagcgcgtgatggatcaggtgatctggccgaccgtaaacggcatggccgcagagggaaatacctacgtcggtttcctgtatgcaggcctgatgatttctgccgatggtcagccaaaagtgatcgaattcaactgtcgctttggcgatccagaaacacagccaattatgctgcgtctgcgttccgatttggtggaactgtgtctggcagcctgtgacggcacgctggatcagaaagattccgtctgggatgagcgtccgtctctgggtgtggtattggccgcaggcggctacccggctgactacaacacgggcgatgtgatttccggtttaccgcagcaggatgccgaagatggcaaagtctttcatgcgggtaccaagctgaacggtattaatgtcgttaccaacggcggccgcgtactgtgcgtcaccgcattgggtaataccgtagctgaagcgcagcaacgcgcttatgaaatagcagcgggtattcagtggcaaggggtattctgtcgtaaagacatcggctatcgtgccattgagcgcgagcaagcctga

SEQ ID NO: 988 - DNA, 1269 bp, Colwellia psychrerythraea 34H
atgtttcaacctattagtatcttcatcgggctacgctatagtcgtagtaaaagccatacaggctttgtttcttttataactttcttttccactgttggtattttattaggggtggctgcgcttataaccgttgtttctgtaatgaatggttttgaaggcgaattaaagaaacgtatattaggtatagttccccacgtaattgttagtgactttagcactatagatacgggtactgaccaagagaaatcctggcaaaacttacgtgaagagttactgactcaacccaatgtgctgcgagtaacaccttttcttgaaagtgaggctctgatccaatcaactaaagggcttcaaggtgttttagttcaaggtatcatgcctaaatttgaacaaaaaaatatcgtaagtactcatatggttgctggtagtatggagaatctctcgacacaaagttattctttagtcttagggcaatctttagccaataaattacaggtttctcttggcgatgaggttcgcttagtactgcctaataaaagtgtttttactccgatggggcgcattccggtacaacgcgtttttactgttgcgggtatttttcatattggttcacaggttgatgatgccatggtttacgttgatagtcgctatggtgcgaaattactcaggcgaacgggtgatggtattgataaattacgcctatatttagatgatgcatttaatgccaaaaccgtagtgaaaaaccttgagcagaagcaacaaaatacagagcatagtaaaacactcgattctattaattttagtacttgggatgagagccaaggagcattattttcagccgtgaaaatggaaaaaaatatgatgtggttaatgttaagtttaatcgtggctgtggctgcatttaatattgtttctgcgttagtgatggttgttgttgaaaaacaagctgaaataggcatattgcaaacattaggtttagcgcgaattgaggttataaaaatatttatcactcaaggtatggttaatggcctgtggggagttagcttaggtggacttcttggcgtgatattagcgctaaatttgaacagtatcttgttagtggtaggggttaatttatttggttttggtatgcaagacttaccaataaaacttgagtggtttgatgtgcttactattattttatctgcactcgcaatgagctttcttgccacactttatcctgcataccaagcctcgactactcagccagctcaggtattacgaaatgaataa

SEQ ID NO: 989 - DNA, 1236 bp, Shewanella denitrificans OS217
ttgaagaattttggcgtttctttttttatcggatatcgctattggcgcgcaaaaaaagccaatgcctttgcctctttcctgaccttgtttgccgtgtcgggtatttttttgggggtggtggcgttaattctggtcagttctgtgatgaatggcctagaagggcagcttaagcaacgcatattgggcgcaattcctcagttaaccctggtaaatgatgcgggctttagccaatggcagcaagatattgccgtgattgaagccttgccgcaagtgcttggggctgtgccaactgtgaccacccaagccatgatccaatctgttgataatattggcgccgcccaagtctatggcatattccccgaacaagaagcggccctttctgccaagataggcagtgtctattcagacgcgttcggaacccttgaagcgaaccagtatcacatcgtactgggtgttgagcttgccagaaaacttaacgtcaatattggcgataaaatccggttattaagcggtgatggcgtggtgtactcccccattggacctgtgccgagccagcgtaaatttgtggttgctggactgtttgaaacaggatcccaagtggatgctggtgtggcctatgtgcattatcaagatgcgcggcggttgatgcgcttagagagcctgagtatcaatgaagtgagattgtatttaaccgatccctttttagcccccgacttaagccagcaagccatcagcttaatggcgcaacaagggattgaggtacacagccgtgactggcgcgccgactttggtcagctttttgcagcggttaagatggaaaaaagcatgatgtccttgatgctcagcctcattgtggcagtggcggcatttaatatagtgtctgccctagtcatgatggtggtggataaaaccgcggatgtggcggtattaaagactcaaggcttatcgactcaagctgtgatgaatattttcatcgtccaaggcttactcaacgccgtgataggcttaagttcgggacttctggtgggcatactgttggcgttaaatctgaatcctattcttaatcagtttggcgtgtctattttaggcacaggtcagtcattacctgtggcattaagcttagagcaactgagccttatcgctgtcggcaccttgatcatcactttgcttgcaaccctttatccagcatttactgccgcacgggttcaacctgctagcgccttgagatacgaataa

SEQ ID NO: 990 - DNA, 1194 bp, Baumannia cicadellinicola Homalodisca coagulata
atgtatcaacctttagcattatatattggtctgcgttatatgtgcagacaagtatcaaatggacgttttatctccttactgtctacaatcggtattatattaggtgttatggcattagtaactatattatcgattatgaatggctttgagcgagtactagaaaataatgttctgcgttttattcctcaagcgctgttaacaactaagaatggttgtttaaatccgttatctgctccgttctttmttaaagaagatatactaaaagataaaggagtaataggcattgcaccttttactaccggagatgttattttacagagtcctaatagttttgctatgggaattatacttgggattaattctagtgattctgaacctttagccaactatttagtagatacacacataagccagctatctcccggtaagtatcatattattcttggtcagaagttagcagataagctgggtgtaaaatataacgataaaatacgcataattgtgccttcggttagtcaatttactcctcttggtcgtatccctagtcaacgtttatttactgtaataggtacatatattactaatagtgaagttgatcaatatcaaatactagtaaatcagcaagatgcttcgcatcttatgcattatccgtccggttatgttacaggttggcgtctatggttacagcaacctctaaaagtagacagtattagcaaaatacagtgcttaccgaatgagttaatctggaaagattggcgtgaacgtaagagcgaattatttcatgctatacatatggaaaaaaatattatgggtttactactcagcttaattgtagtagtagccgcatttaatattctgacttctttatgcatgatagtaagagaaaagaaaagcgaagtagctatttttgctacacagggactacaattttaccaaattatgccagtatttatgattcagggagttagtgcagggattattggagcacttgtaggtgctattttaggagtattattagcaaatacactaaattattttccattatttcataataatacattaccaattaatattgaacctttacagatagtaactattataatactaactacagtattagcatggctatctactatttacccttcttggtgtgccgtaacaaaaaatgtagttgagttactacgcgatgaataa

SEQ ID NO: 991 - DNA, 1233 bp, Shewanella baltica OS155
atgaatccaggatttcctttctatattggttaccgttattggcgggccagaaaagcgaacgcgttcgcgtcgttcattactctatttgccgtttcgggcatttttttaggcgttgccgcgctcattgtcgtgagctctgtgatgaatggtctcgaaggccaactcaagcaacgtatcttaggcgcagtaccgcaattaactgtttatagtgaagcgcctttagtcgattggactgagcaggcgagtgcgcttaaagccttacctggcgtattaggcgtgacgccgagcgtgtcgacgcaggccatggtgcaatcggcggcgagtattcgtgctgtacaggtttatggcgtgttccccgagttagcggaaaagttatcttcggttgcccagcacacttactcaggtgcatttgaacagctgacgagcggcgactacaaggtgattttgggctctgagctggcaaggcaacttaaagtcgcccccggtgatacggtgcgattattgagtggcgatggtgtggtgtattctcccttaggcccagtgccgagccaacgtaagtttttagtctcaggcatttttgaaatgggctctcaggtcgatgcgggcgtggcgtatatccattatcaagatgcgaaacggctgatgcgccaacccagtgaggctattgatcagcttagactctatttagccgatccctttagcgcacctgctttagcgcctaaagtgcaggatatattagctaaacaaggtgttaaggcgacaaccagcgattggcgtgatacctatggccacttgtttggcgcggtcaagatggaaaagaacatgatgtcgctgatgttgagtctgattgtggccgttgccgcattcaatatcgtctcggcgctggtcatgatggtggtcgataaaaccacagatgtggcggtgctcaaaactcaaggcgtgaccacgcccgccgtgatgggcatttttgtggtgcaagggtcgctcaatgcagtgctcggtttagtgctggggctggcggttgggatactcatcaccttgaatctgaatggcattatgaccaccttagggatttctattttaggtgtggggcagagcttgccggtgaaattggagttgatgcagttgtctgtgatcgtgattggtacgctactggtgaccctgctggcgaccttatatcccgcactgcgcgccgccaatgtgcaacccgcgactgcgctcaggtacgagtaa

SEQ ID NO: 992 - DNA, 1200 bp, Enterobacter sp. 638
atgtatcaacctgtcgcactcttcataggcttacgttacatgcgtgggcgcgccgcggaccgcttcggtcgctttgtctcctggctttccactatcggcattacgcttggcgtaatggcgctggtgacggtactttccgtaatgaatggcttcgagcgcgagctgcaaaacaacatcctggggctgatgccacaggcggttctctcttcgactaacggatcgatcaatccgcaacagttacctgaaagcgcggtgaaactgcaaggcgtgaatcgtattgcgccgctgacgaccggcgatgtggtgctgcaaagcgcgcgcagcgtctcggtgggcgtgatgctgggcattgacccggcgcaaaaagatccgcttacgccgtatctggtgaacgtcaaacagaccgatctggcaccgggtcaatacaacgtgattctgggcgaacagctcgccggacagcttggcgtcaaccgtggcgaccagctgcgcgtgatggtgccgtctgccagccagtttaccccgatgggccgcttgccaagccaacgcttgttcaacgtgatcggcacgtttgccgccaacagcgaagtcgatggctatcagatgctggtcaacattcaggatgcgtcgcgcctgatgcgttatccgctgggcaacatcaccggctggcgtctgtggctcaacgaaccgctgaaagtggacgtgctgagcgagcaaaaattacctgaaggcaccaaatggcaggactggcgcgagcgcaaaggcgaacttttccaggccgtgcgcatggaaaagaacatgatggggctgctgctgagcctgatcgtcgccgtcgctgcgtttaatatcatcacctcgctgggtctgatggtgatggaaaaacagggcgaagttgcgattctgcaaacccaggggctaacgccgcgccagattatggcggtgtttatggtccaaggggcgagcgccgggattatcggggcgctgctcggtgcggtgcttggggcgttgcttgccagccagttaaataatttgatgccgattatcggaattttgctcgacggcgcggcactgccggtcgctatcgagccgttgcaggtcgttggtatcgcgctggtcgctatggcgatcgcgctactttctacgctttatccttcatggcgcgctgccgccactcaacccgctgaggctttacgttatgaataa

SEQ ID NO: 993 - DNA, 1233 bp, Shewanella putrefaciens CN-32
atgaatttaggaattcctttctacgttggttaccgctattggcgggccagaaaagcaaacgcgtttgcctcgtttattactttatttgcagtgtcgggcatttttttaggcgttgccgccttaattgtggtcagttctgtgatgaatggtctcgaaggtcaacttaaacaacgcatccttggcgcagtgccgcagctcacggtttataccagtacgcccttaaacgattggactgaacaggcgaatgtgcttaaggctttgcctggtgtgcaaggtgtcacacccagtgtttcaacccaagctatggtgcaatcggcggctaatattcgcgccgtgcaagtgtttggggtatttcccgagcttgcagcaaagctttcggttattgcacagcacacctattcaggtgcatttgatgaacttgtcgcgggtcaatataagatcattttgggctccgagttggcgcgccaacttaaagtgaatccaggtgatacggttcgattattaagtggtgatggggtggtgtattcgccctttgggccagtacctagccaacgtaaatttttggtttcaggcatatttgaaatgggctctcaagtcgatgctggcgtggcttatattcactatcaagatgctaagcgattaatgcgtcagcccagcgaagcaatcgatcaacttcggctttatcttgatgatccctttagtgcaccggcgttatcgcctaaggtgcaagatatcttacttaagcaacatatcgaggcaacaaccagcgattggcgcgatacctacgggcacttatttggcgcagtgaaaatggaaaaaaacatgatgtcactgatgctcagtctgattgttgccgtggcagcctttaacattgtttcggcattagtgatgatggtggtggataaaacgacggatgtagctgtgctgaaaacccaaggcctaactacccccgctgtaatgggcatatttattgtgcaaggctcgctcaatgccatattaggtttagtgctggggttaggggttggcattctcctcacgcttaatttgaatgggattatgtctacccttggcatttctattttaggtgctggacaagtgctacccgtcaaacttgagttgacgcaactgtctgttattgtggtgggtactttactcgtgacgttactcgcgaccttatatcccgcattgcgtgcagccagagtgcaacctgctactgcactaagatatgaataa

SEQ ID NO: 994 - DNA, 1233 bp, Shewanella baltica OS185
atgaatccaggatttcctttctatattggttaccgttattggcgggccagaaaagcgaacgcgttcgcgtcgttcattactctatttgccgtttcgggcatttttttaggcgttgccgcgctcattgtcgtgagctctgtgatgaatggtctcgaaggccaactcaagcaacgtatcttaggcgcagtaccgcaattaactctttatagtgaagcgcccttagtcgattggactgagcaggcgagtgcgctaaaagccttacctggcgtattaggcgtgacgccgagcgtgtcgacgcaggccatggtgcaatcggcggcgagtattcgtgctgtgcaggtttatggcgtgttccccgagttagcggaaaagttatcttcggttgcccagcacacttactcaggtgcatttgagcagctgacgagcggcgactacaaggtgattttaggctctgagctggcaaggcaacttaaagtcgccccaggtgatacagtgcgattactgagtggcgatggcgtggtgtattcgcccttaggcccagtgccgagccaacgtaagtttttggtctcgggcatttttgaaatgggctctcaggtcgatgcgggcgtggcgtatatccattatcaagatgcgaaacggcttatgcgccaacccagtgaggctatcgatcagctcagactctatttagccgatccctttagcgcacctgctttagcgcctaaagtgcaggatatattagctaaacaaggtgttaaggcgacaaccagcgattggcgtgatacctatggccacttgttcggtgcggtcaaaatggaaaagaacatgatgtcgctgatgttgagtctgattgtggccgtggccgcattcaatatcgtctcggcgctggtcatgatggtggtcgataaaaccacagatgtggcggtgctcaaaactcaaggcgtgaccacacccgccgtgatgggcatttttgtggtgcaagggtcgctcaatgcagtgctcggtttagtgctggggctggcggttgggatactcatcaccttgaatctgaatggcattatgaccaccttagggatttctattctaggcgtagggcaaagtttgccggtgaaactggaattgatgcagttgtctgtgatcgtgattggtacgctgctggtgaccctgctggcgaccttatatcccgcactgcgcgccgccaatgtgcaacccgcgactgcgctcagatatgagtaa

SEQ ID NO: 995 - DNA, 1224 bp, Shewanella pealeana ATCC 700345
atgaatctttcattatcgttttatattggttatcgctactggcgatcccgtaaagccaacgcattcgcatcatttattactattttttctgtttctggcattttactcggtgtagcggcattgattgtggtcagttcggtgatgaatggcttagagaaccagcttaaacaacgaattttaggggctgtgccgcaattaaccgtgcactcgcaaacggccatcgagaattggccaagccaagtggagaaactaagccaacttccgggcgttcagggcgcaaccccaagtatatcgacccaagccatggtgcagtcgccgagtaatataggcgccgcgcaggtgtatggcatctatcctgagcaggaaaaaacactactaaataccactaagcgagtttactcgggagattttgatgccttagagtcggggaaataccgggttattttaggcgctgagttagcccgaacactcgacgttgcgcctggggataaaattcgaattcttagtggtgatggcgttgtgtatacgccattggggccggtgccgagtcaacgtaagttcaccgtggcgggtgtttttgaaatgggctcacaagtcgatgcgactctggcctatgttcatcatgatgatgctcagcgactgatgcgtcaaaaggcgggagaggtcaaggagctgcgtctatatctcgatgatcctttcaatgccgccaaaatggcgccagaggtcgttgcgcaatttgccactcccgtgacgacgaccgattggcgtgacacctatggacatctgtttggggcggtgaagatggaaaagaacatgatgtctttgatgcttagtctcattattgccgttgcagcctttaatatcgtttccgccctggtgatgatggtggtggataaaactacggatgttgcggtactcaagacccaaggtctgacgacggcgaatgtgatgggcatttttatgatccaaggctcactcaacgcggtcataggtcttatatccggcgtggcagtcggcagtttattaaccctcaacctcaacaccataactcaggctcttgggatctctatcttgggtgcagggcagaatctgcctgttcaacttgagttgagtcaattgacttggattgttgtcggcaccttagtgatgacattggtggccactgtttatcctgcaattagagcggctaatgtgcagccagcggccgcactcaggtatgagtag

SEQ ID NO: 996 - DNA, 1233 bp, Shewanella baltica OS195
atgaatccaggatttcctttctatattggttaccgttattggcgggccagaaaagcgaacgcgttcgcgtcgttcattactctatttgccgtttcaggcatttttttaggcgttgccgcgctcattgtcgtgagctctgtgatgaatggtctcgaaggccaactcaagcaacgtatcttaggcgcagtaccgcaattaactctttatagtgaagcgcctttagtcgattggactgagcaggcgagtgcgcttaaagccttacctggcgtattaggcgtgacgccgagcgtgtcgacgcaggccatggtgcaatcggcggcgagtattcgtgctgtacaggtttatggcgtgttccccgagttagcggaaaagttatcttcggttgcccagcacacttactcaggtgcatttgagcagctgacgagcggcgactacaaggtgattttaggctctgagctggcaaggcaacttaaagtcgcccctggtgatacggtgcgattattgagtggcgatggcgtggtgtattcgcccttaggtccagtgccgagtcaacgtaagtttttggtctcgggcatttttgaaatgggctctcaggtcgatgcgggcgtggcatatatccattatcaagatgcgaaacggctgatgcgccaaccaagtaaagagatcagtcaacttaggctttatttagcggatcctttcagcgcaccggctttagcgcctaaagtgcaggatatattagctaaacaaggtttgaaggcgacaaccagcgattggcgtgatacctatggccacttgtttggcgcggtcaagatggaaaagaacatgatgtcactgatgttgagtctgattgtggccgtggccgcattcaatatcgtctcggcactggtcatgatggtggtcgataaaaccacagatgtggcggtgctcaaaactcaaggcgtgaccacacccgccgtgatgggcatttttgtggtgcaagggtcgctcaatgcagtgctcggtttagtgctggggctggcggttgggatactcatcaccttgaatctgaatggcattatgaccaccttagggatttctattctaggcgtagggcaaagtttgccggtgaaactggaattgatgcagttgtctgtgatcgtgattggtacgctgctggtgaccctgctggcgaccttatatcccgcactgcgcgccgccaatgtgcaacccgcgactgcgctcagatatgagtaa

SEQ ID NO: 997 - DNA, 1233 bp, Shewanella baltica OS223
atgaatccaggatttcctttctatattggttaccgttattggcgggccagaaaagcgaacgcgttcgcgtcgttcattactctatttgccgtttcgggcatttttttaggcgttgccgcgctcattgttgtgagttctgtgatgaatggtctcgaaggccaactcaaacaacgtatcttaggcgcagtaccgcaattaactctttatagtgaagcgcccttagtcgattggactgagcaggcgagtgcgcttaaagccttaccgggcgtattaggcgtgacgccgagcgtgtcaacgcaggccatggtgcaatcggcggcgagtattcgtgctgtgcaggtttatggcgtgttccccgagttagcggaaaagttatcttcggttgcccagcacacttactcaggtgcatttgagcagctgacgagcggcgactacaaggtaattttgggctctgagctggcaaggcaacttaaagtcgcccccggtgatacggtgcgattattgagtggcgatggtgtggtgtactcgcccttaggcccagtgccgagccaacgtaagtttttagtctcgggcgtttttgaaatgggctctcaggtcgatgcgggcgtggcgtatatccattatcaagatgcgaaacggctgatgcgccaacccagtgaggctattgatcagcttagactctatttagccgatccctttagcgcacccgctttagcgcctaaagtgcaggatatattagctaaacaaggtgttcaggcgacaaccagcgattggcgtgatacctatggccacttgtttggcgcggtcaaaatggaaaagaacatgatgtcgctaatgctgagtctgattgtggccgtggccgcattcaatatcgtctcggcgctggtcatgatggtggtcgataaaaccactgatgtggcggtactcaaaacccaaggcgtgaccacacccgccgtgatgggcatttttgtggtgcaagggtcgctcaatgcggtgctcggtttagtgctggggctggcggttgggatactcatcaccttgaatctgaatggcattatgaccactttagggatttctattctaggtgtggggcagagcttgccggtgaaattggagttgatgcagttgtctgtgatcgtgattggtacgctactggtgaccctgctggcgaccttatatcccgcactgcgcgccgccaatgtgcaacccgcgactgcgctcaggtatgagtaa

SEQ ID NO: 998 - DNA, 1206 bp, Dickeya zeae Ech1591
atgtatcaacctgtcgcactttttattggcctgcgttatatgcgagggcgggccgcggaccgctttgggcggtttgtttcctggttatccgctattggtatcaccctcggcgtgatggcgttggttaccgtgctgtcggtaatgaacggttttgagcgggaactggaaaacagcattctggggctgatgcctcaggccctgatcacgacgccgcaaggctcccttaatccacagacgttaccggcctcttcgctctctgcgctgaagggcgtgaaccgtatcgcgccgctcacgaccggcgatgtcgtgctgcaaagcgcccgcagcgtggcggtgggggtgatgctcggtatcaatccggacgagcaggaaccgctggcgagttatttgaccaaggcggcgtcgctacagcaactgcagccgagtcaatatcaggtgattctcggtgagcaactggccaaccagctcggcgtcaagccgggcgatcacgtgcgattgatggtgaccggcgccagccagttgacgccgatgggacgtgtgccgagccaacggttgtttaccgtcgccgggacgttttacgcccacagcgaagtggatggttatcaactgttggttaaccagcaggatgcgtcgcgcctgatgcgctatgcgcccggcagcatcaccggctggcggctgtggcttgaccaaccgctgacggtggatacgctgagtcagcaggcgttgccggcagggacggcatggaaagactggcgtgagcgcaaaggcgagttgttccaggcggtccggatggagaaaaacatgatggggctgttattgagcctgattgtggctgtcgccgcgttcaatatcattacttcactgggtttgctggtgatggaaaaacagggcgaagtcgcgattttgcagacgcaaggactcacccagcggcagatcatggcggtctttatggttcagggcggcggcgccggtgtggtgggggcgttggtcggcgcgatactgggtatggtgctggccagccagttgaataccctgataccgatgctggggttgttgattgacggtggcgcgctgccggtacagattcagccgttgcaggtgatcgcgattgcgctggtggcgatgctgctggcgctgctttccacgctttatccttcctggcgcgcggccgccacccatcccgcagaggctttacgttatgagtaa

SEQ ID NO: 999 - DNA, 1203 bp, Pectobacterium carotovorum PC1
atgtatcaacctgtcgctttatttattggcctgcgctacatgcgtgggcgtgcatcagaccgcttcggccggtttgtctcctggttatccgccattggtatcacgctgggcgtgatggcactggtcaccgtgctttccgtgatgaatggcttcgagcgcgaactggaagacaatattctgggcgtgatgcctcaagcggtcatctctacaccgcaaggttcgctgaacccggcgttgattcctgcttcctccttagactcgctggacggcgtgacgcgcattgcgccgttgacgacgggcgatgtggtgctgcaaagcgcccgcagcgttgccgtgggcgtaatgttagggattgatcctgacgagcaggagccgctgtcgcgctatctggtcaacgtcaaacagcagcagctgcaacccggtcagtatcaggtcattttgggcgaaaaactggccgcacagctagaggttaaagctggcgatcagattcgcatgatggtgacgagtgccagccagctaacgccgatggggcgtattcccagccagcgtatcttcaccgttgtcggcacctttgccgcgaacagcgaagtggatagctatcagctgttggtcaatcagcaggatgcctctcgattgatgcgctatccggcgaaccacattactggctggcgtttgtggctggaaaaaccgctgtcggttgatacgttgagcacgcaaacgctgccggaaggcacggtctggaaagactggcgcgaacgtaaaggcgagctgtttcaggccgtgcgcatggagaaaaacatgatggggctgctgctcagcctgatcgtggccgtggccgctttcaacattattacctcgctgggtttactggtgatggaaaaacagggtgaagtcgccattttgcaaacgcaggggctgactcaacgccagattatggcggtgtttatggtgcaggggggcagcgctggtgtgattggcgcgttgttaggggcattgctggggacgctattggccagccaactgaatacgctgatgccaatactgggcgtcttgcttgatggcgccgcgttacctgtggatattgatcccgcgcaggtggtgaccattgccatttccgcgatggtgattgctctcttatcaacactttacccgtcatggcgcgccgccgccgttcaacccgctgaggctttacgctatgagtaa

SEQ ID NO: 1000 - DNA, 2631 bp, Escherichia coli BL21 (DE3)
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggaaaaagaagtagggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttgggggggccctccgggaagcccggaagaagacggcgaccgctacattgagatctggaacatcgtcttcatgcagttcaaccgccaggccgatggcacgatggaaccgctgccgaagccgtctgtagataccggtatgggtctggagcgtattgctgcggtgctgcaacacgttaactctaactatgacatcgacctgttccgcacgctgatccaggcggtagcgaaagtcactggcgcaaccgatctgagcaataaatcgctgcgcgtaatcgctgaccacattcgttcttgtgcgttcctgatcgcggatggcgtaatgccgtccaatgaaaaccgtggttatgtactgcgtcgtatcattcgtcgcgcagtgcgtcacggtaatatgctcggcgcgaaagaaaccttcttctacaaactggttggtccgctgatcgacgttatgggctctgcgggtgaagacctgaaacgccagcaggcgcaggttgagcaggtgctgaagactgaagaagagcagtttgctcgtactctggagcgcggtctggcgttgctggatgaagagctggcaaaactttctggtgatacgctggatggtgaaactgctttccgtctgtacgacacctatggcttcccggttgacctgacggctgatgtttgtcgtgagcgcaacatcaaagttgacgaagctggttttgaagctgcaatggaagagcagcgtcgtcgcgcgcgcgaagccagcggctttggtgccgattacaacgcaatgatccgtgttgacagtgcatctgaatttaaaggctatgaccatctggaactgaacggcaaagtgactgcgctgtttgttgatggtaaagcggttgatgccatcaatgcaggccaggaagctgtggtcgtgctggatcaaacgccattctatgcggaatccggcggtcaggttggcgataaaggcgaactgaaaggcgctaacttctcctttgcggtggaagatacgcagaaatacggccaggcgattggtcacatcggtaaacttgctgcgggttctctgaaagtgggcgacgcggtgcaggctgatgttgatgaggctcgtcgcgcccgtattcgtctgaatcactccgcaacgcacctgatgcacgctgcgctgcgccaggttctgggtactcatgtatcgcagaaaggttcactggttaacgacaaggtgctgcgcttcgacttctcacacaacgaagcgatgaaaccagaagagattcgtgcggtcgaagacctggtgaacacacagattcgtcgcaatttgccgatcgaaaccaacatcatggatctcgaagcggcgaaagcgaaaggtgcgatggcgctgttcggcgagaagtatgatgagcgcgtacgcgtgctgagcatgggcgatttctctaccgagttgtgtggcggtactcacgccagccgcactggtgatattggtctgttccgcatcatctctgaatcgggtactgctgcaggcgttcgtcgtatcgaagcggtaaccggagaaggtgctatcgccaccgttcatgcagacagcgatcgcttaagcgaagtcgcgcatctgctgaaaggcgatagcaataatctggctgataaagtgcgctcagtactggaacgtacgcgtcagctggaaaaagagttacaacagcttaaagaacaagctgccgcacaggagagcgcaaatctttccagtaaggcaattgatgttaatggtgttaagctgttggttagcaagcttagcggtgttgagccgaaaatgttgcgtaccatggttgacgatttaaaaaatcagctggggtcgacaattatcgtgctggcaacggtagtcgaaggtaaggtttctctgattgcaggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1001 - DNA, 2625 bp, Shewanella oneidensis
atgtatcaaacgacagcagcgcttagaagtgctttcctcgaatttttccgcagcaatggtcaccaagttgtggacagtagttctcttgtaccaggcaacgatcccacgctcttattcaccaacgccggtatgaaccagttcaaggacgtgtttcttggcatggacaaacgtagctatacacgtgcgaccactgcccaacgctgcgtccgtgcgggtggtaaacacaacgacttagataatgtgggttataccgcacgtcaccacacttttttcgaaatgctgggtaacttcagttttggtgattatttcaaagaagatgcgattcgttttggttggacattcctgaccgaagtattgatgctaccaaaggaacgtctgtgcgtaactatttaccaaacagacgatgaagcctttgaaatctggaataaaaaaataggcgttgccgctgagaatatcatccgtatcggtgataacaagggcgcgccatatgcttcagataacttctggcaaatgggcgacaccggtccttgtggtccttgtaccgaaattttctatgaccacggcgaccacatttggggcggacgtccaggcagccctgaagaagatggcgatcgtttcatcgaaatttggaacattgtattcatgcaatacaatcgccaagcctctggcgaaatgttgccgctaccaaaaccatcggttgataccggtatgggtatcgagcgtattgccgcgattatgcaaggtgttcattcaaactacgaaatcgatattttccgcgctttgattgctaaagcggctgaaatcatcggtgtggctgacttatctaacaagtcactgcgcgtgattgccgaccatatccgttcatgtgccttcttagttgccgatggtgtgatgccatcgaacgaaggtcgtggctatgtactgcgccgtattattcgccgcgccgttcgtcatggtaacaagttaggtgcaaccgaagccttcttctacaagttggttccgacgctgatcgatgtgatgggtgatgcggctaaaggcctggctgaaactcaagttattgttgaaaaagcccttaaagcggaagaagaacagtttgcccgtacattagagcgtggtttaggcattctggatagcgcattgaacgaattacaaggtgacaccttagacggtgaaacagtctttaaactgtacgatacctacggcttccctgtggatttaactgctgacgtgtgtcgtgagcgtaacattattgtcgatgaagctggttttgaagctgcgatggctgaacaacgcagtcgcgcgcaagccgcgggtaactttggtgccgattataacgcagcacttaagatcgatgctgaaaccgcattctgtggttactcagaacttactggcaatgccaaagtcactgcactgtacctaaatggcgagtcagtgcctgcgatcaacactggcgatgacgctgtcgttgtgctcgatgtaacccctttctatgctgaatcgggcggccaagtgggtgacaagggcgtattaatggctcaaggcattgagtttacggttaacgatacgcaaaagtttggtcaagcttcaggtcacaaaggaaccttaacggctggcagtttaagtgttggccaagtgcttgaagccaaagtggataaaaagctacgtcaccgcactcagttaaaccactctgtaactcacttattgcatgctgcactgcgccaagtgttgggcactcatgttactcaaaaaggctcattggttgacccagagcgtttacgctttgacttctcccatttcgaagcggtaaaacctttcgaacttaagcaggttgaagagttagtcaatacgcaaattcgtcgtaaccatgagcttaaagtggctgaaatggcgattgatgaagccaaagaaaaaggcgctatggcgctctttggtgaaaaatatgattcacaggttcgtgtcgtgaccatgggcgatttctcaatcgaactttgtggtggtacgcatgttggccgcactggtgatattggtttatttaagatcacttcagaaggtggtatagccgcaggtgtacgccgtattgaagcggttacaggtgctgcggctatggcatatgtggcgcagcaacaggctgagcttgaggaagccgcatcacttctgaaagctgatgctcattcagttgttaccaaactgaaagtccaattagataaaatgaagcaacttgagaaagaaatgcagcaacttaaagataagttagcggctgcagcaagtgcggatttagcgggtgatgcggtagtggttaatggcgtcaatgtgctgattaaaaagctagaaggcgttgaagctggtgcgttacgcggtctgcaagatgagcttaaacaaaagcttaaatccgctattatcgtgttaggtgtagcacaagaaggtaaagtcaaccttattgcaggtgttagcaacgacttaatcgctaaaatcaaagcgggtgagctggttgctatggtcgccacacaagtcggtggtaaaggtggtggtcgccctgatatggcccaagcaggtggtagccaaccagaaaatctggatgcggcactgtcacaagtattaccttggattactgagcgtttagcttaa

SEQ ID NO: 1002 - DNA, 2628 bp, Geobacter sulfurreducens
atgaccggaaaagagatacgcgcccgatttctcaagttcttcgccgaccgggggcatgccgtcgtgcccagctcccccctcattccccacaatgacccaacgctcctgttcgccaatgccggcatgaaccagttcaaggactgttttctgggcctggagaagcgtgattacgtcagggcctgctcctcccagaagtgtgtccgggccggtggcaagcacaacgacctggagaacgtggggcgcaccgcccggcaccataccttcttcgaaatgctcggcaacttttcctttggcgactatttcaagaaagaggccatcgcctttgcctgggaattcctcaccaaagacctgggcctcgataaagaccgcctctacgtgacggtttatacggacgacgacgaggccgccgacatctggcacctgcaagagggggttccccgggagcggatctaccgcttcggcgagaaggacaacttctgggccatgggcgataccgggccctgcggcccttgcagcgagattttctgggacaacggtcccgaggtcggttgcggcagccccgactgcgccgttgggtgcgactgcgaccggtacatggagatctggaacaacgtcttcatgcagttcaaccgctccgccgacggggtgctcacccccctgcccaagccctccgtcgataccggcatggggctcgagcgcatctccacggtcatgcagggggtgaagtccaactacgacaccgacctgttccaggggatcatcgggcacgtggaaaagctctcgggcaagcgctaccggcacagcgagaaagacgacgtctccatgcgggtcatggcggaccacgtccgggccaccactttcctgatctgcgacggggtcctcccctcaaacgagggacggggctacgtgctgcgccggatcatgcgccgggccgcccggcacgcgaagatgctcggctttgccgaaccagtcatctgccggatggtagaggccgtcaacgccatgatgggcgacgcctacccggaacttttggagcgtgaggagtacatcagaaaggtgatccgggccgaggaggagcgctttgccgaaaccctcgaccggggactcgccatcctcaacgaggccgtggcggatctcaagaacgaagggcgcacggtcatccccggcgagaccctgttccggctctacgacaccttcggttttcccacggatctcaccgcggacatcgtccggagcgaagggttcaccatcgatgaagatggtttcgaagcctgcatggagcgacagcgggagcaggcccgggagcactggaagggctccggcgaggaggggatcgccgaggtccacaagaccctccattcccggggcgtccggagccgtttcacgggctacgaagcccgcaccgcctactctccggtgacggtcctcctcaagggcggggccgaggtggccgaggccacggccggcgaccgggtggagatcatcaccgacgccactcccttctacggcgagtcgggcggccaggtgggggacaccggaaccatctccacgggcagcgcccacgtggaggtgacggaaacgcttcgtcctttcccggatctcatcgtccaccgggggaccgtggtcgagggcaccatcaggcagggcgacgcctgcgatctgaaggtcgcgccgggccgcgacgccaccgcccgcaaccataccgcaacccatctcctccagtcggcgctccgccaggtgctgggggatcacgtgaagcaatcgggctcccttgtggggccggaccgcctccgcttcgacttcacccatttcgcggccatgacgcccgaagagatccggcgggttgaggagatcgtcaactcctgcatcatggccaacgacgacgtccatgctcgggaaatggccctggacgaggccatggagatcggcgccaccgcactgttcggcgaaaaatacggggacactgtccgggtggttagggtgggcgaagtgagcatggagctgtgcggtggcacccatgtccacgccgccggcgacatcggtttcttcaagatactctccgaggcgggaattgccgcgggggtccgccgcatcgaggccctgaccggcatgggcgccctgcgtcacgtgcagcagctggaggacgagcggaaagagatcgccgccctgatcaaggccgaggggggcgacaatgtggagcgtctccagcggctgttgactcgtcagaaggatatgcagcgggaaatcgagaccctggagtcgcgcctcaacgccgcccgctcggcggacctgctggcggatgtccgggaggtgaacggcgtcaaggtcctcgccaccctggctgaggtggacgatccgaagaagctccgggagcttgccgacaccctcaaggaccggctcggctctggtgttgtggccctcgggtgcgtcaaggaaggaaaggcgaatcttctggtggcggtgaccaaggatctgaccggccgcgtcaaggccggcgacctgatccgtcagctttcccccatcatcggcggtagcggaggagggaagccggagctggcccaggcgggcggaaccctgccggacaagctcggcgaggccctcggcaaggtgtgtgaactcgtcccctga

SEQ ID NO: 1003 - DNA, 2604 bp, Methylococcus capsulatus Bath
atgaccagtgcggaattacgcgcccgattcctgaaattcttcgccgaccgcggccataccgtcgtggcttccagttccctggtgcccgtcaacgatcccaccctgctgttcaccaatgctggcatggtgcagttcaaggatgtgtttctggggcgcgagcaccgcccctacgtacgcgcggcgagcgcccaacgctgcgtccgtgcgggtggcaagcacaacgatctggagaatgtcggctacacggcgcgtcatcacacctttttcgagatgctgggcaatttcagcttcggcgactacttcaagcgggaggcgatcgtctacgcctgggagttcctgaccgaggtgctcatgctgccgccggaacggctgtggatcacggtatacgccgaggacaaggaagccgagcggatctggctggaagaggtcggcgtcgatccgggccgcttcacccgcatcgccacctccgacaatttctggtccatgggcgacaccggtccgtgcggaccgtgcagcgagattttctatgaccatggtccctccgtcgccggcgggcctcccgggacgccggaagaagacggcgaccgctacgtcgaaatctggaacctggtgttcatgcagtacgagcgtgccggcgacggcacgctgacgcctctccccaagccctcggtggataccggcatggggttggagcggctcgctgcggtgatgcagcgggtgcgcaacaattacgacatcgacctgtttcgcaatctggtcaaggccgcggccgagttggccggcacgaccgacctcgcccaaagttcgctgcgggtgatcgccgaccacatccgctcctgcgccttcctggtcaccgacggcgtactcccgtccaacgaaggaaggggttacgtcctgcgccggatcatccgccgggcgatccgccacggctacaagctcggcatccgcgagccgttcttttacaagctggtcgggccgctctgtgcggaaatgggccaggcctaccccgaactggtcgaggcccgcccgcgggtcgaacaggtgctcgacaaggaggaggagcgcttcgccgagacgctggagcagggcatgaagatactcgacgtcgccatacgcgatctgggtagcccggtgatatcgggtgacaccgccttccagctttacgatacgtacggcttccccgtcgatctgaccgcggacgtggcgcgtgagcatggtctgcaggtggacatggccggattcgagcgggccatggaggcccagcgcgagcgggcgcgggcggccagccatttcagcgtggattattcgcaggagatccatctcgacgtggcgtgcgaattcaccggctaccggaacgccgtcgaggacacgcggatcgtggcgctgctgcgcgacggtcaggccgtggaccggctggaggccggcgaggacggcgtggtcgtgctggagaagacgccgttctatgccgaatccggcggccaggtgggcgaccgcggcgtgatccgcagcgactcggcggtgttcgaggtggcggatacccgcaagcagggcagcgacctgatcctgcaccgggggaagctgcgcgagggagccttgctccggggcgcggtctgccgggcggaggtggagcaatccctgcgcctggccacggccttgaatcattcggccacccatctcttgcatgcggcgctgcgccgggtgctcggagagcacgtcacgcagaaagggtctctggtcgaccccgaacggctgcggttcgatttctcgcatttcgaacctgtcagtccggagcagctcgacgaaatcgagcgtttggtcaaccgggaaatccgtcgcaatgccgaggtcaccgccgaggtcatggccaaggacgccgcaatgaggctcggcgccatggcactgttcggcgaaaaatacggtgacgatgtgcgggtgctcaggatcggcgatttttccaccgagttgtgcggcggcatccacgcccgccgggccggcgacatcggcctgttcaagatcgtgagtgaaagcggcgtcgccgccggcgtgcgccgcatcgaagccgtcaccggggctgccgcggtggaggcggtcgaggccacggaacgtttgctgcgacggctggccgagcgcatgaaggccggccgcgacacccttgaagaacggctcgatcagatgttcgagaagaaccgcgcgctggaaagggagctggaacggctgaaagccaagacggccggcgcagccggtgccgatctggcgtctcgggcggtcgacatcgcgggcgtcaaggtactggccgcgcgcgtcgatgaggcggacgccaggatgctgcgcgagttggtggatcagctcaaggacaggctgggcagcgccgccatcgtgctggctgcggtggaaggcgggaaagtcagcctggtcgccggcgtgaccagggaccagaccggccatatccgtgccggcgatctggtcaacagcgtcgcgacccgtatcggaggcaagggcggtgggcggcccgatctggcccaggcgggcggcaatcggccagaggagttgcagggcgccctcgacggcgtcccggaatgggtgcggcggatgctcaatgcctag

SEQ ID NO: 1004 - DNA, 2622 bp, Nitrosococcus oceani ATCC 19707
atgaaaagcagcgccgaactccgaaaaatatttctcgattattttcgccaccagagccatgagattgttcccagtggccccttagttcctgctaacgatccgaccttgctgttcactaatgcaggcatggtccaattcaaagaggtttttctgggcagggaggtccgagcttatcatcgtgcggcaagcgcccagcgttgcgtccgcgccgggggcaagcataacgatttagaaaatgtaggttataccgcccgccaccataccttttttgaaatgctgggtaatttcagctttggggattattttaagcgcgaagctatcggttatgcttgggaattgttgactgaagtgcttaagctaccgcctgagcggctatgggtgacagtattcaaggaggatgatgaagctgccaatatttggttgcaggaaattggggtaagtccggaacgtttttcccgctgtggtgccgaagacaatttctggtctatgggggagacggggccctgcggcccgtgttctgaaattttttatgatcatggaccggaaatcgagggtggtccccctggcagcccggagcaggagggggataggtacactgagatttggaatctggtttttatgcagtatgaccggggtaaggaaggccggctttctcccttgcctcgtccttcggtagacacagggatgggcttggagcggttagcggcagtaatgcagggagtgcatgataactacaatatcgatttattccgcaaccttatcgccgccattaccgccctttctggtattcaaaatcaagaacaaacttctttgcgggtaattgccgatcatattcgatcttgtgtttttttaatcgtagatggtattcagccttctaatgaagggcgggggtatgttctgcgccgcattatccggcgggctattcggcatgggcataaattgggcctgcgtgatccttttttctaccgcctagtggagccgctggtccaggaaatgggagaggcttatcctgaattgtttcggcttcagagccaagtagagcgggtgctgaaattggaagaggagcgctttaatgaaaccctggagcaaggactcaaaattctagagcaggatattattgatttatcagatgccgtaattcccggagaaacaatatttcggctctacgatacttttggtttcccggtggatttgactgccgacattgcccgggaacggaaactcaccctggatatgaaaggctttgagcaagccatggccaagcagcgtaaacgggctcgggctgccagtcgcttcaaaatcgaatatggatctgagcttcagatggatttggagaccgaatttaccggctatgaacagctccgtggcgagggccagattgccgctctattccgtctggcggagactatggagaccgtggaacaacttagcgctggcgaaagtggcatggtggtgctggaccggactccattttacgcggaggcgggcgggcaagtaggagatcggggaacgctacgtggctccaatgggttattcaacgtgacggatacccacaagcagggcgccgcccatgttcatctgggcgaggttcgcttaggtcagcttcgagttggtgattcaattcaatccgaggtggatcgaaaataccgaactcctacccgactcaaccattcggcaactcatcttctccatgcggccctgcgggaagtgctaggggagggggtgattcagaaaggctccctggtggcttccgaccgcctgcgttttgacttctcccatcttgaagccgtgcagtctggacaattgcgccaaatcgagcatctggtaaatgctaagattagggctaatttgcccgtagaaacacagattatgcctttgcagcaagccctagatgcgggtgttatggcattgtttggcgagaaatacggcgagcaggttcgggttttgcgcatgggagacttctcgatggagctgtgtggtggtacccatgtggatcggaccggcgatattggtcttttcaagatcattaacgaaatgggtgttgccgctggaatccgccgtattgaggcagtcacgggagaggcagcgctatcctgggtagaggagggcgaggtatgcttggaagcccttatgggtcggcttaaggcctcccggaattcagcggttgacaagctggagcaactgcagcaacagacccgccagcaggagaaggaactacagagactgaaagcgaaattagccactacgggaggagcggatttaagcattcaggcgcaagaaattcggggcatcaaagttttggcggcccgaattgatggggttgatagtaaaaccttgcgcgccacggttgatcagctcaaaggcaaacttattactgctgccgttgtattgggcactgtagtggaagataaagtcgttttaattgctggggtgactaacaatgccactagccggattaaggcgggagatttggtcaactttgttgctgagcaggtaggtggccggggtggaggtcgtccggatatggcccaggcgggaggcaggaatccggataaattggatgctgcccttgatttagtgccgaagtgggtagagggacagttaacttccggagcgcaataa

SEQ ID NO: 1005 - DNA, 2649 bp, Pelobacter carbinolicus
atgaccggcaacgaaatacgatcccgttttttgaagtttttccaggaccatggacacacggtagtcccctcttcggcgttgatcccgcacaacgacccgacgctgctgttcatcaatgcgggcatgaaccagttcaaggatgtgtttctcggtcgggaaaaacgcgactatgtgcgcgccacctcggcccagaaatgcgtgcgcgccggcggcaaacataacgacctggaaaacgtcggtcagaccgcccgtcatcacaccttttttgaaatgctcggcaacttctctttcggcgactacttcaagaaagaggccatcgaccatgcctggaagtttctcactgaagagatgggcctgcccaaggacaaattgtgggtcaccgtctttcgcgaggacgacgaagcatacgatatctggcgcgaccagcaaggtatccccgaagagcgcctgatccgcatgggcgaaaaggacaacttctggtccatgggcgacaccggcccctgcggaccctgttcggaaatcctcatcgaccagggcgaatccatgtcctgcggcgacgagtgcggtatcggcaaatgcgactgcgaccgctacctggaactgtggaacctggtgttcatgcagttcaatcgcgacgccgacggcaccatgacccccctgcccaagccgtccatcgacaccggcatggggctggagcgcatcaccgccgtcatgcagggcgtgcaaagcaattacgactgcgacctgctgcgcggcatcatcgcccatgtggaagaactctcgggcaagcgctacggcgacaatgccgagcacgacatgtccatgcgggtcatcgcagaccacagccgcgccacagcgtttctcattgccgacggcgtgctgcccagcaacgaaggccgcggctacgtattgcggcgcatcatgcgccgggccgcccgtcacgccaaaatgctcgggttcgccgatccggtactgtaccgcacggcaaccttcgtactgcaatcgatggccgaagcgtaccccgaaccggcccagcgtgctgactacgtcgccaagatcgtcaagatcgaggaagagcgttttatccagaccctggacaacggcctgcgcatccttaccgaggaggtcgagcgcctcaaagcggccaacgccaccgtgctgccgggcgatgtagcgtttaaactctacgacactttcggctttccccttgaccttaccgcggatattttacgcggcgaaaacgtcaccatcgacgaagacggtttcgaagcctgcatggaggaacagcgccagaaagcccgcgagcactggaaaggctccggcgaagaagccatttccggcatctaccggcagcttgccgaggaaggcgcccgcaccgactttaccggctacggcgaactgaccggccagagcgagattctcgccatcctcctcgacggccaaccggtgtccagcgcaccggccggagccaaagtcgaaatcgtcaccgccgccacgcccttttacggggaatcgggtggccagaccggagactgcggcacccttgccgccggcgatgccgaagtcaccatcacagacaccaaaaaaccgttgccggaattattcgtacacgtgggcgaaattgccgccggcacgctgcagaccggcgaaaccgcaaccctgacggttgaccgggagcgtcgccaggccacggccctcaaccacacggccacccatctgctgcaggcggcccttgtcgaagtactcggcgagcatgtcaaacaggccggatcgctggtaaccccggagcgtctgcgcttcgactttatccatttctccgccatgagcgccgaggaattggaacgggtcgaaaccctggtcaattgccgtatccgggagaacgccggagtcgacacccgcgaaatggatcacgaacaggccgttgccgagggcgccaccgccctgttcggcgaaaaatacggcgacaaggtccgcgtcgtccgggtcggcgacatcagcatggaactgtgcggcggcacccacgccaacgcatccggggatatcggcctgttcaaaatcctgcaggagaccggcatcgccgccggcgtacgacgtatcgaagcggtgacgggggccaaagccctccaggtggtacgcgaccaggaacgtaccctcgacgatctggcaagcctgatcaaaaccgatcgtccccaactggaagcacgcctgcgcaagctgctggaacgccagaaggaactggaacgcgaaatcgaatccctgcagggcaagctcaacgccgaccaggccggcgatctgctgcagcaggctaccgagatcgacggcatcagcgtggtttgcggccgtgtcgacaacctcgacggcaaggctttgcgggaacttgccgatcaggtccgtgaccgactgtcatcaggcgtcctgattctgggcagtgcccacgaaggcaaggccgggcttctggtagcagtcaccaaggatctgaccaagcggctgcaggccggcgcactggtcaaacaactggccgccatggtcggtggtggcggcggcgggcgacccgacctggctcaggccggcggcagcaagcccgaacaacttgacgaggccctggccagcgtaccgcaacgcatctccgaagcccttaacgcggcctga

SEQ ID NO: 1006 - DNA, 2631 bp, Geobacter metallireducens GS-15
atgaccggaaacgaactacgcgccagattcctgaaatttttcgaggaccgcggacacaccgtggtccccagctccctcctcatcccccacaatgacccgacgctcctttttgccaatgccggcatgaaccagttcaaggactgcttcctcggcatggaggaccgggggtacacccgggcaaccagttcccagaagtgcgtgcgggccggggggaagcacaacgacctggagaacgtggggcgcaccgcccggcaccataccttcttcgagatgctcggcaatttctccttcggcgactacttcaagaaggaggccattgcctttgcctgggagttcctcaccaaggacctggggcttgacaaggaccgcctctacgtgacggtctacaccgatgacgacgaggccgccgacatctggcaccaccaggagggggttccccgcgagcggattttccgcttcggcgagaaggacaacttctggtccatgggagacaccggcccctgcggcccctgctccgagatcttctgggacaatggtcccgaggtagggtgcggctcccccgactgtaccgtcgggtgtgactgcgaccgctacatggagatctggaacaacgtcttcatgcagttcaaccgctccgccgacggcaccatgaccccgctccccaaaccctccgtcgataccggcatgggtcttgagcggatctgcaccgtcatgcagggggttaaatccaactacgacactgacctcctccagggggtcatcaggcatgtggagcggctttcgggaaaacggtaccgggagaatgagaaggacgacgtctccatgcgggtcatcgccgatcacgcccgggccaccaccttcctcatctgcgacggtgtccttccctccaacgaggggcggggctacgtgctgcgccggatcatgcgccgggcagcccgccacgccaagatgctcggctttgccgagccggtcctctaccggaccgtggatgccgtgaacgagatgatggggggctcatacccggagcttctggagcgggaagaatacatcaaaaaggtgatccgggccgaggaggagcgcttcgccgaaaccctcgaccggggcctcgccatcctgaacgacgccgtggcccagttgaagggggaggggaagacggtgatccccggcgaaaccctcttccgcctttacgacacattcggttttcccactgacctcacggccgacatcgtccgcgccgaagggttcaccatcgacgagccgggcttcgaggcctgcatgggacgccagcgggagcaggcccgggagcactggaaaggttccggcgaagaagggattgccgccgtccacaaggaactccacaaccgtggggtcagaagcgtctttgtgggttatgacgagaagtgcagctacgcagcgatcggcagcatcctccgtggtggctccgaggtggccgaggcgaaggccggcgaagatgtggaaatcatcaccgacaggacccccttctacggcgagtccggcggccaggccggagataccggcaccatctccaccggctcggcccacgtgcgggtgaccggcacgatccgcccctatcccgacctcatcgtccaccggggaaccgtcgtcgaggggaccatcaagaccggcgaggcgtgcgacctgaaggttgcgtccgtggatcgcgacgccacggccagaaaccacaccgccactcacctcctccagacggcgctccgccgggtgctcggcgaacacgtgaagcaggccggctccctcgtggcgccggaccggctccgtttcgacttcacccactttgccgccatgaccccggaggaaatccgccgggtggaggagatcgtcaataccttcataatggagaacgatacggtccatgcccgggagatggctgttgaggaagccatggagagcggagccacggccctgttcggcgagaagtacggcgatcgggtacgggtggtcaaggtgggggaggtgagcgccgagctctgcggcggcacccacgtccgggccgccggcgacatcggctccttcaagattctctccgaggcgggaattgccgccggggtgcgccgcatagaggccctgaccggcatgggggcgctgcgccacatccaggagctggaggatgagaagcggcagatcgcggccctcatgaaggccgaggggggagacaatatcgaccggctccagaaacttctcgcccgccagcgggagatgcagcgggagatcgagacgctccagggtcagctcaatgcggccaaatccggggatctcttggcggatgtccgggaggtgaacggtgtgaaggtcctggccacgaaagtggaggtggacgatccgaaaaagttgagggagttggccgataccctcaaggaccgtctcggttccggggttgtggcccttgggtgcgagaaggacggcagggccaacctcctcgtggcggtgacgaaagatctggcgggccgcatcagggccggcgacatcatccggcagctggcgccggtcatcggcgggagcggcggcggcaagccggagctggcccaggcgggggggagccagcccgacatgctggccgaggccctcggtaaggtgtacgggctcatcggctga

SEQ ID NO: 1007 - DNA, 2595 bp, Thiomicrospira crunogena XCL-2
atgaccagtgcagaactcagaaaagcatttttagacttttttgttaagcaaggccatactgctgtgcattcaagcccagtcgtgccaggaaatgacccaacgttactctttactaacgcaggaatggttcagtttaaagaaacttttctaggtcaggagacccgggaatataagcgtgcaaccagtgtgcagcgctgtattcgtgcgggtggaaaacacaatgacttggaaaacgtggggtataccgcccgtcatcataccttctttgaaatgctagggaacttcagttttggggattactttaagcgtgaagcaattcaatacgcttggacgtttttaactgaagagcttgggctgcctgaagaaaagctttggattaccgtgtttgaagaagatcgggaagcggaagatatctggttgaaagaaatgggtgtcagtgccgagcgtttctctcgttgtggtgccaaagataatttctggtcgatgggggatactggtccttgtggcccatgctctgaaattttttacgatcacggtgccgatgtcgcgggtggacctccagggtcacccgacgaagatggtgatcgttatatcgagatctggaacttggttttcatgcagttcgatcgttcggaagatggcactttaacaccgcttccaaaaccgtctgtcgataccgggatgggcttagagcgtttggctgcagtcatgcaaaatcagcataacaactacgacattgatttgtttcaagccattgttaagaaagcctctgagctgacgggcgaaaaagatctggccaacagttctttgcgcgtcattgcggatcatattcgctcttgtgcctttatggttgtggatggtgttcttccttctaatgaagggcgagggtatgtgttgcgtcgcatcattcgacgtgccattcgtcatggttataagttaggccaaaccgatattttcttttaccagttggtgccaacgctggtagagcaaatgggagaagcctatcctgaattggttaaggaacaagcaaatgttgaacgcgcattaaaattagaagaagaacgttttgcggaaacgcttgaaaacggcatgaagattctggaagaagacatcgctcagttaagcggttctgtgatcagtggttcaacagcattcaaactgtacgacacttatggctttccgctcgacttaacggccgatgtggcgcgtgagcgtaatttgagtgttgatgaagctggctttgaacaagaaatggaagcgcaaagagctagagcgcgttcggccagtaactttggtgcacagagcaaaaataaagtggattacactggaagtactcactttattggttatgagcaggatgaagccgaagcggaaattgcagccatttttgtcgataacgtttcagtggagaaagcctctgaaggtcaagaagcgattgtgattttgaatcaaacaccgttttatgccgaatcaggtggtcaggtaggtgatcaaggaagcctgacggaaggaatgaacagttttcatgtggataattgtcaaaaacaaggcgctgcattcctacatatcggtaaagtgacagccggttctatttcggtggggcaaaccattcttgcacacattgatgtgaaagcccgtcgtgcgtccgagcgtaaccattccgcaacgcatttattgcatgccgcattaagaacggtgttagggacgcatgtggggcagaaagggtcgttggtacaaccagaaagattacgattcgatttctcgcattttgaaccgatttcagccgagcaactgctcgaaatcgaacaactggtcaaccataacatcatgctgaatgctcaagttatgatggaagagatggatattgaagccgctaaggccaaaggcgcgatggcgttgtttggtgaaaagtatggcgatgtggttcgagtggttgatatgggcgacttttccatcgagttgtgtggtggaacgcatgtgaattggacaggtgaaatcggtccttttcgtatcacttcagaaagcgggattgcttctggagtgcgccgtattgaagcggtcacaggagaagcggcctggcagacgatttatgatatggagaaaagcttattaaacattgccgccaacctcaaaaccgataaaccacaagttgaatcgaaagtggctcaattagtgacggaacaaaaagagttggaaaagcaattaaagcaactgcaatcaaaacttgcttcttctcaaggagatgatttagccagttccgtaacggaagtgaacggggtcaatgtattggctgccgaactagaaggagccgatgttaatacacttcgcgaaacccttgataagttaagagataagcttgaaccagctgccattgtgcttgccgccgtggatggtgataaagtgtctttggttgctggggtaagtaaatcaattaccggtaatgtcaaagctggtgagttggtgaaccatgtagcacagcaagttggtggtaaaggtggtgggcgtccggatatggcgcaagccggtggaaaagatccaagtaagttaaaagaagccttggcttcagtaaaagagtgggttgcaacagtcgcttaa

SEQ ID NO: 1008 - DNA, 2625 bp, Methylobacillus flagellatus KT
atgaagagcaaccagattcgccaggcattcctggactatttcgcctccaaggggcaccagatcgtcagctccagctcgctggttccggccggcgatcccaccctgctcttcaccaacgccgggatgaaccagttcaaggatgtgtttctcggcttcgacaagcgcccctacacccgcgcaacctcatcacagaaatgtgtacgggcgggtggcaagcacaacgacctcgaaaacgtcggctataccgcgcgccaccatacctttttcgagatgctcggcaacttcagtttcggtgactatttcaagcgcgacgccatccactatgcctgggaattgctcacccaggttttcaagcttccagcggataaactcaccgtcaccgtctatgccgaggacgacgaagcctacgacatctggactagggaaatcggcgtgcctgccgagcgtgtgatccgcatcggcgacaacaaaggcgcgcgctatgcctccgacaatttctggatgatgggcgacaccggtccctgcggcccctgtaccgagattttctacgaccacggcgagcatatcccgggcggcccacccggctcacctgatgaagacggcgaccgcttcatcgaaatctggaacaacgtgttcatgcagttcaaccgcgacgaacaaggcgtcatgcacccgctacccaagccttccgtcgataccggcatgggcctggagcgcattgccgccgtgctgcagggcgtacacagcaattacgaaattgacctgttccagaacctgatcaaggccgccgcccgcgtcacgaataccacagacctggacagcccgtcactcaaggtgctggcggaccatatccgcgcctgcagctttctgatcgccgacggcgtcatcccgggcaacgagggccgcggctatgtgctgcgccgcatcatccgccgcgcgatccgccatgggtacaaacttggagcaagacaagctttcttccacttgatggtttctgcccttgtgaacgaaatgggcgacgcctatcccgagctcaagagcggggaagaacgtatcaccagcatcctgcgtcaggaagaagaccgcttcttcgagaccattgagcacggcatggcaatcctcgaggccgagctcgaggaaatggcgaagaccggcaaccacgtgttcaacggcgagaccgccttcaagctgcacgacaccttcggcttcccgctcgacttgaccgccgacgtatgccgcgagcgtggcgtgagcgtggactctgccgcattcgacgctgccatggcgcgccagaaggaacaggcccgcgcggcaggcaagttcaagatggcagccaacctggaatacacaggcaatgcgaccaccttccatggctacgacaccctcgaagcgcaaggtaaggtactcgcgctgtacaaagacggtagcgcagtgccagccctcaatgaaggcgaactgggtgtggtggtactcgacaacaccccgttctatgctgaatccggcggccaggtcggcgatcaaggcatattgaaaggtgcggaaggcattttccaggtggaagacacccagaaaatccaggccagtgtattcggccatcatggcgtattgagcaccggcaccctgcgcgtgggcgacgaagtcagcgcacgcgtcgaccttctgtcgcgccaccgcaccatgcgtcaccattccgccacccacctcatgcacaaggcattgcgtgcagtgctcggcagccacgtacagcaaaaaggctcgttggtagatcctgacaagacgcgcttcgacttttcgcacaatgccccagtgactgccgatgagatccgccgcattgaagacatcgtcaatgccgagattctggccaacacacccaccttggcacgcgtcatgcccatcgacgaggcacagaagaccggcgccatgatgctgttcggcgagaaatacggcgacgaagtgcgcgtgctcgacatcggcacctcgcgcgaactctgtggcggcacccatgtgagccgcaccggcgacatcggcctgttcaagatcgtgtcagaatccggcgtcgccgcaggcgtgcgccgcattgaagccgctgcaggcgatgtggcattgcgccatatccagcaacagcagcagctgctcgccgatgcggcagcctccttcaaggttcctgccattgagctggccggcaaaatcagccagaccttggagcagatcaaggcactggaaaaagaacttgcccgcctcaaatccaagctagcctcctcacaaggtgacgaactcgccagccaggccgtgaacatcggtggcatcaaggtgctggcggccacgctggaaggcgcagatgccaacaccctccgcgaaaccatggacaagctcaaggacaagctcaagactgccgccatcgtgctcgccagcgtcaatggcgacaaggtcagcgtggctgcgggcgtgaccaccgatacgactgccaggatcaaggccggtgagttggtgaatttcgttgcggcgcaggtaggcggcaagggcggcggcaaaccggacatggccatggcaggcggcagcgaccccagccagctgccccgggcactcgccagcgttgctggctgggtagaggaaagactgaagtaa

SEQ ID NO: 1009 - DNA, 2607 bp, Chromohalobacter salexigens DSM 3043
atgaaaagcgcagacatccgacaagcctttctgacgttcttcgaggagcacggtcataccatcgtgccgtcgagctcgctcgtgcccgccaacgacccgacgctgttgttcaccaacgccggcatggtgccgttcaaggacgtcttcctgggacgcgacccacgcccctacgtgcgtgccacttccgcgcagcgctgcgtgcgtgccgggggcaagcacaatgacctggacaacgtcggctacaccgcgcgtcaccataccttcttcgaaatgctggggaacttcagcttcggggattacttcaagcgcggcgccattcgctttgcctggacgttcctgaccgaacggctgggcctgcccgccgacaagctgtgggtcaccgtccacgtcagcgacgacgaggccgagcgtatctggaaggacgaaatcggcatcgatccggcgcgcttctccaagctcgacgaagacaacttctggcagatgggcgacaccggcccctgcggcccttcctcggagatcttcttcgaccacggccccgaggtggccggggggccgccgggaagccccgaagaagacggcgaccgctacatcgagatctggaacctggtgttcatgcagttcgatcgcgatagcgcgggaacgctgaacccgctgcccaagccgtccatcgataccggcatgggcctggagcgtgtcgcggccgtgctgcagggggtgcattccaactacgagatcgacctgttccagaacctgctgaacgcggcctccgaggccacgggatacgacgataccagtgcgccgtcgctgcgcgtgatcgccgaccacatccggtcctgtgccttcttgatcaccgacgatgtgctgccctccaacgaagggcgcggctacgtgttgcgccgtatcatccggcgcgccattcgccacggccacaagctcggtgcccgtgagccgttcttccacaccctggtggcggcgctggatgccgagatgggggcggcctatccggaactgcgcaaggcgcgtccgcgcatcgagaaggtcctgctcaaggaagaagaacagttcgcgcgcacgctggatcacggcatgggcctgctgacggaagccctggaaacgctggacggcgaggtactgccgggcgagaccgtgttcaagctttacgatacctacggctttccgttcgacttgacggccgacgtgtgccgcgagcgcggcgtgacgctcgacgaggtcggcttccagcgcgagctcgaggcccagcgcgagcgagcccgcgcggccagccagttcggtgccgactacacggcggcactcgacctggagggcgagacggccttcaccggttatgagcgcctggaagacgaggctcgcgtgaccgccctggtcgatcgtgagggcaacgcgctggcggcgctcgaggccgggcagcacggtgtcgtggtgctcgaccgtacgcccttctatggcgaatccggggggcaggccggtgacacggggtatctggaggccgacggcatgcgcttccaggtcaccgatacccagaagcaaggcggccatcacctgcatcacggggtgctcgtcgagggacgtctcgacgtgggtgccagcgtgacgccacgggtcgatgccagtctgcgggcggcgaccatgcgcaaccactcggccacccacctgttgcacgaggcgctgaggcaggtgctgggcgagcacgtgcagcagaagggctcgctggtcaccgccgagcgcttgcggttcgacgtgagtcatttcgaggcgatgacccgggcgcagctcgacgaggtcgaacgtatcgtcaatgcccagatcctggccaacgccgcgacccgtatcgagcacatgacgctcgacgaggccaaggccaagggtgccgcggcgctcttcgaggccaagtacgccgacagcgtgcgcgtgctgaccatcggtgccgacgacttttccatcgagctgtgcggcggtacgcacgtggcgcgcagcggcgacatcggttgcttccacatcctcagcgaggcgggtgtcgctgctggagtgcgccgcatcgaggccgtgaccggcgaaggggccctggcgtatttccgcgaccaggaagccaaggtcgcgcgtgttgccgaacagctcaaggccaagccggagcaagtggaagcacgtctcgaggcgaccctcgagcgtaaccgcaccctggaaaaggagctcgagcggctcaaggccaagttggcgagtgccaccagcggcgatatgctcgccgacgtgcgcgaggtggccggcgtcaagcttctcgccaagcaagtcgagggtgtgggcggcaaggaactgcgtggcctgctcgaccaactcaagaacaagctgggctcgggcgtcatcgtgctcggcgtcgcgggcgacgagaaggtcagcctgatcgccggcgtgaccgatgacctgaccgcacgcctcaaggccggcgacctggtcaagcatgtcgccgagcaggtcggcggcaagggcggcggccgggccgacatggcccaggcgggcggctcacggccgcaggcgctgcccgatgccctggcgagtgtgccgagttgggtcgaggcccggctcggcgagtga

SEQ ID NO: 1010 - DNA, 2598 bp, Pseudoalteromonas atlantica T6c
atgagtaagagcacagcgcaaattcgacaagcctttttaaacttttttgcagacaaagggcatcaaaaagtttctagttcgtctctggttccaagcgacgatcccacattgttatttaccaacgcgggtatgaaccaattcaaagatgtgtttttaggcactgaacaacgcaagtacacacgtgcaacctcatctcaacggtgtgtaagagcgggtggtaaacataatgatttagaaaatgtaggctacacggcgcgtcatcacaccttttttgaaatgctaggtaacttcagttttggtgattatttcaagcaccaagccattggttatgcatggtcttttttaaccgaagtattgaaactgccgaaagacaagttattagtcactgtttattcagaggacgacgaggcgtttgacatttggcacaacgacattggcattcctaaagaaaaaattattcgtattgccacctcagataatttctggtcaatgggtgacaccgggccttgtgggccttgttctgaaatattttatgatcacggtgaacacatctggggtggtcctcctggctccccggaggaagatggcgatcgttttatcgaaatctggaacttggtcttcatgcagttcaatcgtcaagccaatggtgacatgttgcctttgcctaaaccctctatcgataccgggatggggttagaacgtatttcggctattatacaaaatgtgcacagcaactatgaaattgatattttccaaaacttgataaaagccactgcaaagattgttggggtaacaagccttgaagacaaatcgttgcgcgtggtggcggatcacattcgctcctgtagtttccttatttcagacggcgtcatgccatcgaatgaggggcgagggtatgtactgcgtcgtattatccgccgcgcggtgcgccacggtaataagctgggtgcaaacggcgtgtttttctataaattagtagcagcattggccacagagatgggcgacgcgtatccagagctaaacgaacaacgtgcagtgattgaaaaagtgcttcgagtggaagaggagcagttttcccgtacgcttgagcgcggaatgctaattctaaacgatgcattgaacgagcttgaaggtaaagtggtaccgggtgatgtggtcttcaagctctatgatacctatggcttcccagcagatttgaccaatgatgtagcccgagagaaaggtttgagcattgatgaggaagggtttgagcaggcgatggctgagcagcgaaaacgagcccaaaaagccagtaactttgacgtggattacaacgagcaacttcgcagcgatttagagtcaatctttgtgggatatgaacatgaagataacactgcaacaatcactgagctgtttttcaaagggcaatcagttaacgaattagcagcaggtgctgagggcacagttattttagatgagagtccattttatgccgaagcgggtggtcaagctggtgatacaggtacgttagtcactgacgcgggtggtttcagcgtaaaagatacggttaagttagggaaagcaatcgcccataaaggcgctgcccttagcaagctaagcgtgggagatagcgtattagcaaaggttaatggtgttcgtcgccatgcaattaagctaaaccacagcgcgacgcatttaatgcacgcagcactgaaatcgattcttggtgagcatgtaaaccaaaaaggttcgttagtacaagcggatcgcttgcgctttgatttctcgcattttgaagcgatgagtaaagagcaagtgctggctgtggaaaccatggtgaatgagcagatactcgctaatcatcctttgcaaactcaactaatgggcttagagcaagcaaaagaagctggtgcgatggccttgttcggtgagaaatacgatgatgatgtgcgcgtggtgtccatggggagtttctcgatggaactgtgcggcggtacgcacgttgaacgcactggtgatattggattattcaaaatcatctcagaaagcggtatcgcgtcaggcgtgcgacgaatagaagcggtaacaggtttgactgcactccaacatgtacagcaacagacattcgaactaagttctattagcgcagtcttaaaaacggatgttaattctgcgggtgagcgcgttgttcaacttatcgagcagactaaaacgctcgaaaaagaagtcgctaaacttaagcaggaaatagctaatagcgcggggagtgatcttttatcccagataaacgaaataaatggggtaaaagtattgtcttatcatgtacaaggcattgaaagtggggctttacgcaccatgatagatgatctaaagaatcaaatcggcagtggcgttatccttttagggttagcaactggcgataaggttagtttaattgctggcgttacgaaggatttaacccacaaggtgaaagccggcgagttagtcaattttgtggctcagcaagtaggtggaaaaggtggcggacgtcctgatatggcgcaagctggtggctctcaacctgagaacttagacactgcgattgcctctgtttcagagtggttgcaagaaaggctgtaa

SEQ ID NO: 1011 - DNA, 2625 bp, Shewanella sp. MR-7
atgtatcaaacgacagcagcgcttagaagtgctttcctcgaatttttccgcagcaatggtcaccaagttgtggatagtagttctcttgtaccaggcaacgatcccacgcttttattcaccaacgccggtatgaaccagttcaaggacgtgtttcttggcatggacaaacgtagctatacacgtgcgaccactgcccaacgctgcgtccgtgcgggtggtaaacacaacgatttagataacgttggttacaccgcgcgtcaccatactttcttcgaaatgctgggcaacttcagctttggtgattatttcaaagaagatgcgattcgttttggttggacattcctgactgaagtcttgaagctaccaaaggaacgtctgtgtgtaactgtttaccaaacagacgatgaagcctttgaaatttggaataaaaagattggtgttgctgccgaaaacatcattcgcatcggcgataacaagggcgcgccatacgcttcagataacttctggcaaatgggtgacactggtccttgtggtccttgtaccgaaattttctacgatcacggcgatcatatctggggcggacgtcctggtagcccagaagaagatggcgaccgtttcatcgaaatctggaacatcgtattcatgcaatacaatcgccaagcctctggtgaaatgttgccgctgccaaaaccttcagtcgatactggtatggggattgagcgtatcgctgcgattatgcagggcgttcattcaaactacgaaatcgatattttccgcgccttgattgcgaaagcagccgaaatcatcggcgtgactgacttatctaacaagtcactgcgcgttattgccgaccatatccgttcatgcgccttcttagttgccgatggtgtaatgccatcgaacgaaggtcgtggctatgtactgcgtcgtattattcgccgcgccgtgcgtcatggtaacaagttaggggcaactgaagccttcttctacaagttagttccgacgctaatcgaagtgatgggcgatgccgctaaaggtcttgctgatactcaagtgattgttgaaaaagcccttaaggcggaagaagaacagtttgcccgtacgcttgagcgtggtttaggcattctagatagtgcgttaaacgaattgcagggcgataccttagacggtgaaactgtctttaaactttacgatacctatggcttcccagtggatttaaccgccgacgtatgccgtgagcgcaacattatcgtcgatgaagcgggcttcgaagcggcgatggctgaacaacgtagccgcgctcaagccgcgggtaacttcggcgccgattacaacgctgcactgaaaattgatgctgaaaccgcattctgtggttactcagaactcacaggcaatgccaaagtcactgcactttacctaaacggtgagtcagttcctgcaatcaatgcgggtgatgatgccgtagtcgtgctcgacgtgacgccattctacgccgaatcgggcggccaagtcggcgacaagggcgtattagtggctcaaggtatcgagttcgctgttagcgatacgcaaaagtttggtcaagcctcaggccacaaagggacgttaacggctggcagcctaagcgttggccaagtacttgaggcaaaagtggataagaaactgcgtcaccgcacccagttaaaccactcagtgactcacttattacatgctgcgctgcgtcaagtgttaggtactcacgttactcaaaaaggttcactagttgatcctgagcgtttacgtttcgacttctctcatttcgaagcggtcaaacctgctgaattgaaacaggttgaagagttagtcaacacccaaattcgtcgtaaccatgagctgaaagtcgctgaaatggcgattgatgaagccaaagaaaaaggcgctatggcgctctttggtgagaagtacgatgcgcaagtgcgtgtcgtcactatgggcgatttctctatcgaactgtgtggtggtactcacgttggtcgtaccggtgacattggtctgttcaaaattacctctgaaggcggtatcgctgcgggcgttcgccgtatcgaagcggtaaccggtgcggcagcgatggcctatgtggcacagcaacaagcgcaacttgaagaagcagctgctctgcttaaaggcgatactcaatctgttgtggctaagctgaaagtgcaactggataaaatgaagcaacttgaaaaagacatgcagcaactaaaagataagttagctgcggccgcgagtgcggatttagccggtgatgccgttgtggttaatggcgtaaatgtgctgattaagaagcttgaaggcgttgaagcaggtgcactgcgtggactgcaagatgagttgaagcaaaagctgaaatccgccgttatcctgctcggtgtggctcaagaaggtaaagtgaaccttatcgcgggtgtgagcaacgacttagtcggtaaagttaaagccggtgaactggttgctatggttgctgcgcaggtgggtggtaaaggcggtggtcgccctgatatggctcaagcgggtggtagccaaccagaaaatctggatgcggcactgtctcaagtattaccttggattactgagcgtttagcttaa

SEQ ID NO: 1012 - DNA, 2625 bp, Shewanella sp. MR-4
atgtatcaaacgacagcagcgcttagaagtgctttcctcgaatttttccgcagcaatggtcaccaagttgtggacagtagttctcttgtaccaggcaacgatcccacgcttttattcaccaacgccggtatgaaccagttcaaggacgtgtttcttggcatggacaaacgtagctatacacgtgcgaccactgctcaacgctgcgtccgtgcgggtggtaaacacaacgatttagataacgttggttacaccgcgcgtcaccatactttcttcgaaatgctgggcaacttcagctttggtgattatttcaaagaagatgcgattcgttttggttggacattcctgactgaagtcttgaagctaccaaaggaacgtctgtgtgtgactgtttaccaaacagacgatgaagcctttgaaatttggaataaaaagattggtgttgccgctgaaaacatcattcgcatcggcgataacaagggcgcgccatacgcttcagataacttctggcaaatgggtgacacaggtccttgtggtccatgtaccgaaattttctacgatcacggcgatcatatttggggcggacgtcccggtagcccagaagaagatggcgaccgtttcatcgaaatctggaacatcgtattcatgcaatacaatcgtcaagcttctggtgaaatgttgccgctgccaaaaccttcagtcgataccggtatggggattgagcgtatcgctgcgattatgcagggcgttcattcaaactacgaaatcgatattttccgcgccttgattgctaaagcagccgaaatcatcggcgtgactgacttatctaacaagtcactgcgcgttattgccgaccatatccgttcatgcgccttcttagttgccgatggtgtaatgccatcgaatgaaggtcgtggctatgtgctgcgccgtattattcgccgcgcagtgcgtcatggtaacaagttaggggcaactgaagccttcttctacaagttagttccgacgctaatcgaagtgatgggcgatgccgctaaaggtcttgccgatactcaagtgattgttgaaaaagcccttaaagcggaagaagagcagtttgctcgtacacttgagcgtggtttaggtattctagatagcgcattaaacgaattgcagggcgacaccttagacggtgaaacagtcttcaaactgtacgatacctatggcttcccagtggatttaaccgctgacgtatgccgtgagcgtaacattattgtcgatgaagcgggcttcgaagcggcgatggctgaacaacgtagccgcgctcaagccgcgggtaacttcggcgccgattacaacgctgcactgaaaattgatgctgaaaccgcattctgtggttactcagaactcacaggcaatgccaaagtcactgcactttacctaaacggtgagtcagtgcctgcaatcaatgcgggtgatgatgccgtagtcgtgctcgatgtgacgcctttctacgcagaatcgggcggccaagtcggtgataagggcgtattagtggctcaaggtattgagtttgctgttagcgatacgcaaaagtttggtcaagcttcaggccacaaaggaacgttaacggctggcagcttaagcgttggccaagtacttgaagcaaaagtggataagaaactgcgtcaccgcacccagttaaaccactcagtgactcacttattacacgctgcgctgcgtcaagtgttgggtactcatgtcactcaaaaaggttcgttagttgaccctgagcgtttacgtttcgacttctctcatttcgaagcggtgaaacctgctgaattgaaacaggttgaagagttagtcaacacccaaattcgccgtaaccatgagctgaaagtcgctgaaatggcgattgatgaagcgaaagaaaaaggcgctatggcactctttggtgagaagtacgatgcgcaagtgcgtgtcgtcactatgggcgatttctctatcgagctgtgtggtggtactcacgttggccgtaccggtgacattggtctgttcaaaattacctcagaaggcggtatagctgcgggcgttcgccgtatcgaagcggtaaccggcgctgcggcgatggcctatgtggcacaacaacaagcgcaacttgaagaagcagcagcactgcttaaaggcgatacacaatctgttgtggctaagctgaaagcgcagctggataaaatgaagcagcttgaaaaagatatgcagcaactaaaagataagttagctgcggctgcgagtgcggatttagcctgtgatgcggttgtggttaatggcgtaaatgtgctgattaagaagcttgatggcgttgaagcaggtgcactgcgtggactgcaagatgagttgaagcaaaagctgaaatccgccgttatcctgctaggtgtggctcaagaaggcaaagtgaaccttatcgcgggtgtgagcaacgacttagtcggtaaagttaaagccggtgaactggttgctatggttgcagcgcaggtgggtggtaaaggcggtggccgccctgatatggctcaagcgggtggtagccaaccagaaaacctggatgcggcactgtctcaagtattaccttggattactgagcgtttagcttaa

SEQ ID NO: 1013 - DNA, 2610 bp, Alkalilimnicola ehrlichei MLHE-1
atgaagagcagcgcagagattcgcaacgcctttctggagttcttcgagcaccgggggcacaccgtggtgcccagcagccccctcgtgcccgccaacgacccgacgctgctattcaccaacgccggcatggtgccgtttaaggacgtgttcctgggcaaggagcagcgtggctatacgcgggcctgcagcagccagcgctgtgtgcgggccggcggcaagcacaatgacctggataacgtcggttacaccgcccgccaccacaccttcttcgagatgctgggcaacttcagcttcggtgactacttcaagcgtgaagccattgaatacgcctgggaattcctgacccggaccattggcctgcccgccgagcgtttgtgggtcaccgtctatgaggaggacgatgaggcggccgatatctggttgaacgagatcggcgtggacccggagcgtttcggccgcatcggcgcggcggacaacttttggtccatgggcgataccggtccctgcggcccctgctccgagatcttctacgatcacggcccggaggtgcccggcgggcccccgggcagccccgaggaggacggcgaccgttacgtggagatctggaacctggtcttcatgcaatacgaccgggacgccgagggccgactggccccgctgcccatgccctgtgtggacaccggcatggggctggagcgcctggcggccgtggtccagggggtgcattccaatttcgagatcgacctgttccgccgtttgatcggtgctgccgccgcactggcggggttgccggaggattcggacaacgcctcgctgaaggtcattgccgatcacatccgcgcctgcgcgttcctcattaccgacggggtggttccggccaatgacggccgcggctatgttctgcgccggatcatccgccgggcggtgcggcacggctacaagctggggatcgacgaacccttcttccaccgcctggtgcagccgctggccgatgagatgggtggggccttcccggaactgcccgagcgccaggcgttggtggagcgcctgctgctgcaagaggagcagcgcttccgcgagaccctggagcagggcctgaagctgctggaggaggacctccggcagctcacgggcgccgagatcccgggcgagacggtcttcaaactggcggacacctacggcttcccggtggatctgaccgccgacatcgcccgcgagcgcgacctcaccctggacatggccggctttgaggcctgcatggcggcccagcgcgagcgggcccgcgcccacagccagttcaaggtccagcacggcgagggggaacagttcgaaggagagtcgcattttataggctacgatcaactggaagggcacggcgaggtgctggcccttttcagggatgggcgtagcgtgcagacactgtcggccggcgaagaaggcatggtcatccttgatcagaccccgttctatgcggagtccggcggccaagtgggtgaccagggtgtgctggagaccgcggggggtgaggtcttcgaggtgcgcgataccctcaagcagggcgagggccacggccatctgggccggctccgcgagggccggatccacgtgggggatcggctccgggcgcaagtggacgcggagacccgctgggccaccgcgctcaaccactccgccacccacctgctgcacgcggcgctgcgcggcgtgctgggcacccatgttcagcagaaagggtcgctggtggcccccgaccggctgcgcttcgatttcgcccactacgaggccccttcaaccgagcaactggagcagatcgagcggatcgtcaatgacgagattcgcgccaaccgggcggccgacattgagcacatggcctatgacgatgccatcgagaccggcgccatggccctgttcggcgagaagtacggggaccaggtgcgggtgctgcgcttcggggagttctccatcgagctttgtggtggcacccacgtcgagcgcaccggggatatcggcctgtgcaagctgatcagcgagggcggcgtggccggcggcgtccggcggatcgaggctgttaccggcgaccgcgcggtgatgtgggtccagcggacggagcagcgcctggtccaggtggcggagacggtcaaggccagtcctgataacgcggcggtccgggtggcccaactggtggaccggctcaagggccaggagaaggagctggagcggctgaagcagaagctggccagccaggcgggcagcgatctcgccggccaggcggtggacatcggtggcgtcaaggtggtggcggcgcgggtcgatgccgacaacaaggcgctgcgggacaccgtggaccagcttcgcaacaagctggggacggccgtcatcgtcctgggtgccgtggccggagacaaagtgcggttggtggccggggtcagcaaggactgcaccgaccgcatcaaggccggcgatctggtccgccaggtggcggagcaggtcggcggcaagggtggcggacgccccgacttcgcacaagccggtggcgagcagcccgagcacctggagacggcgctggcaagcgttgaatcgctggtgcgcgacgccctgggtttggaataa

SEQ ID NO: 1014 - DNA, 2637 bp, Magnetococcus MC-1
atgaacggtaatgagatccgtaaaaggtttgtagcgtttttccaacaacatgggcatacccatgtggaatcctccagcctggtgccgcgcaacgaccccaccctacttttcaccaacgccggtatggtgcagtttaaaagtctttttttgggcgaagagcggcgggattacagccgcgccgtcagtgcgcaaaaatgcgtgcgtgccgggggtaagcataatgatctggagaatgtggggcgtaccgcccgccaccacactttctttgagatgctgggtaacttctcttttggagattatttcaaggaggaggcgatccgcctgggctggcgctttgtcaccgaagatctgggtattgatgcccagcgcctgctggtcacggtctatagcgaagatgacgaagcctatgccatctggacccaacagatcggcctgcccgctgacaaggtgatccgtatacccaccaccgataacttttggtccatgggcgataccggcccttgcggcccctgtagtgaaattttctatgactatggcgacaccgtagcggggggtccccctggctcggaagatgaggatggtgatcgctttgtcgagatctggaacttggtctttatgcagtatgaccgcagcagcgacggtaccttaacccccctgcccaaacccagcattgatactggtgccgggctggaacggctggcttcggtgctgcaaggcaagaccaacaactatgataccgacctttttcagcctcttatcaaggccgctgcggctttggcgggggtggatgataccacatgctcggcggagcagttggtctcattgcgggtgattgccgaccatattcgttcggtcagttttttaattgccgacggtgtgttgccctccaacgaagggcggggttacgtgttacgccgcatcatgcggcggggcatgcgccatggccgcctgctggggctagaacagccctttatgcacaagttggtggagacgttaggggcattgatgggggatacctatcctgagcttaccgcccaacgtaaaaccttggcgatggtgattgagaccgaagagaagcgctttgctgcgactttgggcacgggtcttaaacatttggaggaggcggtcgcaggtctgcgtatgggggatgtgctggatggcaagaccctttttaccctttacgacacctttggtttcccgctggatttgacggcggacatcctgcgtgatcgtgagattggggtggatcaggagggctttagcgcttgcatgaaagagcagcgggagcgtgcccgcgccgcatggtcgggcagtggtgaggccagtctgggcgccctttatcatccgctgttggagcgtgtgggagccagtgagtttttgggatatgtgcatgaatcagcctcggccagtgtggtggccttgattaaaaacggggctgaggtggagagtctgacggcgggggatgagggctccgtggtctgcaaccagacccccttttatggggagtccggtggccaagtgggggatcggggtgtgattcagttggccaatggtgcccgctttaccgtgaccgatacgcaaaagcccctgcccgatttgattgtacaccatggtaaaatggtcactggtacggtgcatcttggggatcatgccgagttacaggtagatggcgcaacccgtcaggcgattcgtctgcaccactcggctacccatttgatgcaccatgcgctacgggcggtgttgggggagcatgttaagcaggcgggctcgcatgtgagcgcggagcgtttacgtctcgatttttctcactttcaggggatgagtgaagaggagttgcgggcggtggaggatcgggtcaatggggcgatattgagcaatgtcagccaagagaccgccgtgatgaccccgcaagaggcggtggccgcaggggccatggcgctgtttggggagaagtatggggatgaggtgcgggtggtccgtattggcgacagcatggaactctgtgggggtacccacgtaagccgcagtggggatatgggtatctttcatatcctctctgagagcgctgtggctgccggtgtacgccgtttagaggcggtgtgtgggggacgtgcccgagccatcttccgtggcgaccaagaggcgctcaaggccgcggctgcgctcttgaagacacaaccgaataaactggctgagggtattgagcgtcttttgggcaagcagaaagagttggagaagagtttagagaagctgcaatcggcgcaggcggggggcatggtagaggcgttgttggagcaggctgtcgaggttggcggtattaaactgctggcggtagaggttaagggggttgatggcaaggcgctacgggagatggtggaccaagttaaggataagctgggttcaggggtgattctgttggcgttgggaggggataaggtctcgttggtcgctggtgtgaccaaggatttggcgggcaagcgggtcaaggcgggggatttgatggcctttgccgccgccatggtggggggcaagggtggaggtcgtccagacatggcgcaggggggtggtaccgaggttgcggctatccccaccatgttgaccgcgattcctggttggttacaggaacagcttggctaa

SEQ ID NO: 1015 - DNA, 2625 bp, Shewanella sp. ANA-3
atgtatcaaacgacagcagcgcttagaagtgctttcctcgaatttttccgcagcaatggtcaccaagttgtggacagtagttctcttgtaccaggcaacgatcccacgcttttattcaccaacgccggtatgaaccagttcaaggacgtgtttcttggcatggacaaacgtagctatacacgtgcgaccactgctcaacgctgcgtccgtgcgggtggtaaacacaacgatttagataacgttggttacaccgcgcgtcaccatactttcttcgaaatgctaggtaacttcagctttggtgattatttcaaagaagatgcgattcgttttggttggacattcctgactgaagtcttgaagctaccaaaggaacgtctgtgtgtgactgtttatcaaacagacgatgaagcctttgaaatttggaataaaaagattggtgttgccgctgaaaacatcattcgcatcggcgataacaagggcgcgccatacgcttcagataacttctggcaaatgggtgacacaggtccttgtggtccatgtaccgaaattttctacgatcacggcgatcatatctggggcggacgtcccggtagcccagaagaagatggcgaccgtttcatcgaaatctggaacatcgtattcatgcaatacaatcgccaagcctctggtgaaatgttgccgctgccaaaaccttccgtcgataccggtatggggattgagcgtatcgctgcgattatgcagggcgttcattcaaactacgaaatcgatattttccgcgccttgattgctaaagcggctgaaatcatcggcgtgactgacttatctaacaagtcactgcgcgttattgccgaccatatccgttcatgcgccttcttagttgccgatggtgtaatgccatcgaacgaaggtcgtggctatgtgctgcgccgtattattcgccgcgccgtgcgtcacggtaacaagttaggggcaaccgaagccttcttctacaagttagttccgacgctaatcgaagtgatgggcgatgccgctaaaggtcttgcagatactcaagtgattgttgaaaaagcccttaaagcggaagaagagcagtttgctcgtacgcttgagcgtggtttaggtattctggatagcgcattaaacgaattgcagggcgacaccttagacggtgaaactgtcttcaaactgtacgatacctatggcttcccagtggatttaaccgctgacgtatgccgtgagcgcaacattatcgtcgatgaagccggtttcgaagtggcgatggcagaacaacgtagccgtgctcaagccgcgggtaacttcggcgccgattacaacgctgctctgaaaattgatgctgaaactgcattctgtggttactcagaactcacaggcaatgccaaagtcactgcactttacctaaacggcgagtcagtttctgcaatcagtgcgggtgacgatgccgtagtcgtgctcgatgtgacgccattctatgcagaatcgggcggccaagtcggtgacaagggcgtattagtggctcaaggtattgagtttgctgttagcgatacgcaaaagtttggtcaagcttcaggtcacaaaggtacgttaacggctggcagcttaagcgttggccaagtactcgaagcaaaagtggataagaaactgcgtcaccgcacccagttaaaccactcagtgactcacttattacatgctgcgctgcgtcaagtgttaggtactcacgttactcaaaaaggttcgttagttgacccagagcgtttacgtttcgacttctctcatttcgaagcggtgaaacctgctgaattgaaacaggttgaagagttagtcaacacccaaattcgtcgtaaccatgagctgaaagtcgctgaaatggcgattgatgaagccaaagaaaaaggcgcaatggcgctctttggtgagaagtacgatgcacaagtgcgtgttgtcactatgggcgatttctctatcgagctgtgtggtggtactcacgttggccgtaccggtgacattggtctgttcaaaattacctctgaaggcggtattgctgcgggcgttcgccgtatcgaagcggtaaccggcgcagcggcgatggcctatgtggcacagcaacaagcgcaacttgaagaagcagcagcactgcttaaaggcgatactcaatctgttgtggctaagctgaaagcacaactggataaaatgaagcaacttgaaaaagacatgcagcaactgaaagataagttagctgcggcagcgagtgcggatttagccggtgatgcggttgtagttaatggcgtaaatgtgctgattaagaaacttgaaggcgttgaagcaggtgcactacgtggcctgcaagatgagttaaagcaaaaactgaaatccgccgttatcctgctcggtgtggctcaagaaggcaaagtgaaccttatcgcgggcgtgagcaatgacttagtcggtaaagtgaaggccggtgaactggttgctatggttgctgcccaggtgggtggtaaaggcggtggtcgccctgatatggcccaagcgggtggtagccagccagaaaatctggatgcggcactgtctcaagtattaccttggattactgagcgtttagcttaa

SEQ ID NO: 1016 - DNA, 2637 bp, Pelobacter propionicus DSM 2379
atgacaggcagcgagattcgcagacggtttttgacatttttcgcggagcgggggcataccatcgtgcccagctcgggcatcattcccaagaacgaccccacgctcatgttcgccaatgccggcatgaaccagttcaaggattgcttcctcggcatggaaaaacgtgactatacacgggcctgcagctcccagaaatgcgtgcgggccggcggcaagcacaacgacctggagaacgtcggccgcacggcacgccaccataccttcttcgagatgctggggaacttctcctttggggattatttcaaaaaagaggccatcgcctttgcctgggagttcctgacccgggacctgaagctggacaaaaaccgcctctacgtctccgtctacacggacgaccaggaggccgccgatatctggcaccagcaggagggggtgccgctggaacgcatcttccgcttcggcgagaaggacaacttctggtccatgggcgacaccggcccctgcggcccctgctcggagatcttctacgaccagggggaggcagccggctgcggcagtcccgactgtaccgtggggtgcgactgcgatcgctacatggagatctggaacaacgtcttcatgcagttcgaccgctcgaccgacggcgtgctgacgccgcttcccaagccgtcggtggacaccggcatggggctggagcgcatctcggcggtcatgcagggggtgaccagcaactacgacaccgatctgatccaggggatcatccgccatgtggagcggctttcgggcaagacatacgggaaggacgagcgggacgacgtctccatgcgggttatcgccgaccacgcccgggcggtgacctttctgatctgcgacggtgccctgcccagcaacgaggggcgtggctacgtgctgcgccgcatcatgcgccgcgccgcccgccatgccaagatgctggggctcgccgaccccatgctctgccacatggtggacgctgtgcgcgacatgatgggggctgcctatccggagctcgtggaacgcgaggaatacatcaaaaaggtcatcctggccgaggagcagcgtttcgccgagaccctggaccgcgggctggccatgctcaacgacgaggtggccaggatgcgcgcggccggatcgacggtcattccgggggatgtgcttttcaggctctacgacacctacggctttcccatcgaccttaccgctgacatcgtggagagcgagggattcaccatcgacgaagccgggttcgagcagtgcatggagcgccagcgggaacaggcccgcgaacactggaagggatccggtgccgaggggatcggccgggtctacaaggaactgtactcccgcggcatccgcggagaattcgtcggctatgacgggctgtcggccctgtcgccggttctggcgatcatccgtgacggcgtggaggtggagagcgcaacagcgggggagaccatcgagttggtaacggaatcgacccccttctacggcgagtcgggaggccagaaaggggattgtggttccatctccaccggcaacagccacctggaggtgagcggtgccagccgcccctacagcgacctgatcgtgcaccacgcaaccgtcagggagggcatcatcaggaagggagacggggccgacctcagggtctcgcgtcccgagcggagcgccacggcgcgcaaccacaccgccacccacctgcttcaggccgccttgcgcagggtgctgggagaacatgtcaaacaggccggttcgctggtctcccctgaccggctccgcttcgacttcatccacttcaccgccatgaccacagaggagattcgtagggtcgagacactggtcaacgggtttgtcatggacaaccagccggtcgtgatcacccagatggatatggccagcgccatcgaagccggcgccacggcgctcttcgacgagaagtacggtgataatgtgcgcgtcgtgcgggccggtgaggtgagcatggagctgtgcggcggaacccatgtgcgtgccacgggcgaaatcgggctgttcaagatcattaccgagaccggcatagccgccggcgtgcgccgtatcgaggcacaaaccggaggcggcgcgctctccttcgtgcgccagatggaggacgagcagcgggccctggccggcttgctgaaggccgaggggggcaacctgcctgagcgactggagaagctcctggcccgccagagggagatgcagcgcgagatcgagtcgctgcagggtaagctcaacgcggcagcctcgggagacctgctctccggtgtggaggaggttggcggcatcaaactgctggcggccgaggtgcgggtggaggatgtgaaggcgctgcgcgacctctccgacaccctcaaggagcgcatcggccagggggtgatcgtgctgggggcggcaatcggcggcaaggccaacctgctggtggcggtgaccagggaactgagcggaaccgtcaaggccggcgatctggtgaagaagctggcccccctggtgggggggagcggcggcggaaaaccggaactggcccaggcgggcggttcccgtccggaaaacctggccgaggccctggctgccgcgagacaggtgctggctgagcagtag

SEQ ID NO: 1017 - DNA, 2703 bp, Shewanella amazonensis SB2B
atgagccccaaatttttgtcggcagcccgtggacgtggctgcggcttgtcgtatcaggcttatccaactcaggacgttttcatgtatcaaaccacagccgcgcttcgcagtgcttttctcgagtatttcaggcagcagggtcaccaggtagtagacagcagctctctggttcccggtaatgatccaacactgctgttcaccaacgccggtatgaaccagttcaaagactgtttcctcggtatggagaagcgcagctacgtacgcgccgcgaccgcgcagcgatgcgtacgtgccggtggcaagcacaacgacctggacaacgtgggttacaccgcccgtcaccacaccttcttcgaaatgttgggtaacttcagctttggtgattacttcaaagaagacgccattcgttttgcctgggaattcctcaccggcaccctgaaactgccgaaagagaagctgtgcgttaccgtgtaccacactgatgacgaagcattcgatatttggaacaagcaaatcggtgttcctgctgaaaacattatccgcatcggagataacaagggtgcaccattcgcatcggacaacttctggcagatgggcgataccggtccttgcggaccttgtaccgaaattttctacgatcacggcgagcacatttggggtggccgcccaggcagtccagaagaagacggtgaccgctttatcgagatctggaatatcgtatttatgcagtacaaccgtcagtccgatggtacgctggacccgctgcccaagcccgcggtggatacaggtatgggtatcgagcgtatctctgccatcatgcagggtgttcactctaactacgaaattgatattttccagaaactgatcgccaaagctgccgaaatcatcggtgtgagcgatctggaaaataaatcccttcgcgttattgccgaccacatccgctcctgtgccttcctggttgccgatggcgtgatgccatccaatgaaggtcgcggctatgtgctgcgccgtattatccgccgtgcagtgcgccacggaaacaaactgggcgccaccgacaccttcttctacaaactggtgcctactctgatagaggctatgggggatgctgccaaggaactcaaggctacccagaccatagtggaaaaggcgctcaaagctgaagaagagcagttcgcccgcactctggagcgtgggcttggcatgcttgacgctgcgctggcagacctcaagggtgacactctggacggtgaaaccgtctttaaactttatgatacctacggcttccctgtggatttgaccgctgacgtgtgccgcgagcgtaacctcaaggtagacgaagaaggctttaacgccgccatggccgagcagcgcagccgcgcccaggcggctggtcagttcagtgccgactataacgctgcgttgaaaatcgatactgccaccgatttttgtggttacaccgagcttgcagccgagagtaaggtcgttgcgctttaccgtgatggcgaatccgtcgatgctgcagaggcgggcgccgttctggttgtcgtgctggataacaccccattctatgccgagtccggtggtcaggttggtgacaaaggtcagctgctcgctgaaggcgttgaattcaacgttgccgatacccagaagttcggccaaggcattggtcacaagggacaactggcgcttggcagcatcaaggttggtgacagcctcaaagccatggtggataagaagctgcgtcatcgcacagagcttaaccactcagtgacgcacctgctgcacgcagcgctgcgtcaggtgctgggtacccacgtgacccagaaaggatctttggttgaccctgagcgtctgcgttttgacttctcccacttcgaaggtgttaagcgtgaagagctcaaagcggttgaagatctggttaacacccaaatccgtcgtaaccacgaactgaatttcgccgagatggatatcgaagaggccaaggcaaaaggcgccatggcactctttggtgagaagtacgattccaaggtacgcgttgtgactatgggcgacttctctatcgagctgtgtggtggtacccacgttggccgtaccggtgatattggtctgtttaagatcacttctgaaggcggtatcgcggcgggaattcgccgtatcgaagctgtgactggtgccgctgccatggcttatgttgcccagcagcaggccgagcttgaagaagccgccgcactgctcaagggcgatgtagcctcagtggttgccaagctcaaagcccagctcgacaaggcccgtcagcttgagaaagagaatgcccagcttaaagacaagctggccgccgctgccagtgccgaccttgccggtgacgcccaggaaatcaacggcgttaaggtattggttaagcgccttgaaggcgtggaagccggtgctctgcgcggtttgcaggacgaactcaagcagaagctgaagtccggggttgtgttactcgccattggcagtggtgacaaggtgaacctgattgccggtgtgactcaggatctgaccggcaaagtgaaggccggtgaactggttgccatggtggctgcgcaggtgggcggtaagggcggtggtcgcccggatatggctcaggctggtggcagtgaacctgccaagctcgacggtgccctggccagtgttgtgccttggcttaatgagcgtctgtaa

SEQ ID NO: 1018 - DNA, 2592 bp, Halorhodospira halophila SL1
atgacatcggcgcagttgcgcgccgccttcctggacttcttcagggagcgggggcacgaggtcgtgccgagttcgccgttggtgccggccaacgacccgacgctgctctttaccaacgccgggatggtcccgttcaaagaggtcttcctggggcgggagcagcgcggctaccagcgggccaccagtagccagcgctgcgtgcgcgccggcggtaagcacaacgacctggagaacgtcggctacacggcccggcaccacaccttcttcgagatgctgggcaacttctctttcggcgactacttcaagcgggatgccatccgctacgcctggtcgttcttgaccgaggtggtggagcttccgcccgaacggctctgggtgacggtctacgaggatgacgacgaggccgcgcagatctggctggaagagattggcgtggatccggcgcggttccgccggatcggtgcccacgacaatttctggtccatgggggataccgggccgtgcgggccgtgctcggaggtcttctacgaccacggtcccgaggtgccgggcgggccgccgggttccgatgaagaggatggtgaccggtacatcgaggtctggaacctggtgttcatgcagtacgaccgcgatgccgagggcaacctgaacccgctgccgagtccttccatcgacaccgggatgggcctggagcgcctggccgcggtcctgcagggcgtccacgacaatttcgagacggacctgttcaccccgctgatcgatgccgccggcgagatcgccggggtcagcgatcggcgcaagccctcgctcaaggtagttgccgaccatatccgcgcttgttcgttcctgatcgttgatggggtgttgccctcgacggaggggcgcgggtacgtgttgcgccggatcatccggcgggcggtacgccacggatatcagttgggcatcgatgagccgttcttctaccgcctggtcgatccgctcgatgcggtcatgggcgaggcattcccggagctgcgtgaccgccgtgaattcgtcgaaaagatcctcttccaggaggagaagcggttccgcgagacgctggaagacggactcgcgctgcttgacgagtacctcggcgggaacgacagcggggtgatcgatggcgaggtggtgttcaagctctacgatacccatggcttcccggtggacctgaccgcggatatcgcccgcgagcgcaaccttgaggtggactatcagggcttcgaggcgcgcatggccgagcaacgggagcgcgcgcgcgcggctagccggtttggcggggcgcgtgaggaagtggttgacgcgggcgagagccgcttcaccggctacgagaccctcgaggatgtcggctcggtgatcgggctgtatcaggacggccgctcggtacagcggttgcagcccggcgaagaggggatggtggtcctcgaccggactccgttctacgccgagtcgggtggtcaggtgggcgatcgcggcgaaatcctcgccaacggtctacgcttccgggtagcggacaccgtgaagcagggcgaggcccatggtcacctggggcgtctggaatcgggcgagctgggtgtcggcgatcaggttaccgcgcgggtggatcgtggcacccgcgaggcaacggtccgcaaccactccgccacgcacctgctgcacgccgcgctgcgcgagatcctgggggatcatgttcagcagaagggatccctggtggcgccggatcgcctgcgtttcgacttctcccactacgaggcgccgtcgcgggaagacctggaacggatcgaggcgcgcgtgaatcaggagatcctcaccaatcaccccgtcgaggcggcgcacatggcctacgaagaagcagtccaggtcggagctatggcgttgttcggcgagaagtacggggatacggtgcgggtgatctccctgggggactattcccaggagctctgtggtggcacccacgccgcccggactggggacatcgggttgttcaaaatcatcgacgagacgggtgtggccggcggcgtgcggcgcatcgaagcgatcactggtgagcgggccatcggctgggtccaagaggcggaagggcggttgaatcggttggcagatctcctgcgtgtcgggccggacaacctggtgatgaaggtcgagcagctcagcgagcgcacccgcgagcaggagaaagagattgagcgcctcaagcagaagctcgctacgcaggccgggcgttcgctgttggatgatgccggtgaggttgccggtgtccgcttcttggccacctgcgttgaagggggtggcaaggggttgcgggataccctggatcagctcaagaaccaactcggcagtggcgtgatcgtgctggcggcggttcagggcgaaaaggtccagctggtagcgggtgtaaccaaggatctgaccgatcgattggccgccggcgatctggtcaatcatgtcgccgcccaggttggggggcgcggcggagggcgggcggacttcgcccaggcagggggtaaagacccaagccacgtcaatgatgcgttggcttcagtcgaagcttggattaaggataacttgacttaa

SEQ ID NO: 1019 - DNA, 2625 bp, Shewanella baltica OS155
atgtatcaaactacagcagagcttagaagcgctttcctcgaatttttccgcagcaatggtcatcaagttgtggacagtagttcattagtgccaggcaacgatcccacacttttatttaccaatgcaggcatgaaccagttcaaggacgtgtttcttggcatggacaaacgcaattatacgcgtgcgaccactgctcaacgttgtgtacgcgccggtggtaagcataacgatttagataacgtcggttatacagcacgtcatcacacctttttcgaaatgctgggtaacttcagttttggtgattatttcaaagaagaagcgattcgctttggctggactttcttaactgaaactttaaagctgccgaaagaacgtctgtgtgtcactatttatcaaacagatgatgaagcctttgaaatctggaataaaaagattggtgttgctgccgagaacattatccgtatcggcgacaacaaaggtgctgcttatgcgtcagataacttctggcaaatgggtgataccggtccttgcggcccatgttctgagattttctatgaccatggcgatcacatttggggcggccgtcctggcagtcctgaagaagatggcgaccgtttcatcgaaatctggaacatagtgttcatgcagtacaaccgtcaagcatcgggtgaaatgttgcctttgcctaagccatcggttgataccggcatggggattgagcgtattgccgcgattatgcaaggcgtacattctaactacgaaatcgacatattccgtacgttgatcgctaaagcggcagaaatcatcggcgtaagcgatttaaccgagaagtcactgcgcgtcattgccgaccatatccgttcatgtgcattccttattgccgatggtgttatgccgtcgaacgaaggccgcggttatgtgctgcgccgcattattcgtcgcgccgttcgccatggtaacaagttaggcgcgaccgaagctttcttctataagctggttccgtctttgattgcggtgatgggcgatgcggccaaagggttagctgagactcaagcgattgttgaaaaagcactgaaagcggaagaagagcaatttgcccggacgcttgaacgtggtttaggcattttagatacggccttaaacgagttaaaaggtactaccttagacggtgaaacggtatttaagctgtatgacacctatggcttcccaatggatttaactgctgacgtgtgtcgtgagcgcaacattattgtcgatgaagcaggtttcgaagtcgccatggctgaacaacgtagccgcgcacaagctgccggtaactttggtgcagattataacgcggcgctgaaaattgatgccgaaaccgcattcagtggttacaccgaattagcgggccaagctaagatcactgcgatttatcaaaacggtgagtcagtgacggcgatcaaagcgggtgacgaagcggttgttgtactcgacgtgacacctttctacgcggaatctggcggtcaagtgggcgataaaggccaactggttgcgagcggtgttgagtttacggttaacgacacacaaaagtacggtcaagcaacgggccatcaaggtgttttagctacaggtaacttgagtgttggccaagttgttgaagcaaaagtcgacaaaaaactgcgtcaccgtactcagttaaaccattctgttacgcatttactgcatgccgcactgcgtcaagtgctcggtactcacgtttcgcaaaaaggttctttggttgatcctgagcgtttgcgttttgacttctcccatttcgaaggtgtaaaagccgcggaattaaaagaagttgaagaattagttaacactcaaattcgtcgtaaccatgagctgaaaaccgctgaaatgggtatagacgaagccaaagagaaaggcgcaatggcgctctttggtgagaaatatgactcacaagtgcgtgttgtgactatgggcgatttctctatcgaattgtgtggtggtacccatgtgggccgcacgggcgatattggcttattcaaaatcacctctgaagcgggtattgctgcgggtgttcgtcgtatcgaagccgttactggcgctgcggctatggcctatgtggcgcagcaacaagctgaactggaagaagctgcagccttattgaaaggcgatgccaactcagttgtcgctaagttaaaagcccagctcgataagatgaagcaactcgaaaaagaaatggcgcagttgaaagataaactcgcggctgcagccagtgctgatttagtgggcgatgccgttgtggttaatggcgttaacgtactgatcaaaaagttagacggcgttgaggcaagctcattacgcggtctacaagatgaattaaaacaaaaattgaaatcggccattatcgttcttggcaccgcgcaggaagggaaagttaacctgatcgctggtgtgagtaacgatctgatcggcaaagtcaaagcgggtgagctagtcgctatggtcgctgcgcaagtgggcggtaaaggcggcggtcgtcctgatatggctcaagcgggcggtagccagccagaaaatctggatgcggcattggctcaagtattaccttggattactgagcgtctagcttaa

SEQ ID NO: 1020 - DNA, 2625 bp, Shewanella loihica PV-4
atgtatcaaaccactgcagcgctgagaagtgctttcttggagtttttccgcagaaacggtcaccaggttgtggacagcagttcactggtacctggcaatgatcccaccttgctatttaccaacgcagggatgaaccaatttaaagatgttttccttggggaagacaagcgcgactacagccgcgccactacggcacaacgctgcgtgcgcgccggtggtaagcacaacgacctggataatgtcggttacaccgcacgtcatcacaccttcttcgaaatgctgggtaacttcagcttcggtgattatttcaagcaagatgcgattcgcttcgcctggaccttcctgaccgaagaactcaagctgccaaaagagcgcctgtgtgtcaccgtctatgagacagacgatgaagccttcgagatctggaacaaagagattggcgtcgcggccgagaacattatccgcatcggcgataacaagggggcggcatacgcctcagataacttctggcagatgggcgataccggtccttgtggcccttgtaccgagatcttctacgatcacggcgagcacatctggggcggccgtcccggcacgccggaagaagatggtgaccgcttcatcgagatctggaacatagtcttcatgcagtataaccgtcaagccgacggcaccatggatccactgcctaagccttctgtcgataccggtatgggcatcgagcgtatcgccgctatcatgcagggtgtgcactcaaactatgagatcgatatcttccagtcactgatcaagaagaccgccgagatcctgggcgtgaccgatctggagaacaagtcgctgcgcgtagtcgccgaccatatccgttcttgcgccttcttggtggccgatggtgtgatgccatcaaacgagggccgtggttacgtattgcgccgcatcatccgccgcgccgtgcgtcatggtaataagctaggtgctaccgaggccttcttctacaagctggttcctacactgattgaagtgatgggcgatgcggctaaagagctggtggcgacccaggcgatcgtcgaaaaggcgcttaaggcggaagaggagcagtttgcccgtactctggagcgtggtcttggtattctcgataatgccctgagccagctagagggtaaggagcttgacggtgagaccgcctttaagctgtacgacacctatggcttcccggttgatctgacggctgacgtctgccgagagcgtgatatcacggtcgatgaagccggcttcgaagcggccatggccgagcagcgcagccgcgcccaggcggcgggtcagttcgataccgattacaacgatagcctgaagatcgacgccgaaaccgagttttgcggttatagcgaccttaatggcgaagccaaggtcatcggcctctatgtcgatggtcaggcggtcgacgcgctagccgaaggcgaccaaggtgtggtggtgctcgatagcacgcctttctacggcgaatctggtggccaatgtggcgacaagggcctgctgagcgcagaaggtgtcgagttcgaggtgaaggacacgcaaaaatatggtcaggcaatgggccatatcggcctggtcaaggccggcagtatcgctatgggtcaaacccttaacgcggcagtggataagaagctcagacatcgcaccgagctgaaccactctgtgactcacttgctacacgccgcgctgcgtcaggtgctgggtactcacgtgagccagaagggttctctggttgagcctgagcgtctgcgtttcgacttctctcacttcgaggcagttaagcgtgaagagcttaagcaggtcgaagatctggttaacactcagatccgtcgtaaccacgagctgaaggccgaggtgatggatatcgaccaggcgaaagagaaaggcgccatggctttgtttggtgagaaatatgactcacaggttcgcgtggtgaccatgggtgacttctctatcgagctgtgtggtggtactcacgtaggccgcacaggcgatatcggtctgtttaagatcacctctgaaggcggtatcgcagccggcatccgtcgtatcgaggcggtcacaggtgcggcagcaatcgcctatgtgggtgagcagcaggcgcagcttgaacaagccgcctcgctacttaaaggcgacagcgcctcggtagtggctaagctcaaagcccagctggataagactaagcagcttgagaaagagctgtctcagcttaaagacaagctcgcggctgcgaccagcgctgatctggccggggaggctcaggagcttgctggcgttaaggtactggttaagctgctcgaaggtgtcgaggccggcgcgctgcgtggcctgcaggatgagcttaagcagaagctgcaatctggcattgtggtgcttggcatcgcaggggacgccaaggtgaacctgattgccggcgtcaccaaagacttgaccggtaaggtcaaggccggtgagctagtggctatggtggctgctcaggtgggcggtaagggcggtggacgcccagacatggcccaggccggtggcagcgagcccgagaagttagcaggtgccctggattctgttatcccttggttgtcagaacgtttggcctaa

SEQ ID NO: 1021 - DNA, 2628 bp, Enterobacter sp. 638
atgagcaagagcaccgctgagatccgtcaggcgtttctcgattttttccatagtaagggacaccaggtagttgccagcagctccctggtaccgaacaatgacccgactctgctgtttaccaacgccgggatgaaccagttcaaggatgtattccttggtctcgataagcgtaattattcccgtgcgacaacctcacagcgttgcgtacgtgcgggcggtaaacataacgatctggaaaacgtcggctacaccgcacgtcaccacactttcttcgagatgctgggtaacttcagcttcggcgactatttcaaacacgacgctatccaatacgcatgggaattgctgaccggtgaaaactggttcaacctgccgaaagagcgtctgtgggttaccgtttatgaaaccgacgacgaagcttacgaaatctgggagaaagaagtcggcatcccgcgtgagcgtattattcgtatcggtgataacaaaggcgcgccctacgcgtcagataatttctggcagatgggtgataccggtccttgcggtccgtgcaccgagatcttctacgatcacggcgaccacatctggggtggacccccaggaacagcagaagaagacggcgatcgctatattgagatctggaatatcgtcttcatgcagttcaaccgtcagattgacggcacgatggagccactgccaaaaccgtccgttgatacgggtatgggtctggaacgtattgccgctgttctgcaacacgttaactccaactacgatatcgatctgttcagcacgctgattaagtctgttgctgaagtgaccggcgctaccgatctgagcaataaatctctgcgcgttatcgcagaccacattcgttcttgtgcgttcctgattgctgatggcgtgattccgtcgaatgaaaaccgtggttatgtgctgcgtcgtatcattcgtcgtgctgttcgtcatggcaacatgctgggcgcgaaagacaccttcttctataaactcgtgggtccactggttggtgtcatgggcgatgcaggcgaagagctgaaacgtcagcaatcgcaagttgagcaggtcctgaaaacagaagaagaacagttcgctcgcaccctggagcgcggtctggcgctgctggacgaagaactttctcagttgactggcgatacgctggatggcgaaaccgcattccgtctgtacgacacctatggcttcccggttgacctgacggctgacgtttgccgcgagcgcaacatcaaggtggacgaagcgggctttgaagctgcgatggaagaacagcgccgtcgtgcgcgtgaatccagtggttttggtgcggattacaatgcgatgatccgtgtggacagcgcatctgaattccagggttacgatcgcctggaattaaacgcgaaagtcaccgccctgtttgtcgacggcaaagccgtagacagcattagcgcaggccaggatgcggttgtcgttctcgacaaaaccccattctatgcggaatccggtggtcaggtcggcgataaaggcgaactgaaagggaacggctttagcttcgctgtcagcgacacccagaaatacggtcaggcaattggtcatatcggcaaacttgcttccggttctctgaaagtcggtgagggcgttcaggcagaagtcgacgaagcacgtcgcgaacgtattcgtctgaatcactctgcaacgcacctgatgcacgctgcactgcgtgacgttctgggaacgcatgttgcgcagaaagggtctctggtcaacgacaaaatcctgcgtttcgacttctctcattttgaagcgatgaaaccgtctgaaatccgtgcggttgaagatatggttaacgcgcagatccgtcgtaacctgcctatcgaaaccaacatcatggatctcgaggcggccagagccaaaggcgcaatggcgctgtttggcgagaaatatgatgagcgcgttcgcgtgctgagcatgggtgatttctctaccgaactctgcggcggaactcacgcttcccgtaccggtgatatcggcctgttccgtatcctatccgaatcgggtacagcggcgggtgtgcgtcgtatcgaagcggtaacaggtgaaggcgcgatcgccagcctgcatgctgaaagcgatcagttgcacgatattgctcaactgttgaaaggtgacagccacaacctgggtgagaaagtgcgtagcgcgctggaacgcagtcgccagctcgaaaaagaactgcagcagctcaaagagcaagcagccgttcaggaaagcgcgaatctctctagcaaagcggttgatattaaaggtgttaaactgctggtcagtgaactggcaggtgttgaacctaagatgcttcgtaccatggttgatgatctgaagaaccagctcggttcgacaattatcgttctggcgacagcggtcgacggtaaggtttctctgattgcgggcgtctctaaggatgtgaccgaccgtgtgaaagcaggggaattgattggtatggtcgctcagcaggtcggcggcaaaggtggcggtcgtccggacatggcgcaagccggtggtacggatgcagcggcacttccagcggcattggccagcgttgaaagctgggtaagcgctaaactgtaa

SEQ ID NO: 1022 - DNA, 2679 bp, Shewanella putrefaciens CN-32
atgcggctgccctatggtgtagctggtaatgcttatccaattcaggacgatttcatgtatcaaactacagcagagcttagaagtgctttcctcgaatttttccgcagccacggtcatcaggttgtggacagtagttcattagtgccaggcaacgatccaactcttttatttaccaatgcgggcatgaaccaatttaaggacgtgtttcttggcatggataaacgcaattacacgcgtgcgaccactgctcaacgttgtgtacgcgctggcggtaaacataatgatttagataatgtgggatataccgcccgtcaccatactttcttcgaaatgttaggtaacttcagctttggggattatttcaaagaagaagcgatttgttttggttggtcatttttaactgaaaccttaaagctgccgaaagaacgtctgtgcgtcactatctaccaaactgacgatgaagcctttgaaatttggaataaaaagattggtgtggccgctgaaaatatcattcgtatcggtgataacaagggcgcaccttacgcttcagataacttctggcaaatgggtgacactggtccttgtggtccttgtaccgagattttctatgaccatggtgatcatatttggggtggacgtcctggtagcccagaagaagatggcgatcgtttcatcgaaatttggaatattgtattcatgcaatacaatcgccacatttcaggcgaaatgttgccgctaccaaaaccttctgtcgatacaggtatggggatcgaacgtattgctgcgattatgcaaggcgtacattctaactatgaaatcgatatcttccgtgctcttattgccaaagccgcagaaattatcggcgtgactgatttatccaataaatcactacgcgttattgctgaccatattcgctcatgtgcatttttagtggccgatggtgtaatgccatctaacgaaggccgtggctatgtgctgcgccgtattatccgccgcgccgtgcgtcatggtaataagttaggtgcgaccgaagcctttttctacaaattagttccgacgctgattgatgtgatgggggatgcagccaaggggctcgctgaaactcaagttattgttgaaaaagcacttaaagcggaggaggagcagtttgctcgtactttagagcgtggtttaggtattttagacgcagccttaagcgaattaaccggtgacactttagacggtgaaaccgtattcaaactctatgatacctacggttttccaatggatttaaccgcagacgtttgtcgtgagcgtaatattattgtcgatgaggcaggttttgaagcggcaatggctgagcaacgtagccgcgcccaagcagcgggtaactttggtgccgattacaatgcggcattgaaaattgacgccgaaacagcattctgcggttacaccgaacttgtgggtcaagcaaaagtcaccgcgatttatcaaaacggcgagtcagtgacggctattaaagcgggtgatgaagcggttcttgtgctagacgtgacacctttctatgctgaatcgggcggtcaagtgggcgataaaggccaattggttgcgaatggtattgaatttacggtaaacgatacgcaaaagtatggtcaagcaacaggccatcaaggtgtcttagtcgcagggagcttgagtattggccaaatggttgaggctaaggttgataaaaaattacgtcaccgtactcagttaaaccattctgttacgcatttattacatgccgcactgcgccaagtgcttggtacgcatgtcacgcaaaaagggtcgctggttgatcctgagcgtttacgtttcgatttctctcatttcgaagcagtcaaacctgcggaactaaagaaagtcgaagaattagtgaatacccaaattcgccgtaaccacgagctgaaagtcgctgaaatggcgattgatgaagctaaagaaaaaggtgctatggcactctttggtgagaagtacgatgcacaggttcgtgttgtcactatgggcgatttctctatcgaattgtgtggtggtacccacgttggccgtaccggtgacattggtctgttcaaaattacctctgaaggcggtattgctgcgggcgttcgccgtattgaagcggtaaccggtgctgcagctatggcttatgtggcgcagcaacaggctgagctggaagaggcggctgccttgttaaaaggcgatactcattcagtggttgctaagttaaaagcacaactcgataaaatgaaacaacttgaaaaagacatggcgcagctaaaagataaattagcggcggctgcgagtgctgacttagtgggcgatgctgtggttgttaatggcgtgaatgtacttatcaaaaaactagatggcgttgaggctggttcacttcgcggtttacaagatgaattaaagcaaaaactaaaatctgccattattgtgttgggtacggctcaagaaggcaaagtgaatctgattgctggcgtgagtaacgacttagttggcaaagtcaaagcgggtgagctagtcgctatggtcgctgcacaagtgggcggcaagggcggtggtcgtccagatatggcgcaagcgggtggtagccaaccagaaaatctggatgcggccttagctcaagtattaccttggattactgagcgtttagcttaa

SEQ ID NO: 1023 - DNA, 2583 bp, Vibrio cholerae O395
atgtttatgagcacggatgaggtgcgccgcgcgttcctctcattctttgaaagcaaaggtcaccaaattgtagaaagttcttctctggtgcctgctaacgatccgaccctgctgtttaccaacgcagggatgaaccaatttaaagactgtttcttgggcttggaaaagcgcgcctacactcgcgccacgaccgctcaacgttgtgtccgcgcgggcggtaagcacaacgacctagaaaacgtcggtttcaccgcacgtcaccacactttcttcgaaatgctgggtaacttcagtttcggtgactatttcaaagaagatgcgatccagtatgcatgggagtttctgactgacgttctgcaactgccgaaagagcgcttgcttgtgacggtttatgaaaccgatgatgaagcctttgatatttggaataaaaaagtcggcattcctgctgatcgcattattcgtatcggcgataaaaaaggcggcaagaagttcgattcggataacttctggcagatgggtgacactggtccttgcggtccatgtactgaaatcttctacgaccacggtgaccacatttggggtggacctccaggctcacctgaggaagatggcgatcgttttatcgaaatctggaacaacgttttcatgcagttcaaccgtcatgcggatggcacgatggagccgctacctaagccgtctgtggacacgggcatgggtattgagcgtatttccgcgatcatgcaaggcgtgcactccaactacgaaatcgacgtattccaaacgctgatcaaagcagccgcagacgcaattggttaccaagatctgactaatcagtctctgcgcgttgtcgcggatcacatccgttcatgtgcctttttgattgtggatggcgtgatgccgtctaacgaaggtcgtggttatgtactgcgtcgtatcattcgtcgtgccgttcgtcatggcaataagctcggtgcgcaaggtgcattcttccacaagttggtgggaccattggcggaagtgatgggtactgcaggcgttgagctgaaaaagcagcaagctctggttgaaaaagtgctacgtatcgaagaagaaaactttggacgtacgctggatcgcggcatgagcattctgaatgacgcgctggatcaactatcaggccaagtgctggatggtgaaaccgtcttcaaactctacgacacctacggcttccctgcggatttaaccaatgatgtggcgcgtgagcgtggctttagcattgatgaagcgggttttgaacaagcgatggaagagcagcgtcaacgcgctcgtgaggccggccaatttggtacggactataattcgctgatcaaatccgccaccaataccgaattctgcggttacacggcgagtcgtggccaaagtgtggtacgcgaaatgttcgtggagggcgcggaagtttctacgctgtcagccggtgataaagccatcatcgtactagacaacacgccattctacgcagaatcaggtggtcaatgcggcgatactggcgttttgaaaaccgacgcaggtattttccatgttgaagatactcaaaaattaggtaacgcgattgcgcatcacggtgtgctcgcccaaggcgtattggcgacaggcgatcaggtggatgccatcgtcgatgaaaagcgccgtgcggcaatttcgctgaaccactcggcgactcacttgttgcatgctgcactacgtaaagtgctgggtgaacacgtggcgcagaaaggctctctagtgcgtgctgaaacactgcgttttgacttctcacatctggaagcgatgaccgctgcagagattaaagaagtagaacgtttagtgaaccaagaagttcgtcgtaaccacagtatcgaaaccaacatcatgaatattgatgaagcgaaagcgaaaggtgcgatggcgctgtttggtgagaaatatgatgaccaagtgcgcgtgctgtcgatgggcgacttctcaactgagctgtgtggtggtatccacgcgagcaacacgggtgatattggtctgtttaagatcatctctgaaggtggtattgctgcgggtattcgccgtattgaagcggtgactggtgaaggcgcattagattacctcgacgcacagcaagcacagcatgatgccaaagtgtctgaaatggcggcaaaagccaaactgctggagaaagagatccaacagttgaaagataagctggcggcgaaagagagcgcgggtcttatcaaccaagttaagcagatcgcgggtgttaacgtactggttgcgcagctcaacggtgcagacaacaaagcgctacgtggcatggtagatgatctcaaaaaccaattaagcagcggcatcatcatgctgggtaatgtggctgaaggcaaagttggcctaattgcgggcgtaaccaacgatttgactaataaagtcaaagcgggtgagctggtcaacatggtcgcactacaagtcggtggtaagggtggtggccgccctgacatggctcaagctggagggacagatgctcacgctctgccatcggccttagagtctgtcgacgcttggattgccgagcgtctataa

SEQ ID NO: 1024 - DNA, 2631 bp, Geobacter uraniumreducens Rf4
atgacaggcaaagaaatcagggcgcaatttttcaaatttttcgaggaaagagggcatacggttgttgaaagttccaatctcatccccaggaatgaccccaccctcctctttaccaatgcggggatgaaccagttcaaggatgtcttcctcggcctggaaaaacgcgattacgtgcgtgcctgcagttcgcagaaatgcgtgcgggccggcggcaagcacaacgacttggagaatgtggggcgcacagcccgccaccatacatttttcgaaatgctcggcaacttttccttcggcgattacttcaagaaggaagcgattgcctttgcctgggagtttctgaccaaggagctgaagctggacaaggaccgcctctacgtgactgtctatacggacgatgatgaggcggccgatatctggaacaggcaggaaggggtgccgctggagcggatctaccgtttcggcgagaaagacaatttctggtccatgggggataccggcccctgcggcccctgcacggaaattttctgggacaacggcccgggcaccggctgcggcagtccgacctgcgaggtggggtgcgactgcgaccgctacatggagatctggaacaacgtcttcatgcagttcaatcgggatgcgcagggcaatctgacgccgctccccaagccctcggtcgataccggcatggggctggagcggatctcgacggtcatgcagggggtgacctccaattacgataccgaccttttgcaggggatcatcaagcacgtggaaaagctttccggcaagcgttaccgtcaggacgaacgggacgatgtctccatgagggtaatcgccgatcactccagggctatcaccttcctcatctgcgacggcatccttcccagtaacgaggggcggggctacgtgctgcgccggatcatgcgccgggctgcacgccatgccaagatgctcggctttgccgagccggccctctaccggatcgtcgatgccgtcaataccatgatgggggatgcctatcctgaactccttgagcgggaggagtacataaagaaggtcatccatgcggaggaagaacggttcatcgagacgctggacagggggcttgccatccttaacgaagaggtggctgcgctgaagaaagagggcaagagcgtcgttccgggcgaggtgattttcaagctttacgacacctacggttttccggtggacctcaccgccgacatcgtcgaaaacgagggattcaccattgacgaggacggcttcgccctctgcatggaaaggcagcgcctccaggcgcgggagaactggaagggctccggtgaggaggggctggcagagatttacaaaaccctccatggcagggggatcagaagcgcgttcgtcggctacagtgaacagaccgcttattccgccattaccgccattctccgcgaaggcgcagaggtagcggaggcagttgcgggcgaaatggtggaggtcgtcgtcgataccacccccttttacggcgcgtcgggcggccaggcgggcgacacgggggtcatctccaccggcagtgcccatctccgggtggtagccaccagcaagccgttccccgatctgaccgtccaccgggcgctcgtcaccgaagggacggtcaaggctggcgatgcggccgatctccgggtggccacggaggtccggggggccacggcccgcaaccacaccgccacccatctgttgcagtccgcactccgtcaggtgctgggtgagcatgtgaagcaggcggggtcgctggtgacggccgagcggctccgtttcgacttcacccatttctccgccatgacggtcgaggagctgcgccgggtggaaaacatcgtcaacacctatgtcatggacaatgccgatgtgaaatcgctggagatggccgcgacagaagccatgcagagcggcgcgacggcgctgttcggcgagaagtacggcgaccgggtaagggtggtcaaggtcggcgaggtgagcagcgagctgtgcggcgggacccatgtgcgggccgccggggacatcggtttcttcaagatcgtcggcgaggcggggatcgccgccggggtgcggcgcatagaggcgctgaccggcagcggggccttggaatacgtgcagcagctggaggatgagcagcggagcatcgccgtcctggtaaaggccgaaggcgggaccgcccttgacaaggtcgaccggttgttggcgcggcagaaagagttgcagcgtgaagtggaggcgctccaggcacgattgaacgcctcgcgctccgcagacctcctggcgggggccagggagacgaacggaataaaggtccttgccgccaaggtcgagatggatgatccgaagggtttgcgtgagctggccgacagcctgaaggaccgcctgcaatccggggtgatcgtcataggttgcgtctctgccggcaaggccaacctgctggtggcggtgacgaaagacctcagcgaccgcttaagagcgggggatatcatcaagtcgctggcgcccataatcggcggcagcggcggcggcaagccggaactggcccaggccggcggaaccaagccggaaaatctggacgaagcgctggaagcggcgtataaaatcatcggctga

SEQ ID NO: 1025 - DNA, 2625 bp, Shewanella baltica OS185
atgtatcaaactacagcagagcttagaagcgctttcctcgaatttttccgcagcaatggtcatcaagttgtggacagtagttcattagtgccaggcaacgatcccacacttttatttaccaatgcaggcatgaaccagttcaaggacgtgtttcttggcatggacaaacgcaattatacgcgtgcgaccactgctcaacgttgtgtacgcgccggtggtaagcataacgatttagataacgtcggttatacagcacgtcatcacacctttttcgaaatgctaggtaacttcagttttggtgattatttcaaggaagaagcgattcgttttggctggacattcttaactgaaacgttaaagctgccgaaagaacgtctgtgcgtcactatttatcaaacagacgatgaagcctttgaaatttggaataaaaagattggtgttgccgccgagaatattatccgtatcggcgataataaaggtgcagcttatgcgtcagataacttctggcaaatgggtgatactggtccttgtggcccttgtactgaaattttctatgaccatggcgatcacatttggggtggccgtcctggcagtcctgaagaagatggcgaccgtttcatcgaaatctggaacatcgttttcatgcagtacaaccgtcaagcatcaggtgaaatgctgcctttgcctaagccatcggtagatactggcatggggattgagcgtatcgccgcgattatgcaaggcgtacattctaactacgaaatcgatatattccgtactttgatcgctaaagcggcagaaatcatcggcgtaagcgatttaaccgagaagtcactgcgcgtcattgccgaccatatccgttcatgtgcattccttattgccgatggcgttatgccgtcgaacgaaggccgcggttatgtgctgcgccgcattatccgccgcgcagttcgccatggtaacaagttgggcgcgaccgaagctttcttctataagttggttccatctttgattgcggtgatgggcgatgcggctaaagggttagctgagacgcaagtcattgttgaaaaagcgctgaaagcggaagaggagcaatttgcccgtacgcttgaacgtggtttaggtattttagatacggccttaaacgagctgaaaggtgacaccttagacggcgaaaccgtatttaagctgtatgacacctatggcttcccaatggatttgaccgctgacgtctgccgtgagcgcaacatcattgtcgatgaagcaggtttcgaagtcgccatggctgagcaacgtagccgcgcccaagctgctggtaactttggtgcagattacaacgcagcgctgaaaatcgatgctgaaaccgcattcactggttacaccgaattagcgggccaagctaaggtcaccgcgatttatctaaacggtgagtcagtgacggctatcaaggcgggtgacgaagcggttgtcgtactcgatgtcacacctttctacgctgaatctggcggtcaagtaggcgataaaggccaactggttgcgaacggtattgagtttacggtaaacgatacgcaaaagtatggtcaagcaacgggccatcaaggtgttttggctacaggtagcttgagcgttggccaagttattgaagcgaaagtggacaaaaaactgcgtcaccgtactcagttaaaccattctgttacacatttactgcatgctgcactgcgtcaagtgctcggtactcacgtttcgcaaaaaggttcattggttgatcctgagcgtttacgttttgacttctcccatttcgaaggcgtaaaagccgctgaattaaaagaagttgaagaattagttaatactcaaattcgtcgtaaccatgagctgaaaaccgctgaaatgggtatagatgaagccaaagagaaaggcgctatggcactctttggtgagaaatatgactcacaagtgcgtgttgtgactatgggtgatttctctatcgaattgtgtggtggtacccatgtgggccgcacgggcgatattggcttgttcaaaatcacctctgaagcgggtattgctgcgggtgtacgtcgtatcgaagccgttactggcgctgcggctatggcctatgtggcgcagcaacaagctgaactggaagaagctgcagccttattgaaaggcgatgccaactcagttgtcgctaagttaaaagcccagctcgacaaaatgaagcaactcgaaaaagaaatggcgcagttgaaagacaagctagcggcagcagcgagtgctgatttagtgggcgatgccgttgtggttaatggcgttaacgtgctgatcaaaaagttagacggcgttgaggcaagttcattacgcggtttgcaagatgaattaaaacaaaaattgaaatcggccattatcgttcttggcactacgcaggaagggaaagttaacctgatcgccggtgtgagtaacgatctgatcggcaaagtcaaagcgggtgagctagtcgctatggtcgctgcacaagtgggcggtaaaggcggcggtcgtcctgatatggctcaagcgggcggtagccagccagaaaatctggatgcggcattggctcaagtattaccttggattactgagcgtctagcttaa

SEQ ID NO: 1026 - DNA, 2628 bp, Yersinia pseudotuberculosis IP 31758
atgagcaagagcaccgctgagatccgtcaagcgtttctcgatttcttccatagcaagggacaccaggttgtatcaagcagctctttggtccctaataatgaccctacgctgttgtttaccaatgccgggatgaaccagtttaaggacgttttcttaggtttggataaacgggcctattcccgtgcgacgacctctcagcgctgcgtgcgagcgggtggtaagcataacgacctggaaaacgtaggttataccgcgcgtcatcatactttcttcgaaatgttgggtaacttcagcttcggcgattacttcaagcatgatgctatcaacttcgcttgggagttactgaccagtgaacagtggtttaatttaccaaaagaaaaactttgggtaacggtgtacgagaccgatgacgaggcctataacatctgggctaacgaagtcggcgttcctcatgagcgtatcatccgtatcggtgataacaaagggggggcctttgcctcagataacttctggcaaatgggtgataccggcccttgtggcccatgttcagagattttctttgaccatggtgatcatatctggggtggtcctccagggtctgcagaagaagatggcgatcgctatatcgagatctggaatatcgtctttatgcagtttaaccgtcagtctgacggtacgatgctgccattgccgaagccatcggttgataccggcatggggttggaacgtattgctgcggtattacagcatgttaactccaactatgagattgacctgttccgtgatttgattgccgcagtcgcagatgtcacgggggcgacggatttatccagcaagtcgttgcgggttattgctgatcacattcgttcttgtgctttcttgatttcagatggtgtgatcccatcgaatgaaaaccgcggctatgtcttacgccgtattattcgccgtgcaattcgccacgggaatatgttgggtgcgaaagagactttcttctacaaactggtggctcccttgatcgcggttatggggcctgctgctgctgagttaaaacaacagcaagcgatggtagagcaagtattaaagacggaagaagagcagtttgccaggacgttagagcgcggtttggcgctgcttgatgacgagctcagcaagcttaccggcgatacccttgatggggaaacggccttccgcttgtacgatacctatggcttcccagttgatttaacggcagatgtttgtcgcgaacgtaacctgaaagtcgatgaagctggctttgagcaagcgatggaagctcaacgtcgccgtgcccgtgaatccagtggttttggcgcagattacaacagcttgatccgtgttgatagcgcaagccaattttctggttatgaccatgtccaacaacacgcgacggttactgctctattccgtaatggcgaggccgttgatgagattcacgcaggtgaagaagccgttgtcgtactgaatcggacaccattctacggtgaatcgggtggtcaggtcggcgataagggggaactgaaaaatgcgacagcaacctttagcgttactgatactcagaaatatggtcaggctatcgggcacgtaggaatattgactaccggcacgttaagggttaaccacagcgtcgaagcattggttgatgttgtgcgtcgtaaccgtatccgtctgaatcactccgcgacccacttactgcatgctgcgttacgtaacgtcttgggcgagcatgtggcccagaaggggtcactggttaatgacaaatatctacgctttgatttctctcatttcgaagcaatgaagccggaacaaatccggttggtagaagacctggtcaatgaacaaatccgccgtaacatgccggttcagaccgaagtgatggaactggatgcggcgaaagaaaaaggtgcaatggcactgttcggcgagaagtatgacgaccaagtacgtgttctgaccatgggtgacttctcaacagagttgtgtggggggactcatgctagccgcacgggggatatagggttattccgcatcctgaccgaatctggcacggctgcgggtattcgtcgtattgaagccgtcactggcgagggcgcgattgctttattgcatcagcaaagcgacctgttacaggacgtcgctcatctggtgaaaggtgatattcataatctggcagacaaagtccgggcggtattggatcgcagtaaaatgcttgagcgtgagttgcaacagttgaaagatcagcaggcagctcaggaaagtgcctcgttgtcttcaagcgcgaaattgatcaatggtgtgaagcttttggtcagtcagttggataacgttgaaccaaaaatgctacggacaatggtcgatgaccttaaaaatcaactgggttctgccattattgtattggccaccacaactgatgataaggtaagtttgattgttggggtgaccaaggacctgacaggtaaagtaaaagcgggtgaattaatcgcggacattgctcagcaggtgggcggtaaaggcggtggtcgtcctgatatggctcaggcggggggtactgatgtgcaggctttgccagcggcattagccagcgtagaagcatgggtagcatcccggatgtaa

SEQ ID NO: 1027 - DNA, 2598 bp, Vibrio harveyi ATCC BAA-1116
atgtacatgagcactgatgaggttcgtaacgcgttcctcaagttctttgagagcaaaggacaccaaatcgtagaaagttcatcgttagttccacataacgacccaaccctgctgttcacaaacgcgggtatgaaccaatttaaagattgtttcttaggcttagaaaaacgagcctacactcgagcgactacggctcaacgttgtgtacgtgctggtggtaaacacaacgacctggaaaacgttggctttacagctcgtcaccacacattctttgaaatgctaggcaacttcagctttggcgattacttcaaagaagacgcgattgctttcgcatgggaatttctaacggaaactcttaagttgccagcagaccgtctactagtaacggtttacgagacagatgacgaagcattcgatatctggaacaagaaagtaggcgttccagcagaccgcattatccgcattggcgacaagaaaggtggtaagccatttgagtcagacaacttctggcaaatgggtgacactggtccttgtggtccatgtactgaaatcttctacgatcacggtgagcacatttggggtggccgtcctggcacgcctgaagaagatggtgaccgtttcatcgagatctggaacaacgtattcatgcagttcaaccgtcaagcagacggcactatggaaccgctaccaaaaccatcggtagatacggggatgggtatcgagcgtatctctgcaatcatgcaaggcgttcactcaaactacgaaatcgatgtattccaagctctaatcaaagcagctgctgaagtgatcggttacgaagatttatcaaaccaatctctacgcgttatcgctgaccacatccgttcatgttcattcctgatcgttgatggcgtgatgccttcaaacgaaggtcgtggttacgttctacgtcgtatcatccgtcgtgcagttcgtcacggtaacaagctgggcgcacaaggtgcattcttccacaaactggttggtgtactagcggaaatcatgggtactgctggtgaagagctgaagcgtcaacaagctgtggttgaaaaagtactgcgtatcgaagaagaaaacttcggtcgtacacttgagcgcggtatggcgattctaaacgaagcactagataacatttcttcgcaaggaacggacggtaaagtactagacggtgaaaccgtatttaaactttacgatacctacggcttcccagctgacttaactaacgacgttgcacgtgagcgtgagttcgctatcgacgaagaaggtttcgagaaagcgatggaagagcagcgtcaacgtgcgcgtgaagctggtaacttcggtactgactacaacgcagcaatcaaagttgatacgcaaacagaattctgtggttacacaggtactaaaggctctagctctgtagcagcgatgttcgttgaaggtaacgaagtagaatcactatctgcaggcgataaagcaatcatcgtacttggtgaaacaccattctacgctgagtcaggcggtcaatgtggtgacgctggtgaaatccgcactgagtctggtgtattccgtgttgaagacactcaaaagctaggtaacgcaatcgcacaccacggtgtaatggcagaaggcgtgctagcgaaaggcgacgaagtagcaactatcgttgacgcagagcgtcgcgcagctatctctctaaaccactcagcaacgcacttgctacacgcagcgctacgccaattgcttggtgagcatgttactcagaaaggctcactagtgaaagctgatggtctacgtttcgacttctcacacctagaagcagtaactgcagcagaattgaaagaagttgagcgtctagtcaacgcgcaaattcgtcgtaaccacgtgattgaaaccaacgtgatggacattgagtctgcgaagaagaaaggcgcaatggcattgttcggtgagaagtacgatgacgaagtacgcgtgctgtctatgggtgatttctcgactgagctttgtggtggtatccacgcttcaagcactggtgacatcggtctattcaagatcacatctgaaggtggtatcgcagcaggtatccgccgtatcgaagcggtaacgggtgaaggtgcgctagacgcaatcgaagctcaagcggctaagtacgaagagaaactggctgaatcagcacagaaagcgaaatctctagagaaagaaatccaaaaactgaaagacaagatggcagcagcagaaagcgcgaacatcatgggtaaagttcaggatatcaacggtactaaagtactgattgcagctctagaaggcgcagacaataagaacctacgtactatggttgatgacatcaaaaaccaagtaggtagcggcgtaatccttcttgcaaacgtgaacgatgacaagatcggtctgattgcaggtgtaaccaaagaccttatcggcaaagtgaaagcgggcgacctagttaagatggttgctgagcaagttggtggtaaaggtggtggtcgcccagatatggctcaagcaggtggtaccgatgttgcggcgctacctgcggcgattcagactgtacagccttggctagaagaacgcctataa

SEQ ID NO: 1028 - DNA, 2631 bp, Escherichia coli HS
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggtcaccgtctatgaaagcgacgacgaagcctacgaaatctgggaaaaagaagtcgggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttggggtggccctccgggaagtccggaagaagacggcgaccgctacattgagatctggaacatcgtcttcatgcagttcaaccgccaggccgatggcacgatggaaccgctgccgaagccgtctgtagataccggtatgggtctggagcgtattgctgcggtgctgcaacacgttaactctaactatgacatcgacctgttccgcacgttgatccaggcggtagcgaaagtcactggcgcgaccgatctgagcaataaatcgctgcgcgtaatcgctgaccacattcgttcttgtgcgttcctgatcgcggatggcgtaatgccgtccaacgaaaaccgtggttatgtactgcgtcgtatcattcgtcgcgcagtgcgtcacggtaatatgcttggcgcgaaagaaaccttcttctacaaactggttggtccgctgatcgacgttatgggctctgcgggtgaagacctgaaacgccagcaggcgcaggttgagcaggtgctgaagactgaagaagagcagtttgcccgtactctggagcgcggtctggcgttgctggatgaagagctggcaaaactttctggtgatacgctggatggtgaaactgctttccgtctgtacgacacctatggcttcccggttgacctgacggctgacgtttgtcgtgagcgcaacatcaaagttgacgaagctggttttgaagcagcaatggaagagcagcgtcgtcgggcgcgcgaagccagcggctttggtgccgattacaacgcaatgatccgtgttgatagtgcatctgaatttaaaggctatgaccatctggaactgaacggcaaagtgaccgcgctgtttgttgatggtaaagcggttgatgccatcaatgcaggccaggaagctgtggtcgtgctggatcaaacgccattctatgcggaatccggcggtcaggttggcgataaaggcgaactgaaaggcgctaacttctcctttgcggtggaagatacgcagaaatacggccaggcgattggtcacatcggtaaacttgctgcgggttctctgaaagtgggcgacgcggtgcaggctgatgttgatgaggctcgtcgtgcccgtattcgtctgaatcactccgcaacgcacctgatgcacgctgcgctgcgccaggttctgggtactcatgtatcgcagaaaggttcactggttaacgacaaggtgctgcgcttcgacttctcacacaacgaagcgatgaaaccagaagagattcgtgcggtcgaagacctggtgaacgcacagattcgtcgcaatttgccgatcgaaaccaacatcatggatctcgaagcggcgaaagcgaaaggtgcgatggcgctgttcggcgagaagtatgatgagcgcgtacgcgtgctgagcatgggcgatttctccaccgagctgtgtggcggtactcacgccagccgcactggtgatattggtctgttccgcatcatctctgaatcgggtactgctgcaggcgttcgtcgtatcgaagcggtaaccggagaaggcgctatcgccaccgttcatgcagacagcgatcgcttaagcgaagtcgcacatctgctgaaaggcgatagcaataatctggctgataaagtgcgctcagtactggaacgtacgcgtcagctggaaaaagagttacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagccgaaggtaaggtttctctgattgcaggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1029 - DNA, 2679 bp, Serratia proteamaculans 568
atgtcgcgtatcttgctcacgtgtcgttattctagcctttccgggaaaattatgagcaagagcaccgctgagatccgtcaagcgtttctcgatttctttcatagtaagggccatcaggttgtagcgagcagctccctggtgcctgacaatgatccgacattgctgtttaccaatgccggcatgaaccaatttaaagatgttttcctggggctggacaagcgtgcctattcccgagccactacctcacagcgttgtgtgcgtgcgggcggtaagcataacgatctggagaacgtcggttataccgcacgtcaccacaccttctttgaaatgctgggcaacttcagcttcggcgattatttcaaacatgatgccatcagctacgcatgggaactcttgaccggtgaaaactggtttaacctgccgaaagagcggctgtgggtgaccgtctatgaaaccgatgacgaagctttcgacatctggcagcagcagattggtgtgccggcagaacgtattatccgcattggcgacaataaaggcggcgcctttgcctctgacaacttctggcagatgggtgataccggtccatgcggcccgtgtaccgagattttctacgatcacggcgatcatatctggggtggcccaccgggcagcccggaagaagatggcgatcgctacattgagatctggaacctcgttttcatgcagttcaaccgtcaatccgacggtactatgctgccgctgccaaaaccttcggtagataccggtatggggctggagcgtattgccgccgtattgcagcacgtgaactccaactatgaaatcgacctgttcagcaagctgattgccgccgtggccaaggtgaccggtgccacagatttggataacaaatccctgcgcgtgatcgccgaccacattcgctcttgtgctttcctggtgtcagacggtgttacaccgtccaacgaaggtcgtggttatgtgctgcgccgcatcatccgacgcgccgttcgccatggcaacatgctgggtgcgaaagacaccttcttctacaagctggttgcaccgctgatcgaagtgatggggccggcagccgacgaattgaagcgtcagcagtcactggttgagcaagtgctgaaaaccgaagaagatcagtttgcccgcactctggaacgtggtttgacgttgctggacgaagagctggccaacttgcagggcgataccctggatggtgaaactgcattccgtctgtacgacacttacggtttcccggtcgatctgacggcagacgtgtgccgtgaacgtggtctgaaagtggatgaagccggtttcgagcaggcaatggaagcacagcgccgccgtgcgcgtgagtccagcggcttcggcgcagactacaacagcatgatccgtgttgatggtgccagccaattcagcggttatgaccacgagcaacagcagtccaccgtgaccgcgctgttccgtgatggtcagccagtgaacgagatccacgccggtgaagaagccgtggtggtactggacgagactccgttctacggtgagtccggtggtcaggttggcgataagggcgtgctgaaagctgccaatgctgattttgaagtgagcgacacccagaaatacggtcaggctattggccatcagggtaagctgtctcatggctcgctgaaggtgaacgaccgtgttgacgcgaagatcgacaccgtgcgacgcaaccgcattcgtctgaaccactccgcaacccacctgctgcacgctgcactgcgccagacgctgggtgagcacgtggcgcaaaaaggctcgttggttaacgataaatacctgcgtttcgacttctcgcattttgaagcgatgaagccggagcaaattcgcaccgtggaagacttggtgaaccaacaaattcgtcgtaacctgccggtgcagaccgaggttatggcgctggatgatgccaaagggaagggcgctatggcgctgttcggtgagaagtacgacgacaacgtgcgcgtactgaccatgggcgacttctcgaccgagctgtgtggcggcacccatgccagccgtaccggtgacatcggcctgttccgcattctgagtgagtctggtaccgccgcaggtatccgccgtattgaagcggtaaccggtgatggcgcgattgctaccttgcatcagcaaaacgatctgctacaggacgttgctcatctggttaagggtgacagcaataacctgacggacaaagtgcgtgcggtgctcgatcgtacccgcgcattggaaaaagagctgcagcagttgaaggaccagcaggcggcacaagaaagcgcttcgttgtccagcaaggcgaaaatggttaacggtgtacagctgttggtcagccaactggataacgttgaggccaaaatgctgcgtactatggttgatgatcttaaaaatcaactgggttccgcgattatcgtgctggccaccacggcggatgataaggtgagcctgattgccggcgtgaccaaagatctgaccgaccgggtaaaagccggcgagctgatcggtaacgtagcgcagcaggttggcggtaaagggggcggacgccctgatatggcgcaggccgggggaacggatgtcagcgccctgccagcggcattagacagcgtagaagcctgggtggcctcgaaactgtga

SEQ ID NO: 1030 - DNA, 2625 bp, Shewanella baltica OS195
atgtatcaaactacagcagagcttagaagcgctttcctcgaatttttccgcagcaatggtcatcaagttgtggacagtagttcattagtgccaggcaacgatcccacacttttatttaccaatgcaggcatgaaccagttcaaggacgtgtttcttggcatggacaaacgcaattatacgcgtgcgaccactgctcaacgttgtgtacgcgccggtggtaagcataacgatttagataacgtcggttatacagcacgtcatcacacctttttcgaaatgctgggtaacttcagttttggtgattatttcaaagaagaagcgattcgctttggctggactttcttaactgaaactttaaagctgccgaaagaacgtctgtgtgtcactatttatcaaacagatgatgaagcctttgaaatctggaataaaaagattggtgttgctgccgagaacattatccgtatcggcgacaacaaaggtgctgcttatgcgtcagataacttctggcaaatgggtgataccggtccttgcggcccatgttctgagattttctatgaccatggcgaccatatttggggcggccgtcctggcagtcccgaagaagatggcgaccgtttcatcgaaatctggaacatagtgttcatgcagtacaatcgtcaagcgtcgggtgaaatgctacctttgcctaagccatcggttgatactggcatggggattgagcgtattgccgcgattatgcaaggcgtacattctaactacgaaatcgatatcttccgtacgctgatcgccaaagcggctgaaatcatcggcgtaagcgatttaaccgagaagtcactgcgcgtcattgccgaccatatccgttcatgtgcattccttattgccgatggcgttatgccgtcgaatgaaggccgcggttatgtgctgcgccgcattatccgccgcgcagttcgccatggtaacaagttaggcgcgaccgaagctttcttctataagctggttccgtctttgattgcggtgatgggcgatgcggccaaagggttagctgagactcaagcgattgttgaaaaagcactgaaagcggaagaagagcaatttgcccgtacgcttgaacgtggtttaggcattttagatgcggctttaaacgagttaaaaggtgacaccttagacggtgaaacggtttttaagctgtatgacacctatggcttcccaatggatttaaccgctgacgtgtgtcgcgagcgcaacatcattgtcgatgaagcaggtttcgaagtcgctatggctgaacaacgtagccgcgcccaagctgccggtaactttggtgcagattacaacgctgcactgaaaatcgatgctgaaaccgcattcagtggttataccgaattagcgggccaagctaaggtcaccgcgatttatcaaaacggtgaatcagtgacggcgatcaaagcgggtgacgaagcggttgttgtactcgacgtgacacctttctacgctgaatctggcggtcaagtgggcgataaaggccaactggttgcgaacggtgttgaatttaccgtgaacgacacgcaaaagtacggtcaagcaacgggccatcaaggtgttttagctacaggtaacttgagtgttggccaagttgttgaagcgaaagtcgacaaaaaactgcgtcaccgtactcagttaaaccattctgttacgcatttactgcatgccgcactgcgtcaagtgctcggtactcacgtttcgcaaaaaggttctttggttgatcctgagcgtttgcgttttgacttctcccatttcgaaggcgtaaaagcgacggaattaaaagaagttgaagaattagttaacactcaaattcgtcgtaaccatgagctgaaaaccgctgaaatgggtatagatgaagccaaagagaaaggcgcaatggcgctctttggtgagaaatatgactcacaagtgcgtgttgtgactatgggggatttctctatcgaattgtgtggtggtacccatgtgggccgcacgggcgatattggcttattcaaaatcacctctgaagcgggtattgctgcgggtgtacgtcgtatcgaagccgttactggcgctgctgctatggcctatgtggcgcagcaacaagctgaactggaagaagctgcagccttattgaaaggcgatgccaactcagtcgttgctaagttaaaagcccagctcgataagatgaagcaactcgaaaaagaaatggcgcagttgaaagacaagctcgcggctgcagcgagtgctgatttagtgggcgatgccgttgtggttaatggcgttaacgtgctgatcaaaaagttagacggcgttgaggcaagttcattacgcggtttgcaagatgaattaaaacaaaaattgaaatcggccattatcgtgcttggcactgcgcaggaagggaaagttaacctgatcgccggtgtgagtaacgatctgatcggcaaagtcaaagcgggtgagctagtcgctatggtcgctgcacaagtgggcggtaaaggcggcggtcgtcctgatatggctcaagcgggcggtagccagccagaaaatctggatgcggcattggctcaagtattaccttggattactgagcgtctagcttaa

SEQ ID NO: 1031 - DNA, 2598 bp, Coxiella burnetii RSA 331
atgaatagtaatcaattacgagaaaccttcctgaattattttaaacaattggatcatgaagttgttccaggtagttcattaataccggaaaatgacccgacgctattgttcactaatgcgggaatggtgcaatttaaagatgtttttttgggtgtcgaaacacgaccttatcagcgcgccgtttcgatacaaccttgcatgcgagccggcggaaagcacaatgatttagagaacgttggctacacggcccgccatcacaccttttttgaaatgctggggaattttagttttggtgattattttaaacgcgatgctattaaatttgcatgggattttttgactaatgttttaaagctcccgccccaacgattgtgggtgacggtatttcaggatgactttgagagtgagtccatatggcttaaggaaatgaaaataaatccagagcggttctcgcgttgcggggaaaaagacaatttctggcaaatgagggacactgggccttgcgggccgtgtacagaaatattttatgaccacgggccaactatctcgggaggcccaccgggaagcgcagaggcagatggcgaccgctatgtggaaatttggaatttagtatttatgcagtacaaccgcgacgcaaagggaaatctgctccctcttgcaaagccgagcgtagacacagggatgggtctagaacgcctgacggctgttatgcagggcgtccatgacaattacgatatcgatttatttcagtatttattgaaagcgttaagaacgcttcttaagaccgaggatcttcacaatacgtcgatgcgggtgattgtggatcatattcgctcggttgctttccttattgccgatggagtgatcccgtctaacgaagggcggggttacgttctgcgtcgtattattcgccgggccgttcgtcatgggtataaactggggcaagaggaaccttttttctatcagttaactaaaccgttgctagaagagatgggaggcgcctatcctttgcttcgtaaatcccaagctctgatcgagcaaaccatcaagcaggaagaaatacaattttctaataccttaacaaaaggtcttaagattttagatcatgaaatggctggcttaccttcccgccaaattccaggcaatctaatttttcaattatatgacacttatggattcccgcctgacttgacggctgatattgcaagagagcgtgattttgtgatggattatgcagggttcgataaagccatggaacgtcagcgtgaacaatcgcagcaagcgcatcaattcgtagctaattatgcccaaaaagcatctattggtggcgaaacgcaattcgtgggctatgaaacgttaaattcgcaagcgaacgtaatttctttgctgcagaatgatcagcctattaaccgattaaatgaaagcgaaaaaggggtggtagtactggatcgcacccctttttatgcagaatcgggaggtcaagtcggcgatcaagggtttttatattttgaaaaaggcagttttcgtgttaaggatactaaaaaacaaggtgatatttatttacatattggcgagatgttacaaggtcatttaaatgtaaaagataaagttcgcgccgaagtcgatgtgtcgcgttttgatattatgcgtaaccactccgccacacatttgcttcacgaagccttgcgccgcgtgcttggcgagcgcgtgatgcaaaagggctctctggttgaagcaaagcgtttacgatttgatttttctcatgctaaaccgcttacgccagaagaattgcaggcagtcgaaagattagttaatcaacaaatccaagcgaatttgctttccaccatcgaagtaatgaccccagaagaggcgaagaaaaaaggtgcgttggctttatttggagaacggtacggcaaagaggtccgtgtactcgaaatgggtgatttttctactgaaatttgcggcggaacccatacagaacgaacgggggaaattggtttatttaagattgtctctgaatccggttgcgcggcgggcattcgacgcattgaagcgctcactggtaaggctgcgctagactatattgaatccgcagagcaacaattacgttcgctcagcgatttattaaaaacgaaccgtaaaaatttagcggcaaaattaagccaaattttagaagaccaccgcaaattggaaaaagaacttgcgaaattaaaacagcggctggcgagtcaacaacttgaaagcttaattaatcaagtagtggatgtacatgacataagaacgctcgctattcgattagaagccgttgaccgagagacactgcgagctatcgtcgatcaattaaaacaaaaattgggaaaggctgcgattgtattagcgacgatagaagaagggcgcatacaactagtagcgggagtcaccaaaaattgtttggagcattttaatgcgacagaactactggcgccgatagccgaaaaggttggtggccgcagcgggggccgccccgatttagctcaaggagcaggagaaaggccggagaatttagaagcggcactggcagcggtgcccaaatggattgagaaaaaactaaaggaatag

SEQ ID NO: 1032 - DNA, 2631 bp, Escherichia coli C ATCC 8739
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggaaaaagaagtagggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttgggggggccctccgggaagcccggaagaagacggcgaccgctacattgagatctggaacatcgtcttcatgcagttcaaccgccaggccgatggcacgatggaaccgctgccgaagccgtctgtagataccggtatgggtctggagcgtattgctgcggtgctgcaacacgttaactctaactatgacatcgacctgttccgcacgctgatccaggcggtagcgaaagtcactggcgcaaccgatctgagcaataaatcgctgcgcgtaatcgctgaccacattcgttcttgtgcgttcctgatcgcggatggcgtaatgccggccaatgaaaaccgtggttatgtactgcgtcgtatcattcgtcgcgcagtgcgtcacggtaatatgctcggcgcgaaagaaaccttcttctacaaactggttggtccgctgatcgacgttatgggctctgcgggtgaagacctgaaacgccagcaggcgcaggttgagcaggtgctgaagactgaagaagagcagtttgctcgtactctggagcgcggtctggcgttgctggatgaagagctggcaaaactttctggtgatacgctggatggtgaaactgctttccgtctgtacgacacctatggcttcccggttgacctgacggctgatgtttgtcgtgagcgcaacatcaaagttgacgaagctggttttgaagctgcaatggaagagcagcgtcgtcgcgcgcgcgaagccagcggctttggtgccgattacaacgcaatgatccgtgttgacagtgcatctgaatttaaaggctatgaccatctggaactgaacggcaaagtgactgcgctgtttgttgatggtaaagcggttgatgccatcaatgcaggccaggaagctgtggtcgtgctggatcaaacgccattctatgcggaatccggcggtcaggttggcgataaaggcgaactgaaaggcgctaacttctcctttgcggtggaagatacgcagaaatacggccaggcgattggtcacatcggtaaacttgctgcgggttctctgaaagtgggcgacgcggtgcaggctgatgttgatgaggctcgtcgcgcccgtattcgtctgaatcactccgcaacgcacctgatgcacgctgcgctgcgccaggttctgggtactcatgtatcgcagaaaggttcactggttaacgacaaggtgctgcgcttcgacttctcacacaacgaagcgatgaaaccagaagagattcgtgcggtcgaagacctggtgaacacacagattcgtcgcaatttgccgatcgaaaccaacatcatggatctcgaagcggcgaaagcgaaaggtgcgatggcgctgttcggcgagaagtatgatgagcgcgtacgcgtgctgagcatgggcgatttctctaccgagttgtgtggcggtactcacgccagccgcactggtgatattggtctgttccgcatcatctctgaatcgggtactgctgcaggcgttcgtcgtatcgaagcggtaaccggagaaggtgctatcgccaccgttcatgcagacagcgatcgcttaagcgaagtcgcgcatctgctgaaaggcgatagcaataatctggctgataaagtgcgctcagtactggaacgtacgcgtcagctggaaaaagagttacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagtcgaaggtaaggtttctctgattgcaggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1033 - DNA, 2628 bp, Yersinia pseudotuberculosis YPIII
atgagcaagagcaccgctgagatccgtcaagcgtttctcgatttcttccatagcaagggacaccaggttgtatcaagcagctctttggtccctaataatgaccctacgctgttgtttaccaatgccgggatgaaccagtttaaggacgttttcttaggtttggataaacgggcctattcccgtgcgacgacctctcagcgctgcgtgcgagcgggtggtaagcataacgacctggaaaacgtaggttataccgcgcgtcatcatactttcttcgaaatgttgggtaacttcagcttcggcgattacttcaagcatgatgctatcaacttcgcttgggagttactgaccagtgaacagtggtttaatttaccaaaagaaaaactttgggtaacggtgtacgagaccgatgacgaggcctataacatctgggctaacgaagtcggcgttcctcatgagcgtatcatccgtatcggtgataacaaagggggggcctttgcctcagataacttctggcaaatgggtgataccggcccttgtggcccatgttcagagattttctttgaccatggtgatcatatctggggtggtcctccagggtctgcagaagaagatggcgatcgctatatcgagatctggaatatcgtctttatgcagtttaaccgtcagtctgacggtacgatgctgccattgccgaagccatcggttgataccggcatggggctggaacgtattgctgcggtattacagcatgttaactccaactatgagattgacctgttccgtgatttgattgccgcagtcgcagatgtcacgggggcgacggatttatccagcaagtcgttgcgggttattgctgatcacattcgttcttgtgctttcttgatttcagatggtgtgatcccatcgaatgaaaaccgcggctatgtcttacgccgtattattcgccgtgcaattcgccacgggaatatgttgggtgcgaaagagactttcttctacaaactggtggctcccttgatcgcggttatggggcctgctgctgctgagttaaaacaacagcaagcgatggtagagcaagtattaaagacggaagaagagcagtttgccaggacgttagagcgcggtttggcgctgcttgatgacgagctcagcaagcttaccggcgatacccttgatggggaaacggccttccgcttgtacgatacctatggcttcccagttgatctaacggcagatgtttgtcgcgaacgtaacctgaaagtcgatgaagctggctttgagcaagcgatggaagctcaacgtcgccgtgcccgtgaatccagtggttttggcgcagattacaacagcttgatccgtgttgatagcgcaagccaattttctggttatgaccatgtccaacaacacgcgacggttactgctctattccgtaatggcgaggccgttgatgagattcacgcaggtgaagaagccgttgtcgtactgaatcggacaccattctacggtgaatcgggtggtcaggtcggcgataagggggaactgaaaaatgcgacagcaacctttagcgttactgatactcagaaatatggtcaggctatcgggcacgtaggaatattgactaccggcacgttaagggttaaccacagcgtcgaagcattggttgatgttgtgcgtcgtaaccgtatccgtctgaatcactccgcgacccacttactgcatgctgcgttgcgtaacgtcttgggcgagcatgtggcccagaaggggtcactggttaatgacaaatatctacgctttgatttctctcatttcgaagcaatgaagccggaacaaatccggttggtagaagacctggtcaatgaacaaatccgccgtaacatgccggttcagaccgaagtgatggaactggatgcggcgaaagaaaaaggtgcaatggcactgttcggcgagaagtatgacgaccaagtacgtgttctgaccatgggtgacttctcaacagagttgtgtggggggactcatgctagccgcacgggggatatagggttattccgcatcctgaccgaatctggcacggctgcgggtattcgtcgtattgaagccgtcactggcgagggcgcgattgctttattgcatcagcaaagcgacctgttacaggacgtcgctcatctggtgaaaggtgatattcataatctggcagacaaagtccgggcggtattggatcgcagtaaaatgcttgagcgtgagttgcaacagttgaaagatcagcaggcagctcaggaaagtgcctcgttgtcttcaagcgcgaaattgatcaatggtgtgaagcttttggtcagtcagttggataacgttgaaccaaaaatgctgcggacaatggtcgatgaccttaaaaatcaactgggttctgccattattgtattggccaccacagctgatgataaggtaagtttgattgttggggtgaccaaggacctgacaggtaaagtaaaagcgggtgaattaatcgcggacattgctcagcaggtgggcggtaaaggcggtggtcgtcctgatatggctcaggcggggggtactgatgtgcaggctttgccagcggcattagccagcgtagaagcatgggtagcatcccggatgtaa

SEQ ID NO: 1034 - DNA, 2631 bp, Escherichia coli SMS 3 5
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggaaaaagaagtagggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttggggtggccctccgggaagtccggaagaagacggcgaccgctacattgagatctggaacatcgtcttcatgcagttcaaccgccaggccgatggcacgatggaaccgctgccgaagccgtctgtagataccggtatgggtctggagcgtattgctgcggtgctgcaacacgttaactctaactatgacatcgacttgttccgcacgctgatccaggcggtagcgaaagtcactggcgcaaccgatctgagcaataaatcgctgcgcgtaatcgctgaccacattcgttcttgtgcgttcctgatcgcggatggcgtaatgccgtccaacgaaaaccgtggttatgtactgcgtcgtatcattcgtcgcgcagtgcgtcacggtaatatgctcggcgcgaaagaaacctttttctacaaactggttggtccgctgatcgacgttatgggctctgcgggtgaagacctgaaacgccagcaggcgcaggttgagcaggtgctgaagactgaagaagagcagtttgctcgtactctggagcgcggtctggcgttgctggatgaagagctggcaaaactttctggtgatacgctggatggtgaaactgctttccgtctgtacgacacctatggcttcccggttgacctgacggctgatgtttgtcgtgagcgcaacatcaaagttgacgaagctggatttgaagcagcaatggaagagcagcgtcgtcgtgcgcgcgaagccagcggctttggtgccgattacaacgcaatgatccgtgttgacagtgcatctgaatttaaaggctatgaccatctggaactgaacggcaaagtgaccgcgctgtttgttgatggtaaagcggttgatgccatcaatgcaggccaggaagctgtggtcgtgctggatcaaacgccattctatgcggaatccggcggtcaggttggtgataaaggcgaactgaaaggcgctaacttctcctttgcggtggaagatactcagaaatacggccaggcgattggtcacatcggtaaacttgctacgggttctctgaaagtgggcgacgcggtgcaggctgatgttgatgaggctcgtcgcgcccgtattcgtctgaatcactccgcaacgcacctgatgcacgctgcgctgcgccaggttctgggtactcatgtatcgcagaaaggttcactggttaacgacaaagtgctgcgcttcgacttctcacacaacgaagcgatgaaaccagaagagattcgtgcggtcgaagacctggtgaacgcacagattcgccgtaacttgccgatcgaaaccaacatcatggatctcgaagcggcgaaagcgaaaggtgcgatggcgctgtttggcgagaagtatgatgagcgcgtacgcgtgctgagcatgggtgatttctccaccgagttgtgtggcggtactcacgccagccgcactggtgatattggtctgttccgcatcatctctgaatcgggtactgctgcaggcgttcgtcgtatcgaagcggtaaccggagaaggcgctatcgccaccgttcatgcagacagtgatcgcttaagcgaagtcgcgcatctgctgaaaggcgatagcaataatctggctgataaagtgcgttcagtactggaacgtacgcgtcagttggaaaaagagttacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagccgaaggtaaggtttctctgattgcaggcgtatctaaggacgtcacagatcgtgtgaaagcaggggagctgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1035 - DNA, 2649 bp, Xanthomonas oryzae PXO99A
atgaacgcacctgccaaattcagcacttcccagatccgtagcgacttcctcgcgttcttcgaggggaggggccacaccatcgtgccatccgcgccgctggtgccgggtaacgaccccaccttgctgtttaccaactccggcatggtccagttcaaggacgtcttccttggcgcggagaaacgcagttacgtgcgtgccgctgacgtgcagcgctgcctgcgtgccggtggcaagcacaacgatctggactcggtcggctacaccgcgcgtcaccacaccttcttcgaaatgctaggcaactggtcgttcggcgactatttcaagaaggacgccatcgcctgggcatgggaactgctgacccagatctggaagctgccgacagaccgtctgttggtcaccgtctaccacaccgacgaagaagcttttgcgttgtggcgcgacatgatcggcatcccggaaagccgcatcgtgcgcatcggcgacaacaagggtgcgccctacgcgtcggataatttctggcaaatggccgacaccggcccgtgcggcccgtgtaccgaaattttcttcgaccacggcgatcacatcgctggtggtccgccggggtcgccggatgaggatggcgaccgctttatcgagatctggaacctggtcttcatgcagttcgatcgccagcccgacggcacactggtacctctgccagcgccatgcgtggacactggcatgggattggagcgtcttgccgcgatcctgcagcatgtccatacgaactatgaaatcgacctgttccaggcgttgatcggcaaggccagcgcgctgaccggcatcaccgatctggagaacaaatcgctgcgggtgatcgccgatcacatccgcgcttgttcgtttctcatcgtcgatggtgtgctgccctccaacgaaggccgcggctatgtgctgcgtcggattatccgacgtgcgctgcgccatggttggatgttgggcgtgcgccagccgttcttcagcaagatggtgcccacgctggtcgaactgatgggcgaagcctaccccgagctggtggtggcgaaggacaccgtggcgcgcgccttgttggccgaagaagagcgttttgcggagacgctggacgccggcatgaaaatcttcgacgaggtcgcgtcgcgctcgcaggacattatcccgggcgccgatgcgttccggttgtacgacacctatggcttcccggtcgacctgaccgccgatatcgcacgcgagcgcggcatgcgcgtggacatggagggcttcgagtgcgccatggagcgccagcgcgagactgcgcgtgcggccggcaagttcggcggcggcgtggcattgcccgccgatctggtcgccagcatgtcgccaacggtgttcctgggttacgaagcgtacgatgccgatgcgctcagggtcgtggcgttgctcaagcagggccgcccggtcgaacgtgcgcaggccggcgacgaggtgatcgtgttcaccgaccgcacgccgttctacgccgagtcgggtggtcaggttggcgatagcggtcagctgaacggccccggtgtgttgatcgaagttgccgacacgcagaagttcgccggtcagttccatggccatgtgggtcgcatcagcgaaggcacgctcgcgcttggcgatgtgcttgccggtgggatcgacgtacaacgtcgcggcaagaccatcctcaaccattcggcgacccatctgctgcatgccgcgttgcgcgaagtgttgggaacgcatgttcagcagaagggctcgctggtcgcaccggatcgtctgcgcttcgacttctcgcacttccagccgatcactgcggatgagcttgctgtgatcgagcgcaaggtcaacgccgaagtgcgcaccaaccatggcgtggaagtgcataacatggccatgcaggaggcgctggatttcggcgcgatggcgttgttcggcgagaaatacggcgaaaacgtccgcgtgctcaagatgggcggttattccaccgaactgtgtggtggcacgcatgtcacccgtaccggcgacatcggcctgttcaagatcacctccgaaggcggcgtgtcctcgggagtgcgtcgtatcgaagcggtgaccgggcagggcgcgctggattatgtggccgacgaagagcgtcgcttgcttgaggctgcccatttgctcggcggcaacgcgaccgaggtggtggacaaagtgcgcgcactgaccgagcgtcagaagcggctgcagcgcgagctggaatcgctcaaggccaagctggcgtcgggtgcaacggctgacctgggcgctgctgcgatcgacgtcgccggggtcaaggtggtggcagtgcgtctggaaggcttcgatgccaaggcgctgcgcgatgcgatggatcgcctgaagcaacagctcggcgactctgtgatcgtgctggctggcgcttcaggcggcaaagttgcgcttgtctctggtgtgaacggcagcccaactggcaaggtgaaggcaggggaacttctcagcaatatcgccagtcagatcggcggcaagggcggtggccgtccagatctcgcccagggtggtggcgaggacgggcccgcccttgcgaccgcactcgacggtgtgcccctctgggtcaagcaacacttgggctga

SEQ ID NO: 1036 - DNA, 2631 bp, Shigella boydii CDC 3083 94
atgagcaagagcaccgctgagatccgtcaggcgtttctcgactttttccatagtaagggacatcaggtagttgccagcagctccctggtaccccataacgacccaactttgttgtttaccaacgccgggatgaatcagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggaaaaagaagtcgggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttggggtggccctccgggaagtccggaagaagacggcgaccgctacattgagatctggaacatcgtcttcatgcagttcaaccgccaggcagatggcacgatggaaccgctgccgaagccgtctgtagataccggtatgggtctggagcgtattgctgcggtgctgcaacacgttaactctaactatgacatcgacctgttccgcacgttgatccaggcggtagcgaaagtcactggcgcgaccgatctgagcaataaatcgctgcgcgtaatcgctgaccacattcgttcttgtgcgttcctgatcgcggatggcgtaatgccgtccaatgaaaaccgtggttatgtactgcgtcgtatcattcgtcgcgcagtgcgtcacggcaatatgctcggcgcgaaagaaaccttcttctacaaactggttggtccgctgatcgacgttatgggctctgcgggtgaagacctgaaacgccagcaggcgcaggttgagcaggtgctgaagactgaagaagagcagtttgcccgtactctggagcgcggtctggcgttgctggatgaagagctggcaaaactttctggtgatacgctggatggtgaaacggctttccgtctgtacgacacctatggcttcccggttgacctgacggctgatgtttgtcgtgagcgcaacatcaaagttgacgaagctggttttgaagcagcaatggaagagcagcgtcgtcgcgcgcgcgaagccagcggctttggtgccgattacaacgcaatgatccgtgttgatagtgcatctgaatttaaaggctatgaccatctggaactgaacggcaaagtgaccgcgctgtttgttgatggtaaagcggttgatgccatcaatgcaggccaggaagctgtggtcgtgctagatcaaacaccattctatgcggaatccggcggtcaggttggtgataaaggcgaactgaaaggcgctaacttctccttcgcggtggaagatacgcagaaatacggccaggcgattggtcacatcggtaaacttgctgcgggttctctgaaagtgggcgacgctgtgcaggctgatgttgatgaggctcgtcgcgcccgtattcgtctgaatcactccgcaacgcacctgatgcacgctgcgctgcgccaggttctggggactcatgtatcgcagaaaggttcactggttaacgacaaggtgctgcgcttcgacttctcacacaacgaagcgatgaaaccggaagagattcgtgtggtcgaagacctggtgaacgcacagattcgtcgcaatttgccgatcgaaaccaacatcatggatctcgaagcggcgaaagcgaaaggtgcgatggcgctgttcggcgagaagtatgatgagcgtgtacgcgtgctgagcatgggcgatttctccaccgagctgtgtggcggtactcacgccagccgcactggtgatattggtctgttccgcatcatctctgaatcgggtactgctgcaggcgttcgtcgtatcgaagcggtaaccggagaaggcgctatcaccaccgttcatgcagacagcgatcgcttaagcgaagtcgcgcatctgctgaaaggcgatagcaataatctggcggataaagtgcgctcagtactggaacgtacgcgtcagttagaaaaagaactacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagccgaaggtaaggtttctctgattgcgggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1037 - DNA, 2649 bp, Stenotrophomonas maltophilia R551 3
atgaacgcatccgccaaattcacgacttcccagatccgcagcgacttccttgaattcttcaagggcaaaggccacaccatcgtgccgtcggcgccgctggtgccgggcaatgatccgaccctgctgttcaccaattccggcatggtgcagttcaaggacgtgttccttggcgcggagaagcgcagctacgtgcgcgcggccgacgtccagcgctgcctgcgcgccggcggcaagcacaacgaccttgaccaggtcggctacaccgcacgtcaccatactttcttcgaaatgctgggcaactggtcctttggcgactacttcaagaaggacgcgatcgcctgggcatgggagctgctgacccaggtctggaaactgccggccgaacgcctgctggtcaccgtctaccagaccgacgacgaagcgtatgcgctgtggcgcgacatggtcggcatcccggaagagcgcatcgtgcgcatcggtgacaacaagggtgcgccgtttgcctcggacaatttctggcagatggccgataccggcccgtgcggcccgtgcaccgagatcttctacgaccacggcgaccacatcgccggtggccccccgggttccccggatgaagacggcgaccgcttcatcgaaatctggaacctggtgttcatgcagttcgatcgccagcccgacggcaccctggtgccgctgccggcaccgtgcgtggataccggcatgggcctggagcgcctggcggcgatcctgcagcacgtgcacaccaattacgagatcgacctgttccaggcgctgatccgcaaggcgtccgaactgaccggcaccgccgatctggagaacaagtcgctgcgggtgatcgccgatcacatccgtgcctgctcgttcctgatcgtcgacggcgtgctgccgtccaacgaaggccgcggctacgtgctgcgccgtatcatccgccgcgccctgcgccacggctggatgctgggtgtgcgccagccgttcttcagcaagctggtgccgaccctggtcgagcagatgggcgaggcctatccggaactgcccgcggcggccgataccgtcacccgtgcgctgcaggccgaggaagagcgtttcgctgaaaccctcgacgccggcatgaagatcttcgaagacgttgccggcaaggccagcaatggcgtgatccccggcgttgacgcgttccgcctgtacgacacctatggcttcccgctcgacctgacccaggacatcgcccgcgagcgcgacctgaccgtcgacatcgctggcttcgatgcggcgatggagcagcagcgcgaaaccgcgcgcgcggcaggcaagttcggcggtggcgtgaccctgccggccgagctggtggcgaccctcagcccgacccgcttcctcggctacgaccgcctgcaggccgacggcctgaccgtgctggccgtgctcaaggacggccgtccggtgcagtcggccaatgccggcgatgcggtcatcgtgattaccaaccagaccccgttctacgccgagtccggcggccaggtcggcgacaccggcgtgctgaccggcaacggcgtgcgcctggcggtggaagacacccagaagttcgcaggtcagttccatggccacgtcggcatcctgtccgaaggcggcctgaaggttggtgacgtgctgtccggccaggtcgatggcgagcgccgtggcgccaccatcctcaaccactccgccacccacctgctgcatgccgccctgcgcgaagtgctgggtacccacgtgcagcagaagggctcgatggtggcgccggatcgcctgcgcttcgacttctcgcacttccagccgatcagcgcggaagagctggccgtgatcgagcgcaaggtcaaccagcaggtgcgtgccaacaacgctgccgaagtgcacaacatgggcatgcaggaagcgctggacttcggcgcgatggccctgttcggcgagaagtacggtgagcacgtgcgcgtgctgaagatgggtgactactccaccgagctgtgcggcggtacccacgtcaaccgtaccggcgacatcggcctgttcaagatcacctccgagggcggcgtctccgctggcgtgcgccgcatcgaggccgtcaccggccagggtgccctggactacgtggatgccgaagaggcccgcttggccgaggccgccgacctgctcggcggcagcgctgccgacgtggtcgagaagatccgcgcccttggccagcgccagaagcagctggaacgcgagctggagtccgtgaaggccaaggttgccgctggcgccaccgccgacctgtccggccaggccgtcgaggttgccggtgtgaaggtgctggcggcgcgcctggaaggcttcgacgccaaggccctgcgtgacgccatggaccgcctgaagcagcagctgggcgacgcggtgatcgtgctggccggtgcccaggacggcaaggccgccctggtcgcgggtgtgaacggcagcgcaatgggcaaggtcaaggccggggaactgttgtcccatatcgccggtcagatcgggggcaagggcggcggacgcccggacctcgcccagggtggtggcgaggacgggcccgcccttgccaccgcgctggctgccgtcgtcgaatgggtcagcccccgcctgtga

SEQ ID NO: 1038 - DNA, 2631 bp, Salmonella enterica serovar Newport SL254
atgagcaagagcaccgctgagatccgtcaggcgtttctcgactttttccatagtaaagggcatcaggtagttgccagcagttccctggtgcctaacaatgaccccactctgttgtttaccaatgccgggatgaaccagttcaaggatgttttccttgggctcgataaacgtaattattcccgtgcaaccacttcccagcgttgcgtacgcgcggggggtaaacacaacgatctggaaaacgtcggatacactgcacgtcaccatactttcttcgaaatgctgggcaacttcagcttcggcgattacttcaaacacgacgccattcagttcgcatgggaattactgaccggtgaaaactggtttgctctgccaaaagagcgtttatgggtcaccgtctatgaaaccgacgacgaagcctatgagatctgggaaaaagaagtcggcatcccgcgcgagcgtattatccgtatcggcgacaataaaggcgcgccatacgcatcggataacttctggcagatgggcgataccggtccctgcggtccgtgtaccgaaatcttctacgatcatggcgaccacatctggggcggccctccgggaagcccggaagaagacggcgatcgctatattgagatctggaacatcgtctttatgcagttcaaccgtcaggctgacgggacgatggaaccattgccgaaaccgtctgtagataccggtatggggctggagcgtattgccgcggtactgcaacacgttaactctaactatgacatcgacctgttccgcacgttgattgaagcggtagcgaaagtcaccggcgctaccgatctgggtaataaatcgctgcgcgttatcgccgaccacatccgttcttgcgcattcctggttgccgatggcgtgctgccgtcgaatgaaaaccgtggttatgtgctgcgtcgcattattcgtcgcgcggttcgtcacggcaacatgctgggcgcgaaagagaccttcttctacaagctggttgggccgctgattgaggtaatgggctccgcaggcgaagagttgaaacgtcagcaggcgcaggtcgagcaggttctgaaaacggaagaagagcagttcgctcgtacgctggagcgcggtctggcgctgctggatgaagaactggcgaaattgcagggcgacaccctggacggcgaaaccgctttccgtctgtatgatacttatggtttcccggtcgatctaacggcggacgtctgccgtgagcgcaacatcaaagtcgacgaagccggttttgaagccgctatggaagagcaacgccgtcgcgcgcgcgaagctagcggttttggcgcggactacaacgcgatgatccgcgttgatagcgcttctgaatttaaaggttatgaccatctggaactgaacggcaaagtgactgcgctgtttgtcgatggtaaagcggttgaagcgattaacgcgggacaggaagcggttgtcgtgctggatcagaccccattctatgcggaatcaggcggtcaggttggcgataaaggcgagctgaaaggcgctggatttactttcgctgtggacgacacgcaaaaatatggtcaggcgattggtcacctcggtaaattgtctgcgggcgctctgaaagtgggcgatgcggtacaggctgacgtagatgaagcgcgccgcgcacgtatccgtctgaaccactccgccacgcacctgatgcacgcggcgttgcgccaggtgcttgggacacacgttgcgcagaaaggttcgctggttagcgataaagtgctgcgcttcgacttctcgcacaatgaagcgatgaagccgtcggagattcgtgaggttgaagatttggtgaatgcgcaaattcgccgcaacctgccgattgaaacgaacatcatggatctcgacgcggcgaaggcgaaaggggccatggcgctgtttggcgagaaatacgacgaacgtgtacgcgttctgagcatgggcgatttttctaccgaactgtgcggcggtactcacgccagtcgtaccggtgatatcggtctattccgtattatctctgagtccggcaccgcagcgggcattcgtcgtattgaggcggtaaccggtgaaggcgctatggccaccgttcatgcgcaaagcgatcgcttaaacgatattgcgcatctgctgaagggcgacagccagaatctgggcgacaaagtgcgtgccgtgctggaacgtacacgtcagctggaaaaagagttgcagcagttgaaggaccaggccgcagcgcaggagagtgcaaatctttccagtaaagcggtcgatctcaacggcgtgaagctcctggtcagcgagcttgctggtattgagccgaaaatgctgcgaaccatggttgatgatctgaaaaatcaactggggtctaccgttatcgtactggcaacggttgttgaaggtaaggtttctctgattgcgggcgtgtcgaaggatgtgaccgaccgggttaaagcaggggaattgattgggatggtcgctcagcaggtgggcggtaagggtggcggtcgtccggacatggcgcaagccggtggtacggatgcggcagctctgcctgcagcgttagccagtgtacaaggctgggtcagcgcaaaattgcaataa

SEQ ID NO: 1039 - DNA, 2631 bp, Salmonella enterica serovar Heidelberg SL476
atgagcaagagcaccgctgagatccgtcaggcgtttctcgactttttccatagtaaagggcatcaggtagttgccagcagttccctggtgcctaacaatgaccccactctgttgtttaccaatgccgggatgaaccagttcaaggatgttttccttgggctcgataaacgtaattattcccgtgcaaccacttcccagcgttgcgtacgcgcggggggtaaacacaacgatctggaaaacgtcggatacactgcacgtcaccatactttcttcgaaatgctgggcaacttcagcttcggcgattacttcaaacacgacgccattcagttcgcatgggaattactgaccggtgaaaactggtttgctctgccaaaagagcgtttatgggtcaccgtctatgaaaccgacgacgaagcctatgagatctgggaaaaagaagtcggcatcccgcgcgagcgtattatccgtattggcgacaataaaggcgcgccatacgcatcggataacttctggcagatgggcgataccggtccctgcggtccgtgcaccgaaatcttctacgatcatggcgaccacatctggggcggccctccgggaagcccggaagaggacggcgatcgctatattgaaatctggaacatcgtctttatgcagttcaaccgtcaggctgacgggacgatggaaccattgccgaaaccgtctgtagataccggtatggggctggagcgtattgccgcggtactgcaacacgttaactctaactatgacatcgacctgttccgcacgttgattgaagcggtagcgaaagtcaccggcgccaccgatttgggtaataaatcgctgcgcgttatcgccgaccacatccgttcttgcgcattcctggttgccgatggcgtgctgccgtcgaatgaaaaccgtggctatgtgctgcgtcgcattattcgtcgcgcggttcgtcacggcaacatgctgggcgcgaaagagaccttcttctacaagctggttgggccgctgattgaggtaatgggctccgcaggcgaagagttgaaacgtcagcaggcgcaggtcgaacaggttctgaaaacggaagaagagcagttcgcccgtacgctggagcgcggtctggcgctgctggatgaagaactggcgaaattgcagggcgacaccctggacggcgaaaccgctttccgtctgtatgatacttatggtttcccggtcgatctaacggcggacgtctgccgtgagcgcaacatcaaagtcgatgaagccggttttgaagccgctatggaagagcaacgccgtcgcgcgcgcgaagctagcggttttggcgcggactacaacgcgatgatccgcgttgatagcgcttctgaatttaaaggttatgaccatctggaactgaacggcaaagtgactgcgctgtttgtcgatggtaaagcggttgaagcgattaacgcgggacaggaagctgttgtcgtgctggatcagaccccattctatgcggaatcaggcggtcaggttggcgataaaggcgagctgaaaggcgctggatttactttcgctgtggacgacacgcaaaaatatggtcaggcgattggtcacctcggcaaattgtctgcgggcgctctgaaagtgggcgatgcggtacaggctgacgtagatgaagcgcgccgcgcacgtatccgtctgaaccactccgccacgcacctgatgcacgcggcgttgcgccaggtgcttgggacacacgttgcgcagaaaggttcgctggttagcgataaagtgctgcgcttcgacttctcgcacaatgaagcgatgaagccgtcggagattcgtgaggttgaagatttggtgaatgcgcaaattcgccgcaacctgccgattgaaacgaacatcatggatctcgacgcggcgaaggcgaaaggggccatggcgctgtttggcgagaaatacgacgaacgtgtacgcgttctgagcatgggcgatttttctaccgaactgtgcggcggtactcacgccagtcgtaccggtgatatcggtctattccgtattatctctgagtccggcaccgcagcgggcattcgtcgtattgaggcggtaaccggtgaaggcgctatggccaccgttcatgcgcaaagcgatcgcttaaacgatattgcgcatctgctgaagggcgacagccagaatctgggcgacaaagtgcgtgccgtgctggaacgtacacgtcagctggaaaaagagttgcagcagttgaaggaccaggccgcagcgcaggagagtgcaaatctttccagtaaagcggtcgatctcaacggcgtgaagctcctggtcagcgagcttgctggtattgagccgaaaatgctgcgaaccatggttgatgatctgaaaaatcaactggggtctaccgttatcgtactggcaacggttgttgaaggtaaggtttctctgattgcgggcgtgtcgaaggatgtgaccgaccgggttaaagcaggggaattgattgggatggtcgctcagcaggtgggcggtaagggtggcggtcgtccggacatggcgcaagccggtggtacggatgcggcagctctgcctgcagcgttagccagtgtacaaggctgggtcagcgcaaaattgcaataa

SEQ ID NO: 1040 - DNA, 2631 bp, Salmonella enterica serovar Schwarzengrund CVM19633
atgagcaagagcaccgctgagatccgtcaggcgtttctcgactttttccatagtaaagggcatcaggtagttgccagcagttccctggtgcctaacaatgaccccactctgttgtttaccaatgccgggatgaaccagttcaaggatgttttccttgggctcgataaacgtaattattcccgtgcaaccacttcccagcgttgcgtacgcgcggggggtaaacacaacgatctggaaaacgtcggatacactgcacgtcaccatactttcttcgaaatgctgggcaacttcagcttcggcgattacttcaaacacgacgccattcagttcgcatgggaattactgaccggtgaaaactggtttgctctgccaaaagagcgtttatgggtcaccgtctatgaaaccgacgacgaagcctatgagatctgggaaaaagaagtcggcatcccgcgcgagcgtatcatccgtatcggcgacaataaaggcgcgccatacgcatcggataacttctggcagatgggcgacaccggtccctgcggtccgtgcaccgaaatcttctacgatcatggcgaccacatctggggcggccctccgggaagcccggaagaagacggcgatcgctatattgagatctggaacatcgtctttatgcagttcaaccgtcaggctgacgggacgatggaaccattgccgaaaccgtctgtagataccggtatggggctggagcgtattgccgcggtactgcaacacgttaactctaactatgacatcgacctgttccgcacgttgattgaagcggtagcgaaagtcaccggtgccaccgatctgggtaataaatcgctgcgcgttatcgccgaccacatccgttcctgcgcattcctggttgccgatggcgtgctgccgtcgaatgaaaaccgtggctatgtgctgcgtcgcattattcgtcgcgcggtgcgtcacggcaacatgctgggcgcgaaagagaccttcttctacaagctggttgggccgctgattgaggtaatgggctccgcaggcgaagagttgaaacgtcagcaggcgcaggtcgagcaggttctgaaaacggaagaagagcagttcgcccgtacgctggagcgcggtctggcgctgctggatgaagaactggcgaaattgcagggtgataccctggacggcgaaaccgctttccgtctgtatgatacttatggtttcccggtcgatttaacggcggacgtctgccgtgagcgcaatatcaaagtcgacgaagccggttttgaagcagccatggaagagcaacgccgtcgcgcgcgcgaagctagcggttttggcgcggactacaacgcgatgatccgcgttgatagcgcttctgaatttaaaggttatgaccatctggaactgaacggcaaagtgactgcgctgtttgtcgatggtaaagcggttgaagcgattaacgcgggacaggaagcggttgtcgtgctggatcagaccccattctatgcggaatcaggcggtcaggttggcgataaaggcgagctgaaaggcgctggatttactttcgctgtggacgacacgcaaaaatatggtcaggcgattggtcatatcggcaaattgtctgcgggcgctctgaaagtgggcgatgcggtacaggctgacgtagatgaagcgcgccgcgcacgtatccgtctgaaccactccgccacgcacctgatgcacgcggcgttgcgccaggtgcttgggacacacgttgcacagaaaggttcgctggttagcgataaagtgctgcgcttcgacttctcgcacaatgaagcgatgaagccgtcggagattcgtcaggttgaagatttggtgaatgcgcaaattcgccgcaacctgccgattgaaacgaacatcatggatctcgacgcggcgaaggcgaaaggcgccatggcgctgtttggcgagaaatatgacgaacgtgtacgcgttctgagcatgggcgatttctctaccgaactgtgcggcggtactcacgccagtcgtaccggtgatatcggtctattccgtattatctctgagtccggcaccgcagcgggcattcgtcgtattgaggcggtaaccggtgaaggcgctatggccaccgttcatgcgcaaagcgatcgcttaaacgatattgcgcatctgctgaagggcgacagccagaatctgggcgacaaagtgcgtgccgtgctggaacgtacacgtcagctggaaaaagagttgcagcagttgaaggaccaggccgcagcgcaggagagtgcaaatctttccagtaaagcggtcgatctcaacggcgtgaagctcctggtcagcgagcttgctagtattgagccgaaaatgctgcgaaccatggttgatgatctgaaaaatcaactggggtctaccgttatcgtactggcaacggttgttgaaggtaaggtttctctgattgcgggcgtgtcgaaggatgtgaccgaccgggttaaagcaggggaattgattggtatggtcgctcagcaggtaggcggtaagggtggcggtcgtccggacatggcgcaagccggtggtacggatgcggcagctctgcctgcagcgttagccagtgtacaaggctgggtcagcgcaaaattgcaataa

SEQ ID NO: 1041 - DNA, 2598 bp, Alteromonas macleodii  Deep ecotype
atgacattatcaactgctgacttacgtaacaagtttatcaattattttaaaagtcatggccatcaggcggtggcaagctcgtcactggtgccggcagatgatcccacacttcttttcaccaatgcgggaatgaaccagtttaaagatacgtttctaggtaccgaaaagcgtagctatacccgtgcagtatcgtctcagcgttgtgtacgggcagggggcaaacacaatgaccttgaaaatgtaggttatacagcccgccaccataccttctttgaaatgatgggtaacttcagttttggcgactatttcaagaaagaagcgattgaatttgcgtggaactttctaacaagtgaagttgggcttcctaaagaaaagctattagtaaccgtttactctgaagatgatgaagcgttcgatatttgggaaaaccacattggtgtgcctaaagagaaaattatccgtattagtacgtcagataacttttggtcaatgggcgatacaggcccatgtggtccttgctctgagatcttttacgatcacggcgcgcacatttggggtggtcctccaggaacacctgaagaagacggtgaccgctttatcgaaatctggaacctggtattcatgcagtttaataagcaagctgacggtaccatggagccgcttccaaagccgtcgatcgatactggtatgggtctagagcgtatttcagctattttgcaaaacgttcacagcaactacgaaatcgatttgtttcagaatttaattaagtctgcagcctcaatcgttggcacagaggatcttgaaaataaatcgctacgggttatcgccgatcacattcgttcgtgcagcttcttaatttgcgatggcgttatgccatcaaatgaagggcgcggatacgtattacgccgtattatacgtcgcgcggtacgccatgggtatcagcttggcgccaacgacatcttcttctataaactggttgcttctcttgctaatgaaatgggtgaagcgtatccagagctagttgaccagcttccggttattgaaaaagtactgcgcgtagaagaagagcagtttagtaaaacgctcgcacgcggtatggcaatgctaaacgacacactcgcctcgcttgaaggtgatactgtgccgggtgatgtggtatttaaactgtacgatacttacggatttccaacagaccttactaacgacgtggctcgagagcacgagcttaaaattgacgaagaaggttttgaagcggcaatgcaggctcagcgcgctcgcgcacagcaagcaagcaactttggggcagattacaacagcaaacttgccatcgaccatacaacgtcgtttacgggctataccgatgtggaaggccaggcgaatgtggttgagctaattgcggacaacgcatttgttgaaaaattagaagatggccaagaaggcgtagtggtgttagacagcacgccgttctacgcggaaagcggtggtcaggcaggtgacaaaggggtgctgcgcgttgccaacggtgaattcattgtcactgatacccagaaaatgggtaacgcgtttgcgcacaaaggaatagcgaaaggctctgtttctaagggcgatacagcaaccgccgccatagattcggctaaccgcgaagccattaagaaaaatcacagtgctacccatttgcttcacgcggcgctgcgcgaaattttaggtgagcacgtaacgcagaaaggttcattggttgaagcgccgcgtatgcgttttgacttctcgcactttgaagccgttactacagaacagcttgcagagattgaacgacgcgtgaatcaagaaatacgcgcaaatcattcactggctactgaactaatggacctagaagaagccaaagcctcaggtgcaatggcgctgtttggcgaaaagtacgacgagaaagttcgcgtggtaactatggggccattctctgttgagctatgtggtggtactcacgtagcgcgaactggcgacattggtttgtttaaaattaccagtgaagcgggcattgcatcgggtgttcgacgcatcgaagcggtcactggcgagcaagcaattgaagtcgtgcaaacgcaacaagcgacgctgtcgtcgttgtcgtcattattaaaaacagatagccaaaatgtacttgaacgcgtagtttctctacaaaatcagactaaagaactagaaaaagcgctcaattctgcaaaacaaaaactggcgagtcagcaaggtgctgatatgcttagtaatgcagtagagataaatggcgttaaagtgctaatcgctaatttggaaggtgtcgaagcgaagtcattgcgttcaatgatggacgatattaaaaaccgaattggcgaaggtatcgtagtactaggtgtggctaacaatgcgaaagtgaacctcattgctggcgtgactaaaaatctcactgataaagttaaagcgggcgagttagttaactttgtcgcatcacaagtaggtggtaaaggcggcggtcgccctgatatggctcaagcgggtggcgataagcctgaaaacttggggcaagcgttagattcggttaacgtttggttacaagataagctataa

SEQ ID NO: 1042 - DNA, 2628 bp, Geobacter bemidjiensis Bem
atgacaggcaaagagatccgggctcagttcttcaacttctttcagaaaaaagggcatgcccttgtggagagctcgaacctcatcccacgcaacgaccctaccctcctcttcaccaacgccggcatgaaccagttcaaggacgtcttcctcggcatggagaaaagggattacctgagggcggtctcctcccagaaatgcgtgcgcgccggcggcaagcacaacgacctcgagaacgtgggtcgcaccgccaggcatcacacctttttcgagatgctggggaatttctccttcggcgactatttcaagaaggaggcgatcggctttgcctgggaattcctgaccaaggaactcggcctctccaaggaccgcctctacgtcaccgtctacaccgacgacgacgaagcggccgacatctggcacaaccaggaaggggtgccgcgcgagcgcatctaccgcttcggcgagaaggacaacttctggtccatgggcgacaccggcccctgcggcccctgcaccgagatcttctgggacaacggcccgggaaccggctgcggcagccccgactgcgcggtaggatgcgattgcgaccgctacatggagatctggaacaacgtcttcatgcagttcaaccgcggcaaggacggcgtcctgaccccgctcccgaaaccttccgtcgacaccggcatgggccttgagcgcatctcggccgtcatgcagggggtcacctccaactacgacacggacctcctgcaggggatcatccgccacatcgagcaggtctccgggaagaagtaccgggacgacgagaaggatgacgtctccatgcgcgtcatcgccgaccacgcccgcgccgtcaccttcctgatctgcgacggcgtcctccccagcaacgaggggcgcggctacgtgctcaggcgcatcatgcgccgcgccgcccgccacgcgaagatgctgggaatcgccgagccggtcctcttccgcatcgtcgacgcggtgaacatgatgatgggcgacgcctacccggagcttctggagcgcgagcattacgtaaagaaggtgatcctggccgaggaggagcgcttcatcgagaccctcgaccgcggcctcgccatcttgaacgaggagacggcggcgctcaaggccaagggagagaaggtcatctccggcgaggtcatcttcaagctctacgacaccttcggcttcccggtcgacttgaccgccgacatcgtcgagtccgaaggattcaccctcgacgaggacggcttcgccctctgcatggagaagcagcgcgtcaaagcgagggagaactggaaggggtccggcgagcaggggctggccgacatctacaaggagctgcacggcaccggcatcaccaccgacttcctgggctacagcgagcagaccgccttctccaccatcagcgccatcgtcaagggtgggaccctggtcgaagaggcgagcgccggcgacgagatcgagatcgtcaccgcggcgaccccgttctacggcgagtccggcgggcaggccggcgacaccggaaccatctccaccggctccggccacatcgaagtgaccggctccacccgccccttcaccgacctcatcgtgcaccgcggccgcgtggtctccggcgccgtcaggaccggcgaagcggcagacctgaagatcaccgtcgccaaccgcgccgcaacggccagaaaccacacggcgacccacctcttgcaggcggcgctccgggaggtgctgggcgatcacgtgaagcaggcaggctccctggtgaccccggaccggctccgcttcgacttcacccacttcaccccgatgacccaggaggagatccgcagggtcgagatcctggtgaacggccacatcatggggaactccacggttgagtcccgcgagatgccggcggcagacgcgcttgccgcaggcgccacagcgctcttcggcgagaagtacggcgacgtggtccgcgtggtcaaggtgggagacgtctccagcgaactctgcggcggcacccacgtccacggcgccggcgagatcggcttcttcaagatcatctccgaggcggggatcgccgcgggggtccggaggatcgaggcgcagaccggcagcggcgcgctggcggtggtgcacggaatggaagacgagcagcgcggcatcgccacccttctgaaggctgaagggggaaccgtcctggacaaggtcgagaaactggtggccggccagcgcgagctgcaaaaggagctcgaaacgctgcaggcgcgtctgaacgcctccaagtccgcagacctgatccagcaggtgcgcgagcaaaacggcatcaagatcctgtcggtaaaggtcgacggggacgctaaggggttgagggaactctccgacacgctgaagcagcgcatcggctccggcatcatcgtccttgggaccagcgacgccgcgagggcgaacctcctggtggcggtgacggccgatctctcggcgcgctggaaggcgggggacatcatcaaggccatcgccccgatagtcgggggcaacggcggaggaaagcccgagctggcgcaggcgggaggctccaagccggaacacctggccgaggcgctagaggcggtgtaccagatagtggggtaa

SEQ ID NO: 1043 - DNA, 2631 bp, Salmonella enterica serovar Agona SL483
atgagcaagagcaccgctgagatccgtcaggcgtttctcgactttttccatagtaaagggcatcaggtagttgccagcagttccctggtgcctaacaatgaccccactctgttgtttaccaatgccgggatgaaccagttcaaggatgttttccttgggctcgataaacgtaattattcccgtgcaaccacttcccagcgttgcgtacgcgcgggggggaaacacaacgatctggaaaacgtcggatacactgcacgtcaccatactttcttcgaaatgctgggcaacttcagcttcggcgattacttcaaacacgacgccattcagttcgcatgggaattactgaccggtgaaaactggtttgctctgccaaaagagcgtttatgggtcaccgtttatgaaaccgacgacgaagcctatgagatctgggaaaaagaagtcggcatcccgcgcgagcgtatcatccgtatcggcgacaataaaggcgcgccatacgcatcggataacttctggcagatgggtgataccggtccctgcggtccgtgcaccgaaatcttctacgatcatggcgaccacatctggggcggccctccgggaagcccggaagaagacggcgatcgctatattgagatctggaacatcgtctttatgcagttcaaccgtcaggctgacgggacgatggaaccattgccgaaaccgtctgtagataccggtatggggctggagcgtattgccgcggtactgcaacacgttaactctaactatgacatcgacctgttccgcacgttgattgaagcggtagcgaaagtcaccggcgccaccgatctgggtaataaatcgctgcgcgttatcgccgaccacatccgttcttgcgcattcctggttgccgatggcgtgctgccgtcgaatgaaaaccgtggctatgtgctgcgtcgcattattcgtcgcgcggttcgtcacggcaacatgctgggcgcgaaagagaccttcttctacaagctggttgggccgctgattgaggtaatgggctccgcaggcgaagagttgaaacgtcagcaggcgcaggtcgagcaggttctgaaaacggaagaagagcagttcgcccgtacgctggagcgcggtttggcgctgctggatgaagaactggcgaaattgcagggcgacaccctggacggcgaaaccgctttccgtctgtatgatacttatggtttcccggtcgatctaacggcggacgtctgccgtgagcgcaagatcaaagtcgatgaagccggttttgaagccgctatggaagagcaacgccgtcgcgcgcgcgaagctagcggttttggcgcggactacaacgcgatgatccgcgttgatagcgcttctgaatttaaaggttatgaccatctggaactgaacggcaaagtgaccgcgctgtttgtcgatggtaaagcggttgaagtgattaacgcggaacaggaagcggttgtcgtgctggatcagaccccattctatgcggaatcaggcggtcaggttggcgataaaggcgagctgaaaggcgctggatttactttcgctgtggacgacacgcaaaaatatggtcaggcgattggtcatatcggcaaattgtctgcgggcgctctgaaagtgggcgatgcggtacaggctgacgtagatgaagcgcgccgcgcacgtatccgtctgaaccactccgccacgcacctgatgcacgcggcgttgcgccaggtgcttgggacacacgttgcgcagaaaggttcgctggttagcgataaagtgctgcgcttcgacttctcgcacaatgaagcgatgaagccgtcggagattcgtcaggttgaagatttggtgaatgcgcaaattcgccgcaacctgccgattgaaacgaacatcatggatctcgacgcggcgagggcgaaaggggctatggcgctgtttggcgagaaatacgacgaacgtgtacgcgttctgagcatgggcgatttctctaccgaactgtgcggcggtactcacgccagtcgtaccggtgatatcggtctattccgtattatctctgagtccggcaccgcagcgggcattcgtcgtattgaggcggtaaccggtgaaggcgctatggccaccgttcacgcgcaaagcgatcgcttaaacgatattgcgcatctgctgaagggcgacagccagaatctgggcgacaaagtgcgtgccgtactggaacgtacacgtcagctggaaaaagagttgcagcagttgaaggaccaggccgcagcgcaggagagtgcaaatctttccagtaaagcggtcgatctcaacggcgtgaagctcctggttagcgagcttgctggtattgagccgaaaatgctgcgaaccatggttgatgatctgaaaaatcaactggggtctaccgttatcgtactggcaacggttgttgaaggtaaggtttctctgattgcgggcgtgtcgaaggatgtgaccgaccgggttaaagcaggggaattgattggtatggtcgctcagcaggtgggcggtaagggtggcggtcgtccggacatggcgcaagccggtggtacggatgcggcagctctgcctgcagcgttagccagtgtacaaggctgggtcagcgcaaaattgcaataa

SEQ ID NO: 1044 - DNA, 2634 bp, Acidithiobacillus ferrooxidans ATCC 53993
atgcaagcgcaagccattcgccaagcttttctggagtattttgtggaacaggggcatcagatcgtgccctccagccccctgatccctcgtaacgatccgaccctgctgtttaccaatgccggtatggtgcccttcaaggacgtgtttcttggcctggaaacccgtccctaccggcgcgccgtttcctcgcagcgttgcatgcgcgcgggtggcaaacacaacgatctggaaaatgtcggctacacagcgcggcaccataccttcttcgagatgctgggcaacttctcttttggcgactatttcaagcgtgaagtgatcggctttgcctggcgtttcctcaccgaacgtctgggcctgccgccggaaaagctctggattacggtttacgaggaggatgatgaggcggccgacatctggatgaacgagatcggtatcgatcccgcgcgcctctcccgctgcggcgaaaaggacaacttctggagcatgggcgacaccggcccctgcggcccctgttcggagattttctatgaccacggcccccatattcccggaggccctccgggcagtccggaggaagacggcgatcgctatatcgaaatctggaatctggtcttcatgcagtttgaccgggacagcagcggcaccctgacccctctgccaaaaccctccgtcgataccggcatgggtctggagcgtctcgcggccgtgctccagggcgtacataacaactatgacaccgatctcttcaagccgctgattgccgcagcagccaccatcagcggcaaaacatatgggagcgatgcggcgacggacatcagtttgcgggtgctggcggatcacatccgtgcctgcagctttctcatcaccgatggcgtcctgcccgccaacgaaggccgcggctatgtgctgcgccgcatcatccgccgcgccgtgcgtcatggccgcaagctgggcatggagacggtatttttccatcaactggtggcgccgctggtggcggagatgggcagtgcctttcccgaactcacgcgggcacagcgcgaagtggagcgcgctctggagcgtgaggaaacccgtttccgggaaacgctggagcgcggactcagtctgctggaggaggccattgcggatcttgcagcgggtgccgccattcccggcgagatcattttccggctcgcagatacctttggtttccccgtcgatctaaccgctgatatcgcccgcgagcgcgatctgatcatggatatggagggctacgaggcggctatggcggagcagcgcagccgctcccgtgccgcctgggcgggcagcggtgaggtcaagaccgagcgggtgtaccacgatctggccatgcggctgccggttaccgagttcaccggctattcgacctgtgccgatgaggggaaggtggtggcgctgatccgcgatggtgaagaggtggccttcctcgaagcgggggacatgggagtggttattctcgatcggacgcccttttacggggagtccggcgggcaggcgggagaccgtggcgagctccagtcggatgatgccctgtttgccgtgacggacacccaaaagcccatgggtcacctgcatgtgcatttggggcgcatggaatccgggcgcctgcgggtcggcgatatggtggttgccagcatcgacgaagtggccagacgggcgacggccgcacatcactccgcgacccacctgctccatgccgccttgcgcaacattctcggcagtcatgtgcagcagaagggttcgctggtcaacccggagcggctgcgtttcgacttcagtcagccggagccggtgacggccgcacagttgcgggaaatcgagcgcgtggtcaacgccgctatccgtaataatgtcggcgccgaaacccggatcctgcctgtcgccgaggcacaggccctgggtgccatggcgctcttcggcgagaagtacggagacgaggtgcgggtggtgcgcatgggtgacttctccatggaactctgtggcggcacccatgtggaggcgctgggcgatataggtgttttcaagatcctcagcgaaagcggcgtggcagcgggtatccggcgtatcgaagcagtcaccggcgcggtggcgctggaggctattcagcgtgatgaagaacgcctgcaagcggcggccggactgttgaaagttgcccctgcagaactggaccaacgtctggcgcaaaccctggaacgcctgcgccagttagaaaaagagctggaaaaggtcaagcgggatgaagccgccagagcgggtgccgatcttgccgcagaggccgaggatgtgggcggagtaccggtattgatcaggcgcctggaggggatggatggcaaagccttgcgcgatgccctggatcgcctgcgcagtcagttacctgacggcgtcatcgtccttgcgggcgtggaaagggagaaagtggcgttgattgccggagtcggtaaaggattgactggacgggttcacgccggagaactggtgaacaccgtggcacaaccgttgggcggcaaggggggtgggcgtccggaactggcgcaggccggggccggcaatccggcggccttggatgccgccctcgccgccgcccgcgactgggtcaaaggcaaactcggctag

SEQ ID NO: 1045 - DNA, 2631 bp, Salmonella enterica serovar Dublin CT 02021853
atgagcaagagcaccgctgagatccgtcaggcgtttctcgactttttccatagtaaagggcatcaggtagttgccagcagttccctggtgcctaacaatgaccccactctgttgtttaccaatgccgggatgaaccagttcaaggatgttttccttgggctcgataaacgtaattattcccgtgcaaccacttcccagcgttgcgtacgcgcgggggggaaacacaacgatctggaaaacgtcggatacactgcacgtcaccatactttcttcgaaatgctgggcaacttcagcttcggcgattacttcaaacacgacgccattcagttcgcatgggaattactgaccggtgaaaactggtttgctctgccaaaagagcgtttatgggtcaccgtctatgaaaccgacgacgaagcctatgagatctgggaaaaagaagtcggcatcccgcgcgagcgtattatccgtattggcgacaataaaggcgcgccatacgcatcggataacttctggcagatgggcgataccggtccctgcggtccgtgcaccgaaatcttctacgatcatggcgaccacatctggggcggccctccgggaagcccggaagaagacggcgatcgctatattgagatctggaacatcgtctttatgcagttcaaccgtcaggctgaagggacgatggaaccattgccgaaaccgtctgtagataccggtatggggctggagcgtattgccgcggtactgcagcacgttaactctaactatgacatcgacctgttccgcacgttgattgaagcggtagcgaaagtcaccggcgctaccgatctgggtaataaatcgctgcgcgttatcgccgaccacatccgttcttgcgcattcctggttgccgatggcgtgctgccgtcgaatgaaaaccgtggttatgtgctgcgtcgcattattcgtcgcgcggttcgtcacggcaacatgctgggcgcgaaagagaccttcttctacaagctggttgggccgctgattgaggtaatgggctccgcaggcgaagagttgaaacgtcagcaggcgcaggtcgagcaggttctgaaaacggaagaagagcagttcgctcgtacgctggagcgcggtctggcgctgctggatgaagaactggcgaaattgcagggcgacaccctggacggcgaaaccgctttccgtctgtatgatacttatggtttcccggtcgatctaacggcggacgtctgccgtgagcgcaacatcaaagtcgacgaagccggttttgaagccgccatggaagagcaacgccgtcgcgcgcgcgaagctagcggttttggcgcggactacaacgcgatgatccgcgttgatagcgcttctgaatttaaaggttatgaccatctggaactgaacggcaaagtgactgcgctgtttgtcgatggtaaagcggttgaagcgattaacgcgggacaggaagctgttgtcgtgctggatcagaccccattctatgcggaatcaggcggtcaggttggcgataaaggcgagctgaaaggcgctggatttactttcgctgtggacgacacgcaaaaatatggtcaggcgattggtcacctcggcaaattgtctgcgggcgctctgaaagtgggcgatgcggtacaggctgacgtagatgaagcgcgccgcgcacgtatccgtctgaaccactccgccacgcacctgatgcacgcggcgttgcgccaggtgcttgggacacacgttgcgcagaaaggttcgctggttagcgataaagtgctgcgcttcgacttctcgcacaatgaagcgatgaagccgtcggagattcgtgaggttgaagatttggtgaatgcgcaaattcgccgcaacctgccgattgaaacgaacatcatggatctcgacgcggcgaaggcgaaaggggccatggcgctgtttggcgagaaatacgacgaacgtgtacgcgttctgagcatgggcgatttttctaccgaactgtgcggcggtactcacgccagtcgtaccggtgatatcggtctattccgtattatctctgagtccggcaccgcagcgggcattcgtcgtattgaggcggtaaccggtgaaggcgctatggccaccgttcatgcgcaaagcgatcgcttaaacgatattgcgcatctgctgaagggcgacagccagaatctgggcgacaaagtgcgtgccgtgctggaacgtacacgtcagctggaaaaagagttgcagcagttgaaggaccaggccgcagcgcaggagagtgcaaatctttccagtaaagcggtcgatctcaacggcgtgaagctcctggttagcgagcttgctggtattgagccgaaaatgctgcgaaccatggttgatgatctgaaaaatcaactggggtctaccgttatcgtactggcaacggttgttgaaggtaaggtttctctgattgcgggcgtgtcgaaggatgtgaccgaccgggttaaagcaggggaattgattgggatggtcgctcagcaggtgggcggtaagggtggcggtcgtccggacatggcgcaagccggtggtacggatgcggcagctctgcctgcagcgttagccagtgtacaaggctgggtcagcgcaaaattgcaataa

SEQ ID NO: 1046 - DNA, 2631 bp, Escherichia coli O157 H7 EC4115
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcaccataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggaaaaagaagtagggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttggggtggccctccgggaagtccggaagaagacggcgaccgctacattgagatctggaacatcgtcttcatgcagttcaaccgccaggccgatggcacgatggaaccgctgccgaagccgtctgtagataccggtatgggtctggagcgtattgctgcggtgctgcaacacgttaactctaactatgacatcgacctgttccgcacgttgatccaggcggtagcgaaagtcactggcgcaaccgatctgagcaataaatcgctgcgcgtaatcgctgaccacattcgttcttgtgcgttcctgatcgcggatggcgtaatgccgtccaatgaaaaccgtggttatgtactgcgtcgtatcattcgtcgcgcagtgcgtcacggtaatatgctcggcgcgaaagaaaccttcttctacaaactggttggtccgctgatcgacgttatgggctctgcgggtgaagacctgaaacgccagcaggcgcaggttgagcaggtgctgaagactgaagaagagcagtttgctcgtactctggagcgcggtctggcgttgctggatgaagagctggcaaaactttctggtgatacgctggatggtgaaactgctttccgtctgtacgacacctatggcttcccggttgacctgacggctgatgtttgtcgtgagcgcaacatcaaagttgacgaagctggttttgaagcagcaatggaagagcagcgtcgtcgggcgcgcgaagccagcggctttggtgccgattacaacgcaatgatccgtgttgacagtgcatctgaatttaaaggctatgaccatctggaactgaacggcaaagtgaccgcgctgtttgttgatggtaaagcggttgatgccatcaatgcaggccaggaagctgtggtcgtgctggatcaaacgccattctatgcggaatccggcggtcaggttggtgataaaggcgaactgaaaggcgctaacttctccttcgtggtggaagatacgcagaaatacggccaggcgattggtcacatcggtaaacttgctgcgggttctctgaaagtgggcgacgctgtgcaggctgatgttgatgaggctcgtcgcgcccgtattcgtttgaatcactccgcaacgcacctgatgcacgctgcgctgcgccaggttctggggactcatgtatcgcagaaaggttcactggttaacgacaaggtgctgcgcttcgacttctcacacaacgaagcgatgaaaccggaagagattcgtgcggtcgaagacctggtgaacgcacagattcgtcgcaatttgccgatcgaaaccaacatcatggatctcgaagcggcgaaagcgaaaggtgcgatggcgctgttcggcgagaagtatgatgagcgtgtacgcgtgctgagcatgggcgatttctccaccgagctgtgtggcggtactcacgccagccgcactggtgatattggtctgttccgcatcatctctgaatcgggtactgctgcaggcgttcgtcgtatcgaagcggtaaccggagaaggcgctatcaccaccgttcatgcagacagcgatcgcttaagcgaagtcgcgcatctgctgaaaggcgatagcaataatctggcggataaagtgcgctcagtactggaacgtacgcgtcagttagaaaaagaactacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagccgaaggtaaggtttctctgattgcaggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 1047 - DNA, 2625 bp, Shewanella baltica OS223
atgtatcaaactacagcagagcttagaagcgctttcctcgaatttttccgcagcaatggtcatcaagttgtggacagtagttcattagtgccaggcaacgatcccacacttttatttaccaatgcaggcatgaaccagttcaaggacgtgtttcttggcatggacaaacgcaattatacgcgtgcgaccactgctcaacgttgtgtacgcgccggtggtaagcataacgatttagataacgtcggttatacagcacgtcatcacacctttttcgaaatgctgggtaacttcagttttggtgattatttcaaagaagaagcgattcgctttggctggactttcttaactgaaacgttaaagctgccgaaagaacgtctgtgtgtcactatttatcaaacagatgatgaagcctttgaaatctggaataaaaagattggtgttgctgctgagaacattatccgtatcggcgacaacaaaggtgctgcttatgcgtcagataacttctggcaaatgggtgataccggtccttgcggcccatgttctgagattttctatgatcatggcgatcacatttggggcggccgtcctggcagtcctgaagaagatggcgaccgcttcatcgaaatctggaacatagtgttcatgcagtacaaccgtcaagcatcgggtgaaatgttgcctttgcctaagccatcggttgataccggcatggggattgagcgtattgccgcgattatgcaaggcgtacattctaactacgaaatcgatatcttccgtacgctgatagccaaagcggcagaaatcatcggcgtaagcgatttaaccgagaagtcactgcgcgtcattgccgaccatatccgttcatgtgcattccttattgccgatggtgttatgccgtcgaacgaaggccgcggttatgtgctgcgccgtattatccgccgcgcagttcgccatggtaacaagttaggcgcgaccgaagctttcttctataagctggttccgtctttgattgctgtgatgggcgatgcggccaaagggttagctgagactcaagcgattgttgaaaaagctctgaaagcggaagaagagcaatttgctcgtacgcttgaacgtggtttaggcattttagatgcggccttaaacgagttaaaaggtgacaccttagatggtgaaaccgtatttaagctgtatgacacctatggcttcccaatggatttaaccgctgacgtatgtcgcgagcgcaacatcattgtcgatgaagcaggtttcgaagtcgctatggctgaacaacgtagccgcgcacaagctgccggtaactttggtgcagattataacgcggcactgaaaattgatgccgaaaccgcattcagtggttacaccgaattagcgggtcaagctaagatcactgcgatttatcaaaacggtgagtcagtgacggcgatcaaagcgggtgacgaagcggttgttgtactcgacgtgacacctttctacgcggaatctggcggtcaagtgggcgataaaggccaactggttgcgaacggtgttgagtttacggttaatgacacacaaaagtatggtcaagcaacgggccatcaaggtgttttagctacaggtagcttgagtgttggccaagttgttgaggcgaaagtcgacaaaaaactgcgtcaccgtactcagttaaaccattctgttacgcatttactgcatgccgcactgcgtcaagtgctcggtactcacgtttcgcaaaaaggttctttggttgatcctgagcgtttgcgttttgacttctcccatttcgaaggtgtaaaagccgctgaattaaaagaagttgaagaattagttaacactcaaattcgtcgtaaccatgagctgaaaaccgctgaaatgggtatagatgaagccaaagagaaaggcgcaatggcgctctttggtgagaaatatgactcacaagtgcgtgttgtgactatgggtgatttctctatcgaattgtgtggtggtacccatgtgggccgcacgggcgatattggcttattcaaaatcacttctgaagcgggtattgctgcgggtgtgcgtcgtatcgaagccgttactggcgctgcggctatggcttatgtggcgcagcaacaagctgaactggaagaagctgcagccttattgaaaggcgatgccaactcagtggtggctaagttaaaagcccagctcgataagatgaagcaactcgaaaaagaaatggcgcagttgaaagacaagctagctgccgcagcgagtgctgatttagtgggtgatgctattgtggttaatggcgttaacgtgctgatcaaaaagttagacggcgttgaggcaagctcgttacgcggtctgcaagatgaattaaaacaaaaattgaaatcggccattatcgttcttggcactgcgcaggaagggaaagttaacctgattgccggtgtgagtaacgatctgatcggcaaagtcaaagcgggtgagctagtcgctatggtcgctgcacaagtgggcggtaaaggcggcggtcgtcctgatatggctcaagcgggcggtagccagccagaaaatctggatgcggcattggctcaagtattaccttggattactgagcgtctagcttaa

SEQ ID NO: 1048 - DNA, 2634 bp, Acidithiobacillus ferrooxidans ATCC 23270; identical to SEQ ID NO: 1044

SEQ ID NO: 1049 - DNA, 2598 bp, Thioalkalivibrio HL EbGR7
atgaaaagcgccgacttaagaacgagcttcctcgaatacttcaggtccaagggccacgaggtggtgccttcgagcccgctgatcccgggcaacgatcccaccctgttgttcaccaatgccggcatggtgcagttcaaggatgtcttcctgggtcgtgagcagcgcccttacgtgcgcgccaccagctcccagcgctgcgtgcgcgccggcggcaagcacaatgatctcgaaaacgtgggctacaccgcacgtcaccacaccttcttcgagatgctgggcaacttcagcttcggcgactacttcaagcgcgaggccatccagtacgcctgggagtacctcacccaggtactcaagctgcccgaggaaaagctctgggtcacggtgttcgaggaggacgacgaggctgccgacatctggctcaaggacgtgggcgtcaatcccgagcgtttctcccgcatcggcgcctcggacaacttctggtccatgggcgataccggcccctgcggcccctgtaccgagatcttctacgaccacggccccgaggttcccggcggcccgcccggcacccccgaggcggacggcgaccgctacatcgagatctggaacctggtgttcatgcagtacgaccgggccaaggacggcaccctgaccccgctgccgcgtccctcggtggacaccggcatgggcctggagcgtctggccgccgtcatgcagggcgtgcactccaactacgagatcgacctgttccagaacctgatccgcgccatccgtgacatggcgaagggcgcggatcccacgagcccttccctgcgggtgatcgccgatcacatccgctcctgcagcttcctggtggccgacggcgtcatgcccgccaacgagggccgcggctacgtgctgcgccggatcatccgccgcgccgcccgtcacggccacaagctgggcctggatgagcccttcttccaccgtctggtgggccccctggtggccgagatgggcgaggcctacccggagctggtcaaggcccagcccatggtggagcgggtgctgcgccaggaagaggagcgcttcgccgagaccctggagaagggcctgcgcatcctggaagaggacatcgacgggctcaagggcaccgagatccccggcaagaccatcttcgtgctctacgacacctacggcttccccgtggacctgaccggcgacatcgcccgggagcggggcctgaccctggacatggccggtttcgaggcggagatggagattcagcgcgagcgcgcccgggccgccagccacttcgatgcggactaccaccgcaaactcaagatcgagggcgagagtgccttcaccggctacgaacacctggatggacagggccgggtcaccgccctgtttaaggacggcgaacccgtggacgcactggcatccggcgagcacggtctggtggtgctcgatgagacgcctttctacgcagaatccggcggccaggtgggtgataccggcgagttgctcgccgagggcgtgatcttcgaggtcaccgacacccgcaagcacggcgccgcccacgcccacatgggtcgcgtggtggaagggcgcattgcccagggcgacgtgctgggtgcgaaggtcaaccaggcccgccgccaggcggtggtcctgaaccattccgccacccacctgatgcacgccgcattgcgggagatcctgggcgatcacgtgcagcagaagggctccctggtggcccccgaccgtctgcgtttcgacttctcccatttccagcccgtgagcgccgaggaactggagcgcatcgagcgccgcgtcaatgaggccatccgcgccaatgccgaggccgaggcgcgcatcatgcccatcgaccaggccctggagtccggggcgatggccctgttcggcgagaaatacggcgatgaggtgcgggtgctgtccatgggcggcttctccacggagctttgcggcggcacccacgtgcgtcgcaccggcgacatcggcgtgttcaagatcctctccgagtccggcgtggcctcgggcatccgccgcatcgaggcggtcaccggcgagaacgccctgaactacatcggcgagacggaaaagaacctctcccgcatcgcggagatggtcaaggccggccgcggcgacctggacgagaaggtcgccctgctcgtggagcgcagccgccagctggaaaaggaactggaggccctcaagggcaagctggccagcgccgccggttccagcctcgccgatcaggccgtggaggtgaacggcatcaaggtgctggccgccaacctggaaggcgccgatcccaagtccctgcgcgacaccgtggaccagctcaagaacaagctgggcgaggccgccgtggtgctggccacggtcaaggacggcaaggtgagcctggtggccggcgtgacccagggccagaccgcgcgcctgaaggccggtgaactggtcaatgccgtggcccagcaggtgggtggcaagggcggcggacggccggacatggccatggccggcggcaccgacccctcgggactgcccggtgcgctggcctcggtgcccgactgggtccgcgaacggctgggctga

SEQ ID NO: 1050 - DNA, 2628 bp, Dickeya dadantii Ech703
atgagcaagagcaccgctgagatccgtcaagcgtttctcgacttttttcaaagcaaaggacatcaggttgttgctagcagctctctggtgccaaataacgatccgacattgctgtttaccaacgcggggatgaaccaattcaaggatgtattcctcggtctggataaacgtagctatgtgcgagcaaccaccgcccaacgttgtgtccgtgccggcggtaagcataacgatctggagaatgtcggttataccgctcgccaccatacgttctttgagatgctgggtaacttcagtttcggtgactatttcaagcatgatgccattctcaatgcatgggaattattgactgggccacagtggttcaacctgccaaaagaaaaattgtgggttacggtgtatgccaccgacgacgaggcctatgatatttgggccaatgttgttggaatccctcaggagcgcattattcgcatcggcgataacaaaggtgctccctatgcctcggataacttctggcagatgggcgatacggggccttgtggtccttgctcggaaattttttacgatcatggcgaccatatctggggcggaccgccgggaagtcccgaggaagatggcgatcgctatatcgaaatctggaatctggttttcatgcagtttaaccggcaggcggatggcactatgctgccgctgccgaagccgtcagttgatactggaatggggctggaacgtgtttccgccgttcttcagcatgtcaactccaactatgaaatcgatgtgtttcgcacattgattgccgaagcagccaaagtggttggtacccgcgatctgaacaacaaatcgttgcgggtcatcgccgatcatatccgttcctgtgctttcctgatcgccgatggcgttatgccgtccaacgaaaaccgtggctatgtgctgcgccgtattattcgtcgcgctattcgtcatggaaacatgttgggggcgaaggatacgtttttctacaagttggttgctcccttgatcgatgtcatgggaagtgcggccgatgagcttcggactcagcagaccgttgtcgagctggcgctgaaaagtgaagaggaacagtttgcccgcacgcttgagcgtggtttgtcgctgttggatgaagaaatcagaactctgcaaggcgataccctgagtggggaagctgcatttcgactgtatgatacctatggcttccctctggatttgactgcggatgtctgccgtgagcggggattgaaagtcgatgaaaccggctttgagcgcgaaatggaagcccaacgtcagcgtgcacgcgaagccagcggttttggtgctgattacaacagtttgatccgtgtcgatagtgcaaccactttctgtggctatgatcatgctgaacaacgttctcatgttgtagcgctgtatcggaaaggtgagcctgtgcaggaaatttctgccggtgatgaagccgtcgtcattctggatgaaacgccgttctatggcgagtctggcggtcaggttggcgatcagggcgtgttgaagggtgtatctgcatattttgttgttgatgatacccagaaatatgggcgggctttcggacatgtcggtaagttgacccagggttctttgcgcgtaaatgatgctgttgatgccgttgtagatgacgttcgccgcgaccgtattcgtttgaatcactcggctacccacttgttgcatgctgctttgcgtcaggttcttggaacacatgtcgcgcagaagggctctctggtgaatgaccgttatttgcgattcgatttttctcatccggaagcgatgaagccggatgaaatccgtcaggttgaagatattgtcaatgctcaggtacgacgcaacctgccggtggatacggcgattatggcgatcgatgatgcaagagctaaaggggcgatggcgctgtttggcgaaaagtatgacgatcaggttcgtgtcctgaccatgggcgatttttctattgaactgtgtggtggtattcatgctcgccgcactggtgatatcggtctatttcgcattgtttcagaatcggggacggctgcggggattcgccgtattgaagcggtaactggcgagggggctgttgcctcgttgcaccatcaaagcgatttactgcaagatgttacgctgcttgttaaaggcgacgcgaataaccttattgagaaggtgcgttcactgcttgagcgtaatcgcgggctggaaaaagagctgctgcagttgaaagaacagcaggctgcacaggaaagctcttcgcttgctggcaaggcaaaggatatcaacggcgtgaagttgctggtaacgcaattgagcaatgttgagcccaaaatgctgcggacgatggttgatgatttgaagaatcagctagggtcagcagtgatcgtgctatcaacgattgttgaaggcaaagtcagtctgattgccggagtgactcaggggctgacagagcgcgttaaagcgggagagttggtcggttttgtggctaatcaggttggtggtaaaggtggcggacgtcccgatctggctcaggcaggcggtagtgatgccgatgcattaccctctgcgctagctagcgttgaagcgtgggtcgctgataagttataa

SEQ ID NO: 1051 - DNA, 2628 bp, Dickeya zeae Ech1591
atgagcaagagcaccgctgagatccgtcaagcgtttctcgactttttccatagtaaaggacatcaggttgtcgccagtagttcactggtgccaaacaatgaccccacgctgctgtttaccaatgccgggatgaaccagttcaaggatgtgttcctggggctggataaacgtaactatgtacgcgctacgacgtctcaacgttgtgtccgtgccggcggtaaacataacgatctggaaaatgtgggttacactgcgcgccatcacaccttcttcgaaatgctgggtaacttcagcttcggtgattattttaaacgcgacgccattatttatgcctgggaactgttaaccagctctgaatggtttgggttgcccaaggaaaaattatgggtcacggtttatgccaccgatgatgaagcctatgacatttgggctaatgaggtaggcgtgccgcacgagcgtatcatccgcatcggggacaataaaggtgcgccgtatgcgtcggataacttctggcaaatgggtgataccggcccttgtggtccgtgctctgaaattttctacgatcatggcgatcacatctggggcggacctccaggaagcccggaagaagacggtgatcgctatattgagatttggaacctggtattcatgcagttcaaccgacaggctgacggtacaatgctgccgttgccgaaaccctcggttgataccggcatgggactggaacgtatttccgcagttctgcaacatgtcaattctaactacgacatcgatttgttcagtacgttgattgctgaagccgcccgtgtggtaggaaccgatgatctgaacaataaatcgttacgcgttatcgccgaccacatccgttcttgcgcgtttctgatcgcagatggcgtgatgccgtcgaatgaaaaccgcggttatgtattgcgtcgcattatccgccgcgctattcgccacggtaatatgctgggtgcgaaggaaacctttttctataagctggtggggccgctggttgatgttatggggtctgccgccgaggaactgaaacgccagcagagcctggttgaacaagcgcttaagaacgaagaagagcagttcgcccgcacgctggagcgcggcttgctgttactggatgaagagattaagcagcttaagggcgatacgctgagtggtgaagcggcattccgcctctatgatacctatggtttcccggttgatttgacggcggatgtttgccgtgagcgtaatctgaaagttgatgaggccggttttgagcgtgcgatggaagctcaacgccagcgtgcgcgtgatgccagcggtttcggtgctgattacaacagcctgattcgggtcgatgagtcgacaacgttctgtggctatgagcgtaccgaacagcagtctacggttgtggcgatttaccgtcagggtgaatccgtgcaggaaattcaggcgggcgacgatgcggttgtgatcctgagcgagacaccgttctatggtgaatcgggtggacaggttggcgaccaggggacgttggtttcggccgccgctcgtttttctgttgtcgacgcgcagaaatatggtcaggctatcgggcatgtcggttcattggttcagggcgttttgcgggtcaacgacaaggtggatgcggcagtggatcatgttcgccgcgatcgtattcgtttgaaccactctgcgacccatctgctgcacgccgctttgcgtcaggtcttgggcgaccatgtggcgcagaaaggctctttggtcaatgacaactacctgcgttttgacttctctcatccggaagcgatgaaaccggagcagattcgtcaggtagaagatatcgtcaatacccagattcgtcgcaatttgccggtagacacagacgtaatggcgctggatgcggccagagcgaaaggtgcaatggcgctctttggcgagaaatacgacgagcaggttcgtgtgttatcaatgggtgatttttccattgagttgtgtggcggtacacatgcccgtcgtactggcgatatcggtctgttccagattgtgtctgaatcaggtacggctgccggtgttcgccgtattgaggctgtgaccggcgagaatgccattgttgccttacaccagcaaagtgatgtgctgcatgaagtaacacagttggtgaagggggatagcaacaatctggccgataaagtccgttctttgctggagcgtactcgtgggctggaaaaagaattgcagcagttgaaggaacaacaagccgctcaggaaagttcttcattgtctggcaaggcaaaagatatcaacggcgtaaaactgctggtgactcagctaaacaacgttgaacctaaactgctgcgcacgatggttgatgatctgaagaaccaactgggttccgcggtgatcgtgctatcgacggtagctgacggcaaggtcagcttgatcgcgggtgtaaccaaagaattgaccgatcgcgtcaaagcgggtgagttggttggttttgtggcaaaccaggtcggtggcaagggcggggggcgtccggatatggctcaggcaggcggtagtgatgttggtgcgttgccatcggcgctgaccagcattgaagcctgggtggttgataagctataa

SEQ ID NO: 1052 - DNA, 2628 bp, Pectobacterium carotovorum PC1
atgagcaagagcaccgctgagatccgtcaagcgtttctcgattttttccacagtaagggacaccaggttgttgatagcagctctctggtgccgaacaacgatcctacattgttattcaccaatgcgggtatgaaccagttcaaagatgtgttcctcggtctggataaacgtaactatgtccgagcgacgacctcgcagcgctgtgtgcgcgccggtggtaaacataatgacctggaaaacgtaggttataccgcacgccaccacaccttctttgaaatgctgggtaacttcagcttcggtgattacttcaagcatgatgcgattcgctatgcgtgggaattactgacgtctccccagtggttcaacctgccaaaagagaaactgtgggtaacggtatacgcaacggatgacgaagcctacgatatttgggctgatgaagttggcgtaccgcgcgaaagaattattcgtattggtgataacaaaggcggaccttacgcctctgataacttctggcagatgggtgaaacagggccgtgtggtccgtgtaccgagattttcttcgatcacggtgaacacatcgccggtggcccgccgggaagccctgatgaagacggcgaccgctatatcgaaatttggaacctggtgttcatgcagttcaaccgtcaggttgatggcacgatgctgccgctgccgaaaccttccgtcgataccggaatggggttagaacgtatttctgccgtgttacaacacgtcaattcaaactatgacattgatttgtttaaaacgctgattgaggcagttgctaacgctgtcggcacgacggatttaaccaataaatcgctgcgtgttatcgccgaccatatccgctcttgtgcattcctgattgcggacggcgtgacgccatcgaatgaaaaccgtggttatgttctgcgccgtatcattcgccgcgctgcacgtcacggtaatatgctgggcgctacggatgccttcttctataaactggttgcgccgctgattgaagtcatggggccagcggcggcggagttgaaaaagcagcagtcggttgttgagcaagcgctgaagatggaagaagagcagtttgcccgtacgctggaacgcggcctgtctctgctggacgaggaaattaaaaacctgaaaggggatacgctggacggcgagacggccttccgcctgtatgatacctatggtttccctgtcgatctcactgcggatgtgtgccgcgagcgtggcctgaaagtcgatgaggaaggttttgaagcggcaatgacggctcagcgtcagcgcgcgcgtgaagccagcggatttggtgtggattacaacagccttattcgtgtggatgaaaacaccccattctgcggctatgaaaaaacgcagcagcaagcgaaggtgattgcgctttatcacaacggaaacgcggttgatcagattgcggcaggtgatgaagcggtagtgatcctgaacgaaacgccgttctatggcgaatccggtggtcaggttggcgaccagggtgaactgaaaaacgcgggcgtcagctttgccgttcaggatacgcagaaatacggtcaggcaatcggccacgtcggtaaactgacgcagggtacgctgcgtgttaacgacagtgttgatgcaaacgttgatagccaacgccgcgatcgcattcgtctgaatcactctgcaacgcacctgctgcatgccgcgctgcgtcaggttctgggcgatcatgtcgcgcagaaaggttctctggttaacgatagctatctacgttttgacttctcacatacggaagcgatgaaacctgagcagattcgtcaggttgaagatatcgtcaatgcgcaaatccgccgtaaccttaccgtgcaaacggatgtcatggcgctggatgatgcgagagcgaagggcgcgatggcgctgttcggcgagaagtatgacgaccatgttcgtgttctgacgatgggggacttctccattgaactgtgcggcggcacacacgccagtcgtactggtgatatcggcctgttccaaatcatttcagaatcaggtaccgcagccggggtgcgccgtattgaagcgactacgggtgaaaatgcgctttctgcgctgcaccgtcagagtgacgttctgcaagatatcgcgcaactgctgaaaggggatagtcacaacctgacagataaggtacgctctgttttagatcgtgctcgcgcgttggagaaagagcttcagcagttgaaggctcagcaagcggcgcaggaaagctcgtcactgtctggcaaagcaaaagaggttagcggcgtgaagttgctggttacgcaactggacaacgtggatcctaagctactgcgcacgatggtggatgacctgaagaatcagttagggtctgctgttattgttcttggaacggtggcagaaggtcgggttagcttgatttctggtgtaacgaaagatctgactgaccgtgtcaaagctggtgaactgattgggtttgttgcccagcaggttggcggtaaaggcggtggtcgcccagatatggcacaggctggtggttcagatgtgtctgcactgcctgctgcgctggcaagcgttgaatcctgggttgctgctaagctataa

SEQ ID NO: 1053 - DNA, 2628 bp, Geobacter M21
atgacaggcaaagagatccgggctcagttcttcaacttctttcagaaaaaagggcatgcccttgtggagagctcgaacctcatcccacgcaacgaccctaccctcctcttcaccaacgccgggatgaaccagttcaaggacgtcttcctcggcatggagaaaagggagtacctgagggcggtctcctcccagaaatgcgtgcgcgccggcggcaagcacaacgacctggaaaacgtggggcgcaccgccaggcaccacaccttcttcgagatgctggggaacttctccttcggcgactacttcaagaaggaggcgatcggcttcgcctgggagttcctgaccaaggaactcggcctctccaaggaccgcctctacgtcaccgtctacaccgacgacgacgaggcggccgacatctggcacaaccaggaaggggtgccgcgcgagcgcatctaccgcttcggcgagaaggacaacttctggtccatgggcgacaccggcccctgcggcccctgcaccgagatcttctgggacaacggcccgggaaccggctgcggcagccccgactgcgcggtaggctgcgactgcgaccgctacatggagatctggaacaacgtcttcatgcagttcaaccgcggcaaggacggcgtgctggccccgctccccaaaccttccgtcgacaccggcatgggccttgagcgcatctcggccgtcatgcagggggtcacctccaactacgacaccgaccttttgcagggaatcatccgccacatcgagaaggtctccgggaagaagtaccgggacgacgagagggacgacgtctccatgcgcgtcatcgccgaccacgcccgcgccgtcaccttcctgatctgcgacggcgtccttcccagcaacgagggacgcggctacgtgctcaggcgcatcatgcgccgcgccgcccgccacgcgaagatgctgggaatcgccgagccggtgctcttccgggtcgtcgacgcggtgaacatgatgatgtccgacgcctacccggagcttctggagcgcgagcagtacgtgaagaaggtgatcctggccgaggaggagcgcttcatcgagacgctcgaccgcggcctcgccatcttgaacgaggagacggcggcgctcagggccaagggggagaaggtcatctccggcgagatcatcttcaagctctacgacaccttcggcttcccggtcgatctcaccgccgacatcgtcgagtccgaagggttcaccctcgacgaggacggcttcgccctctgcatggagaagcagcgcgtcaaagcgagggagaactggaagggatccggcgagcaggggctggccgacatctacaaggagctgcacggcaccggcatcaccaccgactttttgggctacagcgagcagaccgccttctccaccatcagcgccatcgtcaagggggggaccctggtcgaggaggccggcgccggcgaagaggtcgagatcgtcaccgcggcgacgccgttctacggcgagtcgggggggcaggccggcgacaccggaaccatctccaccggctccggccacgtcgaggtgaccggctccacccgccccttcaccgatctcatcgtgcaccgaggccgcgtggtctccggcgccgtcagaaccggcgaggcggcggacctgaagatcacggtcgctcaccgcgccgctaccgccagaaaccacaccgcgacccaccttttgcaggcggcgctccgggaggtgctgggcgagcacgtgaagcaggcaggctccctggtgaccccggacaggctccgcttcgacttcacccacttcaccccgatgacccaggaagagatccgcagggtcgagatcctggtgaacggccacatcatggggaactccccggtggaggcccgcgagatgccggcgacggacgcgcttgccgcgggcgccaccgcccttttcggcgagaagtacggcgacgtggtccgcgtggtcaaggtaggcgaggtctcaagcgaactctgcggcggcacccacgtccacggcgccggcgagatcggcttcttcaagatcatctccgaggcggggatcgccgccggggttaggaggatcgaggcccagaccggcagcggcgccctggccgtagtgcatgggatggaggacgagcagcgcggcatcgcgacccttctgaaggcggaaggggggaccgtcctggacaaggtcgagaaactggtggccggccagcgcgagctgcaaaaggagctcgaaacgctgcaggcgcgcctgaacgcctccaagtccgccgacctgatccagcaggtgcgcgagcaaaacggcgtgaagatcctgtcggtgaaggtcgaaggggacgccaaggggttgagggaactctccgacacgctgaagcagcgcatcggctccggcatcatcgtccttgggaccagcgacgcggcgagggcgaacctcctggtggcggtgacggccgacctcgccgggcgctggaaggcgggagacatcatcaaggccatcgccccgatagtcgggggcaacggcggaggaaagcccgagctggcgcaggcgggaggctcgaagcccgagcacctggccgaggcgttagaggcggtgtaccagatagtggggtaa

SEQ ID NO: 1054 - DNA, 1329 bp, Polaromonas JS666
atggaaccacaaaacattaagccccacacccccgagctctcccgcaacaccgcgctgttcgagcgcgccaaaaagttgatccccggcggggtgaattcgccggtcagggcgttcaaggccgtgggaggtacgccgcgctttgtgcagcgcgcccagggcgcctacttctgggacgccgacgaccagcgctacatcgactacatcggctcgtgggggccaatgattctggggcacgggcatcccgccgtgcttgcgtccgttcagaaagcgctgctggacggtttctcttatggtgcgccgaccgagcgcgaagtggaactggctgaagagctcgtgcgcctggtgccgtccctcgaaatggtgcggctggtgagctcgggtaccgaagcagccatgagcgccatccgcctggcgcgcggcgcgaccggacgcagcaagatcatcaagttcgagggctgctaccacggccacgccgacgccctgctggtgaaagccggctccggcctggccaccttcggcaacccaaccagcgccggtgtaccgcccgaggtagtgcagcacaccctggtgctcgaatacaaccacctggcccagctggaagaagcttttgcgctgcatggcagcgcgattgcctgcctgatgatcgagccgatcgccggcaacatgaatttcgtgcgggccagcattcctttcatgcagcgttgccgcgagctgtgcacccagtatggtgcgctgctggtgtttgacgaagtcatgaccggctttcgcgtggccctcggtggcgcgcaaagcgtgtacgccaaaagtattcccggcttcaaacccgacatgacggtgctgggcaaggtgattggcggcggcatgccgctggcggcctttggcggaacccgcgccgtgatggaacagctggcgcctttgggcccggtctaccaggccggtacgctgtcgggcaacccggtggccaccgcctgcggcctggccaccttgcgcgagatccagaaacccgggttttatgaagcactgggagagcgcacgcgcggtctggtcgcaggcctcacgcaggcggccaacaaggcgggcgtgcctttttgcggtgacagcgagggcggcatgttcggctttttcctgctcgggcaactgcctcaaaactacgccacggtcatgacgaccgacggtccggccttcaaccgcttctttcatgccatgctggccagcggggtgtactacgcgccggcgctgtacgaggccggctttgtcagctcggcgcacagcgcggcggatattgaggccacggtggatgcagcggcgaagttttttgccggggcctga

SEQ ID NO: 1055 - DNA, 1314 bp, Acidovorax avenae citrulli AAC00-1
atgacacccagcactgacctcaaccttcccctcttcgaacgcgccaaggcgctcatccccggcggcgtcaactcgcccgtgcgcgccttccgcgcggtgggcggcacgccccgcttcgtgcagcgcgcccagggcgcctacttctgggacgccaacggccagcgcttcatcgactacatcggctcctggggtcccatgatcctgggccacggccatccggccgtgctggaagcggtgcagaaggccgcgctcgacggcttcagcttcggcgcgcccaccgagcgcgaggtcgagctggccgaggagatcctccgccacgtgccgtccatggagatgatccgcctggtcagttccggcaccgaggccggcatgagcgccatccggctcgcgcgcggcgccacgggccgcagcaggatcatcaagttcaacggctgctaccacggccatgccgacgcgctgctggtcaaggccggctcgggcctggccaccttcggccacgccaccagcgccggggtgccggccgaggtggtacagcacacgctcgtgctggaatacaacgacatcgcccagctcgaagaggccttcgctctgcacggcagcgagatcgccgggctcatgatcgagcccatcgccggcaacatgaacttcgtgcgcgccagcgtgcccttcatgcggcgctgccgcgagctctgcacgcagcacggcgcactgctggtgttcgacgaggtgatgacgggcttccgcgtggcgctcggcagcgcgcagagcgtctatgcccgcgacatcccgggcttccagcccgacatcaccgtgctcggcaaggtgatcggcggcggcatgccgctcgcggcgttcggcggaccgcgcgcgatcatggagcagctggccccgctcgggccggtgtaccaggccggcacgctttcgggcaacccggtggccaccgcctgcggcctcgccacgctgcgcgagatcgcccgccccggcttctacgaggcgctgggcgagcgcacccgcgccctgaccggcgggctggccgacgcggcgcgcgcggaaggcctgcccttcagcgcggacagcgaaggcggcatgttcggcttcttcctgctgcccgagctgccccggaactatccgacggtgatgaccacggacggcgcgcggttcaacgcgctcttccacgggctgctggaccgcggcgtgtacatcgcacccgcgctctatgaggccggtttcgtgagcagcgcccacagcgcgcaggacatcgacgagaccatcgccgcggcgcgcgaggtgttccgcctggtctccgcgggctga

SEQ ID NO: 1056 - DNA, 1305 bp, Acidovorax sp. JS42
atgacacacaacactgatctcaatctcccccttttcgaacgtgccaaggcgctcatccccggcggcgtgaattcgccggtacgcgccttccgcgccgtgggcggcacgccccgcttcatcacgcgtgcccagggcgcctacatgtgggacgccaacggccagcgcttcatcgactacatcggctcctggggacccatgatcctgggccatggccacccggccgtgctggaggccgtgcagaaagcagccctggagggcttcagcttcggcgcgccaaccgagcgtgaagtggagctggccgaggaaatcatccgccacgtgccgtccatggagatgatccgcctggtcagctcaggcaccgaggccggcatgagcgccatccgcctcgcgcgcggcgccacccggcgcaacaagatcatcaagttcaacggctgctaccacggccatgccgactcgctgctggtgaaggccggctcgggcctggccaccttcggccacgccaccagcgccggcgtgccgcaagaggtggtgcagcacaccctggtgctggaatacaacgacgtggcccaactggaggaggccttcacgctgcacggccccgacgtcgcctgcgtgatcatggagcccatcgccggcaacatgaacttcgtgcgcgccagcgtgcccttcatgcgccgcgcgcgcgagctgtgcacgcagcacggcgcgttgctggtcatcgacgaggtcatgaccggctttcgcgtggcgctgggcggggcgcaaagcctgtacgcccaggccatcccgggcttcaagccggacatcaccgtgctcggcaaggtcattggtggcggcatgccgctggcggccttcggcggctcgcgcgccgtgatggagcagcttgcgccgctgggcccggtctaccaggcgggcacgctgtcgggcaacccggtggccacggcctgcggactggccacactgcgcgagatcgccaagcccggtttctacgacgccctgggcgcccgcacccgcgcgctgatcgacggcctcgcgggcgctgccagcgctgcgggtgtgccgttgtgcggcgacacccagggcggcatgttcggcttcttcctgctgccgcaactgccgcagaactaccccgaggtgctcaacaccgacggcatgcgcttcaacacgctgttccacggcctgctggacggcggcgtctacattgccccggcgctctacgaagccggctttgtgagtgccgcccacaccgagcaggacatcgccgacaccgtggccgtggcgcgcgacgtgttccaaaagctatag

SEQ ID NO: 1057 - DNA, 1329 bp, Polaromonas naphthalenivorans CJ2
atggaacaaccaaacactaagcctgtcgcccccgcgacatcgcgcaacgcagccctgttcgaacgcgcccaaaagctgatccccggcggcgtcaattcgccagtccgcgctttcaaggcggttggcggcacgccgcgttttatccagcgcgcccagggcgcctatttctgggatgccgacggccagcgctacatcgactacatcggctcctgggggccgatgatcctgggccacggccatccggcggtggtggaagccgtccagaaagccgtgctcgaaggcttctcctacggcgcgccgaccgagcgcgaggtggaactggccgaggaaatcgtcaagctcgtgccgtccatcgaaatggtgcggctggtgagttctggcaccgaagcgacgatgagcgtgatccggctggcgcgcggcgcgaccgggcgcagcaagatcatcaagttcgagggctgctaccacggccactccgatgcgctgctggtcaaggccggctcgggcctggccaccttcggtagcccgaccagcgcgggcgtgccgcctgaagtggtgcagcacacgctggtgctggaatacaaccacatcgcccagctggaagaagccttttcgctgcacggcagggacattgcctgcctgatgatcgagccgattgccggcaacatgaacttcgtgcgcgccagcgtgccctttatcaagcgctgccgagaactgtgcacgcaatacgacgcgctgctggtgtttgacgaggtgatgacgggctttcgcgtagcccttggcggcgcgcaaagcgtttatgcccaaagcattcccggcttcaagcccgacataaccgcgctgggcaaggtgattggcggcggcatgccgatggccgctttcggcgggacgcgcgcggtgatggagcacctggcgcccctgggcggtgtttaccaggccggcacgctgtcgggcaacccagtggcgaccgcctgcggcctggccacgttgcgtgaaatccagaaacccggtttttacgacgcgctgggcgcgcgcacgcgcagcctcgttgaaggcctgacgcacgcggcgaaccaggccggcgtgcctttttgcggcgacagcgaaggcggcatgttcggctttttcctgctgggcacattgccacaaaactacccgcaggtcatgaagaccgacagcccgaccttcaaccgcttttttcacgccatgctcgacagcggcgtgtattacgccccggcgctctacgaagccggctttgtcagcgcggcccacacggccgaagacatcgaagccacggtggaggcggcaacccggtttttcgcggggcgctga

SEQ ID NO: 1058 - DNA, 1314 bp, Verminephrobacter eiseniae EF01-2
atgacaccaaacactgatctgaatatcccgctgttcgagcgcgccaaggcgctcattcccggtggcgtgaactcgccagtccgggccttcaaggcagtcggcggcacgccccgcttcgtcaagcgcgcccggggcgcgtacttctgggacgccaacgaccagcgtttcatcgactacatcggctcctggggaccgatgattctggggcatggccacccggcggtgctcgaagcggtgcagcaggcagcgctggagggtctgagctttggcgcccccaccgagcgcgagttggaactggccgaggccatcttgcgcctgctgccatcgatgcagatgatccgcctggtcagttcgggcaccgaggccggcatgagcgcgatccgcctggcacgcggcgccaccggccgcagcaagctcatcaagttcgagggctgctaccacggccatgccgatgcgctgctggtcaaggccggttcgggcctggccaccttcggcaacgccaccagcgccggcgtgcccgccgaggtggtgcagcacacgctggtgctcgaatacaacagcatcgagcagctcgaacgagcctttgcattgcacggcaaggaactggcctgcctgatcatcgagccgatcgccggcaacatgaacctggtgcgcgccagcgtgcccttcatgcgccgctgccgcgagttgtgcagcgaatacggcgcattgctggtgctcgacgaggtgatgaccggctttcgggtggcgccgggcggcgcgcaaagcctgtacgcccgggacataccaggcttccaacccgatctgacggtgctcggcaaggtgattggcggcggcatgccgctggccgcctttggcgggtcgcgcgcgctgatggaacacctggcgccattgggtgcggtctaccaggctggcaccttgtcgggcaacccggtggccacggcctgcggcctggcgacgctgcgcgccatcggccaaccgggcttttttgccgcgctgtcggcccgcacccgggcgctggtcgaggggctacggggcgctgcggcggccgaaggcgtggctttcagcgcggacagcgaaggcggcatgttcggcttctttctgctgccggcgctgccccggaactacgcccaggtgctgcaaaccgacagcgcacgcttcaaccaactgttccacggcctgctcgaacgcggcatctacatcgcgccggcgctctacgaggccggctttgtcagcgcagcgcacagcgacgaggacattgcagccaccgtggctgcggcgcgcgaggtgttcaagacgctggcaaaaccatag

SEQ ID NO: 1059 - DNA, 1311 bp, Methylibium petroleiphilum PM1
atggccgactcgcgcaatgccagcctgttcgaacgggcccgccgcagcatccccgggggcgtgaactcgccggtccgcgccttccgcgcagtcggcggtacgccgcgtttcatcgcccgggccgacggcgcctacctgtgggacgccgacggcaagcgctacatcgactacatcggctcctggggaccgatgatcctcggtcacggccaccccgccgtgctggaggccgtgcagaaggcagcaaccgagggcttcagcttcggcgccccgacggagcgcgaggtggaactggccgaggagatcctgaaactggtccccagtgccgagcaggtgcgcctggtcagctcgggcaccgaggcggcgatgagcgcgttgcggctggcgcgcggcgcgactgggcgctcgaagattgtcaagttcgagggctgctaccacggccatgccgacgcgcttctggtgaaggccggctcggggctcgcgaccttcggccaccccacctcggccggcgtgcctaccgaggtggtgcagcacacgctggtgttgacctacaacgacgtgacgggcctcgaggcggctttcagtgcgcacggcgccgagatcgcctgcgtgatgatcgagccgatcgccggcaacatgaatttcgtgcgggccggcctcccgttcatgaagcggctgcgcgagctgtgcacgcagcacggggcgctgctggtgttcgacgaagtgatgacgggctttcgcgtcgcgctcggcggcgcccagagcctgtatgcgaaggcgattcccggcttcaagcccgacctcagcgtgttcggcaaggtcatcggcggcggcatgccgctcgcggctttcgccgggccgcgcgccatcatggaacagctcgcaccgctcggcccggtctaccaggccggcacgctgagcggcaacccggtcgccaccgcgtgcggcctggccacgctgcgcgagatccagaagccgggcttcttcgaatcgctggcagcgggcacgcgcgacctgctcgacggactgctgcacgcggccactgcggctggcgtgccgatggtgggcgactgcgagggcggcatgttcggcttctttttcccgaagacggcgcaagccgcgctgccgcagaactatgtcgaggtgatggccaccgacggcgagcgcttcaaccgctatttccacggcatgctcgaccgcggcgtgtatctggcgccggctctctacgaagccggcttcgtcagcgccgcgcacacgccggccgacatcgaggcgacgctcgccgcggcccgcgccacgctggcagcggcctga

SEQ ID NO: 1060 - DNA, 1317 bp, Delftia acidovorans SPH-1
atggcagactcctgcactatgaccactgacctgaatattcccctgttcgaacgcgccaaggccgtgatccccggcggcgtgaattcacccgtgcgcgccttcaacgccgtgggcggcacgccgcgcttcgtgcgccgtgcgcagggcgcgcatttctgggacgagaacgcccagcagttcaccgactacatcggctcctggggtccgatgatcctgggccatggccaccccgaggtgatggccgccgtgcaggccgccgcgctggaaggcttctccttcggcgcgcccacggagcgcgaggtcgtgctggccgagaagatcctctcgctcatgccctccatggacatggtgcgcatggtcagctcgggcaccgaggccggcatgagcgcgctgcgcctggcgcgcggcttcacgggccgcaacaagatcatcaagttcaacggctgctaccacggccatgccgacgcgctgctggtcaaggccggctcgggcctggcgacgttcggcgcctcctcctcggccggcgtgccgcaggacgtggtcaaggacaccgtggtgctggaatacaacgacgtgggccagctcgaagaggccttcgcccagttcggcgaccagatcgcctgcgtgatcatggagcccattgccggcaacatgaacttcgtgcgcgccagcgtgcccttcacgcgccgcatccgcgaactcacgcgcgagcatggcgcgctgatggtctacgacgaggtgatgacgggctttcgcgtggccctgggcagcgcccagagcctgtacgcccagcacatcgaaggctttgcgcccgacatcaccgtgctgggcaaggtcatcggcggcggcatgcccatggcggccttcggcgcgcgccgcgagatcatggaaaagctctcgcccctgggcccggtctaccaggccggcaccctgtcgggcaaccccatcgccacggcctgcggactcaagacgctggagctgatcagcgagcccggcttccacgacgccctgcacgcgaagaccggccgcctgatggccggcttcaaggccgaggccgacgccgccggcgtgcccttcagcgtggaccaccagggcggcctgttcggcttctacctgctgcccgagctgcccagcacctggaccgaggtcatgaagaccgatggcgcacgcttcaaccgcttcttccacggcatgctggagcgcggccactactttgcgcccgccctgtacgaggcgggcttcgtgagcgccgcgcacacggacgctgacatcgacaagaccatcgaagccgcgcgcgaagtgttcaagacgctctga

SEQ ID NO: 1061 - DNA, 1314 bp, Leptothrix cholodnii SP 6
ttggcgacacccgtgagcagcaacgcagaactcttcgaacgcgcccagcgctcgatccccggcggcgtcaattcgccggtccgtgccttccgagccgtgggcggcacgccgcgtttcatcgcgcgcgcccagggcgcctacatgtgggacgccgaaggcaagcagtacatcgactacatcggctcgtggggcccgatgatcctcggccacggccacccggccgtgctcgcggcggtgcagaaggccgccaccgaaggcttcagcttcggcgcgccgaccgagcgtgaggtcgagctcgccgagaccatcctcgccctggtgccgagctgcgagcagatccgcctggtcagctcgggcaccgaggcggcgatgagtgcgatccgcctggcgcgtggcgccaccggccgcagcaagctgatcaagttcgagggctgctatcacggccacgccgacgcgctgctggtcaaggccggctcgggcctggccaccttcggcaacccgacctcggccggcgtgccgcccgaggtggtgcagcacacgctggtgctgacctacaacgacatcgagcagctcgaagaggcgttcaagatccacggccccgaactcgcctgcgtgatgatcgagccgatcgccggcaacatgaacttcgtgcgtgccaccgtgccgttcatgaagcgcatccgcgagctgtgcacgcagcacggcgcgctgctggtgttcgacgaggtgatgtgcggcttccgcgtcgcgctcggcagcgcgcagagcctgtatgcgcaggcgatccccggcttcgcgcccgacgtcagcgtgttcggcaaggtgatcggcggcggcatgccgctggccgcgttcggcgcctcgcgcaagatcatgagcctgctggcgccactcggcccggtctatcaggccggcaccttgagcggcaacccggtcgcgaccgcctgcggcctggcgacgctgcgcgagatcagccagcccggcttcttcgaggcgctcggcgccaggacccgccgcctggtcgacggcctgagtgctgcggcggctgacgccggcgtgcccttcgtcggcgactgccagggcggcatgttcggcttcttcttcccgcgcaaccgcggcgaaggcctgccgcagaactacgccaccgtgatggcgaccgaccaggcgcgcttcaacagcttcttccacggcctgctcgaccgcggcgtctacctcgcgccggcgctctacgaagccggcttcgtcagcgccgcccacagcgacgccgacatcgacgcgaccgtcgctgccgcgcgcgccgccctgcagccctga

SEQ ID NO: 1062 - DNA, 1305 bp, Diaphorobacter TPSY uid29975
atgacacacaacactgacctcaatctcccccttttcgaacgcgccaaggcgctcatccccggcggcgtgaattcgccagtgcgcgcgttccgcgccgtgggcggcacgccccgcttcatcacgcgtgcccagggcgcctacatgtgggacgccaacggccagcgcttcatcgactacatcggctcctggggacccatgatcctgggccatggccacccggccgtgctggaggccgtgcagaaagcggccctggagggcttcagcttcggcgcgccaaccgagcgtgaagtggagctggccgaggagatcatccgccacgtgccttccatggagatgatccgcctggtcagctcgggcaccgaggccggcatgagcgccatccgccttgcgcgcggcgccacccgacgcaacaagatcatcaagttcaacggctgctaccacggccatgccgactcgctgctggtcaaggccggctcgggcctggccaccttcggccacgccaccagcgccggcgtgccgcaagaggtggtgcagcacaccctggtgctggaatacaacgacgtggcccaactggaggaggccttcacactgcacggccccgacgtcgcctgcgtgatcatggagcccatcgccggcaacatgaacttcgtgcgcgccagcgtgcccttcatgcgccgcgcgcgcgagctgtgcacgcagcacggcgcgttgctggtcatcgacgaggtgatgaccggctttcgcgtggcgctgggcggggcgcaaagcctgtacgcccaggccatcccgggcttcaagccggacatcaccgtgctcggcaaggtcatcggcggcggcatgccgctggcggccttcggcggctcgcgcgccgtgatggagcagcttgcgccgctgggtccggtctaccaggcgggcacgctgtcgggcaacccggtggccacggcctgcggactggccacgctgcgcgagatcgccaagcccggtttctacgacgccctgggcgcccgcacccgcgccctgatcgacggcctcgcgggcgctgccagcgctgcgggtgtgccgttctgcggcgacacccagggcggcatgttcggcttcttcctgctgccgcaactgccgcagaactaccccgaggtgctcaacaccgacggcatgcgcttcaacacgctgttccacggcctgctggacggcggcgtctacattgccccggcgctctacgaagccggctttgtgagtgccgcccacaccgagcaggacatcgccgacaccgtggccgtggcgcgcgacgtgttccagaagctatag

SEQ ID NO: 1063 - DNA, 1296 bp, Variovorax paradoxus S110
atgccaaacgctgaccaaaacgacattcttttcgagcgcgcccgcgccgtcattcccggcggcgtcaattcgccggtgcgcgccttcaaggccgtgggcggcacgccgcgcttcatccgccgcgccgagggcgcctatttctgggacgccaacgacaagcgctacatcgactacatcggctcctggggcccgatgatcctgggccacggccaccccgcggtggtcgaagcggtgcagaaggccgtgctcgagggcttttcctacggcgcgccaaccgagcgcgagatcgagctggccgaagccatcctcgccctgatgccgtcgatggagatggtgcggctcgtgagctcgggcaccgaggccgccatgagcgcgctgcgcctggcgcgcggcgccaccggccgcaagcacatcatcaagttcgagggctgctaccacggccatgccgatgcgctgctggtgaaagccggctccggccttgccaccttcggccaccccacttcggccggcgtgccgcccgaggtcacgcagcacacgctggtgctcgaatacaacaacatcgcgcagctcgaggaagccttcgcgctgcacggcaacgacatcgcctgcctgatgatcgaggcgattgccggcaacatgaacttcgtgcgcgccacgcccgccttcgccgcccgctgccgcgagctgtgcacgcagcacggcgcgctgctggtgttcgacgaagtgatgaccggctttcgcgtcggcctgcacggcgcgcagggcgtgctgggcatcacgcccgacctcacggtgctcggcaaggtcatcggcggcggcatgccgctggcggccttcggcggcccgcgcgccatcatggagcagctcgcgccgctcggcccggtctaccaggccggcacgctgtcaggcaacccggtggccacggcctgcggccttgccacgctgaaggaaatctcgaagcccggcttctatgaggcactcggcaagaagacgcgctcgctcgccgacggcctcaaggccgccgccgccgccgaagggctgcccttcaacgccgacagcgagggcggcatgttcggcttcttcctgatgaacgagctgccgcagaactacgcgaccgtgatgaccaccgacaacgcgaagttcaacgcgctgttccacggcctgctggagcgcggcgtgtacatcgcgccggcgctctacgaggccggcttcgtgagcgcggcgcatggcgacgacgacattgccgcaaccattgatgcggcgcggcaggttttcaggacgctgcgctcgctctga

SEQ ID NO: 1064 - DNA, 546 bp, Ralstonia solanacearum
atgagcgagacgcgcaccaacctgacttcccgccagcggctgcatgagtaccaggcgatgctggcccgccgcctgcaagaggcgcgtgccaaggcatcgatggacagcttcctgggcgtgcagatcggcgaccgtcattggctgctgtcgctcggcgacaccggcgaagtgctggactatcagccgccggcgcgcgtgccgctgacgcagccgtggtacctcggcctcgtgaacgcgcgcggcacgctgctgggcgtgatcgatttcgcgctgttctccggcgaggcgccgacggtgggtggcgtcggcgccaagatggtggtgctgtccaaggatccgcagcgcgcctgcgcgatcctggtgccccgcgtggcgggcctgcgcagcctgtccgacctgcaggccgtggaggccgggcaggaagatggcctgccgtggcagaaccgcgcctggcgcgatgcgcagggcacgctgtggcgcgaactgagcgtgcgccaactgctggctgatccggcattcctgcaggtgggccgcagccgcgcctga

SEQ ID NO: 1065 - DNA, 555 bp, Pseudomonas putida KT2440
ttgaccacccgcccgcaaggcgcgtcgctgaccgcctttgagttgctgctggacatcgaccggcgctgtcgcctgctggttgccgaccagccgccgcaggacaaccgcgtgcagcagtggagcggcattggctttcgcattgccgggcagtggttcgtcgcgcccatgggcgaagtggccgaggtgctgcgcgagccgcgcagtagccgcgttcccggcgtgcagccgtgggtgtgcggggtggccaacctgcgtggccggctgttgccggtgatggacctgagctgcttcttcggccttggccacgccgcaccgggcaagcagcggcgagtgctggtgctggatcacgacgacctgttcgtcggtttgctggtcgacgaggtgctgggccttcagcactttgccctcgacagcctgcagctgtcgccgccgcagccgctgatccctgccgctgcacgctttgtgcaggggtattttccgcgtgaacgtaactgggcgatcttcagcccctttgccctggcccaggcgccgggctttctcgatgtggcgttatag

SEQ ID NO: 1066 - DNA, 540 bp, Pseudomonas syringae tomato DC3000
atggccgagcctcgtaccgcctttgaactgctgctggatatggaccgacgctgccgttcgctggcggcgggcctgccgttgcaggaaacccaccagcaggactgggtcgggattggctttcgcatgggcgatcagcgttttgtggcaccgatcggtgaaatcgccgaaattctccatgagccccgacacgctgtcatgcccggcgtgaaattctgggtggcgggtgtcgccaatctgcgcggtcggctgttgccgctcatggacttgtgcgggttcttcggtcacgaactgacgtcggcacgcaagcagcgccgggtaatggtggtcgagtacaacgacatatttgccggcctggtggtcgatgaggtgttcggcatgcagcgtttcagtcagttgagcctgataccccacaccccgcaggacgtcgatcagcgcctcgtgccgttcctgcggggtcagttcattcgcgagcaggcctggcagatattcagcccgtgggcgttggtgcagtctgcagatttcatggacctggcgtcctag

SEQ ID NO: 1067 - DNA, 540 bp, Pseudomonas syringae pv B728a
atggccgagccgcgcaccgcttttgaactgcttctggatatggatcgacgctgtcgttcgctggcggcgggcctgccgctgcaggaagcccatcagcaggactgggtcggcatcggctttcgtatgggcgagcaacggtttgtcgcgccgattggcgagatcgccgagatccttcacgaaccccatcatgcggtaatgcccggtgtgaagttctgggtggccggtattgccaacttgcgcggtcggttgttgccactcatggatctgtgcgggtttttcggccacgaactggtgccggtgcgcaaacagcgacgggtgctggtggtcgagcaccatgatgtatttgccggtctgctggtcgatgaagtgttcggcatgcaacgtttcagtcagttgagcctcataccccagaccccgcaggagatcgatcagcgtatggtgccgttcctgcgcgggcagtttatccgcgagcaggcgtggctgatcttcagcccatgggcgctggtgcagtctgcggatttcatggacctggcttcctag

SEQ ID NO: 1068 - DNA, 531 bp, Psychrobacter arcticum 273-4
gtggcatcgagaggatttgttgagcttctgcgtatagcagatatggcacgttcgcgtaaaagtggatcccgcggtggacaaaaatttgactggcaaggaatagtatttgagattggcggtcaacgcttggttgcgccaatgggtcaagtagcagaagtattatccatgccagagtataccagcgtgcccttagtaaagccttggatgcttggtatcgccaatattcgcgggcgtttactgccgttgaccgatttgtctcgatttttacaagtgcccagtcggttatcgcaaatgagccagtgcaaagtcatggtcatcgaccataataatgtattttcagggttgcttgttgatcaagtgctcggtatcgaacagtttactcaagaccaatatcgtccagaagcaatggagccgaattcgccatttgcgccttataaccatggcaagtttttcaaagatgaacaagattggtatgtgtttatgccaagcttgctgacacaggatttacagtataccgatgctgcaatataa

SEQ ID NO: 1069 - DNA, 513 bp, Dechloromonas aromatica RCB
atggcccggaaaaccagtcttcgcgatttccaggagtacctggcatcccgtttgagccaagcggcgcggggaaaaggttcggcatcctggcttggggtggaagcaggcggtgaggcttggctggttgatctttccgatggcggtgagatcgttcaggcctcccagatggcgcctgtcccgctgactcgtccatggtttgtcgggatatcaaatatccgcggcaatctgcatgcggtcagtgatttttcattgtttcgtggtggtccgccgatcgtacagaatgccaatgcacgcttactgttgataggggcgcgttacggtatcaatgcggctttgttggtgtcgcggatgctgggcttgaagaatcccgaagatttcacccccgagtcggctgatgcatccatgcctgcgtgggggatgcagcgttttgccgatacgcacggaaaaatctggcacaaactgtcggttcgcgaattgctcgccgatcaggatttcatgaatattggggtttga

SEQ ID NO: 1070 - DNA, 549 bp, Ralstonia eutropha JMP134
atgaacgcgccacgccaagacctccgcacccgccagactcggctgcaggactaccaggccatgctcgccaggcgcctgcgcgaggcccgcaacgtgcctgccgccgacagctacctcgctctccaggtaggccagcgcggctggctgttgccgcttgcgcagaccggcgaggtgctcgacatgcgccacccgagccgcgtgccgctgacgcagccgtggtacgcgggcctggtcaatgcgcgcggcagcctgcttggcgtgattgatttcggattgttctgcggcgacgcgccgacgccactgcagccgggcagcaagatcgtcgtgctgtcgcgccaggtcgagcgcgcgtgcggcatcctggcgacgcgcgtggttggcttgcgccatgcggcggacctgcgcgagccggcacaaccagccggggcggtagaggcatgggaaggcaggcggctggatgacggcgacggccgcgcgtggcaggtgctggacgtgcgcgccttgcttgacacaccggcatttctgcaggcagggcgcatggcggcataa

SEQ ID NO: 1071 - DNA, 525 bp, Thiobacillus denitrificans ATCC 25259
atggcgaagaaattcaatctgcgtgaatttcagaccgcgctttcgcagcagctgcaggcggccgcgagccgcgacaacaccggttcgcgcctgggctttcgcgctggcgacgtcaactggctggtggccctgtcggataccgaggaagtgatcccggtgccgccggtcgtcagggttccgggcgcgcggcgctggtttcgcggcgtcaccaacattcgcggcaacctgttcgcggtgagcgacctttccgacttcatggggcagggagtcacgcctgagcacggcgactgccggctgctgattccgcatcacagtttcggcgtcaatgccgcgctgctggtgcagggcacgctcggtctcaagaacgtcggccgttatcaggctcgcggcgagcggaccgcgacgcacccatgggtcgcgcgcgagtatgtcgacgaaggcggcggcgcctggtgcgacatcgatgttgcgcagcttctcggcaaccccgaattcctcatggtcgaggcgcaggtcgggaactga

SEQ ID NO: 1072 - DNA, 537 bp, Nitrosococcus oceani ATCC 19707
atggacaagaacaaccctttttccatacttcgcaatatcgaagctcaaaaccgtcagcatggggctgctttaccacagcaaaccgctatccgtcaggtatggacgaatcttggttttcttcttggtaaccaaaagctagctgctctacttactcaagtatatgaggtttttccttgtcctgcgataaccagagttcctggcgctaagccttgggtagtgggagtagcaaatatccgcggctatatattgccccttatagatctgcatgcctatatctatggtgctccatcacagcggactcatagaagcaaagttttagttgtcaccaaggaaaaatttcttataggtttgttggtagaagaagttttcggactcaagcattttttagacgaagaatggactgggcagaatcttccatcgcatgatcctcttactcgctatattcaaagaggatttgctcagaacagagaaatatggctggaatttgattttcatctgcttatggaacaagagagttttttcctagcaaccacctag

SEQ ID NO: 1073 - DNA, 531 bp, Rhodoferax ferrireducens T118
atggctaatcgcgaagcacttcgagaactccagacccgccttgccagtcgattgcaggcagctcgctccggggacgtgtcagttgcgtggctggctgtcaaggcgggcgagtcaaactacctttttccgctggcgcaatccggcgagatatttccactgaccaacgttcaggttgtcccctattgccgtcaatggttcatgggtgtcgtcaatcttcgtggtggcctttttggcgttgtcgatctggcaagtttcatgagcggcggatcgactcggggcagaaccgaacagtcgctcgctgagtccagtgtcatcacgatcaactcggcgctggagctcaattgtgctttgatggtggacggcctggccggacttcgcaagcgtgatgcgtttgccggtgccgaggcgccacccgagggttctccggttttttttggcacccggtttactgaccgcgacggcgcgcattggcaggaaatcaacttgcagtccttgtctcaacttccagaatttctcagcattagcgcttaa

SEQ ID NO: 1074 - DNA, 540 bp, Saccharophagus degradans 2-40
atgagtcagaacgccgcctttcaggcgttagtacacctgtcaagccttagccgcagcgcggccaagggtcttcccgagcaaatgaacgtcgtgccgcgttggagtggtgtgggtttttctgtgatgggcaaaaagtttgtagcccctatgggccaagtgacagagttaatggagctgccttcttcaacccgtttacccggcgtgcagccttgggttattgggttgtctaatgtgcgcgggcgcctgctgccgctatttgatttggcgcattttttcgaaggaaaaatgaccgggcacaaaaaaaatcaccgtgttttagtgttggaaacagacaccctgtacagcggcttagttgtagatagggcgtttggtatgcagcactttaacgtggatagttttagtacggatactgccgagctggattcccagcttacgccgtttgttgacggcacctatcaggacgatagtggtgagcgctggaacgtttttagtgttgcaaacctcgccgcagatgcaagatttattaatgctgcgctatag

SEQ ID NO: 1075 - DNA, 528 bp, Methylobacillus flagellatus KT
gtggccagaccgaggattaatctgcaggcttatcagcaaggtatcttggagcgcctgcagcatgtcgcgacggactcgggtgcggcggacaatgccaggctgggtatccatgccggggggcagcaataccttgtggccttgcgggatattaaggaagtcttgcctgtaccggaaatccacgccgtgcctctggtacagccctggtttcttggcatgtgcaatattcgcggcaacctgtacgcagtcaccgatttggccaggtttctggggagcaggcaccagccggccgtcatgacggccgaaagccggttgatgctggtgcatgatgactttgacatcaatgctgcctttctcatcgacagcctggccgggctgagaagtcttggggatttcaagccgctggaaatggtggctgatgggccatcctatatcacgtcgcggcatgaggacgatcaacatcacctgtgggaggagctgaacatggccctcatccttgaaaagcaagaattcctgcaggttgccgcctga

SEQ ID NO: 1076 - DNA, 531 bp, Polaromonas JS666
atggcgaacagacaagccctcagagagctacaaacccggctggccgacaggttgcaggttgcgcgaacgcagggcgttgctgcatcctggctggctgtggaggctggcggaaggaactacctgtttcccctgagccagtccggtgaaatttttccgtgggttcacacgcaggcggttccctatacccaggcatggtttgccggcgttgccaatttgcgcggcggcctctttggcgtggttgatctggcaagttacgtgagcggcgaggcgccgcccccgaagactgaacttgcgcgcgctgagtcgaggcttgttgcgctcaatagtgcgcttgaagtcaattgcgccctgctgatcgacagactggccggcttgcgcaagcaggatgccttcgtcgacttctcggaaaaggcgcccgatgcgcctgaattttttggcaaccagtacgttgacctcaatggtgcaagctggcaggaaatcaatcttcagttgcttgcccagcaagctcattttttgacgatcggcgcatag

SEQ ID NO: 1077 - DNA, 531 bp, Psychrobacter cryohalolentis K5
gtggcatcgagaggatttattgagcttctgcgtatagcagatatggcacgttcgcgtaaaagcggacgccgcggcggacaagaatttgactggcaaggggtagtatttgagattggcggacaacgcttggttgcgccaatgggtcaagtagcagaagtattatccatgccagaatataccagcgtgcccttagtaaagccttggatgcttggtattgctaatattcgtgggcgtttactgccattgaccgatttgtctcgatttttacaagtccccagtcggttagcgcaaatgagtcagcgtaaggtgatggtcattgaccatgaaaatgtgttttcagggttacttgttgaccaagtgatcggtatcgaacagtttactcaagaccaatatcgtccagaagccattgaaccgaattcgccatttgcaccttataaccatggcaaatttttcaaagatgaacaagattggtatgtgtttatgccaagcttactgacacaggatctacagtataccgatgctgcaatataa

SEQ ID NO: 1078 - DNA, 543 bp, Cupriavidus metallidurans CH34 uid250
atgaacgcgccgcgccaagaccttcgtgcccgccagacccgcctgcaggattaccaggccatgctggcccggcgtctgcgcgacgcgcgcaacctgccggccgtcgatagctacctgggtgtggtggtgggccagcgcaactggctgctgccgttgctggaaaccggcgaggtgatcgagatgcgccagcccgccggcgtgccgctgacgcagccctggtatcgcggtctcgtcaacgcgcgcggcaacctgctgggcgtgatcgatttcgccatgttctgcggcgacggccccacgccggtacagccgggcagcaagatcgtagtcctgtcgcgtcacgtcgaacgtgcgtgcggcatcatcgcgacgcgcgtgctgggcctgcgccatgcggtggatctgacgccggctcagggtgacgaacccgaaggctggcagggcttgcgcttcgcggacaaggaggggcgtggctggcaggtgctcgatatcgggcagttgctggcgtcgcccgcgtttctgcaggccggccgtaccgtggcttga

SEQ ID NO: 1079 - DNA, 552 bp, Alkalilimnicola ehrlichei MLHE-1
gtgttgagcctggaggaacagcccaccgccttcgatgccctgcgggccctggatcggatgggccgtgcccatcccctggacctgacggtcgacgaggggggcgagtccgaatggtacggggtggcggtgcggttctccgggcgccatttcctgctgccgatgcacgaagtggcggaggtgatgccctgccccccgctgacccccgtgccccacacccgcgattgggtcaagggcgtggccaacgtccgtggcaccctgatcccggtcatcgacctggacggcttcttcggccagggcccggtcaacatgtcccacctgacacgcattgtcatcatgcgcgccggggaggtggtggccggcctgttggtggacgaggtgctggggctgcgcccctgtgctcgcggcggttggctggcccaggtgccgggcgggctgtcgtccgacctggcgcgctgcatcgccggggtgtttcagcgcgaggatggtgactggccggtctttcgcccggtgcggctggtgcgtgacccccgtttcatgcgggtggcggcctga

SEQ ID NO: 1080 - DNA, 537 bp, Pseudomonas aeruginosa UCBPP-PA14
atgtcggacgttcagacccccttccagctcctcgtcgacatcgatcagcgctgccgacgcctggccgccggcctgccggcccagcaggaggcggtgcagagctggagcgggatcggcttccgcatgggcgggcggttcttcgtcgcccccatgggggaggtcggcgaagtcctgcacgaaccgcgctacacccagctgccgggcgtgaagacctgggtcaagggggtggccaacgtacgtggccgcctgctgccgatcatggacctctgcggtttcctcggcaccgaactgtcgcccttgcgcaagcagcggcgggtgctggtggtggagcacctggacgtgttcgccggcctcatcgtcgatgaggtgttcggcatgcagcacttcccggtggacaccttcagcgaacagctgccgccactagaagcggcactgcaacccttcattcatggcgtcttccatcgagagcagccgtggctggtgttcagcccgcatgcgctggcgcaacaccagggcttcctcgacgtcgccgtataa

SEQ ID NO: 1081 - DNA, 528 bp, Acidovorax avenae citrulli AAC00-1
atggccaatcgcgaagcgctccgagaactccagacccggctggcggcccgattgcaggccgcgcgggtcgaaggttcgtccgtgtcctcctggctggccgtggagtcggccggccgccgtttcctgcttcccctgggccagtccggagagatcttcccgtggacgggcgtgcagcccgtcccctatacccagggctggttcctcggtgtcgccaacctgcgcggatcgctgatcggcgtggtggacctggccggcctgctggggcagtccaccgcccgcaccgagcaggcgctcggcgaggccagcctgctcgtgctgaacgccgcgctggaggtgaacgcggcgctgctggtcgatcgcctctcgggcctgcgcggcaccgatgccttcgtggactcatcgccccccggtgacgacgcacccccgtacttcggcaccacctacctggatgccgaggggaccccgtggcaggagctgaacctgcaggcgctctcccaacaccccgcattcctcagcatcagcgcttga

SEQ ID NO: 1082 - DNA, 528 bp, Acidovorax sp. JS42
atggctaaccgcgaagccctgaaagagctacagacacgacttgccgcccggctgcaggctgccagaggcgagggtgtgtccgtgtcgtcctggttggccgtggagtctgccggacgctatttccttctcccccttggacaatcgggggagattttcccctggggcggggtgcagcccgttccgtatacccaaccgtggttcctgggcgtggccaacctgcgtggcgcgctcaccggcgtggtggatctggcgggcctccttggcgccgcgcagatgcgcacggagcaggccttggcagaatccagcctgctggccttcaatggtgcgctggacgtgaatgccgccttgctcgtggaccggctgtccggcctgcggggaatggaggccttcgtcgcctccgagccgccggaggccgatgcgcccccctatttcggcaccacctatcttgatgcacagggcacgcgttggcaggaattgaacctgcacgctctttcccagcatcccgcttttctcagcatcagcgcttga

SEQ ID NO: 1083 - DNA, 531 bp, Polaromonas naphthalenivorans CJ2
atggcgaacagacaagcccttaaagagctacagacacggctggcagagcgattgcagcttgccaagatgcaaggcattgcaccctcgtggctggccgttgaagccggtagcaaaaaataccttttccccctggctcaatccggggaaattttcccctggatcggcatccagccggtttcctatacccagttctggtttttgggtgtggccggcttgcgtggcggtctttatggcgtggtcgatctggccggttttgtgagcggccagccatccgtttcgagaaatgaacttgcccgtacagagtcgaggcttgtttctttcaatagcgcgcttgaggttaattgtgtcttgctgatcgacaagctagcaggattgcgaaaacaggatgccttcatcgatttctcggtgcgagcgcccgatgcacctgcattttttggaaaccagtacgttgatatcaatggtgcaagctggcaggaaatcaacctgcagttgcttgcacaacaagttcattttttgaccatagctgcttag

SEQ ID NO: 1084 - DNA, 528 bp, Verminephrobacter eiseniae EF01-2
atggccaaccgcgaagccctgcgagagctacagacccggcttgccagccgcctacaggctgcaagggacgaagccacgtctgtgtcatcctggctggccgcagagtccgccgggagttcttatttgttgccgctgggacaatcgggggagatcttcccctgggtctcggtacaaaccgtgccctatacccaaagctggtttctcggcgttgccaatctgcgcggcggtttggtcggcgtggtcgatctggcgggcctgctgggctcggtcgtgccccgcaccgagcaggctttggccgatgccagcctgctggcgttcaacaccgcgctggaggtcaacgcggcgctgctggtcgaccgcctggcgggtttgcgcggcaccgatgcctttgtggcgtccgagccaccggccaaagattcgcccccgtactttggcaccacctatatcgattccagcggcaagcgctggcaggaactgaacctgcagatcctgtcccgacaccccgcttttttgagtatcagtgtttga

SEQ ID NO: 1085 - DNA, 525 bp, Methylibium petroleiphilum PM1
atggccaagaaggaagcgctgcgtgaactgcagacccggctcgccgagcggctgcaggccgcgcgactgcagaagtccgagacggccacctggctggctgtcgagtgcggcgggcagggcctgttgctgccgctggggcaggcgagcgagatcttcccgctgacggcgctgatgccggtgccgcacaccggtgcctggtttctgggtgtggccaatctgcgggggcgccttcatggcgtggtcgatctggcggtcttcctgggcctgcgcgcggcgccgccccaggagttcggcccccagtcgcgactgatcgcgttcaatccggcgctggaagtcaactgcgccttgctggtcgatcgactggccggcctgcgctcggccgaccagttgcgggtcgtgcccgacgaggcggcccatccggccttcgccggcgctacctatgccgacgccggtggccggcgctggcaggagatcgtgctggcggaactggctggcgaagaggcattcctgaggatcgcccggtga

SEQ ID NO: 1086 - DNA, 546 bp, Marinobacter aquaeolei VT8
atgtccgcccaggccgccccttttgccgttctgacggatatcgcccagcgcagccggtccatggccgccggtctgccggaacaacaggaagccgttgaactctggaacggcatcggttttattctctcgggcgagcgctacgttgcccccatgggcgaagttaccgaaatcctgcatgtaccccggttcacccatgttccgggggttcggtcgttcctgatgggagcggccaatgttcgcggccgcctgttacccctggtcgatctcgccacctttttcgatgtgccccgctcttcccgcagcctgcgtgaacggcgggttctggtggttgagcagggcgacgtattcagtggcctggtcgtcgacagcgtactgggcatgcagtacttcgccaaagacagtttcagggccacccccgacggggtgcccgacagcgttcgtccgtttgtgagcggcggttacgagcgtaatgaggaggtctggaaagtgttctcagccaccgatctggtggaagacgaacgctttcttgatgttgcacagtggtaa

SEQ ID NO: 1087 - DNA, 534 bp, Pseudomonas mendocina ymp
atgtctgcgcagactcctttccagattctccttgagattgaccagcgttgccgtgccctggcggctggcctgccgtcgcagcaggcggcggtgcagacctggagcggcatcggctttcgtatgggggagcgcctgttcgttgcacccatgggggaggtgggtgaagttttgcacgagccgcgctataccttgttgccaggcgtgaagagttgggtcaaaggggtggccaacgtgcgtggccgcctgttgccgatcatggatctgtgcggcttcttcggtaatgaactgtcgccgctgcgcaagctgcggcgggtgctggtggtcgaccaccaggaaatcttcgccggcctgacggtcgacgaagtcttcggtatgcagcatttccccgtggatgcctactcagaacaactgccgcctctcgaggcgagcattgcgccgttcatccacggtgtcttccagcgagaacagccctggttggtattcagcccctacgcgctggctgccgatccgggttttctcgatgtggcttattaa

SEQ ID NO: 1088 - DNA, 555 bp, Pseudomonas putida F1
ttgaccacccgcccgcaaggcgcgtcgctgaccgcctttgagttgttgctggacatcgaccggcgctgtcgcctgctggttgccgaccagccgccgcaggacaaccgcgtgcagcagtggagcggcattggctttcgcattgccgggcagtggttcgtcgcgcccatgggcgaagtggccgaggtgctgcgcgaaccgcgcagtagccgcgtccccggcgtgcagccgtgggtgtgcggggtggccaacctgcgtggccggctgttgccggtgatggacctgagctgcttcttcggcctgggccacgccgcaccgggcaagcagcggcgagtgctggtgctggatcacgacgacctgttcgtcggcttgctggtcgacgaggtgctgggccttcagcactttgccctcgacagcctgcagctgtcgccgccgcagcctctgatccttgccgctgcgcgctttgtgcaggggtattttccgcgtgaacgtaactgggcgatcttcagcccctttgccttggcccaggcgccaggctttctcgatgtggcgttatag

SEQ ID NO: 1089 - DNA, 540 bp, Psychrobacter PRwf-1
gtggctttaaagggatttattgagttactgcgcttagagcatatggccaaatcacgccaagtggagcgtcagcaagggatggataccccatggcagggagtggcattttgtgtggctgggctaaattttgtggcccccattggtgaggtgaccgaggttatcagcttccctaacagcctaactgaggtacctatgagcaagccgtggctgttagggattgccaacatacgtggtcaactgttgcccttggtggatctggcaagctttgtcaacctatctggtacagcggaacaattaaaccgtcgtaaagtactggtagttaagcagcaagacatagcagtcgggctattggtcgataccgtgtggcacataaaaaacttcttacctaagcattacctgcctgagcacctgccagctggcgccccttttttaccctatacccacggtcaatttgtcaccgataccgagcttgaggcttggccgatatttaggccaagcttattgttagccgatcctaggtttttggaagtatccctttaa

SEQ ID NO: 1090 - DNA, 537 bp, Pseudomonas aeruginosa PA7
atgtcggacgttcagacccccttccaactcctcgtcgacatcgaccagcgctgccgacgcctggccgccggcctgccggcgcagcaggaggcggtgcagagctggagcgggatcggcttccgcatgggcggccggttcttcgtcgcgccgatgggcgaggtcggcgaagtcctgcacgagccgcgctacacccagctgccgggcgtgaagacctgggtcaggggagtggccaacgtgcgtggccgcctgttgccgatcatggacctctgcgggttcctcggtaccgaactgtcgcccttgcgcaagcagcggcgggtgctggtggtggagcacctggacgtgttcgccggcctcatcgtcgatgaggtgttcggcatgcagcacttcccggtggacaccttcagtgaacagctgccgccgctagaagcggcactgcaacccttcattcatggcgtcttccatcgagagcagccgtggctggtgttcagcccgcacgcgctggcgcaacaccagggcttcctcgacgtcgccatataa

SEQ ID NO: 1091 - DNA, 528 bp, Delftia acidovorans SPH-1
atggcgaaccgtgaagcactgcgcgatctgcaatcccgtctggccggccgtctccaggccgcacgcagcgaaggcgtcaaggtggcggcctggctggccgtccaggccggcgggcgcaactacctgatgccgctgggccagtccggcgagatctttccctgggccggcgtacagcccgtgccctatacaaagccctggttcctgggcattgccaacctgcgcggcaccctggccggggtgatcgacctggccagcctgctgggccatggcgtggcgcgcagcgaaccggcgctggccgagtccagcctgctggccttcaatgccgcgctggaagtgaacgcctccctgctggtggaccgcctgcagggcctgcgcagcgccgacgcctttgtgcgcaccgagcccgcgcccgagcaatcccccgcctttttcggccccgtgcatatcgatgaagcgggccaccgctggcaggagctgcaattgcagcgcctgtcccaaacctccgagtttctgagcattcgcgcctga

SEQ ID NO: 1092 - DNA, 555 bp, Pseudomonas putida GB 1
ttgaccacccgcccgcagggcgcgtcgttgaccgccttcgagttgttgctggacatcgaccggcgctgccgcctgctggtggccgaccagccaccgcaggacaaccgcctgcagcagtggagcggcatcggttttcgcattgccgggcagtggttcgtcgcgcccatgggcgaagtggccgaagtgttgcgcgaaccgcgcagtagccgtgttcccggcgtgcagccgtgggtgtgcggggtggccaacctgcgtggccggctgttgccggtgatggacctgagcagcttcttcggcctgggccacgccgccccaggcaagcagcggcgggtgctggtgctggaccacgatgacctgttcgtcggcctgctggtggacgaggtactgggcctgcagcactttgccctcgacagcttgcagctgtcgccgccgcaaccactgatccgggccgctgcacgctttgtgcaggggcacttcccgcgtgaacgcaactgggcgatcttcagccccttcgccctggcccaggcgccgggctttctcgatgtggcgttatag

SEQ ID NO: 1093 - DNA, 555 bp, Pseudomonas putida W619
ttgaccacccgcccccaaggcgcgtcgctgaccgccttcgagctgttgctggacatcgaccggcgatgccgactgctggttgccgaccagccgccgcaggacacgcgcctgcagcaatggagcggtatcggctttcgcgttgccgggcagtggttcgtcgcgccgatgggcgaggtggccgaagtgtcgcgcgagccgcgcagcagtcgggtgccgggcgtgcagccttgggtttgcggggtagccaatctgcgcggcaggttgttgccggtgatggacctgagcagctttttcggcctcggtcctgcggcatcgggcaagcagcgacgcgtgctggtgctggaccatgaggacctgttcgtcggcctgctggtggacgaagtgctcggcctgcagcattttgccctggataccttggagctttcgccaccacagccgctgatccgcgccgctgtacgattcgttcaggggcatttcccgcgtgagcgcaactgggccatcttcagccccttcgccctggcccaggcgccgggctttctcgacgtggcgctatag

SEQ ID NO: 1094 - DNA, 531 bp, Leptothrix cholodnii SP 6
atggccaacaaggaagcgctgcgcgaattgcaaggccggctggccgagcgcctgcacgaggtcaagacccaggagcgcacgctctcctggctggcggtcgagtccggaggccacggcttcctgttgccgctggccgaggccggcgagatcttccagcccggcgcgctgctgtcggtgccgcacgcgctaccgtggtttctgggtgttgccaacctgcgcggcgtgcttgcaggggtggtcgatctggcaggatttctcggattgcgctcccggctgcccgaaggcgagcgcgatcaggcacgggtcgtcgccttcaacccgacactcgagatcaacggcgccttgcaggtcgatcggctggcgggcttgcgcaaccagactcagctcacgcccgaggcggtcgatgtgcatgctcagcccggctttgtcggcggtcgctaccacgacgccggcggtcgggtctggcaagagttgcggctggccgtgctggcccgcgacgagcgctttcttcgcatcgtcaagggtgcgtga

SEQ ID NO: 1095 - DNA, 531 bp, Xanthomonas oryzae PXO99A
atgcgctctccattcgatattctcgaagactacgagcgtcgtagtcttgcgcacgccacgccgctgccggaacgccagttctctgcagatatctggcgcggcgtaggttaccgcgtcggtacccggcgattggtttctgacttccgcgaagtggcggaaatcgtgccgatgccgccagtgactccggtgccgggcgcacagccctggctgctgggcgtgggcaacctgcgcggcaatctatttccggtgatcgatctgaagcagttcctggagggccgtcgcacggtgctgcaggaaggccagcgtgtgctgatcatgcgtcagagcggcggcgacgtcgccctgaccatcgatgagctgtacggccaacgcagcttcgagcaggtccaggcggtggaacccggcgagttggcgcaaggccgctacgcccactttatcgaccgtgccttccgcaacgagacgcaggactggggggtgttttccctggccttgctgtcgcgcactcctgaattccggcaggccgcggcctaa

SEQ ID NO: 1096 - DNA, 546 bp, Ralstonia pickettii 12J
gtgaacgaacagcgcaccaacctgacctcccgccagcgcctgcacgaataccaagcgatgctggcccgccgcctgcaggaggcgcgcgccaagtcggcgacggaaggctttctgggcgtgcagatcggcgagcaccactggctgctgtcgctgaccgaaaccggcgaggtgctggactaccagccgcccgcacgcgtgccgctgacgcagccgtggtacctcggtctcgtgaatgcgcgcggcaacctgctcggcgtgatcgatttcggcttgttctgcggtgaagcgccgacgggcagtggcagcggcgccaagatcgtggtgctgtccaaagacccgcagcgtgcgtgcgcgattgtcgtgccgcgcgtggccggcctgcgcagcctgagcgatctgcagcccgcggaagccacggcggaagaggggcgtccgtggttggggcgcgcctggcgcgacgcgcagggcacgcaatggcgcgaactggatgtgcggcagttgctggccgatccggcgttcctgcaggtcggccgcagccgcacgtaa

SEQ ID NO: 1097 - DNA, 531 bp, Stenotrophomonas maltophilia R551 3
atgcgctcgcccttcgacattcttgaagcctacgaacggcgcagcctggcccatgcggtgcagctgcccgaacggcagttcgcccaggacctgtggcgtggcgtcggctatcgcgtcggccagcgtcggctggtgtccgatttccgcgaagtggtggaaatcgtaccgatgccgccggtaaccccggtgccgtgcgcgcaaccgtggctgctgggcgtgggcaacctgcgcggcaacctgttcccggtggtcgacctgaagtacttcctggaaggcacgcgcactgtgcagcaggaaggccagcgtgtgctgatcatgcgccaggccggcggcgacgtcgcgctgaccatcgatgaactgttcggccagcgcagcttcgaactggcccagcagatcgaggccggtgcactggccgatgggcgttatggccattttgtcgaccgcgcctttcatgccgacggccaggactggggcgtgttctcgctctcgctgctgtcgcgcacccctgaattccggcaagccgcggcctga

SEQ ID NO: 1098 - DNA, 507 bp, Thauera sp. MZ1T
atggcccgcagcagcctgcgcgaattccaggaacgcctcgcccgtcgcctcgccgaggccgccggcgccgagcgccgcggcctgctcggcttccagtgcggcagcgacaactggttgatcgaactcgccgaggccggcgagatcctgcccccgccgcccttgtccgcggtgccgctcacccgcccctggttccgcggcctcgccaacgtgcgcggcagcctgtacggcgtggtcgacttcgccgccttcaacggccagccgccgatcagcgccggcgggcgggcgcgcctgctgctgatcggtgcgcgccacggcatccacagcgcgctgctggtgtcgtcctcgagcggcctgcgcagccacgaggacttcgagcccgccccgggcggcgatgccccgccctgggtggcacgccgcctgcgcgacatgcagggccgcgcgtggctgcagctcgaccccgcccgcctgctcgcccaacccgccttcctcgacgccgggctggaatga

SEQ ID NO: 1099 - DNA, 546 bp, Thioalkalivibrio HL EbGR7
atgtccgccgtccttcagaatcccttcgaatatctccagcttctggcccgcaagggtgaggagctggccggcaagctgcccatgcagtcagtgcagaaggaggcctggaagggcgtgctgttcgggctgcgggggcagcaactgctggcccccatgagtcaggtggcggagattgtcaccccgcctccggtgacccgcatccccggtgtgaaaccctgggcctgcggcatggccaacatgcgcggcaacctgctgccggtgatggatctgcagggcttcctgttcggagaaaacctcccccgtgactcccggcgccatcgcctgctggtggtgaactaccagggtgtctacgcgggcctggtggtcgagtccgtgcagggcatgaagcattactggaccgatgatcgcgtcatggaactgcccgaggccgatccggccctgcgcccctatctggacggtgccttccatgcgggccaggaacacctggccgtgttcagcccctggcggcttgcccaggacgaacgctttctgaatgtatccacctga

SEQ ID NO: 1100 - DNA, 528 bp, Diaphorobacter TPSY uid29975
atggctaaccgcgaagccctgaaagagctacagacacgacttgccgcccggctgcaggctgccagaggcgagggtgtgtccgtgtcgtcctggttggccgtggagtctgccggacgctatttccttctccctcttggacaatcgggggagatcttcccctggggcggggtgcagcccgttccgtatacccaaccgtggttcctgggcgtggccaacctgcgtggcgcgctcaccggcgtggtggatctggcgggcctccttggcgccgcgcagatgcgcacggagcaggtcttggcagaatccagcctgctggccttcaatggtgcgctggacgtgaatgccgccttgctcgtggaccggctgtccggcctgcggggaatggaggccttcgtcgcctccgagccgccggaggccgatgcgcccccctatttcggcaccacctatcttgatgcacagggcacgcgttggcaggaattgaacctgcacgccctttcccagcatcccgcttttctcagcatcagcgcttga

SEQ ID NO: 1101 - DNA, 534 bp, Variovorax paradoxus S110
atggccaatcgcgacgctctccgagccttccagtcccggcttgcaagccgcctgcaggctgcgcgcacgaccggcgtcgccgcctcgtggctcgcggtcgaggcgggcgagggcaagtacctgttcccactcggccacgcgggggaaatcttcccgtggacgccgccgcagcccgtgccctacacgcagccctggttcctgggcgtggccaacctgcgcggcggcctctatggcgtggtgcacctgtcggcattcgcctcgggtgcgccggacaacacggccgccaccgaggcggcccgcatgcaatcgcggctcgttgccctcaacgaactgctcgaagtgaactgcgcgctgctggtcgaccggctggcgggactgcgcggcgccgaggccttcacggcttcggagccgcctggcgcacaggcacccgcctggctggggcatctgtacaccgatgcggcgggcgagcgctggcaggaaatcaacctgcaggcgctttctcagcaacccgagtttttgagtattggcgcctag

SEQ ID NO: 1102 - DNA, 546 bp, Ralstonia pickettii 12D
gtgaacgaacagcgcaccaacctgacctcccgccagcgcctgcacgaataccaggcgatgctggcccgccgcctgcaggaggcgcgcgccaagtcggcgacggaaggctttctgggcgtgcagatcggcgagcaccactggctgctgtcgctgaccgaaaccggcgaggtgctggactaccagccgcccgcacgcgtgccgctcacacagccgtggtacctcggtctcgtgaacgcgcgcggcaatctgctcggcgtgatcgatttcggcctgttctgcggtgaagcgccgacgagcagtggcagcggcgccaagatcgtggtgctgtccaaagacccgcagcgtgcgtgcgcgattctcgtgccgcgcgtggccggcctgcgcagcctgagcgatctgcagcctgcggaagccacggcggaagaggggcgcccgtggttgggacgcgcctggagcgatgcgcagggcacgcaatggcgcgaactggatgtgcggcagttgctggccgatccggcgttcctgcaggtcggtcgcagccgcacgtaa

SEQ ID NO: 1103 - DNA, 555 bp, Jannaschia CCS1
ttgagacacgttgtatcagcgctgatcttcgccggccttgcttgcgccatgccccttgccgcgcagcaattcgatgttatcgacggcgtcggagggtttgatggattcgagcttgatatgggcgacgaggacggcacgggcctgaccctgtcggagggggcagataccggcgatatccagttaaacctgggcaccggggcggcaggcacgttcgagacattccctggcgtgacgggccctgtgacctccatcagccagcccgcgacggaggttgggacgaccgtctcgctccgcgcgctcgacaagatgttggggcaacccacggatatcgagctgtcgatgggtcagacagtggtctttggccgtgtcgcgatccgggtgatcgaatgccgctatcccgccgcagacccgggcggcgatgcctttgcgctgcttgaggtgctgaatatggaaggcgagacgctttttgacggatggatgatcgcgtccagcccggccctgaatgcgttggagcattcccgctacgacgtctgggttttgggctgttcggcgtaa

SEQ ID NO: 1104 - DNA, 438 bp, Ruegeria sp. TM1040
atgaagcgcctgatcacacttgctttttgccttctggcatcggcgccgctttcggctcagacgatctctgtcgaggagcttgacccggtgatcgtgcagccgcgcgtccccgaaagccgtgagcgtgttgaacgcatcgaggcaaccgagggtacacttacgagcctgcgcgggctagataaggtcaacggcaagagtgtcgatgtcgaggtgcagaccggtggcacggcagagatcttcggcctgatcgtgactttgcgcgagtgccgctatccaacagagaacccctcgggggatgcttttgcgtatctgacgatccgggatcgccaggacggcaaagtgttctttgatggttggatgattgcatcgagccccgcgctcaacgcactcgatcatcgccgttacgacgtctgggttctgcgctgcaagagcacctga

SEQ ID NO: 1105 - DNA, 492 bp, Rhodospirillum rubrum ATCC 11170
atgctccgtctggtttccagcccccgcgccgccgttctttcggcaacgggcggcctttgcctgatgcttgccgccaccgccccggccggggccgaggatatcaacgccgataccgcccgcctgggctggcttgacaagaccacggcgcgggtgggcgaaagcagcatcgccgtgggcggcgacctgcggctggggtcgctgaccatcaccgtgcgctcctgcgtgcgccgggtgccgcccgacgatcccgaaagcgccgctttccttgatatcgtcgaacgcgccgaaggggtggcggccaagcagatcttcgaaggctggatgttcgcatccagcccgtcgctctcggcgatggaccacgcggtttacgatgtctgggtcctgcgctgcgagatcccggccgaccgtgacgccggcgatagcggcaagcccgaaagcgcccccgaagccgcccccatcccggtcgatcccggcggcgccccgctcgattaa

SEQ ID NO: 1106 - DNA, 372 bp, Rhodobacter sphaeroides 2 4 1
atgaggcttctggcggtgctgctgcttctggcggcgcccgcctgggcgcaggaccagcgcaccggggaaggcaccggcgccctgctgcgctggctcgacaagatgtcgggcgagaccgccgacgtcgagctgcagcgcggccagtcggccgtcagcggccatctgaccatcgaactcgacgaatgccgcttcccggccggagacccggcctcggatgcctatgcccatctgacgatccgcgattcgcgcgcagccgagcccgtgttcgacggctggatgatcgcctcgagcccggcgctctcggcgctcgaccatccgcgctacgatgtctggctgttgcgctgcaccactgaggcgggatcggcccagtag

SEQ ID NO: 1107 - DNA, 492 bp, Paracoccus denitrificans PD1222
atgaccgaccttctgacccgcgcctgcctgtgcctgctgctggccgccagccccgtccttgcccaggaggagccggccgaggaccagcagttgatgatcgacccggccttcagcgacgatcccgaggcggtcgttccggccgagccttcggcggccgagcgccaacgcgcggccgaggccgcacgcgggcccgagacggcgcgaggcaccggggcgcaactgcgaggcctcgacaagattaccggcaggacgcaggatttcaccctggccgtaggcgaggtggccgagttcggccggcttcagctcagcctcgcggaatgccgctatccggcggcggacccgacttcggatgcctatgccgagctgacgatcaccgacagtcaggccaatgcgcggctgttttcgggctggatgatcgcctcgtcgccggcgctctcgtcgctggacgattcccgctacgatgtctgggtgatttcctgcaacagggcctga

SEQ ID NO: 1108 - DNA, 372 bp, Rhodobacter sphaeroides ATCC 17029
atgaggcttctggcggtgctgctgcttctggcggcgcccgcctgggcgcaggaccagcgcaccggggaaggaaccggcgccctgctgcgctggctcgacaagatgtcgggcgagaccgccgatgtcgagctgcagcgcggccagtcggccgtcagcggccatctgaccatcgaactcgacgaatgccgcttcccggccggagatccggcctcggatgcctacgcccatctgacgatccgcgattcgcgcgcagccgagcccgtgttcgacggctggatgatcgcctcgagccccgcgctctcggcgctcgatcatccgcgctacgacgtctggctgttgcgctgcaccaccgaggcgggatcggcccagtag

SEQ ID NO: 1109 - DNA, 372 bp, Rhodobacter sphaeroides ATCC 17025
atgagggtcctggcggcgcttctgctgatggcggcgccggccctcgcgcaggatctccgcacggccgagggcagcggggcgctgctgcgctggctcgacaagatgtcgggcgaaaccgccgatgccgagctgatgcgcggccagtcggcggtcagcgggcacctgaccatcgaactggacgagtgccgctatccggccggagacccggcctcggacgctttcgcccacctgacgatccgagactcgcgtgcggcggaacccgtcttcgatggctggatgattgcgtcgagcccggctctgtcgtcgctcgatcatccgcgctacgacgtctggctgctgcgctgcacgaccgaggccggatccggcgaatag

SEQ ID NO: 1110 - DNA, 582 bp, Acidiphilium cryptum JF-5
atgagcctccgtcgcgccggcgccgtcgttctggtggtcgcgatgttcgcggcgctgccgggccgcggacttgcgcagtccggtcaatcggtggtgacagtgccggaggccccgcccgtcgcctcggcgccgagcccagccatgccggatggcgcgctgccggcgccggacctaccgaacgcgcccaccttgccgggtgaccagggcggcgcctttgcaggacctgcaaccccgaaagggtcgcaggcgacgccgcctgcgccgccgaaacaggtcaagccgatctgggatccgcgccaggccgcgattctcgacgtgcttgagaaggccgatggcgcggtgaaccggatcatcgcgcccgtcgggtcgagtttcaccgaaggcgcgctgcgggtgacgatcggcgcctgtgtcgtccgcccggccgacatgccgccggacgctgcggtatacatgaccgtgcggcacggcatggctgcccccgacctgttccgcggctggctgatccgctccgagcccggcgccaccgtggtgggtgacgctgcggtgacattccgcctcatcggttgttccgctggctga

SEQ ID NO: 1111 - DNA, 261 bp, Sphingomonas wittichii RW1
gtcaccgaaggcacgccgatgggcgagcgggtggcggtgctcggcctgctcaacaagcgcaacggcgaatcgcgcgacgtcaccctgcggccgggtcaggcgatccggatcggcgacgtcgtcctgcgcctgcgcgcctgcgagacgaccgccccctgggaggatcagaagctgaccggcgccttcgtccagaccgacgtgcgcggccgcgacggcgcctggcggcgggtcttctcgggctggctgttcaaggaatcgccg

SEQ ID NO: 1112 - DNA, 408 bp, Parvibaculum lavamentivorans DS-1
atgcgccacctcgcgcgccttgccgccgcatcggccattctctgcctttcggccgcgccggcattcgcggacaaatatcccgtcgccgtcttcagcggcctcgataagacgaccgcgcgcgtcacaagcttcagcgtaaaggtggatgagcctgcgcaattcggctcgctggaggttctcgtccgcgcttgcgacaagcggccgccggaagagccgccgcagacggccgctttcctcgaaatccgccagatcgaccgcgacgacgacagcgttcagccggcgccgattttcgagggatggatgtttgccgaaagccccggcctgaacggcctcgagcaccctgtctacgacatctgggtgacggactgcaaaaccgcctccggcggcgcatcgaccggcagcgagtag

SEQ ID NO: 1113 - DNA, 543 bp, Dinoroseobacter shibae DFL 12
gtgatccgcaccacgctggcggttgccctgctctgggtcggatgcgcggccgcggcccagcaggaggcgatcatcatctcgcccctcgatgagctcgaagaacgcgccgagggcgaagaggacggcttcggtggggagttgcgcctgcgcgacgaggagttccagaccttcgagcaggagctgcgcgtctccgcggccgaagccggcctgatccgcgtgctcgacaagaccaccggccgcgtcgagaccctggaaatccccgccggtgaggcccggcagagcggtcggctcagcatcactttgatcgaatgccgctttcctgaggaaaaccccgcctctgacgccttcgtgcacctgcagatcaccgagcgggacacgccgctctatgacggctggatgatcgcgtcctcgcccgcgctcgccgcccttgatcatcaccgctacgacgtctgggccctgcgctgtgccaccccgggggaggaagaagccacccccgaagttgccgccggtctgcaatccccgcgaccgaccgcgcggccctga

SEQ ID NO: 1114 - DNA, 945 bp, Ralstonia solanacearum
atggagattaggcatctgcgttgttttcttgcggtcgccgaagaactccacttcgcccgcgcagcggagaagctgcatatcgagcaatcgccgctgtcgcgcaccatcaaagaactggaagaagacctaggcgaacagttgttcatccgcaccagccgcagcacacgactgacgcgggcgggaaaactgttccttgagcatgtgccacgtgtgttcactgccttgcaacaagcgcgcgacagcgtgagggccgcaagcaatggattccacggtcagttgcgcatcgcactgtccgacggcatcacgccgtcgcgcctgccagctttgctggcgatgtgcaggcaggaggaacccgaggtcgatatccgtctgttcgaggtgccgctgtcgcaacagatcaagggactgcatgacgacctgtacgacgtgggtttcgcccagtccgatgaggtaggcgaatgcatcgcagccgaagcggtgtggagcgatccgctgatggtggccgtgccagcgcgccatcccctgctcaagcacaagcgcattcccttggaagaaatgctgcgttacccgctggtgctgtgcgatccactggcgtgcgaagggcatgcacgccaggtagagcgggtgctgcgccgctcggacatggagccgctgattgccgagcgcgtggcctcctgcgatttgatgatggcgctcgtgtcagcaggcttcgcgctggggctgaccggcgcaccccacatcgtgaccagccgcgagcccggtgtggtcgcgcgacccttggcgggccgctcccccgtgctgacaacctatctgttgcatcgggagggcgagtcttcggcagtgctgtcccggttcatcgaacgggtgcaggccatcgacttgcccgaaggcgcacgacccgcgctgccatctgaagccgcgcccccggaggacaccgagccatga

SEQ ID NO: 1115 - DNA, 456 bp, Burkholderia thailandensis E264
atggggctaacgttaatggtagcggtgccggctcggcatccgctgctggcgcataaatatttgccactggaagaagtgctgcactacccgttggtactgggcgacccacacgcctgcgagggctttgctcgccaagtggatcgtattctgcgccgcgtggatcgagagccgatcgttgccgaatgggtcgcatccatcgacttgatgatggccttagtgtcagcaggcttcgccttgggtctggcgggcacctcgcagattgtggccagcagagagccgggtatcgtcgcacggccgctggctggacgcgctcccatgctcacgacctatctgctgcgttccgacaatgaaccgtcgcaggtgctggctcgtttcattgagcgagtaagcaatcttgaatcacttgcggcaaagaaggccgtcgtatcatttgatcccgacgcgagggaggaatag

SEQ ID NO: 1116 - DNA, 963 bp, Cupriavidus metallidurans CH34 uid250
ttgaataggaagggcacagtggagttgcgccaccttcgatgcttcatcgctgtcgcggaagaactccacttcgcgcgcgccgccgagcggctacatatcgagcagtcgccattgtcgcgggccatcaaggaattggaggaggacttgggtgtgcaattattcgaacgcaccacccgcagtacccgcctcacccgcgcgggccagctcttcctggaacacgtgccacgcatctttactgccttgcagcaggcgcgtgacagcgtgaaagcggtcgccaatggtttccacgggcaattgcgtgtggccttgtcggatggcatcacgccttcgcgcttaccggccttgctggcgctatgccgacaagaggagcccgaggtcgaaattcgcttcttcgaggtgccgctgtcgcagcagatcaaagggctgcatgatgacctgtacgacgtgggatttgcccaatccgatgaagtgggcgacggcatcgtcgctttgcccgcctggagcgatgcgttgatggtggcggtgcccgcccggcatccgctgctgatccacaagcgcatccccttggatgagttactgcgctacccattggtactgtgcgatccgcaagtctgtgaaggcctcgcgaagcatgttgagcgggtgcttcgccgagtggacatggagccgctggtcgcggagcgagttgccacaagcgatttgatgatggcgttggtgtcagcgggcttcgcacttgggttggcgggtgcagctcacattgccgccagtcgtgaatcaggtgtggtggcacgacctttggcgtcacgcgtgccaccgctgacgacctatttgcttcgtcttgacagtgatccgtccgatgaactggcgcggttcattgagcgcgtaaaggccatcgatctgccagaaactcccagacccgcacgaggccgcaatcccgatcacccggaggaactgatgccatga

SEQ ID NO: 1117 - DNA, 981 bp, Cupriavidus metallidurans CH34 uid250
atgacctcagggcgcgattccctacggcgggcttgtatggatcttaggcattttaggtactttattgccgtagccgaagagctgcattttgcccgtgccgcggaaagactgcatatcgagcaatcgccgctatcgcgagccataaaagaactagaagaagagttgggggtgacactcttctcacgtaccacgcgcagcactagattgactcgcgcgggtcaactttttttggagagcgcatacagggtgatggctgcctttcaacaagcccaggacagtgtcaaggctgtcgccaacggcttccagggacaactgcgcattgcgttatcggatggcatcacaccgtcgcgtctaccgatattgcttgcgctctgtcggcaagaagagccggaaattgaactccggttttttgaggtgacgctttcgcaacagataaaaggccttcaagatgatttgtatgacgtcggcttcgcgcagtccgatgaagtcggcgatggaattgtggcaatacctgtgtggagcgatgcgcttatggtggcagtgccggcccgacacccacttctggctcacaagcgaatacctttggatgagctattgcgctatccgttggtcctctgcgatccgcagatctgcgaaggtcacgcaaagcacgttgatagagtgttacgtcaggcagacatggagccgctgattgctgaacgagttgctactggcaatttaatgatggcgctggtatcggctggctttgcgttagcactgacgggcgcgactcatattgctgcgagccgtgaaccaggtgtcgtagcacgaccactggcttcgcgcgtgccaccattgacgacctacctgcttcacaccgaaggcgaaccctcagatgtattggctcgctttattgagcgcgtgcaagccatcgaagtacctgatacccctcgatccgcaatgggccaccgccccaatccacccgaggaagctgtgccatga

SEQ ID NO: 1118 - DNA, 942 bp, Burkholderia ambifaria AMMD
atggaacttcggcacctgcgttgcttccttgccgtcgccgaagagctgcatttcgcccgtgcggcggagaaattgcatgtcgagcaatcgcctttatcgcgggccatcaaggaactggaagaagaactgggcgtggtgctgtttgcgcgaactacgcgcagcactcggttgacccgtgcgggcaagctgtttttagagcatgtgccgcgcgtcttctctgccttgcagcaggcccgcgacagcgtgaaggcagcggccaacggcttccacagccaattgcgcgttgcgctgtccgacggcatgacgccctcacgtctgccggctttgctggcgctctgtcggcaggaggagcccgaagtcgaaatccgtttctttgaggtgccgctggcgcaacagatcaaagggctgtacggcgatctgtacgacgtaggcttcgcccgcgccgatgaagtcggcgatggcctcattgccgagccggtatggagtgatcctctgatggtggccgtgccggcacggcatcccctgctggcccacaagcgcatccctttggaagaattgctgcgctatcccctggtgctgtgcgatccgcaagcgtgcgagggccatgcccggcaggtggatcgtgtgctgcgccgtgtggacatggaaccgctggtggctgaacgggtggcgtcctgcgacctgatgatggcgctggtgtccgcaggcatcgctctggggctgacgggctgcgcgcacatcttggccagccaggaacctggcgtagtggcacggccactgacaggccgctcaccgttgctgacgacctacttgctgcgtccggaaggcgagccttcggaaatgctcgcccgcttcatcgaccgtgtgcaggccatcgaatcacccgaaggtagcaggcccacgccgggtcttgatgccgactctctggaggaacccgcatga

SEQ ID NO: 1119 - DNA, 942 bp, Shewanella sp. ANA-3
atggaacttcgccaccttcgttgcttccttgccgttgctgacgaactccacttcgctcgtgcggcggagaaactgcacatcgaacagtcaccgctgtcacgtgctatcaaagaactggaagaagacttgggcgagcagttattcgtccgcaccagccgcagcacacggttgacacgggcaggcaaactgtttttggagcatgtgccgcgcgtcttcactgctttggagcaggcgcgcgacagcgtgaaggctgcagccaatggctttcacggacagctgcgcatcgcgttgtccgacggcatcacaccatcgcgtctaccgatcttgctggcgctttgcagacaggaggaaccggaagttgaactcagattcttcgaggtgccgctgtcgcagcagatcaaggggttgcaggacgacctgtatgacgtgggattcgcacaatccgatgacgtgggtgacggcatcaccgtagaggcggtgtggcacgatccgctcatggtcgcagtaccagcccggcatccattgctgatacataaacgcattcctctcgatgaagtgctgcgctatccactggtgctatgtgatcccaaggtatgtgagggccatacacgccaggtcgaacgtgtgttgcggcgtgcggagcaagaacccttgatcgccgagcgcgtggcctcctgcgacctgatgatggcgctggtgtcagccggctttgctctgggcctggcgggcgcgccgcatatcgcttccagccgcgaatctggtgtggtcgctcggccactagcgggccgttcgccgatgctgacaacgtatctgctgcatcgggaagcggagacctcggaagtgctggcccgtttcatcgagcgggtacaggctatcgaatcgcctgagggcgtcaggctagtgccaccgcccgaatccgatcaggaggaaatcgaactatga

SEQ ID NO: 1120 - DNA, 945 bp, Acidovorax avenae citrulli AAC00-1
atggaaatacgtcatctgcgctgctttctagctgttgccgaagaactgcacttcgcccgcgccgccgagcggctgcacatcgagcaatctccgctgtcgcgcaccatcaaggaactggaagaagacctgggcgaacagttgttcgtccgcaccagccgtagcacgcgcctgacacgggctggcaagctgtttctggagcatgtgccgcgcatcttcactgccttgcagcaggcacgcgacagcgtgaaggcggcggccaacggtttccacggccaattgcgcatcgccttgtccgaaggcatcacaccctcgcgcctgtcgtccttgctggcgctttgccgacaagaagaacccgaagtcgagatccgtctgttcgaggtcccgctggcacagcagatcaaggggctgcatgatgacctgtacgacgtggggtttgcacagtccgatgaagtgggcgaaggcattgcagcccacgcggtgtggagtgatccactgatggtggcggtgccagcgcgccacccgctgctcaaacacaaacgcattcccctggaagaattgatgcgttaccccctcgtgctgtgcgatccgctcgcgtgcgaagggcatgcgcgccaggtcgagcgcgtgctgcgccgctcggacatggagccgctgattgccgagcgcgtggcctcatgcgatttgatgatggcactagtgtcggcgggctttgcgctggggctgactggctcagcacacttagcggctagccgcgagttgggcgtagtcgcacggcctttggagggtcgttcccctgtgctgacgacctacctgctacatcgagaaggtgaatcttcggaagtgctgtctcgattcatcgaaagggtgcacgccatcgacttgccagaaggagcgaggctagcacaaccacctgaatccaatcctcctgaggacaccgagccatga

SEQ ID NO: 1121 - DNA, 912 bp, Polaromonas naphthalenivorans CJ2
atggagttacgtcatcttcgttgttttatcgcagtggccgaagagttgcacttcgcccgtgcggccgagcgcctgcacatcgagcagtcgccgttgtcgcgagctatcaaggaactggaatccaacttggctgtgcagttgttcgagcggacgacaagacgcacgcggttgacctgggcgggtaaggtttttctggaggaggcccatcgcgtcttcgcagctatcgaccaagccaaagccagtgtcaaggcagcggctaccgggtaccgcggccgcctgcgcatcgctctgtccgatggcatcgcccagccacgactatcggctttgctggcacagtgccgcgaggaggaaccagaggtagagattcgtttgtcggaaacaccgttgtcgcagcagatcaaggggctgaacagtgacctgtatgacgcggggtttgcacaatccgatgaagtgggtgaaggcatcatcgctgaggccatctggagcgagcctttggtgatcgctgtaccggcgcgccatccgctcctggtgcaccgtcgcatcccgctcgacgaagtgttgcgctatccgctggtgctgtgccatcccgaaacttgcgaaggtttctggcagcaggtcaagcgggtgctacgcacggtggatgccaagcccatcgtggtggatcgtgtgccaacgctggacttgatgatgaccttggtggcagctggttacggcttggggttcgcaggcgaaagccagattgcagcatgccgcaatcccgatgtgattgcccgcccactggccggtcgttcgccgatgctgaccacctacctgctgcgcccagaaattgaaccttccgagcagttgagccgcttcatcgacagggtgagccctgtcgatgagcaagcatcgaatcccgccactgttcaatga

SEQ ID NO: 1122 - DNA, 939 bp, Pseudomonas aeruginosa PA7
atggagctacgtcatcttcgttgttttctcgcagtcgcagaagaactccacttcgctcgcgcggccgagcggttgcacatagagcagtcgccgctatcacgaaccatcaaggaactggaagacgaattgggcgcgcgactgttcgcgcgtaccacgcgcagcacccgactgacccgtgcgggcaagttgtttctggagcatatgccgcgtgtcttcgccgccttgcagcaggcgcgggacagcgtgaaggctgcggccaacggctttcacgcccaaatacgcatcgcactgtccgatggcattacaccgtcgcgcctgccaaccctgctggcgttgtgccgtcaggaggaacccgagatagagattcgcttgttcgaggttccgctgtcgcagcagatcaagggcttgcaggaggacttgtacgacgtaggattcgctcaatcggatgaagtgggtgaagcgcttgtcgccgagccggtgtggagcgattcgctgatggtggccgtgccggctcggcatacgctgctcaaatacaagcgcatccccttggacgaagtcctgcgtcatccgctggtgctgtgtgacccacaggtgtgcgaaggccacgcaaagcagatcgagcgggtgttgcgacgggcggagacggagccgctgattgccgaacgagtggcatcctgcgacctgatgatggcgctggtttcggccggctttgccttgggcctgaccggggcggcacacattgcggccagccgcgagcttggcgtggtcgcccgtcccctcgaaggccgttcgccggtgctgaccacctacctgctgcgcccagccggagagccatcgagaaccttggcgcgattcattgagcgggtgcacttcatcgaatcgcccgacggcgccaggaccaggaccccgcctcaatctcatgtttcggaggacagttag

SEQ ID NO: 1123 - DNA, 933 bp, Pseudomonas aeruginosa PA7
atggaactacgccacttgcgctgcttctttgcggtcgccgaagaacttcacttcgcccgtgcggccgagcggctgcacatcgagcagtcaccgctgtcgcgtgccatcaaggagctagaagaagaactgggcgtggtgctgtttgcccgtaccacgcgaagcacgcgcctgacccgtgcgggcaagctgttcctggatcatgtgccgcgcgtcttcgccgccttgcagcaggcgcgcgacagcgtgaaggcggccgccaacggcttccacggccagttgcgtatcgccttgtccgacggcatcacgccgtcgcggctacctgccttgctggcgctgtgccgccaagaagaacccgaagttgaactccggttcttcgaggtgccattgtctcagcagatcaaaggtctacatgacgatctgtacgacgtggggtttgcgcagtccgatgaagtgggcgacggcatcgtcaccacgcccgcatggagcgatgcgctcatggtggcggtgcccgcgcggcatccgttactggcccacaaacgcatccctttggatgaactgctgcgctacccgctggtgctgtgcgacccacaggtatgcgagggtcttgccaagcacgtcgaacgggtgctgcgccggacagacatggagccattgattgccgagcgggtggcctcctgcgatctgatgatggcgctggtctccgcaggtttcgcgctgggcctgactggtgaggcgcacattgccgccagccgcgagccgggcgtggtggcccggccactagcatcgcgtgtgccgccgttgacgacctacttgctgcgccttgagggcgatccgtccaatgagctggcgcgcttcatcgagcgcgtgcaggccatcgaatcgccggaagctcccaagcattgccctgattccccggatgcacctgcgccatga

SEQ ID NO: 1124 - DNA, 927 bp, Delftia acidovorans SPH-1
gtggagcttcgtcatctacggtgtttcctcgctgtagcagaggagcttcactttgcccgcgctgccgagcggttgcacatcgaccaatctccgttatctcgcaccatcaaggagttggaggaagaactcggcgcacgcctgtttgtccgcaccactcgcagcacacaactgacccgcgctggacggctgtttctggagcacgttcagcgagtctttacagtgctggagcaggcccgcgatagtgtcaagtccgccgccaacggcttttgcggccagttgcgtattgccttgtccgatggcgtcacgccttcgcgcctgccggcattgctggcgcgcagccgcgaagaggaccccgaggtggaaatccgattgttcgaggtgcctttggatcagcagatcaaggggcttcatagcgacctgtatgacgcgggcttctcgatggcagaggatgcaggtgatggcatcatcgtcactcctgcatgggaagacgaattgatggtggcggtaccagcccgccatccggtgcttgccttcaaacagatcccgctgaaggaggtgttgcgccatccgctggcgctgggcgacccagcagtgtgcgaaggccacgcgcgccaggtcgatcggttcctacgcacatgcggacaagagccgctgatcgcgcagcgcgtggcgaccttcgacgtgatgatgactttagtctccgccggcttagcattgggcttggcgggcgaggcgcacattgcttccagccgcgagccgggagtcgtggcccggcgcttggcgggcaagccgactatgctcatgacctatctgctgcgccgcgatacggagccgtccgaaatgctggctcgatttatcgaacgagtagattttattgattcggctgatgaactcggcatccccgaagaccttccacgcgaccgatag

SEQ ID NO: 1125 - DNA, 942 bp, Burkholderia multivorans ATCC 17616 JGI
ttggaacttcgccatctgcgctgcttcctcgcggtagcctcagagcttcatttcgctcgtgcggctgagcggctgcatattgagcagtcgcctctttcgagggcgattaaggagttggaagaggatctgggcgtcaagctttttgttcggacgactcgcagcacgcggctgactcgtgcgggaaagctgttctttgagcatgtcccgcgcgtcttctctgccttgcaacaggcccgtgacagcgtgaaggccgcagccaacggctttcacagtcaattacgcatcgccctgtccgatggcatcacaccggcgcggttgccagccttgctggcgctctgccgccaggaagagcccgaggtcgaaatccgcttcttcgaagtacctctgtcccaacagatcaaaggactgcatggcgacctgtacgacgtgggctttgcccgcgccgatgaggtcggcgatggcctcattgccgaatccgtatggagtgatccgttgatggtggccgttccggcgcggcatcccctgctggcacacaaacgcattcccttggaagaactgctgcgctatccgctggtgctctgcgatccgcaggcatgcgaaggccacgcacggcaggttgatcgtgtcctgcgccgcgtggatatggaacctctggtggccgaacgggtggtgtcctgcgaactgatgatggcgctggtgtccgcaggcatcgccctggggctgacgggctacgcgcacatactggcaagccaggaacctggcgtagtggcgcggccactggcgggccgcgcaccgttgctgacgacctacctgctgcgcccggaaggtgagccttcggaaatgctcgcccgcttcattgaccgtgtgcaggccatcgaatctcctgaaggcagcaggcccatgccgggccttgatgccgactccctggaggaacccgcatga

SEQ ID NO: 1126 - DNA, 915 bp, Ralstonia pickettii 12J
atggagcttcggcatttgcgttgctttatagcggtggccgaagaacttcactttggccgcgcagcggaaaagctgcacatcgatcagtcccctttgtcgcgcaccatcaaggagatagaggaagagctcggggcgcaactgttcacgcgaaccacgcgaagcacccgcctgacctttgccggaatggcattcctggagcgggtgccgcgaatcttcgaagctctgaaacaggcgtgtgacggcgtcaagtccgccgccagtgggtttcagggacagttgcgcatcgctttgtccgatggcatcacgccctcgcgaatgccgacgctgctggcacggtgccgagaggaagatccagagattgacattcggttatttgagatgccgttggaccaacagatcaagggtctgcacgatgacctgtatgacgtcggcttttcgatggccgaagaggtgggcgacggcattgtggtcaggcctgcgtgggaagacgagctgatggtggcggtcccagctcgccatcctgtgctggcccacaagcacgttccgttggaagaagtgctgcgctatccgctggcgctatgcgatccggcgatatgcgaaggccatgcacgccaagttgatcgcgttttgcagcgctacgagcaacagccactgatcgcccagcgcgtggcgtcctatgaggtgatgatgaccttagtctccgccggattggcacttggtttggcgggcgccgcgcacattgcatccggccgtgggccaggtgttgtggcccggcgcttggcgggcaagtcgcagatgctggccacgtatctgctgcaccgtgacgtggagccctccgaaatgctggctcggttcatcgcacgagtggactccattgattcggcggatggctccagcgccgccgaggactcctga

SEQ ID NO: 1127 - DNA, 921 bp, Thauera sp. MZ1T
atggaacttcgtcacttgcgctgctttctggccgtggccgaagaactccacttcgcccgagctgctgagcggctgcatatcgaacagtctccgctatcgcgagcgatcaaggagttagaagaggagctgggcgtgacgctgttcgcccgcaccacacgcagcacacgactgaccctcgcgggcaaactattcttggaacatgtccggcgtgtcttcgccgccttgcagcaggcgcgcgacagtgtaaaggcggccgctaatggatttcatggccaattgcgcattgccttgtcggacggcatcacaccatctaggttgcctgctctgctggcgctgtgccggcaggaagagcccgaggtcgaaatccggctgttcgaggttccgctatcgcagcagataaaggggctgcatgacgacctgtacgacgtgggcttcgcccgatccgatgaggtcggtgatggactcattgccgaaccggtatggagcgacccgcttatggtggctgttccggcacgccatcctctactggcgcacaagcgcattccgctggaagagttgctgcgttatccgttggtgctgtgcgatccaacggtatgcgaaggcgatgcgcgacaagttgagcgcgtgctgcggcgggtggatatggagccgctgattgccgagcgggtcgcttcctccgatctgatgatggcgctggtatctgcaggttttgcgctggggctgacaggtgccgcgcatatcgcgacaagtcgggagccgggtgtcgtagcgcgacccctggcaggacgctcgccggtactcacgacctacctactgcgtcttgatggtgtcccctcggagacgttggctcatttcattgaacgggtccaagccatcgaatcacccgaagccaaccggcccatatcgggccgtccatcctga

SEQ ID NO: 1128 - DNA, 945 bp, Thioalkalivibrio HL EbGR7
atggagctacgccatcttcgatactttctcgcagttgcagaggaacttcacttcgcccgtgctgccgagcggctgcacatagaacaatccccactatcacgggccatcaaggagttggaggaagaactgggcgtggtgctgtttgcccgcaccacacgcagcacgcggctcacccgcaccggcaagctgttcttggagcacgtgcgtcgcgtgcttgctgccttggaacaagcacgtgacagcgtgaaggcagcggcgaacggttttcacgggcagttgcgcgtagctctatcggacggcgtcacaccgtcgcgcttgccgagcttgctggcgttgtgccgccaggaagagccggaagttgacctccgattcttcgaggtgccgctttcacagcagatcaaaggcttgcatgacgacctatacgatgtggggttcgcacaatccgatgacgtaggcgatggcatcaccgccatacctgtatggagcgatgcgctgatggtggcggtgccggcgcggcatccgctgctggcccacaagcgcatcccgctggacgagttgctgcgctacccgctggttctgtgcaatccgcaagtctgcgaaggtcatgccaagcatgtcgaacgggtgctgcgtcgtgccgacatggagccacttgttgcggaacgtgtggcttcctgcgatttgatgatggcactggtttcggcgggcttcgcgatcgggctgacaggtgaagcgcatattgccaccagccgtgagccgggtgtggtggcccggccactggcgtcgcgtgtaccgccgctgacgacttacctgctgcacctcgacgatgagccatccgatgtgcttgcgcggttcattgagcgcgtgcaggccattgaatcgccggagtccgcgaaacctgttccgcgtcgcagtcctgaccccccggaggaattcacgacatga

SEQ ID NO: 1129 - DNA, 927 bp, Diaphorobacter TPSY uid29975
gtggagttacgccaccttcgatgttttaccgcggtcgcggaagagcttcattttgctcgggctgctgaacggttacacatcgaccaatcgccgctatctcgcaccatcaaggagctggaggaagaccttggtgcgcgcctgttcgttcgtactacccgcagcacgcaattgacccgtgcgggtcgattgctgttggagcacgtaccgcgcatcttcgctgcgctggagcaagcacgcgatagcgtcaggtctgcctccaatggctatcacgggcaattgcgcattgccttgtccgatggcatcacgccatcacgtttaccggcgctacttgcgcagtgccgcgaagaagaccccgaagtcgaggttcggttgttcgaggtttcgatggcccagcaaatcaagggcctgcacgatgagctatacgacgcaggattttcgatggccgactacgtgggcgatggcatcgtggtcacatctgcctgggaggacgaattgatggtggcagtacctgcccgccatcccgtgcttgccttcaagcaggttccgctggaggaagtgctgcactatccgctggtgttgggcgatccggcgatatgcgaaggccatgcgcgccaggtcgatcgcatcctgcgcaggcacgagcaggagccgctgattgttcagcatgttgccacctttgacctcatgatgaccttggtttccgccggattggcattgggcctggctggtgcggcgcacatcggctccagccgcgagctcggtgtcgtggctcggcctttggcgggtaaaccaccgatgctgacgacctatctgctgcgtcgtgatgcggaggttccagaaatgttggcacggttcatcgaacgagtggccttcattgactcggaaaattatctgagcaccgccaaaaattcccgacccacccgatga

SEQ ID NO: 1130 - DNA, 915 bp, Diaphorobacter TPSY uid29975
atggagttgcgccatttacgctgcttcatcgccgtcgccgaagaactccactttgctcgtgctgccgagcggctgcacatcgaccagtcaccgctgtctcgcaccatcaaagagttggaggaagaacttggcgcacgtctgtttgtccgtaccacccgcagcacgcaattgactcatgctggacggctgttcctggaacacgtccagcgcgtttttgcggcattggatcaagcccgagatagcgtcaagtccgttgccaacggctttcacgggcagttgcgccttgccctgtccgacgggatcacgccatcgcgcctgccggcgctattggcgcaatgtcgggaggaagaccccgaagtcgaagttcggctgttcgaggttccgctggctcagcagattaaggggttgcacgacaacctgtacgacgccggcttctcgatggccgatgatggaggcgatggcattgcggtcagttccgcgtgggaggacgagttgatggtggcggtgccagcccgccatcccgtgctcgctttcaaacaggtcccactgaaagaagtgctgcgctacccactggcgctgggcgacccggcggtctgcgaaggccacgcgcggcaagtcgatcgttttctgcgcaagctcgatcaggaaccgctgatcgcgcagcgcgtggcgaccttcgacgtgatgatgaccctggtttccgctggcctggctttgggtttagcgggcgaggcgcatatcgcttccagccgtgagccgggcgtcgtggcccgccgcctggcaggcaagccatacatgctcacgacctatctgctacgccgcgatgcggagccatccgagatgctggctcggttcatcgagcgtgtggccttcattgattcggcagactgtatcgacgctgccgacgatgcttga

SEQ ID NO: 1131 - DNA, 945 bp, Azotobacter vinelandii DJ
atggagcttcgacatctgcgctgcttcctggccgtcgccgaagaactgcactttgcccgcgcggccgaaaagctgcacatcgaacagtcgccgctgtcgcgggccatcaaggagctggaggaagaactgggcgtggtgctgttcgctcgcactacacgcagcacgcggctgacccgtgccggcaagttgttcctcgatcatgtgccgcgcgttttcgccgccttgcagcaggcgcgcgacagcgtgaaggcggccgccaacggcttccacggccagttgcgcattgccttgtccgacggcattacgccgtcacgcctgcccaccttgcttgcgttgtgccgacaagaggagccagaagtcgaaatccgcttcttcgaggtgccgttgtcgcaacagatcaaggggctgcacgacgatttgtatgacgtaggctttgcccgtgccgacgaagctggcgatggaatcgtcgccttgcccgtctggaacgatccattgatggtggcggtgccggcacggcaccccttgctggcccacaagcgcatcccgctggaagaactgctgcgctacccgctggtgctctgcgatccgcaggcgtgcgaaggccatgcacggcaggtcgatcgcgtgctgcgccgcgtggacatggaaccgctggtggccgagcgggtggcatcctgcgacctgatgatggcgctggtttccgctggcttcgccctgggcctgacaggttgcgcacacatcttggcaagccgagaacctggtgtggtggcacgaccactgacgggccgctcgccgatgctcacgacctatctgctgcgtccggatgccgaaccatcggaaacgctggctcgcttcatcgagcgcgtgcaggccatcgactcgcccgaggccgccaggccggcgccaggcgatgaacccgatgtcccggaggaatccgaaccatga

SEQ ID NO: 1132 - DNA, 945 bp, Azotobacter vinelandii DJ
ttggagcttcgtcacctgcgctgcttcctggccgtggccgaagaactgcactttgcccgtgctgccgagcgactgcacatcgaacagtcgccgctgtcgcgcgccatcaaggaactggaagaagaactgggcgtggtgctgttcgcccgcaccacgcgcagcacgcgactgacccgcgcgggcaagctgctcttcgaccatgtgccgcgcgtcttcgccgccttgcagcaagcccgcgatagcgtgaaggcggcggccaatggcttccacggccagttgcgcatcgcgctgtccgacggcatcacgccttcgcgcttgccggccttgctggcgctgtgccggcaggaagaacccgaagtggaaatccgtctgttcgaggtgccgctgtcgcagcagatcaaagggctgaatgatgacctgtacgacgtgggtttcgcccgcgccgatgaagccggtgatggcatcgtggctgtgcctgtctggagcgacccgctgatggtagccgtgccgtcgcggcatcccttgctggcgcacaagcgtatcccgctggaagatgtgctgcgttatccgctggtgctgtgcgacccagtggcatgtgaaggccatgcacggcaggtggatcgtgtgctgcgccgcgtggacatggagccgctggtggccgaacgggtgacgtcctgcgacctgatgatggcgctggtttcggccggcttcgctctggggttgacgggtgccgcgcacatcgcggccagccgcgagcagggcgtggtggctcggccgctggctgctcgatcgccactgctcacaacctatctgctgcgcctggatgccgagccatcggaaacactggcccgcttcatcgagcgcgtgcaggccatcgactcgcccgaagccgacaagccgatgccggacgacgatcccgattccctggaggaacccgaaccatga

SEQ ID NO: 1133 - DNA, 1506 bp, Clostridium perfringens SM101 uid12521
atgggtgaaagaacaccaatgctaaaaatggtaggtgtatcaaaatcctttccaggagtcaaagctttagataatgttagcttaatggcttatggtggagaagttactgctttaatgggagaaaatggagcaggaaaatcaactttaatgaaaatactaagtggagtatataaaaaagatgaaggtaaaatattcattgaaggaagggaagtagaagtaaagggaattaaatcagcagaagaagctggtataacaataattcaccaagaacttagtgttttaaataacttaactgtttcagaaaatatatttttaggtaatgaaaaacatagtaaatttacaggaagaataaataaaaagttattagatgaaagaagtaaaatgttcttagaacaaattggttgtgatatagatccaaatagattagttagtactcttaatgtaggtgaaaagcaaatgatagaaatagcaaaagccttaactaagaatgctagaataattattatggacgagcctactacagccttaactgatgtagagactgaaaacctttttaaagtaatagagaatttaagaaaaaagggaatagcaataatatacatatcacatagaatggaagaaatatttaaaatatgtcatagagtagaagtattaagagatggtaaatatacaggaagtgcagaaataaaagacatagataatgataagcttatagcaatgatggttggaagaaccatagaggatcaatttccatacagagatgttaaaaaaggagatttagctttagaagttaaaaatcttagctgtaaggaaggagttaaaggagcttcatttactcttagaaagggagaaatattaggaattgcaggtcttatgggatctggcagaacagagcttgcaaaaacaatatttggagaatataaaaaaacaagtggtgaaatttctttaaatggaagtcttattaatataaattgcataagtgatgccataaataatggtatatgttatctttcagaggatagaaaaaaagagggctgtattttaggaatgtctgttggagaaaatatgaccttatgtaacttaaagaaatatgaaaataagtttaaatctcttgataaaaaagaagaagcaaaggatatagagtactatattaagaagataaacataaaaactccaaataaggaacaatttattaagaatttaagtggaggtaatcaacagaaggttatacttgctaaatggcttatgctatctccagaagtattaataattgacgagccaactagaggaatagacgtaggtgcaaaaaaagaaatttatgaacttttaaatgaacttaaagctagtggaaaagccataataatgatttcttcagacttaccagaggttttaggaattagtgatagaattatggttatgagtgaaggaagaatctctggggaattaaatagagatgaagcaaatcaagaaagtataatgaaattagccgttggaataaacaattag

SEQ ID NO: 1134 - DNA, 1506 bp, Enterobacter sp. 638
atggacgcattattacaactcaaagggatcgataaatcgttcccgggcgtaaaagccctctctggcgcggcgctgaatgtttacgccggtcgcgtgatggcgctggtaggtgaaaacggcgctggcaaatccaccatgatgaaagtgctgaccggcatctatcaacgcgatgcgggttcgctggtgtggctagggaaagaaaccaccttcaccggagcgaaatcctcacaggaagccggaatcggcattatccaccaggaattaaacctgatcccgcagctcaccattgccgaaaatatctttcttggccgcgaattcgtgggccgctttggcaacatcgactggaagttgatgtatgccgaagccgacaaactactggcgaaactgaatctgcgcttcaagagcgaccgtctggtgggcgatctttcgatcggcgaccagcagatggtggaaatcgcgaaagtcttgagcttcgagtcaaaagtcatcgtcatggatgaaccgactgatgcactcaccgataccgaaaccgaatctttattccgcgtcatccgcgagttgaaatcgcagggacgtggcattgtttatatctctcaccgcatgaaagagattttcgagatttgcgatgacgttaccgtgttccgcgacgggcagtttattgccgagcgcgaggtggcctctctgaccgaagattcgctgatcgaaatgatggtggggcgcaagctcgaagatcagtatccgcgactggataaagcgccgggtgacgtccgcctgaaggtggataatctatgcggtcctggcgtcgacaatgtctcctttacgctgcgccagggtgaaatcctgggtgtggcgggcctgatgggcgcgggtcgtaccgaattaatgaaagtgctgtacggcgcgctgccgcgtaccagcggttacgtcacgctcaacggtcatgaagttgttacccgttctccgcaggatgggctcgcaaacggcatcgtttatatctctgaagaccgtaaacgcgatggcctggtgctgggcatgtcggttaaagagaacatgtctctgaccgcgctgcgctatttcagccgtaacggcggtggcttaaaacataaagacgaacagcaggcggtcagcgattttatccgcctgttcaatgtgaaaacgccttcgatggaacaggctatcggcctgctttccggcggtaatcagcagaaagtggcgattgcgcgcggtctgatgacgcgtccaaaagtgctgatcctcgatgagcccactcgtggcgtggacgtcggcgccaagaaagagatttatcagctgatcaaccagtttaaggctgacgggctgagcatcattctggtctcttccgagatgccagaagtattaggcatgagcgatcgcattatcgtcatgcatgaagggcatctcggcggtgaattcactcgcgagcaggccacccaggaagttctgatggctgccgctgtgggcaagcttaatcgcgtgaatcaggagtaa

SEQ ID NO: 1135 - DNA, 1503 bp, Vibrio cholerae O395
atgactcaagcaattttagccctgagccaaattgaaaaagcgttccctggcgtgaaagccttggacaaagcgagcctgaatgtctatccggggcgggtaatggcgttaatgggtgaaaacggtgctggcaaatcaaccttgatgaaagttctgaccggcatttatagcaaagatgcgggcagcattgagtatcaaggccaacctgtcagttttaaaggcccacgagattcgcagctggcgggcatcagcattattcaccaagagctcaacctgatcccgcagctgacgattgcggaaaatattttccttggccgtgagatgacttcgccattcggacgcattctgtgggatgaaatgcatcgtaaagcggatcaactgctcgcacgtttgaatgtgaaacacagtgctaaaaccttgctcggagagctgagcttgggtgagcagcagatggtggaaattgccaaagcgctgtcgtttgaatcgaaagttatcatcatggatgaaccgaccgatgcgctgaccgataccgaaaccgaatctctgtttaatgtcattaatgaactgcgcgaacaaggctgcggcattgtgtatatctcacaccgtttgaaagaaatttttgagatttgtgacgacatcacagtgctgcgtgacggcaaatttattggcgagtgccgcgtgtgcgataccaatgaagatggcctgattgagatgatggttggccgtaaactggaagagcagtacccacgtattgccgcgcagcagggtgacatcagccttgaggtgattggcctaactggctcgggtgtgcacgatgtcagctttacgcttaaaaaaggcgagattcttggtgtctctggcctgatgggggctgggcgcactgaactgatgaaggtgatttatggcgcgctcccttcggagcgtggcgtgattaacctcaacgggcgcacggttaaccctgtcagtccgcaagatggtttggccaatggcatcgcctatatttctgaagatcgtaaaggcgatggcttggtactcggtctttcggtgaaagagaacatgtcactttgcgcgctcgatcaactgagcaaaggtgtgcaaattcgtcatgccgatgaagtgattgctgtggatgactttattcgtctgttcaacatcaaaaccccaagtcgtgagcaaatcattggcaacctttctgggggcaatcagcagaaagtggcgatcgctaaaggactgatgaccaaacccaaagtactgattttggacgaaccgactcgcggtgttgacgttggcgccaaaaaagagatttaccaactgatcaaccaattcaaagctgaaggcatgagcatcattttagtctcctcagaaatgcccgaagtgctgggcatgagtgaccgcattctggtgatgcatgaagggcggattagcggcgagtttatggcgagcgaagccgatcaagagaaattaatggcgtgtgcggtagggcgtaaccctgctcacgcagcatga

SEQ ID NO: 1136 - DNA, 1506 bp, Escherichia coli HS
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatgctcgcgatgccggcacgcttttatggctggggaaagaaacgacatttaccgggccgaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcttggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 1137 - DNA, 1506 bp, Escherichia coli E24377A
atggaagcattacttcagcttaaaggcatcgataaagccttcccgggcgtaaaagccctctcgggcgcagcgttaaatgtctatcctggccgcgtgatggcgctggtgggcgaaaacggcgcgggtaaatccaccatgatgaaagtgcttactggtatctatgctcgcgatgccggcacgcttttatggctggggaaagaaacgacatttaccgggccgaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatacgcgagctgaaatcgcaaggccgcggtattgtctatatctcccaccgcatgaaagaaatcttcgagatttgcgatgacgttaccgtttttcgtgacgggcaatttattgctgagcgcgaagtggcatcactgaccgaagattcgctgattgagatgatggtgggccgcaagctagaagatcaatatccacacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaagcggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaacaccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 1138 - DNA, 1506 bp, Serratia proteamaculans 568
atgcaacctttactgcaactgaaagggatcgataaagcctttcccggcgtgaaggcgctttccggcgccgcactcagcgtttatcccggcaaggtgatggcgctggtgggggaaaacggtgccgggaaatccaccatgatgaaagtgctgaccggtatttataacaaagacgccggcagtcagtattttctcggtaaagaggtggcattcactgggccaaaggattcgcaagaagcgggtattggcattatccatcaggaactgaacctgatcccgcagttgacgatcgcggaaaacatcttcctcggccgcgaatttgtgaaccgtattggccgcatcgactggaagcgcatgtatgccgaagccgacaagctgttgacgcggttaaacctgagttacagcagccaccggctggtgggcgagctgtcgatcggcgatcagcagatggtggaaatcgccaaggtgctgagcttcgaatccaaagtgatcattatggatgaaccgacggatgcgctaaccgacactgaaaccgcctctttatttaaagtgatcaacgagctgaaggccgaagggcgcggcatcgtttatatttcgcaccggctgaaagagatttttgaaatttgcgacgacgtcacggtgtttcgtgacgggcagtttattgccgagcgtccggtcagcgagctgcaggaagattcgctgatagaaatgatggtcggccgcaagctggaagaacagtacccacgcctgaatctgccgcgcggcgaaaaacggctggaggtcagccaggtttccggtccgggtgtggatgacgtcagctttaccctgtaccggggcgaaatactaggtgtggccgggctgatgggcgccgggcgtaccgagctgatgaaaattctctacggtgccgcaccgcgcaaatccggtaccgtcagcctcgacggccgcccggtggtgacccattctccgcaggacggtctggcgaacggcattgtgtatatctccgaagaccgcaagcgcgatggcctggtgctggggatgtcggtgaaggaaaacatgtcgctgacggcactgcgctatttcagccgtgccggtggcagcctgaaacaggcagaagagcaacaggccgtgggtgacttcatccgtttgttcaatatcaagacgccgtcgatggaacagccgattggcctgctctccggtggcaatcaacagaaagtggcgatcgcccgtggcctgatgacgcggccaaaggtgctgatcctcgacgagccgacgcgcggtgtcgacgtcggtgcaaaaaaagaaatctatcagttaatcaaccagttcaagcaggaagggctgagcatcattctggtgtcttcggaaatgccggaggtgctgggcatgagcgaccgcatcctggtgatgcacgaaggacatctcagcggtgaattcccgattgaacaggccacccaggaagcgttgatggctgcggccgttggcaagcaatacggcgtaaagcaggagtaa

SEQ ID NO: 1139 - DNA, 1506 bp, Escherichia coli C ATCC 8739
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatgctcgcgatgccggcacgcttttatggctggggaaagaaacgacatttaccgggccgaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcttggcaaacggcattgtgtatatctccgaagaccgtaaacgtgacggtttagtgttgggcatgccagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 1140 - DNA, 1506 bp, Escherichia coli SMS 3 5
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatactcgcgatgccggcacgcttttatggctggggaaagaaacgacatttaccgggccgaaatcttcccaggaagccgggattgggattatccaccaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaattgccaaagtgctgagctttgagtcgaaagtcatcattatggatgaaccgaccgatgcgctgaccgataccgaaaccgaatccttgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgtgaagtagcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactgccgcgcaccagcggttacgtcaccctggatgggcatgaagtcgttacccgttcaccgcaggatggcctggcaaacggcattgtgtatatctccgaagaccgtaaacgtgacggtttagtgctgggcatgtcagtaaaagagaacatgtcgctgacagcgctgcgctacttcagccgcgctggcggcagtttgaagcatgccgatgaacagcaggcagtaagtgatttcattcgtctgtttaatgtgaaaacgccgtcgatggaacaggcaattggtctgctctccggtggcaatcagcaaaaagtggcgattgcccgtggtctgatgacacgccccaaagtgttgatcctcgatgagcctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 1141 - DNA, 1488 bp, Natranaerobius thermophilus JW NM WN LF
atgacattactaaaaatgaagggaataaccaaaacttttccaggtgttagggcccttgatgatgttgacctggaccttgaagctggagaagtcctggccctcttaggagaaaacggtgccggtaaatctaccttaatgaaaattctcagtggtgtttacggtgaagatgaaggaatgctggaagtagaaggtaagcaagttgccatagagtcccctcaaaaagccactgatcacggaattgggatcattcatcaggaattaagtttggttcccaacttatcagtgagagaaaatatttttttaggcagggaaaaaacccatcccataaccggaaaaattgactggcactatatgaatgaagagagtagaaaactccttgtccaactgggagttgaagatatagacctgactcgtcctgtcaaagactttagcatcggtattcaacagatggtagaaatagcccgaatactatcaatgaactgcaagatcatcattatggacgagcctacagatgctctcacacctcaagaaatagaggttctttttcaagttatcaactctttaagagagtccgggaaaggaatcatatatatcagccataaactggaagaaatatttcagatttccgatagagttcaggtattaagggacggaactcatgtcggtaccaaagatataacagagactaatacggaagatctaatcaaaatgatggtcggccgggatttaaaagaaaaattcccctgggttgcacctcaaaccggtgatgtggtcttggaacttaaagatgtcagttcaccaggactaatttacaatgtggatttgatggcaaaacagggtgaagtgttggggatttttggtctaatgggagcaggacgtactgaactctgcaaaactatctttggtgctcatcccattcagggtgaaattttgctagacggccaacctattaagataaattcccccaaggatgccattgaaaaggggatcgtttatctgtcggaaaacagaaaatccgaaggattgttcttagaacacgaagtctacaaaaatatgaccctggcatcattaaactctttcacctcaaatttaggaagaatcaacaaaggtcgtgaaaaagaaaaagttgaggaatatatcgataggttgactgtcaaaactcctcatattgctcaaaaggttaagaatttgagcggaggtaatcagcagaaacttgtcttcgccaagtggctaatgaccaatcccagagtactaattttggacgaacccacccgaggtgtagatgtaggggcaaaagtggaactttataatctaattaacgaactaaaacagaaaaatgtggccattatcatggtttcttctgaacttcctgaaataatggggattagcgatagagttatggtaatgcacaaaggtagaataacgggagagtttagccatgaaaatgtgaatcaggagcaaattatggaacgggcagtaaacagttag

SEQ ID NO: 1142 - DNA, 1506 bp, Salmonella enterica serovar Newport SL254
atggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaatgggcctaaatcgtctcaggaagccgggatcggcattattcatcaggaactgaacctgattccgcagttgaccattgcggaaaacatcttcctgggccgtgagtttgtgaatcgctttggcaaaatcgactggaaaaagatgtatgccgaagccgaccacctcttagccaaactcaatctgcgttttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctgaaggtcgataatctgtgcggaccgggcgtgaatgatgtctcttttgtgctgcgaaaaggcgagattcttggcatttccggcctgatgggcgccggtcgcaccgagctgatgaaagtattgtacggcgcgatgccgcgaaccagcggttacgtgacgctcgatggacacgaagtggtgacgcgttctccgcaggacgggctggccaatggcatcgtttatatctctgaagaccgtaagcgcgatggactggtgctcggcatgtcagttaaagagaatatgtcgctgactgcgctggattatttcagccgcgctggcggaagcctgaaacacaaagatgagcagcaggcggtgggggattttatccgtctgttcaacgtcaagacgccgtcaatggaacaggcgataggcctgctttctggcggtaatcagcaaaaagtggcgattgctcgcgggttgatgacgcgcccgaaagtgctcattctcgacgagccgacccgcggcgtggacgtcggcgccaagaaagagatttatcagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 1143 - DNA, 1551 bp, Salmonella enterica serovar Schwarzengrund CVM19633
atgcgaacgtcattctttgcgctggcgtcactttctgaggccgctatggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcaggatcgttgttatggctgggtaaagagaccacctttaacgggcctaaatcgtctcaggaagccgggatcggcattattcatcaggaactgaacctgattccgcagttgaccattgcggaaaatatcttcctgggccgtgaatttgtgaatcgctttggcaaaatcgactggaaaaagatgtatgccgaagccgaccacctcttagccaaactcaatctgcgctttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctctcaccgtatgaaagagattttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctcaaggtcgataatctgtgcggaccgggcgtgaatgatgtctcttttgtgctgcgaaaaggcgagattcttggcatttccggcctgatgggcgccggtcgcaccgagctgatgaaagtattgtacggcgcgatgccgcgaaccagcggttacgtgacgcttgatggacacgaagtggtgacgcgttctccgcaggacgggctggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcaacaggcggtgggggattttatccgtctgttcaacgtcaagacaccgtcaatggaacaggcgataggcctgctttctggcggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 1144 - DNA, 1551 bp, Salmonella enterica serovar Agona SL483
atgcgaacgtcattctttgcgctggcgtcactttctgaggccgctatggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaacgggcctaaatcgtctcaggaagccgggatcggcattattcatcaggaactgaacctgatcccgcagttgaccattgcggaaaatatcttcctgggccgtgagtttgtgaatcgctttggcaaaatcgactggaaaaagatgtatgccgaagccgaccagctcttagccaaactcaatctgcgctttaagagcgataagctggtgggcgaactctctatcggcgatcagcaaatggtggaaatcgccaaagtactgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctcaaggtcgataatctgtgcggaccgggcgtgaatgatgtctcttttgtgctgcgaaaaggcgagattcttggcatctccggcctgatgggcgccggtcgcaccgagctgatgaaagtattgtacggcgcgatgccgcgaaccagcggttatgtgacgcttgatggacacgaagtggtgacgcgttctccgcaggacgggctggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcagcaggcggtgggggattttatccgtctgttcaacgtcaagacgccgtcaatggaacaggcgataggcctgctttctggcggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 1145 - DNA, 1551 bp, Salmonella enterica serovar Dublin CT 02021853
atgcgaacgtcattctttgcgctggcgttacgttctgaggccgctatggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaatgggcctaaatcgtctcaggaagccgggatcggcattattcatcaggaactgaacctgattccgcagttgaccattgcggaaaacatcttcctgggccgtgagtttgtgaatcgctttggcaaaatcgactggaaaaagatgtatgccgaagccgaccacctcttagccaaactcaatctgcgttttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagttggaagatcagtacccgcatctggataacgcgccgggtgagattcgcctgaaggtcgataatctgtgcggaccgggcgtgaatgatgtctcttttgtgctgcgaaaaggcgagatccttggcatctccggcctgatgggcgccggtcgcaccgagctgatgaaagtattgtacggcgcgatgccgcgaaccagcggttacgtgacgcttgatggacacgaagtggtgacgcgttctccgcaggacggactggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcagcaggcggtgggggattttatccgtctgttcaacgtcaagacgccgtcaatggaacaggcgataggcctgctttctggcggtaatcagcaaaaagtggcgattgcccgcgggttgatgacgcgcccgaaagtgctcattctcgacgagccgacccgcggcgtggacgtcggcgccaagaaagagatttatcagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 1146 - DNA, 1506 bp, Escherichia coli O157 H7 EC4115
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccgaaatcttcccaggaagccgggattgggattatccatcaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatagccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagagttgcgatgacgttaccgtttttcgtgacggacaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgattttattcgcctgttcaatgtgaaaacgccgtcgatggagcaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 1147 - DNA, 1503 bp, Alicyclobacillus acidocaldarius DSM 446
gtgcctcgcctcgagatgagagaaatcgaaaaatctttctcgggagtacaagtcctgcgcaaggtgaacttatcggtggaaggtggtgaagttcacgctcttctgggtgagaacggagctggaaaatcaactttgatgaaaacgctcgcaggagtgtatcaccccgatgccggcgaaattctcatcgacggtgctccgcaaaaattccgcggggtcttggattcgaggcgtgctggcatcacgattattcaccaggaactcaacttgtttccgaacctgtcgattgaggaaaaccttcttatcggttatgaagacgaatttcgaaacgctatcggttggattcagtactctcgtttgcggtccagggttcgcgaactactcgatcgggtcgggcttgaccgagatcctagtacgccggtttcggtgctcggcattggagagcggcaattagttgaaatcgctcgagctttacaacaagaagtccgctttctcattatggatgaaccaaccgctgccctcacggacaaagagacgcgcaggctgtttgaaatcattcgcgatttgaaacgtcatgaagtcggtgtcatctacatctcccatcgacttgaggaattgttcgccattgccgacagggtgacggtgttgcgcgatggcatgagcgtgggaacgtactcgatgcgggctgtgagtgaggatgtactcgttgagcggatggtcgggcgaagtgtggaaaatcgataccctaaggtcaaaagccatcctggtgatgtgattctggagctgaaggatgtaaaaacgagagcacttccgcatcccatctctatcactgtgcgaagtggcgaaattgtcggtctgggaggaatgatgggagcggggcgtacagagctcgcacgggccatttcaggagtggaccgagtgctgtcggggaagatgctcatgttcggtcgtgaggtaagatttcgcggccctcgagatgccatggcccacggagtggcatttgtcactgaagatcgaaaagatgacggtcttttgcttccgttttctgtgcggtttaatctcgcgttgcctagtctgtcttctagacatcggttcggatttgtactgggcaagcaggaacgaaaatttgctgagcattgggtgaagcgccttgcgattcgcgttcattccaccgaacagccagttgtgaatctcagcggaggcaatcaacaaaaggtagtgtttgcgaaatggttggctctcgacccgaaactgttggtgcttgatgaaccaacacgcggggtggatgtaggagctaaacaagagatttaccagctgatgaatgagatgaaggttcgtggcaaaggcatcttgatggtttcatccgacttgccggaacttctcggtatgtgtgacagggtgtatgttttgcgtgatcggaccgtggcaggcgaactcacaggcgatcaaatgacacaggaaattttcatgactctcgtagctggaaggcagggtgcgcaagcatga

SEQ ID NO: 1148 - DNA, 621 bp, Anaeromyxobacter dehalogenans 2CP-C
atgcggcgaccggtctcgaagtgggcgctcctcgccctcctgttcacggcgctgctcgccgcggaccagtggacgaagtacctggccgtggagcgcctcaccgtggtgttcgagcgcggcggcgacgagacgctcgcggagcgggtccgcggcttctacacgtaccgtcacctcgagccgctctccaccgagccgtactacgtgtggcggccggtgtggcggatgaactacgtggagaaccccggcgcggcgtggggcctgttccgcggccactcgcagttcttccgcaacgcgttcttcacgctcgtgtcggtcgccgcggtggcgttcatcctccactactaccgcaagctccggcaggaccagcgctacctgcaggtggcgctcgggctcgtgctggccggcgcggtcggcaacttcgtggaccggctcgcccgccgctacgtcatcgacttcatcgagtggtactggtggaaccggcccgacatccgctggcccaccttcaacgtcgccgactcgctcatcgtggtgggcgtcgccatgctcgtcctgcaccccggctcgaggcgcgaggcggcgcgcgcgccggcgcggcgcgacgcggcggccgagcgcgtctag

SEQ ID NO: 1149 - DNA, 636 bp, Anaeromyxobacter sp. Fw109-5
atgagcgcgcgccggcccttctccaagtgggcgctcctggcgctcctcttcgtcaccctggtcgcgatcgaccagtggacgaagtacctggcggtggagcggctcaccacgctgttcgagcggaccggcgcggagacgctcggcgagcggctcgccggcttcctcgagcaccagcacctcgagccgatctccaccgacccctactacgtgtggcggccggtctggcgcatgaactacgtggagaacccgggcgcggcgtgggggctcttccgcggccactccgaggcgttccgcaacggcttcttcacgctcgtctcgctcggcgcggtggccttcatcctccactactaccgcaagctccgggccgagcagcgctacctgcaggtggccctcgcgctcgtcctctccggcgcggtggggaacttcctcgaccggctcgcgcgcggctacgtcatcgacttcatcgagtggtactggtggaaccggccggacatccgctggccgacgttcaacatcgccgactcgctcatcgtcgtcggcgtcgccctgctcgtcctccacccgggctccggcaaggccgcccagaaggccggggcggacgccgagggcgaccggcgcgcgtccaccggcggctag

SEQ ID NO: 1150 - DNA, 483 bp, Candidatus Desulfococcus oleovorans Hxd3
ttgacggcaaaataccaaatgctggccatcatcacccttgtcacggtgatcgccgaccaggcgaccaagcaggtgatcctggcgaccatggccctgcatgaaaccattgaggtgattcccggatttttcagcctgacccatattcacaatccgggcggggccttcgggttcatggccggtcagccccagggtgtccgggccgtgctctttctggtggtctcgaccctggcggcggcatttgtgctctacctttacaagaccacgccccggacccttccctggctgctgggagccctggccctgatctttggcggggccgtgggcaacctgatcgaccgcatccggttcggcgtggtggtggactttctcgacttttacgtaaagggccttcactggcccgcctttaacgtggcggacagcgccatcaccgtgggcatgaccgtgctggtgtttcacattctctttaaaaaggtgccgttctga

SEQ ID NO: 1151 - DNA, 621 bp, Anaeromyxobacter sp. K
atgcggcgaccggtctcgaagtgggcgctcctcgccctcctgttcgcggcgctcctcgccgccgaccagtggacgaagtacctggcggtggagcgcctcaccgtggtgttcgagcgcggcggcgacgagacgctcgcggagcgggtccgcggcttctacacgtaccgtcacctcgagccgctctccaccgagccgtactacgtgtggcggccggtgtggcggatgaactacgtggagaacccgggcgccgcctggggtctgttccgcggccactcgcagctgttccggaacgcgttcttcacgctggtgtcgctcgccgcggtggcgttcatcctccactactaccgcaagctccggcaggaccagcgctacctgcaggtggcgctcgcgctggtgctggccggcgcggtgggcaacttcgtggaccgcctcgcgcgccggtacgtcatcgacttcgtcgagtggtactggtggaaccggcccgacctccgctggcccaccttcaacgtggccgactcgctcatcgtggtgggcgtcgcgatgctcgtcctgcaccccggctcgaagcgcgaggcggcgcgcgcgccggagcgacgcggcgcggcggccgagcgcgtgtag

SEQ ID NO: 1152 - DNA, 393 bp, Dictyoglomus turgidum DSM 6724
atgaaatacttgttagttcttttgatttttctcttagacaggatcactaaagagctcgcagaaagaggctactttagcagattaaatattgattttttcttgaatttttaccttactcataactatggtgttgcttttggaattgatattgcacgaaaaatcattttaatctttaattttttagctctaattgtccttgttcttttgtatagaaaatttggatttataggacttgcttttattttaggtggacttcttgggaatttatatgatagagttttttatggatatgtgatagactttattcatctgaggaacttttttgtttttaatttggcagacctttttattagcttaggaggggtattagtattttttaaactaataaagtga

SEQ ID NO: 1153 - DNA, 621 bp, Anaeromyxobacter dehalogenans 2CP 1
atgcggcgaccggtctcgaagtgggcgctcctcgccctcctgttcgcggcgctcctcgccgccgaccagtggacgaagtacctggcggtggagcgcctcaccgtggtgttcgagcgcggcggcgacgagacgctcgcggagcgggtccgcggcttctacacgtaccgtcacctcgagccgctctcgaccgagccgtactacgtgtggcggccggtgtggcggatgaactacgtggagaacccgggcgccgcctggggcctgttccgcggccactcgcagctcttccggaacgcgttcttcacgctggtttcgctcgccgcggtggcgttcatcctccactactaccgcaagctccggcaggatcagcgctacctgcaggtggcgctcgcgctggtgctggcgggcgcggtgggcaacttcgtggaccgcctggcccgccggtacgtcatcgacttcgtcgagtggtactggtggaaccggcccgacctccgctggcccaccttcaacgtggccgactcgctcatcgtggtgggcgtcgcgatgctcgtcctgcaccccggctcgaagcgcgaggcggcgcgcgcgccggagcggcgcggcgccgcggccgagcgcgtgtag

SEQ ID NO: 1154 - DNA, 537 bp, Desulfomicrobium baculatum DSM 4028
atgcctaagatccgccgcgttccctgcaaacccgacatggggcgtcgctaccggaccatcggtctggtggcggccgtggtctttgtgctggaccaactgagcaagctctggatccagcaggccatcccggtctgggaaaagggcttcacggtcattccgggcttcttcgacatcgtgcacatcctgaaccggggagcggctttcggctttctgaaccgccacgacatagactggcagcggcccttcttcatcgtggtctcgatcctggccgttggactcatctgggtcctggccagaagccaggacgacgacgggcccttctatgtctacgggctgggactgatcctcagcggcgccctgggcaacctgctggaccgggcgcgactcggggtggtggtcgacttcctggatttctacattggcgacatgcactggccggccttcaacgtggccgacatgggcatctgcgttggcgcagcctcgcttctcgtgtctttttaccagcagaggcgtcgctgtgttcccgacaataattga

SEQ ID NO: 1155 - DNA, 498 bp, Desulfohalobium retbaense DSM 5692
atgcgcactcgttatgccctgaccggaggattgggcgctgccatcctggctctggaccagctcaccaaactcctgatccagagcagcattccactgtacgagagccggaccgtcattcccggattcttcgatctcgtccacatccacaaccgcggggccgctttcggtttcttgaaccgggccgatatcgagtggcagacctattttttcatcgcggtatctgctctggctgtggtgcttattttccagctcctgcgcacggtggaccgtcgggatatggtccttttcacaggtctgggctgcattctgggcggggccctcggcaatctggtggaccgcatccgggtcggacacgtcatcgatttcctggatatctatattggctccgcgcattggccagccttcaatatcgctgatattggaatcagtatcggcggtatctgcattctggtttccttttatcgtcgcaagaaacgccatgcatcccatactcgttga

SEQ ID NO: 1156 - DNA, 1401 bp, Ralstonia eutropha JMP134
atgaccatggcagatcgcaccgatcgatacgatacgccccccgtttcgaaagacatcggggtactgcggcccgggtggggctatgcgagcgtgtccgacaagatcgccggcctggtgctggaacggccggtacgcctgccctggctcagcgcctttctgctgaccttcgcggggatgctggtgttcatgggcgccacagcgtggttgttcgcgcgcggcgtcggcatctggggcgtcgacattccggtggcgtggggctttgcgatcggcaacttcgtctggtggatcggtatcggccacgcggggacgttcatctcggcgttcctgctgcttctcaggcagcagtggcgcacgtcggtcaaccgcttcgccgaggccatgacgctgtttgccgccgcgattgccggcctgttcccgatcctgcaccttggccggccgtggttcttctactggctcgtgccctaccccgacgtcatgaacgtatggccgcaatggcgcagtccgctggtgtgggacctgttcgcgatcggcacctacctgatcgtgtcgctgctgttctggtacgtcgggctgatcccggacctggccacgctgcgcgaccgcgcctgcctgcgcggacggcgccgaaccgcgcaggcctacgcgctactggcagtcggctggcggggcgatgcgcgccactgggcccgctacgaaagcgcctatttgctgctggcaggactggcgacgccgctggtgatcgccgtgcattcgatcgtgtcgctcgacttcgcgatcgggaacacccctggctaccactcgacgatctttccgccgtacttcgtcgctggcgcgctgttctcgggcttcgccatggtgctgaccatcgccatcccgctgcggcgcgtgtacgggctggaggacttcatcaccacgcgccacctggccaatgcggcaaagatcatgctgacagtgagtctgatcgtcgcctatggctatgcgagcgagatctttacggccttctacagcggcgaccgctacgagatgttcctgttccagaaccgctggaccgggccgtacgcgggcgtctactgggcgatgatgacctgcaatgtgctcgcgccgcagtgcctgtggtggcgccgcgtgcggcacagccccgccgtgctgttcgtgctgagcctcgtcatcaacacgggcatgtggatggagcggttcctgatcgtcgtatcgagcctgcaccgcgacttcctgccgtcgtcgtggggcatgttctatccgacgcgctgggactggatcatgctcgcgggctccattgcgatgtttgcgtggctgttcctggtcttcattcgctgcctgccggtgatctcgatcgccgaaatgcgcgagctcgtgctcaccagcacgaaggaggcgccatga

SEQ ID NO: 1157 - DNA, 1365 bp, Nitrosococcus oceani ATCC 19707
atgtcatccagatatcctagtaatgtgggcagcactcttgacaaaaagcctcctccgggcgccgttgtgacagataaggtcagtggcctggtgttggctcctcataggcgttggtggtggctgggtgcttttggattttccgcgctgctgtcgttgttgtttttttctgccattggttacctgttagtgacgggcgttggtatttgggggattaatattcccgtggcctgggcgtttgcgatcaccaattatgtatggtggatcggaattggcatggccggaacttttatttcggctgctctgttgctaacacgccaaaagtggcgggcctcgattaatcgttccgcggagacaatgaccgttttcgcagtctctatttctggcttatttcccatccttcacttggggcgtccatggtttttttattggttagcgccttatcccgatattatgaatgtatggccccagtggcgcagcgtcctggtgtgggatttcttcgctatcctggcgtatctggttgtatcgctgctgttctggtataccgggatggtgcccgatttcgctgtgattcgcgatcgggcgcgcaagcgttcccaacagatattttatggcctcttggcccttggctggcgtggcgaagcgagacattggcggcgtctcgaaacggccaccctcctgctggccggcatggcggttcccctagtattttccgttcacagtatggtggggcttgatttcgcggaaggaatagttcctggctggcattccacgattttcccccccttctttgtcgccggcgccttgttttcaggttttgccatggtgttgatgcttgtcgttccgctgcgatccgtttttggcctgcacgcgtttattacctcgcagcatctaaataacatggccaaattattattggctaccagccttattgttacctatagttacattatggaggtttttatagcttggtatagtgccgacccttatgagattgccatgacccagaatcgaatgagtggagcctatgcccctgtttattgggcaacgatattttgtaacgttctggtgccccagattctttggtttaagcgaatccgtcttaatcctattgccttgtttgtggtgggaaccgtggtattcataggcatgtggttagaacgcctcatgctgattgtcacaagtttgtatcgtgattttttgccctccgcctggggaatgttttatccgactgtctgggattggatctttctttttgccccaataggcttttttgccatgcttttcctgttatttattcgttttgcaccggttacttccatgttcgaaatccgaaagctacgctcagaagtgaagaatcatgaataa

SEQ ID NO: 1158 - DNA, 1293 bp, Pelobacter carbinolicus
atgaacaacaacgtacccatgccacaggttgaaaccgatgtacttgccgccatgcgccgcccccgtcttgcgtggctcggcagtctggcgcttgcgggcctgctgtttgccggcggactggccttatgggcttaccagatcagatacggcatgggcgtggccggcatcacccaccctgtcggctggggcgtctacattaccgacttcgtattctgggtcggcatcgcccacagcggcaccctgatctcggcagtgctgtacatttttcgggcgcgcttccgcaccagcttcaaccgcgccgccgaagccatgaccattttcgccctgatggtggcgggcctgttccccctcattcacctgggccgggtctgggttttctactacctctttccctatcccaaccaacgccagctctggatcaacttccgttcgccgctggtctgggacgtatttgcggtctccacctatttcctggtgagcctggtgtttttctatgtcggactgatgcccgacctggccatcgtcgcccgccatcgtagcggctggatcgggcgtgcctaccgtgccctgtctctgggatggaccggcagtttgagacaatggcggcattacgcccgtctgtacatgttcctggctgccttcgccacgccgctggtggcttcggtgcattccatcgtatcctgggatttcgccgtcagcatcatacccggctggcacaccacgattttcgccccttattttgtcgcgggggccattttatccggcaccgccatggtcctgaccctggtcatccccatgcgccgcatgcttcacctggaaaaacatatccccgtcgaccatatcgaagccatcgccaagatcctcctgctgacctcgctgatcgtcggattttcctatgtgatcgagcacggcatggccttctacggcaccaatctgtttgagatggaacagttccggttccgggcattggggcattaccgcctgctgttctggatcatgatcatctgcaacgccctgctgcccctgctgttgttcgtaggtcgcctgcgccgcaacctcgtgtttctgtttgtgctgagcctgctggtcaacgtcggcatgtggctggaacgcttcgtcattgtggtgtgttccctggcccgcgacttcgacccttacaactggggcaactacctgccttcgccggtggagatcggtattaccctgggcagtttcgggttgttttttgcggcttttctggttttcgtcaagaccctcccggtgctttccatcaccgaactgaaggagcgttga

SEQ ID NO: 1159 - DNA, 1437 bp, Anaeromyxobacter dehalogenans 2CP-C
atgaccaccgcgaccaagacgatcgagcgcgtcgatccgctcgagacctcgcccgtgctggtcggccgccccgacgaccgggcgctgaccgacagcctgctcgagccggtgctggggccgacgaagaagggctggctggtgatgctggtcctgttcggcggcgggatggccttctggctcctgtcgctctacatgaccctgttcgtcggcatcggggtgtggggcaacaacatcccggtcgcctgggcctacgacatcaccaacttcgtgtggtggatcggcatcggccacgccggcacgctcatcagcgccatcctgctgctgttccagcagaagtggcggacctccatcaaccgcttcgcggaggcgatgacgctgttcgcggtggccatggccggcgcgtacccggtcatccacctcgggcgcccttggctgttctggtggctcatcccgtaccccgccaccacgcagctctggccgaacttcaagagcgcgctcccctgggacgtgttcgcgatctcgacctacgccaccgtctcgttcctgttctggtacctcgggctcatccccgacctcgccacgctgcgcgacgcggccaggacccgcgcgcagcgggtcgtctacgggatcatgtcgttcggctggcgcggctcggcgcgccactggcagcactggcggatcggctacctgctcatggccggcctgtccacgccgctggtggtgtcggtgcacaccatcgtgtcgttcgacttcgccatctcgcagctgccgggctggcacaccaccatcttcccgccctacttcgtggccggcgccatcttcagcggcttcgcgatggtgatgacgctgatgatcccggcgcggaaggtgttcaagttcgagcacgtcgtcaccgcgcgccacctcgacaacatggcgaaggtgatcctcgcgaccggcctgatggtcacctacggctacgtgatggagtggttcatcgcgtggtactcgggcagcgaggccgagtggttcgccttctacaaccgcgtcgtcggcgactacaagctcgtctacgcgatgcagatcttctgcaacgtggtggcgccgcaggtgttctgggtgcccgcgctgcggcggaacgtgatggtgctgttcctcgtctccgtgctggtgaacttcggcatgtgggcggagcgcttcgtcatcatcgcggtgacgctcacccgcgacttcatccccggctcctgggcgaactacacgccgacctgggtggactggggcctgctgttcgggtcgatgtccaccttcgccgtcctgttcctgctgttcctgcgcttcctgccggcgatccccatctccgaggtgaaggagctccgccgcgagctggagcaccaggatcaccacgccgcgcagggcgggcaggcggtggcgcggggcgcgcacgcggagcgggcatga

SEQ ID NO: 1160 - DNA, 1371 bp, Nitrobacter hamburgensis X14
atgagcgtcattgcgtccgctcccgccaatccggctcatccctggatagccgcagaccacgccagttacggtgaggtgactgctctgatcgccgattccgtcctgctccggccagccgggtggcgctggtggatcgcgttgggtgtgagcggattgttcgtccttgcgaccatggtggccatctacgtgctttttacggaaggcatcggcgtctggggggtcaattccaccgtcgtgtggggatatgccattgccagctacgtctggtggatcgcgatcgggagcggcggcaccctgatttcggcgatgctgctgatcacccgtcagcgctggcgcgcatcggtcaatcgcttcgccgagacaatgacgattttcgcggtatcgatctcgggcctgtttccgatcctgcatctgggcagaccgcaatatttctactggctggcgccatatccaaacaccatgcttttgtggccgcagtggcgcagcgcgttagtgtgggatttctgggcgatcgtgagctatctcctgttctccctcctgttcctttacatcgggctgctgcccgacctcgctaccatgcgtgaccgtgcaaccaccgtctatggccaggtgttctacggggccttcgcgctcgggtggcgaggctctgcgcaccactggcgctgctatgagacgttccagatcacgctcgccgcgctggccgtcccgcttgtcgtatcggtgcactcgatcgttggtctcgattttgctgccagcctgatgccgggctggcaggagacgatctttcctccttacttcgtcgtcggcgcgttgttttccggctttgcctcggtcgccattctcacggcgctggtgcggtggggtttgcggctcgaggctgtcatcacggtccaccatttcaacgccatggcaaagattctgctgctggcgtcggtcgtgatgacctgctcttacgcaacagagtggttcatggcctggtacgccggcgccgccgcggaccgctcgcttctcgtgttcctgttcacgggaagttatgcgccgctttactggatgcaattgtcgttcaattgcctgctgcctcaggcactctggttcccgcgggtccggcgcagcattctctgcgtggtgttgattgcgatcgggatcaatatcggcatgtggctcgagagaatccttatcatctggaatacgctctcgcatggctatgcggtttcgctgtggcggctgttctatccgacgctgtgggactggatcctcctggttggtcccgtcgggctgttcgtcttcttcttcctctgctttgtccgcctggtgccggcggtaccgatgaacgaactgcgcaaactgtgccgcgaggagcatgtggcatga

SEQ ID NO: 1161 - DNA, 1407 bp, Candidatus Koribacter versatilis Ellin345
atgcatcaaggtccagacgagaaaacagtcttacaagacgtccttgagccgggcgaaccaccagtacttgcccccggacacgacttcggcacggtttcggacaagatctccgcgatcgtgctccgtcgcccgctggggctgggctggacgggcgctgccttcatcggcttcgtcttcgtcaacctgctcctcatggccgtcacctggttgttcctgcgcggtgtcggcatctggggcatcaacgttccggtggcatggggcttcgcgatcatcaacttcgtgtggtgggtcggtatcggccacgcgggcacgctgatctctgccatcctgctgctcctcaagcagacttggcgtaactccatcaaccgtttcgccgaagccatgacgctcttcgccgtggcctgcgccggcatgttcccgctcttccacgtcggtcgcccttggttggcctactggttgttcccgtatcccaactccatgggggtgtggccgcagttccgcagcccgctcgtatgggacgtcttcgcggtctctacttacgccaccgtctccgcgattttctggttcgtcggcctcatccccgacatcgccaccctccgcgatagcgcgaaaaatccctacgcacggacgatttacggcttgctcgccatgggatggcgcggctccgcccggcactggaagcgttatcagtcggtgtacctgctcctcgccggcctcgccacgcccctcgtcctctccgtgcatacggtcgtgtccttcgacttcgccgtcgcgcaattgcccggatggcacaccacgatcttcccgccatacttcgtcgcaggcgccatctactccggcttcgccatggttctcgttctggcgattccgatccgtcactactacggcgtgagcgacatgatcacctcgcgccacctcgagaatgccgccaagatcatgctcgccaccggcctcattgtggcttacggctacttcatggaaatcttcatggcgttctacgggacgaatatctacgagcgcgccattgtgtggactcgttggcgcgggccgtacgctccgggatattgggcgttgatcgcctgtaacattctcatcccgcaagtcctgtggatcccgaaggttcgtaagagcccgttttggcagttcgtcatctcaatggacatcctcatcggcatgtggctggaacgcttcatcatcgtcgtcaccagcttgcaccgcgacttcctgccctcctcgtggggcatgtacaccccaacccgttgggactgggcgacctacctcggtacgctcggcttcttcctcttcgcgttcgtgttgttcatccgcgtgctgccgatgatcactattttcgaaatcaaagcgctgctgcccgaatctgagccgcacgcggtggaggtgaaggcgtaa

SEQ ID NO: 1162 - DNA, 1356 bp, Cytophaga hutchinsonii ATCC 33406
atgcaagttacttcttcggtaaggccgccgttggttacaaacggaaaaacaaaacaagacgttaccaacgatatttgtagacaagtagaaggtgcgccttcaactgcatggaaaatatcatttgctatggcattgatcacattgttctatggtggttactgcttatggacaacatggtatgaaggtattggtatgtggggattgaacaagacaattggttggtcctgggatatcacgaacttcgtatggtgggtaggtatcggtcacgccggtacattgatctctgccgtattgttactattccgccaaaaatggagaacatctattaaccgtgcagcagaggcgatgacaatctttgccgttatctgtgctgctacgttcattattgcgcacatggggcgtccgtgggttggtcactgggtattacctttcccgaacaacaatggttctttgtggcaaaactttaactctgccttaatgtgggacgtatttgcgatttcaacatacttcactgtatcattagtattctggtatgtaggtttgattcctgattttgcaaccatccgtgaaagagctacaggtatccgtcgtgttatttacggtgcgttaagtatgaactgggacggttcagcaaaaacatggtcacgttatgaagctgtatccttagtgttggcaggtgtttcaacaccacttgtactctcagtacacacaattgtatccatggactttgcaacgtcattgattccggggtggcatacaacaatcttccctccgtatttcgttgctggtgcgatcttctcaggttttgcgatggtattaacactaatgctggtaacacgtgtgctgttcggcttagaagattacataacaatcaaccacattgaatcgatgaacaagatcatcgtattaacaggttcagttgtaggtattgcttatattacagagttcttcattgcgtggtactcaggtgtaccatatgaaaaatacgccttcattaaccgtgcattcggtccgtattggtgggcatatgcaaccatgatgacatgtaatgtgatttccccgcaaatgttctggttcaagaaagtacgtacaagtatcgcctggacattcggtttatctattgtagtaaacatcggtatgtggtttgaacgttttgtaattatctgtacttcattacacagagactttattccttcatcctggtcttacttctcgccaacgttatatgatgtaggggattacttatttaccttcggattattcttcacatgtttcttattatttgcgaagtatttcccggtaattaacatggctgaagttaaaacaatcattgattcatcttctgaaaagaaataa

SEQ ID NO: 1163 - DNA, 1401 bp, Flavobacterium johnsoniae UW101
atgtcgtctcattacgaagcacccattagaaaacctttagttataggtgataaatcatatcacgatgtaactgtagatgtggcagcgcctgttgaaggacctgcaaataaacaatggtggattgtatttacaatcgcattagtagccttcctttgggggttaggttgtataatttacaccgtatctaccggtatcggaacatggggattaaacaaaacagttggttgggcttgggatattactaacttcgtttggtgggttggtattggtcacgctggaactttgatttctgcagtacttttacttttccgtcagcgttggagaatggctattaaccgttctgcggaagctatgaccattttctcggtagttcaggcaggtttatttccaatcattcacatggggcgtccatggttagcatactgggttttacctattccaaatcaatttggatctttatgggtaaactttaactcaccattgctttgggacgtattcgcgatttcaacttatctttcagtatcattagtattctggtggactggtttattgcctgatttcgctatgcttcgtgatagagctattactccatttaacaaaagagtttattctatcctaagttttggatggagcggtagagctaaagattggcagcgttttgaagaagtatctttagtattagctggtttagctacacctcttgtactttctgtacacacaattgtatctatggactttgctacttctgtaattcctggatggcatacaacaattttccctccatacttcgttgctggagcggttttctcaggatttgcgatggtaaatacattgttgatcgttatgagaaaagtttctaaccttgaagcatacattacattacagcatatcgagttaatgaacatcattattatgattactggttctatcgtaggtgttgcttatatcactgagttattcgtagcttggtattcaggagtagaatatgagcaatatgcattcttaaacagagctactggaccttactggtgggcatattggtcaatgatgacatgtaacgtgttctctcctcagttcatgtggttcaaaaaattaagaacaagtatcatgttctcattcatcatctcgattgtagtaaacatcggtatgtggtttgaaagattcgtaattattgttacttctttacatagagattaccttccatcttcttggacaatgttctcaccaacatttgttgatattggaattttcattggaacaattggtttcttctttgtattgtttttattatactctagaacattccctgtaatcgctcaggcagaggtaaaaacaattttgaaaggaacaggagataattacattagagaaagagcaaataaagattcacatcatgagtaa

SEQ ID NO: 1164 - DNA, 1431 bp, Roseiflexus sp. RS-1
atggcttcacaacccgcacagaaatcggcgtatggcaagatgcttgaggagttgctgggaccgaagcagagttatgaatcggtcaccagaaccattggcgacattgtgctgacgccgctcaagcgaaccccgtggggttgggcgttggggttcgtccttgcagccctgggattgctgatgtacctctactcgctggcggtgctgtttaccgtcggcgttggcatctgggggattaatatcccggttgcctggggcttcgatattatcaacttcgtctggtggatcggcatcgggcacgccgggacgctcatctcggcgattctgctcctcttccggcaggactggcgcacctcgatcaaccgtgctgccgaggcgatgacgatcttcgccgttgcgtgcgccggtatctacccgctggtgcatacgggccgcccctggctcgattactggatgctcccctatcctggcacgctcggtatgtggccgcagttccgcagcgctctggaatgggacgtgtttgcgatctcgacgtatgccacggtctcaatcctgttctggtatgtcggtctcattcccgaccttgcttcgctgcgcgatcgggcgacgaataagtgggtcaagatcttctatggcttcctggcgctcggctggcgcggcggcgcccgcgactggcatcgctatgagatggcgtcgctcattctggcagggctttcgacaccgctggtgctgtcggtgcacagtatcatcagcctggacttcgccatctcacagttgcccggctggcacgtgacggtcttcccgccctacttcgttgccggtgcagtctactgcggcttcgcaatggtgatcctgctgctgataccaatgcgccgttggtacaaactgcacgatctgatcacgatgaagcacttcgacctgatgggcaaggtgatgctggcgtcaggtctggtggtggcgtatggctatttcggtgaaatgttctatgcctggtacagcgccaatatctacgagtacttcctgatcacgaaccgcacgatgggtccgtacgcctggagttactgggcgctgatcgtgctgaatgtcgccattccgcaactgttgtggttcaagcgcttccgcgtcagcctgccctggctcttcttcatctcgatctgtatcaatatcgggatgtggttcgagcgctgggtgatcatcgtgcttagcctgcaccgcgactttatgccagcgtcgtggggctactacacgccgagtgtgtgggatatctcactgtacgccggttcgttcggatggttcttcttcctgttcttcctgttcatccgcttgttgccggcgatctcgatcttcgaggtgcgcgacctggtgcataagatcgaggcagaacagcacgcgccggtccaggtcggcggcgccggacacgtcagggaggcgtag

SEQ ID NO: 1165 - DNA, 1449 bp, Anaeromyxobacter sp. Fw109-5
atgagcaccgcccagaagacgctcgaagaagcccacgcgctcgagggtgcgccggtcctcgtgggccgccccgacgatcgcgccctcaccgagagcctgctcgcgccggtcctcgagccgacgcgcaagggcttcgtcgtcctgctcgtcgcgctgctcggcggggtgggcttctggctcgtctcgctggggacgaccctgttcgtgggcatcggcgcctggggcaacaacatcccggtcgcctgggccttcgacatcaccaacttcgtctggtggatcggcatcggccacgccggcacgctcatcagcgcgatcctcctgctcttccagcagcggtggcgcacctccatcaaccgcttcgcggaggcgatgacgctcttcgcggtggcgatggcgggcctctaccccatcatccacctcggccgcccctggctgttctggtggctcatcccgtacccctcgacgaaccagatctggccgaacttcaagagcgcgctcccctgggacgtgttcgccatctcgacctacggcacggtctccttcctgttctggtacctcgggctcatcccggacctcgccaccctgcgcgacgccgccaagagccgcacccgccggatcgtgtacgggatcatgagcttcggctggcgcgggtcggcgcgccactggcagcactaccgcgtcggctacctgctcctcgccggcctgtccacgccgctcgtcgtctccgtccacaccatcgtctccttcgacttcgccatctcgcagctgcccggctggcacacgacgatcttcccgccgtacttcgtggcgggcgcgatcttcagcgggttcgcgatggtgatcacgctgatgatcccggcgcgccgagtgctcggcttcaagcacgtcgtcaccgagcgtcacctcgacaacatggcgaaggtgatcctcgcgaccgggctgatggtcagctacggctacgcgatggagcacttcatggcctggtactccgggtctgggtacgaggccttcgcgttcctgaaccgctggaccgggccctacgcgcccatctggtacatgcagctcgtctgcaacgtgctcgcgccccagctcttctggttcccgtcgatgcggcgcagcgaggtcgcgctgttcgtcgtcgccatcctggtgaacgtcggcatgtgggcggagcggttcgtcatcatcgccgtgtccctcacccgcgacttcgtcccgtcctcctgggccatgtacgtgccgacctgggtcgactggggcctgctcttcggctccatggcgaccttcggcctcctgttcctgctcttcctcaggttcctgcccgccatcccgatcttcgaggtgaaggagctccggcgcgagctcgagcaccacgggccgggcgtgcacatccagtcgccggcggacgcccccggcgcgcacgtcgaggacccggaggaggtgccatga

SEQ ID NO: 1166 - DNA, 1416 bp, Roseiflexus castenholzii DSM 13941
atggcttcacaacccgcgcagaaatcggcgtatggcaagatgctcgaagaactcctgggaccgaagcagacgtatgagtcggtgacccggaccatcggcgacatcgtgctgacgccgatcagaaagactccatggggctggccggttggtttcgtcatcgccgcccttggattgctcatgtacctcttctcgctggcggttctctttaccgtcggtgttggtgtgtggggcatcaacatcccggtcgcctgggggttcgatattatcaactttgtgtggtggatcggcatcgggcatgccggaacgctcatttctgccattctgctcctcttccggcaagactggcgcacgtcgatcaaccgtgccgccgaggcgatgacgatcttcgccgtggcatgcgccgggatttatccgctggtgcataccggtcgcccctggctcgactactggatgctcccctaccccggtacgctggggatgtggccgcagttccgcagcgcgctcgaatgggacgttttcgctatctcgacctatgcgaccgtttcgatcctgttctggtaccttgggctgatccccgacctggcatcgctgcgcgatcgggcgacgaatatatgggtgaagcgcttctatggctttctggcgcttggctggcgtggcggcgcgcgcgactggaaccgctatgaggtggcctcgctcatccttgccggtctttcgacgccgctggtgctctcggtgcacagtatcatcagtctcgactttgcgatttcgcagttgcccggctggcacgtgacggtcttcccgccgtacttcgtggccggcgctgtttactgcggctttgccatggtgatcctgctgctggttccgctgcgccggtggtacaaactccacgatttgatcacgatcaagcacttcgatctgatgggcaaggtgatgctggcatcgggtctcgtggtggcatacggctatttcgccgagatattctacgcctggtatagcgcgaatatctatgaatatttcctcattacgaaccgcacgatgggaccttacgcctggagttactgggcgttgatcgtgctcaatgtcgctattccacagttgctgtggttcaagcgtttccgtgtcagcctgccatggttgttctttatctcgatctgcatcaatatcggcatgtggttcgagcggtgggtgatcatcgtgctcagcctgcaccgtgattttctcccgtcgtcgtgggggtactacacgccaagcgtgtgggatatctcgctgtatgccgggtccttcggttggttcttcttcctgttcttcctgttcattcggttgctgccggcgatctcgatcttcgaggtgcgcgacctggtgcataagacggaaaccgaaaaagcgctggcacacggcagcgccggacatcactag

SEQ ID NO: 1167 - DNA, 1371 bp, Methylobacterium extorquens PA1
gtgagcgggcatgcccagccccatcgctggatcgcccgcgagcgtctcggctatggcgagatctgcgccgcggtcgccgacccgatccagaggcgcgggccgggccgcgcctgggtcatcgccttcctcggcgtgctgccgctcgtgctcgccacggtgatcgccatcggcgcggtgctcaccgtcggcatcggcctctcgggggtgaacaccacggtggtgtggggcttctcgatcgccaactacgtctggtggatcggcatcggcaatgccggaacgctgatctcctccatgctgctgctgacgcgccagcactggcgcgcctcgatcaaccgcttcgccgaggcgatgacgctgttcgcggccgccatcgccggcatcttcccgatcatccatctcgggcggccgctctactcgtactggctcgcgccctaccccaacaccatggatctctggccgcaatggcgctcggcgctcgtttgggatttctgggcgatcctcagctacctcctgttctcgctgatcttctggttcaccggcctgctgcctgacctcgcgaccatgcgcgaccgggcgcagtcgcgcttcggccggcggctctacggcgcgctggcgctgggctggcgcggctcggcgcggcactgggcggtctacgagacattccacaagaccatggcggctttggccgtcccgctggtctgctccgtccattccatcgtcggcctcgacttcgccgcgagcctgatgcccggctggcaggaatcgatcttcccgccctacttcgtcgtcggggcgatgtattcgggcttcgccatggtggtggtgctggccatcatcatccgctggggcctgaacctccaggcggtgatcaccccggcccatttcgacgccatggcgaaggtgatgctgttcgcctcgatcgtcatgaccttctcctacgccacggagtggttcatgggctggtatggcggcgatcacgccgaccgcgccgtgatcgtctacttcttcactggcgactatcgctggctctactacagcctgttgttctgcaactgcctcgtgccgcaggcgctctggttcgcccgggtgcgcctcaacctatgggcgctcgcgatcatctcgatcgtgatcaatctcggcatgtggctcgagcgcattctgatcgtctggaacacgctctcgcacggccacgccgtgagcctgtggcggacctatcacgtcagcttctacgacgtggtgatcctgatcgcgccgctcgggctgttcgccttcggcttcctcgtgctggcgcggatcttccccatcgtctccatccacgaggtcagccagctcgcccacgatgagggcgcggcgcgaggggggacggcatga

SEQ ID NO: 1168 - DNA, 1359 bp, Methylobacterium radiotolerans JCM 2831
atgagcggcgacccgcaggcccatcgctggatcgccccggcgcagctcagccacggcgcgatctcggcggcgatcgccgacccgatccagaaacggggaccgggccggctctgggtctacgccctgctggcgaccctgcccttcgtgctggtgacgctcggcgccgtcggcgcggtgctcaccgtggggatcggcctgtcgggggtgaacaccaccgtcgtctggggcttctccatcgccaactacgtgtggtggatcggcatcggcaatgccgggacgctgatctcgtcgatgctgctgctcacgcgccagcgctggcgcgcctcgatcaaccgcttcgccgaggcgatgaccctgttcgccgccgggatcgccggcatcttcccgatcatccatctcgggcggccgctctacgcctactggctggcgccctaccccaacaccatggatctctggccgcaatggcgctcggcgctggtgtgggatttctgggcgatcctcagctacatcctgttctcggccctgttctggttcaccggcctgctgcccgacctcgcgacgatgcgcgaccgggcgacgacccggcggggccaggtgatctacggcgccctggcgctcggctggcgcaactccgcccggcactggcaggtctacgagaccttccacaagaccatggcggcgctggccgttccgctggtctgctcggtgcactcgatcgtcggcctcgacttcgccgcgagcctcatgcccggctggcaggagagcatcttcccaccctacttcgtcgtcggtgccatgtattcgggcttcgcgatggtcgtgatgatcgcgatcttcgtccgctggggcctgaacctccaggcggtgatcacgccggcccatttcgacgtcatgggcaaggtcatgctcttcgccagcgtggtgatgaccctgtcgtacgccaccgaatggttcaccgcctggtacgggggcgagcatcccgaccgggacgtcgtgcgctacttcttcgcgggtgattaccgctggctgtactacgccctgatcgtctgcaactgcgtcgtgccgcaggccctgtggttcccgttcgcgcgccgcaacctctgggtgctcgcggggatcgcggtcgtgatcaatgtcgggatgtggttcgagcgcatcctgatcgtgtggaacacgctctcgcacggccacgcgatgagcctgtggcgcacctaccatacgagtctctacgacctcgcgatcctgttcgggcccctcggcctgttcgtgctcggcttcctggtgctggttcggatcttccccgcggtctcgatgcacgaggtccggcagctcagccacgaggcgggggccgccgcatga

SEQ ID NO: 1169 - DNA, 1482 bp, Opitutus terrae PB90 1
atgagcacgcacgctgaacacgccgcgctcgcgggcgccgcgatcctcaaggaagtgaagccggcggtgctgccgcgcgccacgctcgtcgagcacggccgcagcttcgcgtggatcaccgacaagatctgcgggatcatcgaaggcaagacgcccggctggtggtgggtctgcttcgtcgtcgcctgcttcgtcgcctcgttcaccgtcgccgggctgacgtatctcgtcgccacgggcgtcggcgtgtggggtcacgccaatccggtcaactgggcgtgggacatcgtcaacttcgtcttctggatcggtatcggccacgcgggcacgctgatctcggcgatcttgtgcctgctgcgccagaagtggcgcacgtcgatcaaccgcgcggcggaggcgatgacgatcttcgcggtggtctgcgccgcgatcttcccggtcttccacgtcggtcgcatctggtatgcgtggtatctcttcccgctgccgaattcgaactggatctggcagaacttccgctcgccgctcgagtgggacgtgttcgccgtgtcgacctatggcacggtctcggtgctgttctggtatgtcggtctcattcccgatctcgcggtgctgcgcgatcggttcctcgccgccggcaatcgcttccgctcgttcctctacgggctgttcgcgatgggctggcgcggctcgaaccgccactggagcaactacgagatggcctacttggtcctcgccggcgtctcgacgccgctggtgctctcggtgcacacgatcgtgtcgttcgacttcgcggtctcgctgctgcctggctggcacacgacgatcttcccgccgtatttcgtcgcgggcgcgatcttctccgggtttggcatggtgctcacgctcatgctgccgctgcgcgcggtctacaaactcgaggatctgatcacgcagtaccacatcgactgcatgtgcaagatcacgttggcgaccggcacgatcgtcggctacgcctacgcgatggagttcttcatcgcgtggtacggcgcgaacccgtatgaaggcttcaccttcatcaaccgcgcgtttggcaactacgcgtgggcctactggatcatgatcacgtgcaacgtgatcacgccgcagttcttttggtcgaaatgggtccgccgcaacacgacgctggtctgggtgctgtcgatcttcgtcaacgtcggcatgtggttcgagcggttcgtgatcatcgtcacctcgctcgcccgcgacttcctgccctcgagctggggctactacagcccgtcgatcgtcgagatcttcacgttcttcggcacgttcggcgtgttctccgtgctgttcctgctgttcatccggttcctgcccgtgatgccgatggcggaactgaaagcggtgacgccgcaggcggacgtgcacggccacgggcccgacgatcacgcgcacaccacgggcctcggtgacccgatcaaaatggagaaacactga

SEQ ID NO: 1170 - DNA, 1386 bp, Methylobacterium populi BJ001
gtgagtgggacggcccagccgcaccggtggatcgaccgcgaacgcctcggctatgccgagatctgcgccgccgtggccgatccgatccagaagcgtgggccgggccgcgcctgggtcatcgcctttctcggtgcgctgcccttcgtgctggcgacgctcgcggccatcggggccgtgctcaccctcggcatcggcctttcgggggtgaacaccacggtggtgtggggtttctcgatcgcgaactacgtctggtggatcggcatcggcaatgccggcacgctgatctcctcgatgctgctgctgacgcgccagcactggcgcgcctcgatcaaccgcttcgccgaggcgatgacgctgttcgccgcggcgatcgcgggcatcttcccgatcatccatctcgggcgaccgctctacgcctactggctcgcgccctaccccaacaccatggacctctggccgcaatggcgctcggcgctggtctgggatttctgggcgatcctgagctacctgctgttctcgctgatcttctggttcaccggtctgctgcccgaccttgcgaccatgcgcgaccgggccgaaacgcggatcgggcggcgcttttacggcgcgctggcgctcggctggcgcggttcggcccggcactgggcgctctacgagtcgttccacaaggcgatggcggcgctcgccgtgccgctggtgtgctcggtccattccatcgtcggcctcgacttcgccgcgagcctgatgccgggctggcaggaatcgatcttcccgccctacttcgtcgtcggcgcgatgtattcgggcttcgccatggtggtggttctggccatcaccatccgctggggcctgaacctccaggccttgatcaccccggcccatttcgatgccatggcgaaggtgatgctgttcgcctcgatcgtcatgaccttctcctacgccacggagtggttcatgggctggtacggcggtgatcacgccgaccgctcggtgatcgcatacttcttcaccggcgattatcgctggctctattacagcctgttgttctgcaactgtctcgtgccccaggcgctgtggttcgcccgcgtccggctcaacctgtgggcactcgcgctcatcgcggtcgtgatcaatctcgggatgtggctcgagcgcatcctgatcgtctggaacacgctctcgcacggtcacgccgtcagcctgtggcggacctaccatgtcagcgtctacgacgtggtgatcctcatcgcaccgctcgggctcttcgccttcggctttctcgttctggcccgcatctttccgatcgtttcgatccacgaagtgagccagatcgcccatgacgagggcgccgctgcggccggggtgccgaagggaggggtggcatga

SEQ ID NO: 1171 - DNA, 1347 bp, Akkermansia muciniphila ATCC BAA 835
atgcagataatgaacagaccagcaccatcagtccccaccgccgatattccggtagaggccatgctggcagaggtgcggaagccgctgggacccgtttggtggagcgtgtttctcgccagcgcattgctggcggcgtggggcatagggtggagttcctggcgcattgccgcagagggtgtgggcgtgctgggggtgaataataacgtggtgtgggggctggacatcgtgcattttgttttctggataggcctggggcatgcgggcaccctgatttccgccgtcctgctgctgacgcgccagtcatggagaagcccgattgcgcgcggagcggaacagatgaccctgtgcgcggttatctgcgccgccgttttccctgtggtgcacgtagggcgtgtctggatggcgtggatggcttccccgttgccggaagtgagcggaatttggccggacatggcctctcctttgatgtgggatgtcatggcagtcagcacctattttcttctttccctgttgtactggtatatcggcctggtgccggatttcgcgttgctgagggattgctgcaaggggcgtctgaggcgccggtacgggtggctggcgctgggctggcagggaacggggcgccagtggcgcgcctatgaaaaggccagccttctttttgcggttattctgactcctctcgtggtatccgttcattccgtggtgagtttcgatttttccgtgactcaggtgccggggtggcaccagagcattttcccgccctatttcgtagggggggccatcctcagcggcatggcgatggttcagctgattctgctgggggtgagacgtctgatggccggcagcggcgttcgccgggccgttactccggccattctggatttaagttcccggtttgtgctggccctgagcctggtgatgggagccatgtatttgtgggagcatctggcagccattctgaatggaggctctccggagccgtttccgggcagaaatcctgtgaatgccgtgttcctcatcgtcatggttgccgggaatgtggcgctgccccagttgttctggttccgttctctgcgaaccaaccgctgggtgatcgccgccgtggctctgggagtgcttgcgggcatgtggatggaacgtttctggattgtcgtgaattccctgaaggcatccctgctggctgccaacatcggagagtatttccccagcgtgacggatttggccatgatggccgggagcgtggggctgtttatggccctgtacatggcgctggtgcgtgtggctccgttcttctccctgtgcgacgtgcgggaacagcaatccctgaacaaggagggcggggcatga

SEQ ID NO: 1172 - DNA, 1437 bp, Anaeromyxobacter sp. K
atgaccaccgcgaccaagacgatcgagcgcgtcgatccgctcgagacctcgcccgtgctggtcggccgccccgacgaccgggcgctgaccgagagcctgctcgagccggtgctggggcccacgaagaagggctggctggtgatgctggtcctgttcggcggcgggatggccttctggctcctgtcgctctacatgaccctgttcgtcggcatcggggtgtggggcaacaacatcccggtcgcctgggcctacgacatcaccaacttcgtctggtggatcggcatcggccacgccggcacgctgatcagcgcgatcctgctgctgttccagcagaagtggcgcacctccatcaaccgcttcgcggaggcgatgacgctgttcgcggtggcgatggccggcgcgtacccggtcatccacctcgggcggccctggctgttctggtggctcatcccgtaccccgccaccacgcagatctggccgaacttcaagagcgcgctcccctgggacgtgttcgcgatctcgacctacgcgaccgtctccttcctgttctggtacctcgggctcatccccgacctcgccaccttgcgcgacgcggcgaagacccgggcgcagcgcgtcgtctacgggatcatgtccttcggctggcggggctcggcgcgccactggcagcactggcgcatcggctacctgctcatggccggcctgtccacgccgctggtggtgtcggtgcacaccatcgtgtcgttcgacttcgccatctcgcagctgccgggctggcacaccaccatcttcccgccctacttcgtggccggcgccatcttcagcggcttcgcgatggtgatgacgctgatgatcccggcgcggaaggtgttcaagttcgagcacgtcgtcaccgcgcgccacctcgacaacatggcgaaggtgatcctcgcaacgggcctgatggtcacctacggctacgtgatggagtggttcatcgcgtggtactcgggcaacgacgccgagtggttcgccttctacaaccgcgtcgtcggcgactacaagctggtgtacgcgatgcagatcttctgcaacgtggtggcgccgcaggtgttctgggtgcccgcgctgcggcggaacgtgatggtgctgttcctcgtctccgtgctggtgaacttcggcatgtgggcggagcgcttcgtcatcatcgcggtgacgctcacccgcgacttcgtccccggctcctgggcgaactacacgccgacgtgggtcgactggggcctgctgttcgggtcgatctccaccttctccgtcctgttcctcctgttcctgcgcttcctgccggccatccccatctccgaggtgaaggagctccgccgcgagctggagcaccaggatcaccacgccgcgcagggcgggcaggccgtggcgcagggcgcgcacgcggagcgggcatga

SEQ ID NO: 1173 - DNA, 1356 bp, Methylobacterium sp. 4-46
gtgagcgcggagccccggccggcccatcgctggatcgccgccgcgcgcgagagcgacgcggccatcacggacgcggtggtcgccccgatcctggtcggggtcggccggggctggtggatcgccctcgcgctcaccctgcccttcgtgctcctgacgctcgtcgccgtcgcgtggctgttctggcggggcgtcggcgtctggggcatcaacaccacggtggtgtggggcttcgccatcgccaactacgtctggtggatcggcatcggcaatgccggcacgctgatctcctcgatgctgctcctgacccggcagcactggcgggcctcgatcaaccgcttcgccgaggcgatgaccctgttcgcggtctcgatcgccgggctgttcccgatcctccacctcgggcggccgatctacgcctactggctcgccccctacccgaacacgatggggctgtggccgcaatggcgcagcgccctggtgtgggatttctgggccatcgtcagctacctgctgttctcgctgctgttctggtacgtcgggctgatccccgacctcgcgacgatgcgcgaccgggcggattcgcggggcgcccggctcttctacggcagcctggcgctcggctggcgcggctcggcccggcactggcgccgcctcgggaccctgcacacgacgctggcggcgctcgccgtgcccctggtctgctcggtccactcgatcgtcggcctcgacttcgcggcgagcctgatgccgggctggcaggagagcctcttcccgccctatttcgtggtcggcgcgatgtattcgggcttcgccatggtggtggtgctggcggccctggtgcgctggggcctgcggctccaggccctgatcaccgtcaaccacttcgaggtgatggggcgggtgatgctgatggcctcgctggtcatgggcctgtcctacgccaccgaatggttcatggcctggtacggcggcaagcccgacgagcgccgcctcgtcgcctacgagttcctgggcgactacgcgctcctctactgggcgatgctcgcctgcaacgtggtggtgccgcaggccctctggctgggccgcctgcggcgcagcatcccggccatgctggcgatctcgctcgtcatcaatgtcgggatgtggctggagcgcatcctgatcacctggacgacgctgtcgcacggctatgccgcgagcctgtggcgggtgttccgcccgaccttctgggactggtccttcctgatcggtccgctcggattgttcgccttcttcttccttctgttcgtgcgcgtggtgccggcggtgtcgatgcacgagctgcgcgaactcgcccaccgggagggggccgcctga

SEQ ID NO: 1174 - DNA, 1347 bp, Gluconacetobacter diazotrophicus PAl 5 JGI
gtgagcgcccccgccgtcgtcgcaccgggcgagaccgcgcagtcgctgaccgaacgcatttgcgcggtgacgctgcgcgaggacgcgcgcccctggacgccgctgtggtggtggggggcgttcgcggtgtcgctggggctgctgggcatgggcgtggtcgcggtcgcgtggctgttttatgccggcctgggcatctggggcatcgactggccggtggtctgggggctggatatcctcaattacgtgtggtggatcgccatcgcctcgggcggcacgttcatctcggccctgttcttcctgctgggggtggaatggcgtacggcgctgaaccgcctggcggaaagcctgaccctgtgcgcggccctgtgcgccgcgatctttcccatcctgcatctggggcggccctggttcttctactggctgtttccctatccgaacacgatgggactatgggcgcagttccgcagcccgctggtgtgggatttcttcgcgatcctgacctatgttctggcgtcgatcctgttctggtatttcggcctgctgccggacctggcgaccttgcgcgaccgcgcgcgggggcaggggcggcgcatgttctacggggtgctggccctgggttttcgcggttcgggcacccagtggcggcattatcgcgcggtctatgccgtgatggccgcgctgatggcgccgctggtggtgtcggtgcacagcatcgtgggcatggatttcgcgggcagtgccgccaccggctggcattccacgcagtttccgcccttcttcgtcttcggtgccgccctgtcggggttcgccgtggtgctgatggccatcctgccgctgcggtcgctgctgggcctgcagccctatgtgacggagcggcacatcgacgtgctgggccggctgttcctgaccagttccctgtgcgtcgcctatgcctatctgatggacgcgttcgccacgttctacgggcccgaccaggcggaccggacgatgttcctcatgcgcgccttcggcctgtacgcgccggtctattggggcaccatcgtcctgaacatcgtgttcccgcaattgctgtggtggcgcgcggtgcggctgacccagcccctggtctggctgatcgggctgggcgtgctggtcggcatgtggctggagcggttccagatcatcgtgaccagcctggcgcgcacgcaattggcctccgcctgggggcagtacacgccgacgatatgggaatggagcctgctgttcggcacgatcgggctgttcctgaccacgttcctgctgatcgtgcggctgatgccggtggtcgcgatggccgaaatgcgggccatgctgcgggggccggcatga

SEQ ID NO: 1175 - DNA, 1371 bp, Methylobacterium chloromethanicum CM4
gtgagcgggcatgcccagccccatcgctggatcgcccgcgagcgtctcggctatggcgagatctgcgccgcggtcgccgatccgatccagaggcgcgggccgggccgcgcctgggtcatcgccttcctcggcgtgctgccgctcgtgctcgccacggtgatcgccatcggcgcggtgctcaccgtcggcatcggcctctcgggggtgaacaccacggtggtgtggggcttctcgatcgccaactacgtctggtggatcggcatcggcaatgccggaacgctgatctcctcgatgctgctgctgacgcgccagcactggcgcgcctcgatcaaccgctttgccgaggcgatgacgctgttcgcggcggccatcgccggcatcttcccgatcatccatctcgggcggccgctctattcgtattggctcgcgccctaccccaacaccatggatctctggccgcaatggcgctcggcgctggtctgggatttctgggccatcctcagctaccttctgttctccctgatcttctggttcaccggtttgctgcccgaccttgcgaccatgcgcgaccgggcgcagtcgcgcttcggccggcggctctacggcgcgctggcgctgggctggcgcggctcggcccgacactgggcggtctacgagaccttccacaagaccatggcggctttggccgtcccgctggtctgctccgtccattccatcgtcggcctcgactttgccgcgagcctgatgcccggctggcaggaatcgatcttcccgccctacttcgtcgtcggggctatgtattcgggcttcgccatggtggtggtgctggccatcatcatccgctggggcctgaacctccaggcggtgatcaccccggcccatttcgacgccatggcgaaggtgatgctgttcgcctcggtcgtcatgaccttctcctacgccacggagtggttcatgggctggtatggcggcgatcacgccgaccgcgccgtgatcgcctacttcttcaccggcgactatcgctggctctactacagcctgttgttctgcaactgcctcgtgccgcaggcgctctggttcgcccgggtgcgcctcaacctatgggcgctcgcgatcatctcgatcgtgatcaacctcggcatgtggctcgagcgcattctgatcgtctggaacagcctatcgcacggacacgccgtgagcctgtggcggacctatcacgtcagcttctacgacgtggtgatcctgatcgcgccgctcgggctgttcgccttcggcttcctcgtgctggcgcggatcttccccatcgtctccatccacgaggtcagccagctcgcccacgatgagggcgcggcgcgaggggggacggcatga

SEQ ID NO: 1176 - DNA, 1437 bp, Anaeromyxobacter dehalogenans 2CP 1
atgaccaccgcgaccaagacgatcgagcgcgtcgatccgctcgagacctcgcccgtgctggtcggccgccccgacgaccgggcgctgaccgagagcctgctcgagccggtgctggggcccacgaagaagggctggctggtgatgctcgtcctgttcggcggcgggatggccttctggctcctgtcgctctacatgaccctgttcgtcggcatcggggtgtggggcaacaacatcccggtcgcctgggcctacgacatcaccaacttcgtctggtggatcggcatcggccacgccggcacgctgatcagcgcgatcctgctgctgttccagcagaagtggcgcacctccatcaaccgcttcgcggaggcgatgacgctgttcgcggtggcgatggccggcgcgtacccggtcatccacctcgggcgcccctggctgttctggtggctcatcccgtaccccgccaccacccagatctggccgaacttcaagagcgcgctcccctgggacgtgttcgcgatctcgacctacgcgaccgtctccttcctgttctggtacctcgggctcatccccgacctcgccaccctgcgcgacgcggcgaagacccgggcgcagcgcgtcgtctacgggatcatgtccttcggctggcggggctcggcgcggcactggcagcactggcgcatcggctacctgctcatggccggcctgtccacgccgctggtggtgtcggtgcacaccatcgtgtcgttcgacttcgccatctcgcagctgccgggctggcacaccaccatcttcccgccgtacttcgtggccggcgccatcttcagcggcttcgcgatggtgatgacgctgatgatcccggcgcggaaggtgttcaagttcgagcacgtcgtcaccgcgcgccacctcgacaacatggcgaaggtgatcctcgcgaccggcctgatggtcacctacggctacgtgatggagtggttcatcgcgtggtactcgggcaacgacgccgagtggttcgccttctacaaccgcgtcgtcggcgactacaagctggtgtacgcgatgcagatcttctgcaacgtggtggcgccccaggtgttctgggtgccggcgctgcggcggaacgtgatggtgctgttcctcgtctccgtgctggtgaacttcggcatgtgggcggagcgcttcgtcatcatcgcggtgacgctcacccgcgacttcgtccccggctcctgggcgaactacacgccgacgtgggtcgactggggcctgctgttcgggtcgatctccaccttctccgtcctgttcctcctgttcctgcgcttcctgccggccatccccatctccgaggtgaaggagctccgccgcgagctggagcaccaggatcaccacgccgcgcagggcgggcaggccgtggcgcagggcgcgcacgcggagcgggcatga

SEQ ID NO: 1177 - DNA, 1365 bp, Methylobacterium nodulans ORS 2060
gtgagcgcggatctccgggcgaaagccccaccggcccatcgctggatcgcctccgagcgggcgagcgacgtcgccatcacggacgcaatcgtcaacccgatcctgatcggcgtcggcaagggatggtggatcgccctcgcgctcaccctgcccttcgtgctcctcaccctcgtcgccatcgcgtggctgttttggcggggcgtcggcgtctggggcatcaacaccacggtggtgtggggcgtcgccatcgccaactacgtctggtggatcggcatcggcaacgccggcacgctgatctcctcgatgctgctcctcacccggcagcgctggcgcgcctcgatcaatcgcttcgccgaggcgatgaccctgttcgcggtcgcgatcgccgggctcttcccgatcttccacctcggccggccgatctacgcctactggctcgccccctaccccaacaccatggggctctggccgcaatggcgcagcgccctcgtctgggacttctgggcgatcgtcagctacctcctgttttcgctcctgttctggtatgtcggcctgctgcccgacctcgcgacgatgcgcgaccgggcgagctctcgcggcgcccaggtcttctacggcgcgctggccctcggctggcgcggctcggcccgtcactggcggcggctcgaaaccctgcacaccacgatggcggccctcgcggtgcccctcgtctgctcggtccactcgatcgtcgggctcgatttcgcggcaagcctgatgccgggctggcaggagagcatcttcccgccctacttcgtggtcggcgctatgtattcgggcttcgccatggtggtggtgctggcggcgctggtgcgctggggcctgcggctccaggcggtgatcacggtcaaccacttcgaggtgatcggccgggtcatgctcacggcctccctcgtcatgggcctgtcctacgccaccgagtggttcacggcctggtacgggggcaagcccggcgagcgcggtctcgtcgcctacgaggtcacgggcgactacgccgccctctactgggcgatgctcgcctgcaacgtggtgctgccgcaggccctctggctgcgacgcctgcggcgcagcatcccggccatggtcgtgctctcgatcatcatcaatgccgggatgtggctggagcgcatcctgatcatctggacgacgctctcgcacggctacgcggcgagcctctggcgggtcttccacccgacattctgggactggtccttcctgttcgggccgctcggcctgttcgccttcttcttcctcatcctcgtgcgggtggtgccggccgtatcgatgcacgaggtgcgtcagctctcccacaaggaggccgcctga

SEQ ID NO: 1178 - DNA, 1338 bp, Rhizobium leguminosarum bv  trifolii WSM1325
atgaccgatcgccttgcagatcccgatcaggaaatcacaagagagatcgtgtcaatcccgcttgatttcccgcgcccgcgcgcctggtggctgctctttgcagtttcgcttctgctgctaggctgtttcgtcgtcgcggttgccgttctgttttggcgcggtgtcggcgtctggggaaacaacattcccgtcaattggggactggcgatttccaactatgtgtggttcctcggaatcggacatgcgggcactctgatttccgcgctgctgttgatcgtcaacgcccattggcgcaattcactcaaccggtttgccgaggcgatgacactcttcgccgtcttatgcgctgggctctatccgatcctccatctcgggcggccttggtttttctactggatggcaccttatcctaacacgatgcagatctggccgcagttcaagagcccgctgacctgggactttttcgccgtgctcacctatctgaccgtctcggtgctattttggtacatcggtattatcccggatcttgcctcggtgcgcgaccgggcaaaaacgaggcgcaagcaggttttttatggtctctttgcacttggctggcgaggctccgcgcgacactgggcaaaatggcagcaggcctatcgactgaccgccgcgattgccgtgcccctggtgatctccgtccattcggagatctcccttcttttcgccgcaggtccgattcccggctggaattcaaccgtctttccaccttactttgtcatgggcgcggctttttccggcttcgcggtcgttatcatgatcgccacggtgatccgccatcctctcggcctcgaccaactcgttcgcgcgcgccacctcgatctcctcgcggtcttcctgctggtgaccggtctgatgaccgcctacggctacctcgccgaaattttcaatgcgctgtattccagcgacgtgcaggaagtggaaaccctgcgcgaccgaatcgcgggcgcttattcctatagctattggggcgctgtggttttgaatttcgtgccgctgcagcttctctggttccggtctagccgcagatcgcccattgtgatctttctggtcgccctctcagtcacagtcggcatgtggtatgaacgtttcatgctgctgaccagcgcgctttaccgcgactggcttgtctcgtcctatggcgaatatcatcccagtttttgggaatggttgcttttcgtcgggatgttgggcgtgttcttcgcgccctatctcctgtttgtccgcttccttccggtcatctctgccttcgaagtcaaggaggcctatgaggaaacggggagcttggaccatgcgtga

SEQ ID NO: 1179 - DNA, 1473 bp, Pedobacter heparinus DSM 2366
atgtcaggacataacgaatcaatattaagagaaccattaatcaccggcaaggatatcacgtatgcaaagattacggatgatattttaatgccggttgagaacaagccaaacagggcatggtggataggatttaccgtagcactttgcggagccttactatgggtggtagctgtgagctataccttctggtttggtataggtgcctggggattaaataaaacagttggatgggcatgggacatcaccggcttcgtatggtgggtaggtattggtcacgcaggaacgctgatctctgcagtactgttgcttttccgtcagaactggcgtaactccattaaccgttcggcagaggcgatgacgatcttcgccgttatttgtgccgcaacctatgtagtttcccacatgggaaggccatggctggcttactgggtattgccattaccaaatcagttcggttcattatgggttaactttaactctccgctggtttgggatatgtttgcgatctctacttacttctcggtatcactgttgttctggtatacaggtttactgcctgatatcgcgacgatccgtgaccgtgcaacaggcgtaaagagaaaagtttattctatattgtcatttggatgggcaggaaacgtaaagacatggcaacgctttgaggctgtatctttgattctggccggtatttctacaccactggtactttcggtacacacgattgtatcgatggactttgcaacctcggtaatcccgggatggcatactacgatcttccctccatattttgtggccggggcgatcttctccggatttgctatggtactgacgctgttactggtagcacgtaaagtattgggcctggagaactacatcaccatgttccacattgagtcgatgaacaagatcatcatcttaacgggatctattgtaggtgtggcttatttaacagagttctttattgcctggtattcaggttcagaatatgaacaatatgcattcatcaaccgttcgaccggtccttactggtgggcatactggatgatgatgacctgtaacgtgatctctccgcagttgttatggtttaaaaagatccgtaccagcatcccggctacctggattttgtctattgtagtaaacatcggtatgtggtttgagcgttttgtaattatcgtgacttcattacaccgtgattatatcccttcaagctgggccatgttctatccgtcgtgggtagatgtgagtgtctttgtaggatcgataggagtattctttaccttgttcttattgttcctgcgggttttaccttcaattgcaattgcagaggttaaattgctgctgaagagtgcaagtgagcaggctaaactggagcagattaaaggtggacatttagataaagaacatgtatcggaatacgtggagtctttagaaaaatttgatagtgttaaacaagaagaatacgcaaaaatataa

SEQ ID NO: 1180 - DNA, 1434 bp, Dyadobacter fermentans DSM 18053
atgcatgttacttcacctgtaagagaaccgctgatccaaggtgggaaaacgtacgcggacgtaacggaagacatatgtcgtcacgtggaggcagctccaacgaaagaatggaagatcgctttcggactttcgctcatcgttctggcatatgggtctgtgtgtctggcctggacctggtgggaaggcctcggagtttggggtttgaataaaacagtaggttgggcctgggacatcaccaacttcgtatggtgggtaggtatcggtcacgcgggaacgctgatctccgcgatcctcttgctcttccgccagaaatggagaacttccatcaaccgtgcagcggaagcgatgacgatcttcgccgttatttgtgctgcttcatttattttgatgcacatgggtcgtccctggatggcttactgggctcttccattgccaaacgcattcggttctctttgggttaacttcaactcgccgctcgtttgggacgtattcgcgatcagtacttacttctccgtatcgttggttttctggtacatcggtcttatccctgacctcgctaccatccgcgaccgcgctaccagcaaagtttcgaaattcatgtacggaacatttgcaatggggtgggacggttcagctaagacctgggcacgttacgaatacatttcattgatcctcgcaggtctttctacgccacttgtactttcggtacacaccattgtaagtatggactttgctacctcggtaatcccgggatggcacacgacgatcttccctccgtacttcgttgcgggtgcgatcttctccggattcgcgatggtacaaaacctgatgctcatcacacgtgtagtttacaaactggaagactacatcacattggagcacattgaaacgatgaacaaggtaatcacgcttaccggttcggtagtaggtgtggcttacattactgagttctttatcgcatggtacggtggtgttgaatacgaatattacgcattcttcaaccgtatgaccggtccttactggtgggcatactgggctatgatgacctgtaacgtaatctctccacagcttttctggtcaagaaaactgcgtcgcagcatctcgtttacattcttcatctctgtgattgtaaacatcggtatgtggttcgagcgtttcgtaattatcgtaacctctctgcaccgtgactatatcccgtcaagctggacaatgttctcgcctacacggtacgacatcggggactacattttctccttcggtttgttcttcacattgttcctcctgttctcgaaatacctgccggtagtgaacatggcagaagtaaaagcggtattgcgctcgacatctgcgcagctgcctgccaagatcgccggagtagcgaaagtaagacagcgcggaactgctgaacccgcttacaacaaggatcaggaataa

SEQ ID NO: 1181 - DNA, 1461 bp, Chloroflexus aggregans DSM 9485
atggcacaggcgcaaccactccgaacccggcccgtcgatgacggtgaagcgtacttgctgccgggggaaacctacacgtcgatcacgcaaaagatcggcgatgtcccgttaacgccgccgctgaagaccccaaagggctggttggccggctttagcgtggcgttcttcttgttaatgatcttcttcgtgtcggtgacgtggctgttcatccgcggcgtcggtatctggggtattaatatcccggtcggctggggtatggacatcatcaacttcgtgtggtggatcggtatcggccacgccggtacgcttatctcggccattctgttgctgcttaatcagggttggcgcaactcgatcaaccgcttcgccgaagcgatgacgctgtttgcggtggcgtgcgccggtctctacccgatcctgcacctcggtcgaccatggctgttctactggttgatcccgtacccgaacacgcacggcatgtggccacagttccgcagcgcactggcgtgggacgtatttgcgatctcgacctacgctacggtgtcgctggtgttctggctggtcggtctgatccccgactttgcgacgctccgtgatcgggccaagaacatctgggtcaagcgcctctacggcattgcggcccttggttggcgtggatcggcccgccactggcaccgctatgagatagcctcgatcttgctggccggtctctcgaccccactggtggtctcagttcactcgatcatttcactcgacttcgccatttcgcaagtccccggctggcaagtcacggtcttcccgccctacttcgtggccggcgccgtgtttgccgggtttgcgatggtgctcctcctgatgatcccggtacgcaccttctacggctttgagagctacatcaccatccatcacctcgatgtgatggcgaaagtgatgctcgctaccggtatgatcgtcgtttacggctactttatggaggtcttcgcctcgctttacagcggcaatgaattcgaggaatacctcctctacaaccgcctcttcgggccaagctcgtgggcctactggggcctgctcttctgcaacgcggtagccattcaacccttgtggtttaagaaggtgcgtcagaatgtcccagccttgttgatcatctcactaatcgtcagtgttggtatgtggctggagcgctacgtgattattgtcatctcgctcgagcgtgacttcttgccttcgtcgtgggacatctatattccgacgatttgggactggtcgctctaccttggtacctttggtctcttctttaccctgctcttcctcttcatccgcgtcttaccgatgatcaacatctttgagatgcggctgttcctccatcaagagacagagagggcgaagcagcgggcagaacacggtgcacacagccatggccacgatcacagcccggcccacggtgtagcctcggcagactag

SEQ ID NO: 1182 - DNA, 1485 bp, Chitinophaga pinensis DSM 2588
atgcatttaaagtacgaatccacactaagagaaccattagttgatggggtgaaagattaccaccaggtaacagaagatatcatcagcccgattgaagccaagcctggtaaattgtggtatgtgggctttttcatttccctaatgctgctggcatttggcgccttctccgtaacctgggaagtttactacggtacgggtgtgtggaacctgaataaaacgatcggttggggttgggacattaccaacttcgtatggtgggtaggtatcggtcacgccggtacactgatctccgcgatcctcctcctcttccgtcaaggctggcgtactggtgtaaaccgtgcagcagaagcgatgacgatctttgcggtaatgtgtgcgggtcagttcccgatcttccacatgggtcgtgtatggatggccttcttcgtattgccttatccgaatacacgtggtccgctgtgggtgaacttcaactctccgctcttatgggacgtgttcgcgatctctacttacttcacagtatctctcctgttctggtattccggtctgatccctgacttcgcaactgtacgtgacagggctaaaaccaaactgcgtaagttattatatggtgttgcttctttcggctggacaggttctaccaaacactggcagcgtcacgaggcactgtcactggttctggcgggtctctctactccactggtactttctgtacacactatcgtatcttttgactttgcaacttccgtaattcctggttggcatactaccatcttccctccatacttcgtggcgggtgcgatcttctccggattcgcaatggtacagaccctgctgatcatcgtacgtaaaatattaggtctggaagactatatcaccctgggccacatggaggctatgaacaaggtgattgtactgaccggttccgtagtaggttgtgcttacctgactgagttattcatggcatggtacgcagcagttccttatgaattcgatactttctataaataccgtgcagcaggtccgctgggttggtcttactggatcatgatgacctgtaacgtaatcactccacaggtattctggttcagcaaaatgagaagaaacgtagccgtaacctttgtgatgtctatcatcgtaaacatcggtatgtggttcgagcgtttcgtaatcatctgtacttccctgtatcgtgactacctgccatccagctggagctactatcgtccatcctggccggaagttggtttctatatgggtaccttcggtctgttctttacctgtttcttcctgttcgccaagtacttcccggttatcgctgttgctgagatcaagagcgtactgaaaacttccggtgaaagcttcaagaagggcatggagcagtatgagcagcagcctgctgaagagtttgaagctggtttacaccatgatgacgatcatcatcacgatgctcacggtgcagtagctcacgctcatcataactaa

SEQ ID NO: 1183 - DNA, 2739 bp, Arthrobacter FB24
gtggcatcacttatcgaaaaacttctccgcacgggtgacaaaaaaaccctgaggcaactgcggaactatgccgattccatcaatgccctggaaagctccttccagactttcaccgacgccgaactgcgcgaagaaaccgaccggctgcgtgaacgccaccaggacggcgagaagctggacgacctcctgcccgaggccttcgcggcggtccgtgaagcctcctcccgaaccctgggcatgcgccacttcgacgtccagctgatgggcggcgcggccctgcacctgggcaatatcgccgaaatgaagaccggtgaaggcaaaaccctcgtagccaccgctccggcctacctgaacgcactcaccggcaacggggtgcacgtgatcaccgtgaacgactacctggctgaataccagtcggacctcatgggccgggtctaccgctttctcggcctgaccagcggctgcatcctgtccaaccaggaccctgccgtgcgccgcgagcagtacgccgcggacatcacctatggcacaaacaacgaattcgggttcgactacctgcgcgacaacatggcctgggacaagtccgagctcgtccagcgcggccaccacttcgcaattgttgacgaagtggactccatcctcatcgatgaggcccgcaccccgcttatcatttccggtccggcccagggtgacaccaaccgctggtacagcgaatttgccaaggtagtcacccggctcaagcccgatgaagactacgaagtcgacgaaaagaagcgcaccgtaggcgtgctcgagggcgggatcgagaaggtcgaggactacctgggcattcacaacctctacgagtccgccaacaccccgctgatcggcttcctgaacaatgccatcaaggccaaggaactcttcaagcgggacaaggactacgtcatcctcgacggcgaagtgcttattgttgacgagcacaccggccgcatcctcgcgggccggcgttacaacgagggcatgcaccaggcgatcgaggccaaggaaggcgtcgagatcaaagcggagaaccagaccctcgccacggtcacgctgcagaactacttccgcatgtacaacaagctttccggcatgaccggcacagccgagaccgaagccgccgagttcatgagcacgtacaagctcggcgtggtggccatccccaccaaccgcgacatgcagcgcattgaccagcctgacctcgtctacaagaacgaggccgtcaaattcgacgccgtcgtcaaggacattgccgagcggcatgaaaaagggcagcccgtcctcgtgggaaccaccagcgtggagaagagtgaatacctctcccggctgctggccaaggaaggcatccgccacgaggtccttaacgcgaaaaaccacgcccgtgaagccgcgatcgtcgcgcaggccggccgtaagggagcggtgacggtcgccacgaacatggccggtcgaggtacggacatcatgctgggcggaaacgcagaattcactgccgtcgccgagttggcggccaaaggcctggatccggaagaaaactcagaagagtacgaggccgcgtggcccgcggcgttcgaggccgccaagcaggcggtgaaggacgaacacgaggaagtactggaattgggcgggctctatgtcctcggaaccgaacgacacgagtcccggcggatcgacaaccagctccgcggacgttcaggacgccagggcgaccccggcgagtcgcggttctacctctccttgacggatgacctgatgcgcctgttcaattcgggtgcggccgaacggcttatgaacagttccgttcccgacgacgtcgcgctcgaatcgaagctcgtttcgcgtgccatagcctctgcgcagggccaggttgaaggccgcaacgcggaacagcgcaagaacgtccttaagtacgatgacgtcctcaaccgccagcgcgaagccatctatggggaccgccgccgtatcctcgaaggcgacgacctgcacgagaaagttcagttcttcctcgaagacaccatcactgccctcatcgacgcagcaacctccgagggcaccggggacgactgggacttcaaccaactctggacgaacctcaagaccctctacccggtcagcgttacatcccacgacgtcatcgacgaggccggcggcaagtcccgcatcaccgtggacttcctgaaggaagagattctttccgacgcccggctggtataccaggccagggaacaggccatcgggtccgagagcatgcgcgaactcgagcgccgcgtggttctgtccgtgatcggccggaagtggcaggagcatctctacgagatggactacctcaaggagggcatcggccttcgagccatggcccagcgtgacccgctcgttgaataccagcgcgagggattcataatgttccaggccatgatggaggccatcagggaggagagcgtcggcttcctgttcaaccttgaggttgaggtgacccccgctgaggacgtcgtcgtggccgacggcgccggggaacatacagaacaccatgagccacagatccatgcagcaggactggaagcaccggagaagcccgcacagctgcaatacactgctccgggcgaagacggcgccagccagacccgcgtcgaaggcaggtcgtcggggcgttcgggaaatccggcgaaggctgcccaggacggcgcccggaagccggccccgaaaaagaagaagcgctag

SEQ ID NO: 1184 - DNA, 2814 bp, Nocardioides JS614
gtgcctgccattctcgacaagatcctccgcatcggcgagggcaagatcctgcgccagctcgaggccatcgcgcaggcggtgaacgccatcgaggacgacttcgtcgcgatgagcgacgccgagctccagggcatgaccgcggagttcaaggagcgcctcgccaacggcgagagcctcgacgacatcatgcccgaggcgttcgcgaccgtccgcgaggcggcccgccgcgtgatcggcctgcgtccgttcgacgtccaggtgatgggcgccggcgcgctgcacatgggcaacatcgccgagatgaagaccggtgagggcaagacgctggtcgccgtgctgccgtcgtacctcaacgcgctgtccggcaagggcgtccacatcgtcaccgtcaacgactacctcgcgaagttccagtccgagatgatgggccgggtccatcacttcctggggctcaccgtcggcgtgatcctcccggagatgcgccccgacgagcgccgggtcgcctacaactgcgacatcacctacggcaccaacaacgagctcggcttcgactacctgcgcgacaacatggcgggctcgatcgaggagtgcgtccagcgcggccacaacttcgcgatcgtggacgaggtggactcgatcctgatcgacgaggcccggaccccgctgatcatcagcggcccgacgcaggacgaggtgcactggtacgccgagttcgcgaaggtcgcccgcaacctggtccgcgacgaggactacgaggtcgacgagaagaagcggaccatctcggtcctcgagcccggcatcaccaaggtcgaggaccacctcggcatcgagaacctctacgagtcggccaacacgccgctgatctcgttcctgcacaactcgatcaaggccaaggagctcttccacaacgacaaggagtacgtcgtcctgaacggcgaggtgctcatcgtcgacgagcacaccggccggatgctcgcgggccgccgctacaacgacggcctgcaccaggcgatcgaggccaaggaggacgtgcaggtccgcgaggagtaccagaccctcgcgacggtcaccctccagaactacttccgcctctacgacaagctctcgggcatgaccggcacggccatgaccgaggcgtccgagttcgacaagatctacaagctcggtgtggtcccgatcccgaccaacaagccgatggcgcgcaaggaccaggccgacctggtctaccgcaccgaggaggcgaagtacgaggccgtcgtcgaggacatcgccgagcgccacgagaagggccagccgatcctggtcggcaccgtctcggtcgagaagtccgagcacctgtcggccaagttgaagaagcggggcatcccgcactcggtgctgaacgcgaaggtgcacgccgacgaggcgaagatcgtcgccctcgccggtcacaagggggcggtcacggtcgccacgaacatggccggccgaggcaccgacatcatgctcggcggctccgtcgagttcctcgccgacgccgagctgcgcaagcgcggcctcgagcccgccggcgagaccgccgatgagtaccaggccgagtggcccggcaccgtcgagcggatcaagtcccaggtggccaacgagcacgacgaggtccgcgcgctcggcgggctctacgtcgtcggcaccgagcggcacgagtcgcgccgcatcgacaaccagctccgcggccgttccgggcgccagggtgacccgggcgagtcccggttctacctctcgctccaggacgagctgatgcggctgttcaagtccgactgggtggaccgggtgctccaggtcctcaagatcccggacgacgtcccgatcgagaacaagcgcgtcacgagcgcgatcgcgaacgcccagggccaggtcgagtcccagaacttcgagtcccgcaagaacgtgctcaagtacgacgacgtcatggaccgccagcgcaaggtgatctacgccgagcgccgggaggtcctcgagggcaaggacctccaggaccagatccggaccttcatcgacgacacggtcaccggttatgtcaccggcgccaccgaggagttcgcggaggagtgggacctcgaggcgctgtggaccgccctgcgccagatctaccccgtcggcgtcgactaccgggtcctcgaggaggaggccggcggccgggcgaacatggaccgcgacgagctgatcgccgtgctccagaaggacgctcacgaggcgtacgaccgccgcgaggccgaggtcggcgagaccgtgatgcgcgagctcgagcggcgcgtcgtgctctccgtgctcgaccgcaagtggcgcgagcacctctacgagatggactacctccgcgagggcatctacctgcgtgcctactcccagcgcgacccgctggtcgagtaccagcgcgagggcttcgagatgttcgccgcgatgatggacggcatcaaggaggagtcggtcggcttcctgttcaacctcgaggtccaggtcgagatcgaggaggaggacgaggaggaggaagaggtcctcgagccgatgcgccagccggtgccgtccttcgaccagcagggggcgatgccgcagatccgggcgaagggcctggagcggccgagccagcccaccaagctcgcctactccgcgcccagcgaggacggcgacgcggaggtcaagggtgcgacggtgaccaacgcggacgacgagttcgccggggtcggccgcaacgaccgctgcccctgcggctcgggcaagaagttcaagcagtgccacggccgccccggcgggccgacgggactgaccgctcgcgtcagctag

SEQ ID NO: 1185 - DNA, 2916 bp, Salinispora tropica CNB-440
gtgtcgattctggaaaaggtcctccgtgcgggcgaggggcgcctggtgcgccggctcaaggcgatcgccgccgccgtcaactcgatcgaggacgactacgtcaacctcaccgacgacgagctgcgggagatgaccgcgcagttccgggaacggctggatgacggcgagacccttgatgatctgttgcccgaggcgttcgcggtctgccgcgagggtgctgcccgggtgctcggtcagcgcccgtacgacgtccaggtgatgggtggggcggcgctgcacttcggcaacatcgccgagatgaagaccggcgaggggaagaccctcacctcggtcatgccggtctacctcaacgcgctctccggcaagggcgtgcacgtgatcacggtcaacgactacctggccgagcgagacgccgcctggatgggccgggtgcacgagttcctcgggctcaccgttggcgtcgtgctgcccaaccggcccgccgccgagcaccgcgccgcctacgagtgcgacatcacctacggcaccaacaacgagttcggctttgactacctgcgcgacaacatggcctggtcgaaggaggacctggtccagcggggccacaacttcgccgtcgtggacgaggtcgactcgatcctgatcgacgaggcccgcaccccgttgatcatttccggtccggccgaacactccgcccgctggtacggcgagttcgccgcggtggtcgcccgcctccagtccggcaaggacggcgagggcgactacgaggtcgaccacgccaagcgcacggtcgcggtgacggagcggggagtcggcaaggtcgaggaccggctcggcatcgacaacctctacgagtcggtcaacacgccactggtcggttacctgaacaacgcgatcaaggcgaaggagctcttcaagcgggacaaggactacatcgtcagcgagggcgaggttctcatcgttgacgagttcaccggccgcattctgcacgggcgccgctacaacgagggcatgcaccaggcgatcgaggccaaggagggggtggagatcaagcaggagaaccagaccctggccaccatcaccctccagaactacttccgcctctacgagaagctcgccggcatgaccggtaccgcccagaccgaggcgggcgagttcaacaaggtctacaaggtcggggtggtgaccatcccgacgcaccggccaatggtccgggaggaccgctccgacgttatctacaagaccgagaaggccaagttcaacgcagtcgtcgaggacatcgccgagcggcaccacgccggccagccggtgctcgtcggcacggtctcggtggagaattccgagatcctctcccagctcctgcgccgtcggggaatcccgcactcggtgctgaacgcgaagttccacgcgcgcgaggcggagatcgtcgcccaggccggtcgcaagggcgcggtcaccgtcgccaccaacatggctggccgcggcaccgacatcctgctcggtgggaatcccgagttcctcgccgccaacgacctgcgtcagcgcgggctcgacccgaccgagcacgaggaggagtacgccaaggcgatggaggaggtcctgcccacctggaagcaggcctgcgacgacgaggcggaggaggtctccgccgtgggcggcctctacgtgctgggcaccgagcggcacgagtcccggcgcatcgacaaccagctgcgcggccgatcgggtcgccagggggacccgggtgagtcccgtttctacctgtcgctgcaggacgagttgatgaagcgtttccgctccggcgccgtcgaggccgtcatggagcgcttcaacatcccggaggacgtgcccatcgagtcgaagatggtcacccgccagatcaagaccgcgcaggcgcagatcgagtcccagaacgccgagatacgcaagaacgtcctcaagtacgacgaggtcatgaacaagcagcggcaggtgatctacgctgagcggcttcgggtgctcaacggcgaggacctgtcggaccaggtccggaacatgatcgacgatgtcgtcgaggcgtacgtccgcggcgccaccgcggagggctacgccgaggactgggatttcgagcagctctggtccagcctcaagcagctctacccggtgggcatcaccatcgaggagttggaggaggaggccggcggatcgcgggcgagcattgacgtcgacttcctgctcagccgcctgaaggaggacgcgcacgccgggtacgaccgccgcgaggaggagctcggtgcggagggcgtccgccagctcgagcggatggtcctgctccaggtgatcgaccgcaagtggcgtgagcacctctacgagatggactacctccaggagggcatcagccttcgggcctacgcccagcgggatccggtggtggagtatcagcgcgagggcttcgacatgttcgccaccatgatggacggcatcaaggaggagacggtcggtttcctctacaacctggacgtgcaggtccaggagtcggagccggcggccgacgaggtcaagctcctggagaagccggtcgaggtccgggccaagggcctcggtcgtacgccacagcagcagggcctgcaatactccgcgccgaccatcgatggggaggccgggcgcggctcggtcgccgtcgagcgggccgaggaggccgcgccgcaggaggggcggcccgccatgaccgctccggccgcccccgggcagtccgctcccaccgccccccagcggccgggaaatcgcgcgcgtggccacgccgtcgccgccggcaccgcccgccgggcggcaccggggcaggccgagggtggcaacggaccgtcgcgcaacgcgccgtgtccgtgtggctcgggccgcaagtacaagcgctgccacggctcgcctaacggcggcgcctga

SEQ ID NO: 1186 - DNA, 3057 bp, Frankia EAN1pec
gtgggtggcgatcgaggggctagcatcttggttgtcggtgagcctcgccgacatgcctgccggaggagtttcgccgtggttctagacaagatcttgcgtgccggtgagggccggattctgcgcaagctcaaggcgatcgccgagcaggtgaacctcatcgaggacgacttcaccggtctgaccgacgccgagctgcgcgggatgaccgacgagttccgccagcgcctggccagcgaagaggaaaccctcgactcgttgctgcccgaggcgttcgcgacggtgcgcgaggcggcgcggcgcacgctcggccagcgccatttcgacgtccagatcatgggtggcgcggcgctgcacctgggcaacatcgccgagatgaagaccggtgagggcaagaccctggtctccacgctgccgtcctacctgaacgccctgagcggcaacggcgtccacatcgtcacggtgaacgactacctggcccagcgcgacgccgagaacatgggccgtgtccaccgcttcctcggcctcacggtcggtgtcatccatccccagatgccgccgtcggtgcgccgccagcagtaccggtgcgacatcacctacggcacgaacaacgagttcgggttcgactatctgcgcgacaacatgtcctggagcgccgaggaactggtccagcgcggccatcacttcgccgtcgtggacgaggtcgactccatcctcatcgacgaggcccgcacgcccctgatcatcagcggcccggccgacaacccgacccgctggtacaccgagttctcgcggatcgcccccctgctcgagcgggacgtcgactacgaggtcgaggagggcaagcggacggtctcgatcagcgaggtcggcgtagagaaggtcgaggaccagctcggcatcgagaacctgtacgagtcggtgaacacccccctcgtcggttacctcaacaacgcgctgaaggccaaggagctctacaagcgggacaaggactatatcgtcaccgacggtgaggtcctcattgtcgacgagttcaccggtcgcgtcctgcacggccgccgttacagcgagggaatgcaccaggcgatcgaggccaaggagaaggtcgagatcaagcaggagaaccagaccctggcgacgatcactctccagaactacttccggctctacgacaagctgtccggaatgaccggtacggccatgacggaggccgccgagttccaccagatctacgccctcggcgtggtgccgatcccgaccaacaagccgatggctcgcacggaccaggccgacgtcgtctacaagaccgagatcgcgaagttcgacgcggtcgtggaggacatcgccgagcggcacgagaacggtcagcccgtcctggtcggcacgaccagcgtggagaagtcggagtacctgtccaagcagctcgccaagcgcggtgtccggcacgaggtgctgaacgccaaacaccacgagcgcgaggcgatgatcatcggcgaggcgggccggcgcggcgcggtcaccgtggcgacgaacatggccggccgaggcaccgacatcatgctcggcggcaaccccgagttcatcgcccagacggagcttcgccagcgcggcctgtctccgatcgacaccccggacgactacgaggcggcctggcccgaggcgctggagaaggcccgtgcgtcggtcaaggccgagcacgaggaagtcgtcaacgccggtggcctctatgtgctcggcaccgagcggcacgagtcccgccggatcgacaaccagctgcgcggccgtgccggccgtcagggcgaccgcggcgagtcccggttctacctctccctcggtgacgacctcatgcggttgttcaacgccgcggcggtcgagggcatcatggaccgcctcaacatcccggacgacgtcccgatcgagtccaagatcgtgactcgcgcgatccgttccgcgcagacccaggtcgagggccagaacttcgagatccgcaagaacgtcctcaagtacgacgaagtcatgaacaagcagcgcaccgtgatctacgaggagcgccgcaaggtcctggagggcgccgacctgcacgagcaggttcgccacttcgttgatgacaccgtcgagggctatgtgcgcggcgcgacggccgacgggtacccggaggagtgggacctcgaaaccctctggtcgggcctgggcctgctctacccggtcggcgtcgacgcaccgggcaccgacgaccgcgaggggctgacctccgacctcctgctcgaggatcttcaggcggacgcgcaggacgcctacgaccggcgcgaggccgacctcggcgacaagccggacggcgaggccgtcatgcgtgagctggagcgccgggtggtgctcgcggtactcgaccgcaagtggcgtgagcacctctacgagatggactacctgcaggagggcatcggcctgcgggcgatggggcagcgagacccggtcgtggagtaccagcgcgagggcttcgacatgttccagacgatgatggagggcatcaaggaggagtcggtccgcctcctgttcaacgtcgaggtgcaggtagcggggcgggacaccgaccagagcggcaccgcgcccgaaggagcgcccgcagccccggccggcacgacgcccacgccggccaccccggccgagcgcggctccgtgtccgtcggcgcggtgcctctggtcaccccggccgcgcccgcaccggcgcagcccgcgcggaccgctcccgagcctccgccggccccggtgccggcgtccccgccgcccgtcttcgtcaagggcctcgaaccgcaccgcccgaccggtggactgcgttacacggcgccgtctgtcgacggcggctcgtccacggtgacgaccgtcgacaacgggtccgagctgtcccgtgccggcggtggtgggccgcgctcggccggcggcggcgtgtcccgcggcgctggcgagggcggaacggcccgcccggcacgcaacgcgccctgcccctgcggctcggggcggaagtacaagcgctgccacggcgatccggcccgccgcaacgactga

SEQ ID NO: 1187 - DNA, 2916 bp, Salinispora arenicola CNS-205
gtgtcgattctggaaaaggtcctccgtgcgggcgaggggcgcctggtgcgccggctcaaggcgatcgccgccgccgtcaactcgatcgaggacgactacgtcaacctcaccgacgacgagctgcgggggatgaccgcgcaactccgggagcggctggccgacggcgaaaccctcgacgacctgctgcccgaggcgttcgcggtatgtcgcgagggcgccgcccgggttcttggtcagcgcccgtacgacgtccaggtgatgggcggcgcggcgctgcacttcggcaacatcgccgagatgaagaccggtgagggcaagacccttacctcggtcatgccggtctacctcaacgcgctctccggcaagggcgtgcacgtgatcacggtcaacgactacctggccgagcgcgatgccgcctggatgggccgggtgcacgagttcctcgggctcaccgtcggcgtggtgctgcccaaccggcccgccaccgagcatcgcgccgcctacgagtgcgacatcacctacggcaccaacaacgagttcggcttcgactacctgcgcgacaacatggcctggtcgagggaggacctggtccaacgtggccacaacttcgcggtcgtggacgaggtcgactcgatcctgatcgacgaggcccggaccccgctgatcatctccggcccggccgaacactcggcccgctggtacggcgagttcgccgcggtggtcgcccgcctccagtccggcacggacggcgagggcgactacgaggtcgactacgccaagcgcacggtggccgtgacggaacggggagttgccaaggtcgaggaccggctcggtatcgacaacctctacgagtcggtcaacacgccgctggtcggctacctgaacaacgcgatcaaggcgaaggaactcttcaagcgcgacaagaactacatcgtcagcgagggcgaggtcctgatcgtcgacgagttcaccggtcggatcctgcacgggcgtcgctacaacgagggcatgcaccaggcgatcgaggccaaggagggggtggagatcaagcaggagaaccagactctcgccaccatcaccctccagaactacttccggctctacgagaagctcgccggcatgaccggtaccgcacagaccgaggcgggtgagttcaacaaggtctacaacgtcggggtggtgaccatcccgacccaccggccgatgatccgggaggaccgctccgacgtcatctacaagaccgagaaggccaagttcaacgcggtcgtcgaggacatcgtcgagcggcaccaggccggccagccggtactcgtcggtaccgtctcggtggagaactccgaggttctctcccagctcctgcgtcgtcggggcatcccgcactcggtgctgaacgcgaagttccacgcgcgggaggcggagatcgtcgcccaagccggccgtaagggcgcggtcacggtcgccaccaacatggccggccgcggcaccgacattctgctcggcggcaatcctgagttcctcgccgccaacgagctgcgccagcgcggacttgacccggcggagcacgaggaggagtacgccaaggcgatggaggaggtgctgcccacgtggaagcacgcctgcgacgccgaggccgaggaggtcacctccgtcggcgggctctacgtgttgggcactgagcggcacgagtcccggcgcatcgacaaccagctgcgcggccgatcgggtcgccagggcgacccaggtgagtcccggttctacctgtcgctgcaggacgagctgatgaagcgcttccgctccggtgccgtcgaggctgtcatggaacgcttcaacatcccggaggacgtgcccatcgagtcgaagatggtcacccggcagatcaagaccgcgcaggcgcagatcgagtcccagaacgccgagatccgcaagaatgtcctcaagtacgacgaggtcatgaacaagcagcgtcaggtgatctacgctgagcggctgcgggtgctcaatggtgaggatctgtccgaccaggttcggaacatgatcgacgatgtggtcgaggcgtacgtgcggggagccaccgccgagggctacgccgaggactgggatttcgaccagctctggtccagcctcaagcagctctaccccgtgggcatcaccatcgaggagatggaggaggaggccggcggctcgagggcaagcatcgacgtcgacttcctgctcagccgtctcaaggaggacgcacacgccgcgtacggtcgccgtgaggaacagctcggtgaggagggtgtccgccagctcgagcggatggttctgctccaggtgatcgaccgtaagtggcgagagcacctctacgagatggactacctccaggagggcatcagccttcgggcgtacgcccagcgggatccggtggtggagtaccagcgcgagggcttcgacatgttcgccaccatgatggacggcatcaaggaggagacggttggtttcctctacaacctcgacgttcaggtcgaggagccggagccggcggccgacgaggtgaagttgctggagaagccggtcgaggtgcgggccaagggccttggtcgggcaccgcagcagcagggcctgcaatactccgcgccgacgatcgacggcgaggcggggcgcggctcaccctccatcgaacgtgccgacgaggcggccccgcccgcgggccggcccgccatgtccgctccggccggtcccgggcggacagcccccgccgctccccggcgggcgggtggcggttcgaacggtcacgccgtagctgccggcaccgcccgccgggccgcaccggggcaggccgagagcagcaatgggccctcccgcaacgcgccgtgcccatgtggctccggccgtaagtacaagcgctgtcacggctcccccaacagcggcgcctga

SEQ ID NO: 1188 - DNA, 2751 bp, Arthrobacter chlorophenolicus A6
gtggcatcacttatcgaaaaacttctccgcacgggtgacaagaaaacacttcggcaactgcggaactatgccgactccatcaatgccctcgaagactcgttcaagacctttaccgatgccgagctccgtgaggagacggaccggctcagggaacgccaccaggacggcgaaaagctcgataacctcctgccggaggccttcgcggctgttcgggaagcgtcctcgcgcacccttggaatgcggcacttcgacgtccagctgatgggtggcgccgccctccacctgggcaatattgctgagatgaagaccggtgaaggcaagaccctggtggcaaccgctcctgcctacctgaatgccctcaccggcaagggtgtccacgtcgtcaccgtgaacgactacctcgccgagtaccagtccgacctcatgggccgcgtctaccgcttcctcgggctgaccagtggatgcatccttgccaaccaggaccctgcggtccggcgcgagcagtacgcggcggatatcacctacggaaccaacaacgagttcggtttcgactacctgcgcgacaacatggcctgggacaggaacgaactggtccagcgtggacacaacttcgccatcgtcgatgaagttgactccatcctcattgacgaagcccgtacccccctcatcatctcggggcccgcccagggcgacacgaaccgctggtacagcgaattcgccaaggtcgttttgcggctgcagcccgaaaaggactacgaagtcgatgagaagaagcgcaccgtcggcgtcctggagggcggcatcgaaaaggtcgaggattacctcggcatctcgaacctgtacgagtccgccaatacaccactgatcggcttcctcaacaacgccatcaaggccaaggagctgttcaagcgggacaaagactacgtcatcatggacggcgaggtcctcatcgttgatgagcacaccggccgtatccttgccggccgccggtacaacgaaggcatgcaccaggcgatcgaggccaaggaaggcgtcgagatcaaggcggagaaccagaccctggccaccgtcaccctgcagaactacttccgcatgtacggcaaactctccggcatgaccggcaccgccgagaccgaagccgccgagttcatgagcacctacaaactcggcgtcgtggccattcccaccaaccgcgacatgcagcgcatcgatcagtccgaccttgtcttcaagaacgaaacagtgaagttcgatgccgtcgtccgcgatatcgccgaacgccatgaaaagggccagcccgtcctggtgggtaccaccagcgtcgagaagagcgagtatctttcccggctccttgccaaggacggcatccgccacgaagtcctgaatgccaagaatcacgcacgggaggccgccatcgttgcgcaggccggccgtaaggctgccgtaacggtggccaccaacatggccggacgaggcaccgacatcatgctgggcggcaatgccgagtttacggctgtcgctgaacttgccaagcgcggcctggacccggaggagaactctgaggagtacgagtccgcgtggccggctgcccttgaagcagccaagcaggccgtcaaggatgagcatgaggaggtcctgaacctcgggggactgtatgtccttggcaccgaacgccatgagtcccggcgcatcgacaaccagctccgcggccgttccggacgccagggcgacccgggcgagtccaggttctacctttccttgaccgacgacctcatgcggctgttcaactccggcgccgcagaacgccttatgaacagctccgttcctgacgacgtggccctcgaatccaaacttgtatcccgcgccatcgcctcggcgcagggccaggtggaggggcgcaacgccgagcaacggaaaaacgtcctgaagtacgacgacgtcctgaaccgccagcgcgaagcgatctacagcgaccgccgccgcatcctcgagggtgacgacctgcacgaaaaggtgcagttctttgtcgaggacaccatcatggccctcatcgacgacgccaccgccggaggcaacggcgacgactgggacttccaccagctgtggaccaacctcaagacgctgtacccggtgagcgtgagtgcggacgacatcattgaagaagccggaggaaagtcccggctgacggtggagttcctgaaggaagagctgctttcggacgcccggcttgtctaccaggcgcgggaggaaagcatcggctccgagagcatgcgggaactggaacgccgcgtcgtgctgtcagttatcggacgcaaatggcaggaacacctctacgagatggactacctcaaggaaggcatcgggctgcgtgccatggcccagcgcgatcccctggtggagtatcagcgcgaaggtttcaccctgttccaaagcatgatggaagcaatccgggaggaaagcgtcgggttcctgttcaacctggaagtcgaagtgactccggcccaggatgtggtggtggaggacgccgccggcggacacaccgaacatgttgagccgcaggtccgggccgcgggtctggaagcccccgaaaagcctgcgcaactgcagtacaccgcaccgagcgagggcggtggcacccagacccgggtggaaacccgctccactggacgctcaggcaaccccgccaaggcggcagagcaggatgcggcaaaggacgccgccaagcgtccagccaaaaagaagcggcgctaa

SEQ ID NO: 1189 - DNA, 2958 bp, Brachybacterium faecium DSM 4810
gtggtcaacctcttcgacaagatcctgcgcgccggcgaaggccgggagctgcgcaggctcgaagccatcgcccgacgggtgggagaggcggagaacgtcttcacggagctcagcgatgaggagctgcgcgcggagacggaccacttcaaggagcggctcgcggagggcgagaccctcgacgacatcctcgtcgaggcgttcgcggcagtgcgcgaggccgcgcaccgcaccctcggccagcgcccctacgacgtgcagatcatgggcggcaccgccctgcaccgcggccgcatcgcggagatgaagaccggtgagggcaagacgctcgtcgccaccctgcccgcgtatctcaacgcgctgtcgggcaagggcgtgcacatcgtgaccgtcaacgactacctcgccggctaccagagcgatctgatggggcgcgtgttccgcttcctggggctgaccacgggcgtgatcaagtcgggcatgaccccggccgagcgccgcgagcagtacgccgcggacatcacctacggcaccaacaacgagttcggcttcgactacctgcgcgacaacatgtcgctcaagcccgaggacagggtccagcgcggccacgccttcgcgatcgtcgacgaggtcgactcgatcctcatcgacgaggcccgcaccccgctgatcatctccggccccggctccggggacgccaacaagtggttcagcgagttcgcgaaggtcgtcaagctcctgcgccgggaccgcgactacgaggtcgacgagaagaagcgcaccgtcggcgtgctcgagtccggcatcgacaaggtcgaggatcacctcggcatcgacaacctctacgaatcgctcaacaccccgctcatcggcttcctcaacaacgccatcaaggccaaggagctgttcaagcgggacaaggactacgtggtcctcaacggcgaggtgatgatcgtcgacgagcacaccggccgcatcctcgccgggcgccgctacaacgagggcatgcaccaggccatcgaggcgaaggagggggtgaagatcaaggcggagaaccagaccctcgccacgatcaccctccagaactacttcaagctctacgagaagctctccggcatgaccggcaccgccgagaccgaggccgccgagttcatgaacacctacgagctcggcgtggtgccgatccccacgcaccgcccgatgcagcgcgcggacgagcccgaccgcatctaccgcaccgagaaggcgaagttcgacgcggtcgtcgaggacatcgtcgggcggcacgagaagggccagccggtgctcgtgggcaccacgagcgtggagaagtccgagtacctgggcaagctgctgaccgcgcagggcgtgcagcacgaggtgctcaacgcgaagaaccatgccggggaggcggcgatcgtcgccatggccggtgcgaagggcgccgtcaccgtcgccacgaacatggccggccgaggcaccgacatcatgctcggcgggaacgtcgagttcatggcccatgccgagctcgagaagcggggcctggatccggaggaggacccggaagcgtacgaggccgcatgggacgaggagctcgcgcgggccaaggaggccgtggccgagcagcatgacgaggtggtcgaggtcggcgggctgtacgtcctgggcaccgagcggcacgaatcccgccgcatcgacaaccagctgcgcgggcgctccggccgccagggcgacccgggcgagtcccgcttctacctctcgctgcaggacgacctgatgcgcctgttcaactcgggcgcggcggagtcgctgctggcgcggggcggcgtggacgagtcgatccccctgaccggacgcatggtcaccggcgcgatccagcgagcgcagaactcgatcgagtcgcgcaacgcggagatccgcaagaacgtgctgaagtacgacgatgtgctgaccaagcagcgcaagaagttctacgaggagcgcgggcggatcctcgagggcgaggagctcgagccccatatcgagcgcttcatcgacgaggtcatcggcggcaccgtcgatgcccacacccgcggcaagcctgccgaggatgtcgatctcgaggagctgtggggcgcgctgcgcccggcctacccggtctccctcacggcgcaggagctcatcgaggaggtgggcggcaaggagaacctcgaggcgagcgtgctcaaggaggagatcctggccgatgcccgcgtcgcctacgagaagcgtcgcgaggagctcggcgaggaggggctgcagcagctgcagcgccgcgtgctgctgtctgtcctggaccgccgctggcgcgagcacctctacgagatggactatctcaaggagggcatcggtctgcgcgcgatggcgcagcgtgacccgctcatcgagtacgagcgcgagggccacctcatgttcaacgacatgatggccggggtgaaggaggacgtggtcggctacgtctaccacctcgaggtgcaggtcgagaaggccgagccggtggtgccgaaggcggtcagcgatctgctggcgggtgcgacgaaggccgcccggggcgcggcggcagctgccgctgcgagctccggcggggccgcgagcggcggtggcgccgagggcgcggctgccaggagcgccgagcccgctgagtccggtgccgccgagggcgaggacgccgacgagcccgtggacgagagcggcgtcgtgctgcgtgcgaagggcctggacgacggcccctcggagcggcagctgcggtacacctccgccgagggcaacgacgtccaggacgcctccacgctctcgcgtgcacagcgccgccagcaggcccgccagcagcggggcgcggccggggccgccgcccgcggcacggtccaggacaagccggagggggccccgcagggggctgggcagaaccgtgcccagcgcagggcgaagcgccgccggcgctga

SEQ ID NO: 1190 - DNA, 2736 bp, Micrococcus luteus NCTC 2665
gtgccttcgatcatcgaccgcgtcctgaagatctcggacaaccgcgtcctcaagcgcatgcaggccacggtggacgccgtgaacctcctcgaggacgacttccgggcgctcagcgacgcggagctgcgtgccgagacggacacgctccgggccaggcatgcggacggcgagtcgttggacctgctcctgccggaggccttcgccgcggtccgcgaggccgcgggacgcacgctcggccagcggcactacgacgtccagctgctcggcggcatcgcgctgcaccagggcaacatcgcggagatgaagaccggcgagggcaagaccctcgtggccaccgccccggcctacctcaacgcgctgtccggcaggggcgtgcacgtggtgacggtcaacgacttcctcgcctcctaccaggccgacctcatgggccgcgtgttccgcttcctcggcatgcagacgggcgtcatcgtggcgggccagaccccggccgtacggcgcgagcagtacgccgcggacatcacctacggcacgaacaacgagttcggcttcgacttcctccgggacaacatggcctggtccctcgacgagctcgtgcagcgtgagcaccactacgcgatcgtcgacgaggtggactcgatcctcatcgacgaggcccgcaccccgctgatcatctccggccccgcccagggagaggccaaccggtggtacggcgagttcgcccgactggtgcgccgactcgaggcggacacggactacgaggtggaccacaagaagcgcaccgtcggcatcctcggccccggcatcgagaaggtcgaggaccacctcggcatcacgaacctgtacgagacgcagaacaccacgctcatccagttcctgaacaacgcggtcaaggccaaggagctgttcaagcgggacaaggactacgtggtcctcgacggcgaggtgcagatcgtcgacgagcacacgggccgcgtcctcaagggacgccgctacaacgaggggctccaccaggccatcgaggccaaggagggcgtcgaggtcaagcccgagaaccagacgctggccacggtgaccctgcagaactacttccgcggctacgagaagctcgccggcatgacgggcaccgccgagacggaggccgccgagttcacgtcgacctacggcctcggcgtcgtcgtgatcccgccgaaccgggagcggcagcgcgtggaccgcaacgacgtggtgtacaagaacgagaaggtcaagttcgacgccgtcgtcgacgacatcgccgagcggcacgcgaagggccagccggtcctggtgggcaccacctccgtggagaagtccgagtacctctccacgctgctggccaagcgcggcatccgccacgaggtcctgaacgcgaagaaccacgcccgcgaggccgccatcgtggcgcaggcgggccgcccgggcgccgtcaccgtggccaccaacatggccggccgcggcaccgacatcatgctcggcggcaacgccgagttcacggcggtggcccgcatgcaggaactgggcctcgacgccgccgaggacccggaggcgtacgaggcccgctggcccgaggtgctggcgcaggccgaagccgctgtggaggacgcgcaccgcgaggtcatcgaggccggcggcctgtacgtggtgggcaccgagcgccacgactcgcgccgcatcgacaaccagctgcgcggtcgttccggccgtcagggcgacccgggcgagtcccgcttctacctctccctcacggacgagctcatgcgcaacttcaacccgggcgtggcccagcggatcatgaacagtccgtcgatcccggacgacatggcgctcgagttcggcttcgtctcgaaggcgatccagaacgcgcaggcgcaggtcgaggggcgcaacgccgagcagcgcaagaacgtgctcaagtacgacgacgtgatgaaccgccagcgcgaggccatctacacggaccgccggtcgatcctcgagggggaggacctgcaggaccgggtgcgccgcttcgtggaggacgccgtcgggaacatcgtggacgcggccaccgaggagggccaggccaccgactgggacctcgaccagctgtggcgggacctggcagagctctaccccgtgggcatctcgcaggaggacgtcctcgacgaggtcggcggccgtggccggctcaaggccgaggtcctcaaacgcgaactcgtctccgatgcgctcctggcgtacgaggaccgggaggcgcaggtgggatccgaggcgctgcgggaggcggagcgtcgcgtggtgctcgccagcatcgggcgccactggcaggagcatctctacgagatggactacctcaaggagggcatcgggctgcgcgcgatggcccagcgcgagcccctcgtggagtaccagcgcgagggctacacgatgttccagaacatgctcgccggcatccgcgaggacgccgtgcgcacgctgttccaggcgcagatcagtgcggcccccgcgccgacgtcgctgcccggcgtcaaggatgcccgcgccgtgacgatggccccgcagatctcggtggagggcatcgacgccccgcagcgcccggcgcagctgcgtttcaccggtccgtccgaggacgggcagagcgcggtcacccgcagcggcacggactccggcgccacggtcgccgcgggcacgaaccgccgctcccgccgtcaggcggagcgccgcggccgccgcggctga

SEQ ID NO: 1191 - DNA, 2706 bp, Kytococcus sedentarius DSM 20547
gtgcccaagatcatcgaccgagtcctgcgcgccggcgagggccgcgtgctgaagcggttgcaggggatcgctgatgcggtcaacgcgcaggaggcgggcatccaggggctcaccgacgccgagctgctggagcagaccgaccgtttccgggcccgcctggccgacggcgagacgttggacgacctgctgcccgaggccttcgccaccgtccgtgaggccgcggtgcgcaccctcggcaagcggcacttcgacgtgcagatcatgggtggggctgcgctgcaccacgggtcggtggccgagatgaagaccggtgagggcaagacgctggtggccacgctgccgagctacctcaacgcgctcaccggcaagggcgtccacgtcgtgaccgtcaacgactacctggccgagtaccaggccgagctcatggggcgtgtccaccgcttcctggggttggagaccggtgtgatcctgtccaagctctccccggcccagcgccgcgaggagtaccgcaaggacatcacctacggcacgaacaacgagttcggcttcgactacctacgcgacaacatggcctggtccaccagcgacctggtgcagcgcgagcaccactacgccatcgtcgacgaggtggactcgatcctcatcgacgaggcccgtacgccgctgatcatctccggcccgggcgaccaggcgacgagctggtacaccaccttcgccacgctggccggcatgctggagaagggcacggcggccgacaagctcaagggcatcgaggccaccggcgactacgaggtggacatcaagaagcgcaccgtcggcgtgctggagtccggcatcgagaaggtggaggactacctcggggtccacaacctctacgaggcgcgcaacaccccgctgatcggttacctgaacaacgccatcaaggccaaggagctgttcaccaaggacaaggactacgtcgtcatggacggtgaggtccacatcgtcgacgagcacaccgggcgcctgctcaagggccgccgttacaacgacggcatccaccaggccatcgaggccaaggagcaggtggagatcaagcaggagaaccagaccctggccacggtcaccctgcagaactacttccgcatgtacgacaagctcgccggcatgaccggtaccgcccagaccgaggcggccgagctgcactcgatctacaagctggacgtggtgccgatccccaccaaccgcccgatgcagcggcaggaccaggcggatttggtcttcgccaaggccaagggcaagttcgacgcggtggttgaggacatcgtcgagcgccaccgcaggggccagccggtgctggtgggcaccaccagcgtgagcaagtccgagtacctctccgagcagctcacggcgcgcggtgtgcagcacgaggtgctgaacgccaagtaccacgagcaggaggccgcgatcgtggccgaggccgggcgcaagggcgcggtcacggtggccaccaacatggccggtcgaggcaccgacatcatgctgggcggcagcccggagttcatggccgtcgcgtcgctgaagaagcgtgggctggaccccgacgagcagcccgaggcctacgaggcggcctgggacgaggcgctggcgcgggccgagaaggccgtgcagaccgagcaccaggaggtgctggaactgggcggcctgtacgtgctgggtaccgagcgccacgactcgcgccgcatcgacaaccagctgcggggccgttcgggacgccagggtgaccccggcgagagccgcttctacctctcgctcgaggacgacctgatggtccggttcaactcggggctgatgcagcgtgcgatggcgggcgccgacccggacacgccgctggagttcggcatgctcaccaaggcgatcgaacgcgcgcagacgcaggtggagagccagaacttcgagtcgcgcaagaatgtgctcaagtacgacgacgtgctcaaccgccagcgcgaggtcatctacgccgagcgcaagcgtgtgctggagggggcggacctggagagtcaggtgcgtcacttcatcaacgacgtgatcatcggctacgtgcagggtgcgaccgtccacggctacgccgaggactgggactttgacgagctctggggtgcgctggaggagctctacccggtctcgctcacggtggacgacatcgtcgaggccgccggcggcatcggtggcgtggacgcgggcctgctcatcgacgagctgacctcggacgcccagcacgcctacgacgcgcgcgagcaggcgatgggggagaccgtcatgcgccagctggagcgccgcgtggtgctcggcgtgctggaccgcaagtggcgcgagcacctctacgagatggactacctcaaggagggcatcggcctgcgctcgatggcgcagcgcgaccccctggtggagtaccagcgtgagggctaccagatgttcggcgtcatggccgactccatcaaggaagaggccgtgatgggtctgttcagcgtggagcccagcgcccagggcgtgcaggccgtcgccgcgggcgagcagcgccgcaagcacggcggggccgtggacgcgaacgaggaccaggccagttggcagtacaccgcgcccacggccgagggcggcgtggagcgacgcaacgccaccggccagagcggcaaccgcgcccagcgccgggcggcgcagcggggctga

SEQ ID NO: 1192 - DNA, 2787 bp, Catenulispora acidiphila DSM 44928
gtggcgcgtctgatggacaaggtcttgcgggccggcgaggggaagatcctgcgccggcttgaggccgtcgccgatctcgtcgaggagatcgaggacgactacgtccagatgagcgacgccgagctgcgcgctcagaccgatgagttccgggcccgcctggaagacggcgagacgctggacgacctgatgccggaggccttcgcggtcgtccgcgaggcggccaagcgcacgctgggccagcggcactacaaggtgcagatgatgggcggcgccgccctgcacctgggcaacatcgccgagatgcgcaccggcgagggcaagaccctggtgggcaccctgccggcgtacctcaacgcgctggccggcaagggcgtgcacatcgtcaccaccaacgactacctggccgagcgcgactcctcctggatgggccgagtgcaccggttcctggggctgaaggtcggcgtgatcctggcgaacatgacgccggccgagcgccgcgagcagtacgagtgcgacatcacctacggcaccaacaacgagttcggcttcgactacctgcgcgacaacatggcgtggtcccgcgaggagatggtgcagcgcggccacttcttcgcctgtgtcgacgaggtcgactcgatcctcatcgacgaggcgcggaccccgctgatcatctccggtccggcggaccaggccaccaagtggtacaccgacttctccaagatcgtcgaccggctggcgcccgacgtggactacgaggtcgacgagaagaagcgcaccgtcggcatcctggagcgcggcgtggagcgggtcgaggacctgctcggcatcgacaacctctacgagtccgtgaacacccccctggtcggctacctgaacaacgccatcaaggccaaggagctgttcaagaaggacaaggactacgtcgtgatgaacggcgaggtcatgatcgtcgacgagcacaccggccgcatcctggccggccgccgctacaacgagggcatgcaccaggccatcgaggccaaggagaacgtcgagatcaaggacgagaaccagacgctcgccacgatcaccttgcagaactacttccgcctctacgacaagctggccggcatgaccggtacggccatgaccgaggccgcggagttccagcagatctacaagctcggcgtggtcccgatcccgacgaaccggccgctgatccgcatggaccagcaggacctgatctacgtcagcgaggaggcgaagttcgaggcggtcgtggaggacatcgccgagcgcagcgccctgggccagccgatcctggtcggcaccacctcggtggagaagtccgagcggctctcccagatgctgcgcaagcgcggcgtcccgcacgaggtcctgaacgccaagtaccacgagcgcgaggccgcgatcgtggcccaggccgggcgcaagggcgcggtcacggtggccaccaacatggccggccgcggtaccgacatccagctcggcggcaaccccgacgacctggccaacggcgagctgcagcagcgcggtctggacccggagggcactccggacgagtgggtggcagcgctgcccgacgccctggagaaggccaagcgcaaggtgaaggccgagcacgacgaggtccaggaactcggcggcctgtacgtgctgggcaccgagcgccacgagtcccgccgtatcgacaaccagctgcgcggtcgcgccggccgccagggcgaccccggcgagacccggttctacctctcgctgggcgatgacctgatgcgcatgttcaaggccggcatggtcgagcgcgtgctggccatggcgaacgtccccaaggacgtcccgatcgagcacaagatggtcacccgtgccatcgccagcgcgcagacccagatcgagcagcagaacttcgagatccgcaagaacgtcctgaagtacgacgaggtcctcaaccgccagcgcctggtggtctacgaagagcgccgcaaggtgctcgacggcgcggacctggaggatcaggtccggctgatgatggacgacaccatcgccggctacgtcgacgccgccacggccgagggctacgccgaggagtgggacctggacaagctctggaccgccctggagacgctctacccgatctcggtgacggtcgaggagatcgaggaggccgccggcggcgccgacaaggtcacccgcgacgtcctggccgacgagctgatcgccgacatccgcagcggctacgacgcccgcgaggagcagctcggcgagcagatcacccgcgagctcgagcgccgcgtcgtcctgtcggtcctggaccgcaagtggcgcgagcacctctacgagatggactacctccaggaaggcatcggcctgcgagccatggcccagcgcgaccccctggtcgagtaccagcgcgagggctacgcgatgttccaggcgatgatggacgccatcaaggaggagtccgtcggctacctgttcaacctcaaggtcgaggtcgaagcagtgaaccaggacccccaggcccaagcccaggccgccgccaccgccaacgccctggccggccagaacggcgtccaggacgccgtcccccagctccacgccaagggcctggacaccccccgccgcccggaccacctgaactacaccgccccgaccgtcgacggcgaaggcggcgtcctccagcgcgaggtctccttcgccgcggagtacgccgacaaggacgccgcacccgaaccggccgaggacgacactccccgccgccgctcctcgggcaagcgcaagaagcgctga

SEQ ID NO: 1193 - DNA, 2868 bp, Saccharomonospora viridis DSM 43017
atgcttctgaaccgcctgctccgcgcgggcgagggtaagatggtgaagcggctacgccgcatcgccgatcacgtcaacaccctcgaagacgacgtcaaggacctctcggacgccgagctgcaggcgaagaccgatgagttccgcaagcgttactccgacggcgagtccctcgacgacctactgccggaggcattcgccgtggtgcgggagtccgccaggcgcgtgctggggcagaggcactacgacgtccagctcatgggcggtgccgcgctgcacctggggcaggtcgcggagatgaagaccggtgaggggaagacgctcaccagcctcctgcccgtgtatctgaacgcgttgccgggcaagggtgtccacgtcgtcaccaccaacgactacctcgcacagcgtgactccgagtggatgggtcgtgtccaccggttcctcggcctggaggtcggggtcatccggtcggatctgacgcccgccgagcgtaaggccgcctacgccgccgacatcacgtacggcacgaacaacgagttcggcttcgactatctgcgggacaacatggcgtggagcctggacgactgcgtccagcgcgggcactactacgcgatcgtcgacgaggtcgactcgatcctcatcgacgaggcccggacaccgctgatcatctcgggtccggccgaccagtcgtcccgctggtacgtcgagttcgcgcggatggcgccgttgatgaagcgggacgtccactacgaggtggacgagcgcaagcgcgctatcggtgtcaccgaactgggggtcgagttcgtcgaggaccagctcgggatcgacaacctctacgacgcggcgaacaccccgttggtcgggttcctcaacaacgccttgaaggcgaaggagctctaccaccgggacaaggagtacatcgtccgcaacggcgaagtgttgattgtggacgagttcaccggccgggtcctgccgggtcgccggttcaacgagggcatgcaccaggcgatcgaggccaaggaaggcgtggagatcaaggccgagaaccagactctggccacgatcaccctgcagaactacttccgcctctacgagaagctcgcgggcatgacgggtaccgccgagacggaggcggccgagttccaccagacctacaagctcggtgtcgtcccgatcccgacgaaccggccgatgatccgtgtcgaccagcccgacctcatctacaagacggaagaggcgaagttcgaggcggtcgccgacgacatcgcggagcgtcacgagaagggccagccggtgctggtcggtaccacgagcgtcgagaagtcggagtacctgtcgaagctgctcctcaaacggggagtgccgcatgaggtgctcaacgcgaagcatcaccaccgcgaggctctgatcgtcgcgaaggcggggcggaagggtgccgtcaccgtcgcgacgaacatggcaggccgtggtacggacatcgtgctcggtggtaacccggacatcctcgccgacgaggtgttgcgggagcgtggcctcgaccccgtggagaactccgaggagtacgaggccgagtggccgaaggtgctggaggaggtcaccgccgagtgcaaggcggaggccgaggaggtcgtcaaggcgggcggcctctacgtgttgggcaccgagcgccatgagtcccgccggatcgacaaccagctgcgcggccgtgccggacgtcagggtgacccgggtgagtcccgtttctacctgtcgttgggcgacgagctgatgcggcgcttcaacgcgggcatggtggagcgggtcatgaccaccatgcggctgcccgacgacgtgcccatcgagcacaagatggtctccagggcgatcaagagcgctcagacgcaggtcgagcagcagaacatggagatccgcaagaacgtcctgaagtacgacgaggtgatgaaccagcagcgcaaggtcatctacgccgagcgccggagggtgctggagggcgaggacctgcgcgagcagatgcggcacatgatcaccgacgtcatcaccgcgtacgtcaacggcgccaccgccgaggggtacgcggaggactgggatcacgccaagctgtggaccgcgttgaagacgctctacccggtgagcgtgacctgggaagagatcatcgaggagaacgaggacatcgacgccgagcggcttcgggagatcctcgtcgaggacgcgctcgcggcatacgacaggcgtgaggccgagatcgacgccaaggccggcgagggcgcgatgcgtgagctggagcgccgcgtcgtgctctcggtgctcgaccggaagtggcgtgagcacctctacgagatggattacctcaaggagggcatcgggctgcgggcgatggcccagcgcaatccgctcgtggagtaccagcgtgagggcttcgacatgttcaatgcgatgctcgactcgctgaaggaggaggccgtcggcctggtgttcaacctgcaggtgcagcaggccgagcagcagcaggccgaggaggcttcgaagacggagcaggcccgtaagccgcaggcccccgccgcgagcggtaacggcagggcttccggggcggccgccaagacgtcgaccccgcggcacgcgcgtccggtcccgccgcagccgaagatccctgggcagtccgtgcccgtcgcattgcaaggtcagaagctcgggggacagatcccgcaggggctgacgttctcgggcccgtccgagggcggcggcgtgcagtcccgcggtgacggtacgacctcggcgaagaagcaaggttcggctgccggtggtacacgtcgggaacggcgtgccgccgcccgcgaacaggcgaagaagaacaagcgcaacgcgcgccgttag

SEQ ID NO: 1194 - DNA, 2721 bp, Jonesia denitrificans DSM 20603
gtggtcaccatcctggagaaaatccttcgcttcggcgaagggaaaatcctcaagaaactgaacgtcatcgttcagcaggtcaacgccctcgaagagcactaccaggcgttcaccgacgaagaactccgcgaggagaccgcgcgattcaaagaagacatcgctgaaggtagttcactggacgcattgctcccgcaggcattcgcggtcgtgcgtgaagcatctgtgcgaacattgggccagcgtcactacgatgtgcaaatcatgggtggtgcagccctccacatggggaacatcgccgaaatgaagaccggtgaaggaaagaccctggtcgccaccctccctgcctacctcaacgccctgtcaggacaaggcgttcacattgtgaccgtgaacgactaccttgcgaaataccagtccgacatcatgggtcgtgtgttccggttccttgggctgaaaactggctgcatcgtttctggccaaaaccccactgagcggcgtgcccagtacgaagctgacatcacctacgggacaaacaacgagttcgggtttgactacctgcgtgacaacatggcgtggtccatgaaagatcttgtgcaacgtggccataacttcgccatcgttgacgaggttgactccattttgatcgacgaagcccgaaccccgctgatcatctccggtcccgccgatggtgatgtcaacaagtggtacacggagttcgcaaaagtctcacgccgcctgatcgcgggggaagattacgaagtcgacgaaaagaaacgcaccatcgggatcctggaacccggtattgaaaaggtcgaagactacctggggatcgacaacttgtatgagtccctgaacacgccactgatcgggttcctgaacaactcgatcaaagctaaagagctcttcaaacgtgacaaagactacgtggtcatgaacggtgaagtcatgatcgttgacgaacacacgggccgtattctggccggtcgccgttacaacgaaggcatgcaccaggcgatcgaagccaaagagggcgtcacgatcaaagccgagaaccagaccctggcaacaatcacgttgcagaactacttccgcctctattccacgctgtcagggatgaccggtaccgcggaaacggaagcagccgagttccactccacctactcactaggtgttgtaccgattccgacgcaccgtccggtgcaacgtgttgaccagtcggacctcatttacaagacagaaactggcaagttccaggcggttgttcaagacattgttgagcggcacgctcacgggcaacccattttggtgggaacgacgtctgtggagaaatcagagctgctctcctctctgttgaaaaaacaaggtgtccctcacgaggtgctcaacgcgaagcagcacgcccgagaagcggccattgttgcgatggctgggcgcaaaggtgcggtcacggtagccaccaatatggctggtcgtggaactgacatcatgctcggtggaaacgccgaattcatggcccatgccgaactagaacaacgcgggcttgacgcagtagaacacccagacgaatacgaagcagcgtgggatgaagcacttgctgctgctcaacaagctgtcaaagacgaacacgacgaagtcgtggaactcgggggcttgtacgttctgggcaccgaacgccacgaatcacggcgtattgacaaccagttgcgtggacgttccgggcgccaaggtgaccccggtgagtcacggttctacttgtccatggaagacgaactgatgcggttgttcggttcaggtcttgctgaatccatgatgaaccgtgccgggttcccagaagacgtgccactggaatcgaagatggtgtcgcgtggtatcgcctcagctcaggggcaagtggagtcaaggaacctggagatccgcaagaacgtcctcaagtacgatgacgtgctctcccgccagcgcacagtcatttatgacgaacgtcgccgtgtccttgagggcgaggacatgcaggaacaaatccagcacttcctcaccgatgtcatcactgggcatgttgagatgacaaccacgtccaatgaccaaaacgaatgggacttggaagcgctgtgggcaaccctgaaagggatctacccaatctcgatcaccgtggaggaagtggaagagcaagcaggtggccgcacccacctgaaacgcgatgaactgctggaagaaatcctctctgacgcccgcttggcatatgagcaacgcgaagccgaactcggctcggagaatctccgagacttggaacgccgaatcgtgttgtccgttgtagaccgtaagtggcgcgaacatctctacgagatggactacctcaaggaaggcatcgggttgcgtgctatggcgcaacgtgacccccttgtggagtaccagcgtgaaggttatgacatgttcaccgcaatgctggaaggcgtgaaagaagaggccgttggcttcttgtacaacctccaggtcactgtggaaaagaaggaagttgacctcgacggtgacggcactcccgacatcgaagaagacgtgatggtggcgaaagggcttgatcagcccaagcggcccacccagcttcagtacacgtcgtcggaagggtcaacctccgagtcgggttcgggaacctcaggcggagcagcgaacgctggttcgaaccgcgcagagcgccgagcagcgcaaaagcgttcgcggaaacggtga

SEQ ID NO: 1195 - DNA, 2256 bp, Rhodoferax ferrireducens T118
atgaaaaccctgtccgccgagccaacgggcgcggcatctttggcgcagcccttgccgcagttgctgaccgccacggcgcagactttgccggagcagtcccatgcgctggcgcgtgctcgcgcgtttgccgagccgctgctggccagcgagacgctcgacaccggcgagaacacgctggcccatgccgacgcggtcgcggccattctcaggattattggcggttccgaggcgatgcaggccgccagttacctggtttatgcctgcgaccacttgaacaaaccccaagaggtgatcgccaaggcgtttggtgacaactttgccgcgctggcggtagaaaccaccaagctggtgcgggtgcaacgccaggcgcgccaggcgcaagtggccagcgagcgcgccgccacgggcatcccgatggcgcaaacagcggccgcccaaaccgagaatgtgcgcaagatgctgctcgccttttcacgcgacttgcgcgtggtgatgctgcggctggcctcgcgcctgcagactttgcgcttttttgccgctgcccgccaggccgcgccgcccggtgtggcgcgcgaggccttgcaggtgtttgcgccgctggccaaccggctgggcatatgggaaatcaagtgggagatggaagacctggcgtttcgtttcctggagcctgatgtctaccgccaagtggcgcgtctgctcgatgaaaagcgctccgagcgcgagttgcacgttgagcaattgcggcaacaactggagtcggacctgaaggcgcagggcatgagcgtcacggtgcaggggcgacccaaacacatctttagcatcgtcaagaagatgcgcggcaaatcgcttgcatttgaccaggtccatgacattcgggcgctgcgcattgtggttgcagacattgcggactgctacgccgccttgagctgggtacacagccagttcacaccgatcgccgaagaatttgacgactacattgccaaacccaaggccaacggctaccagtccttgcacacagtggtgcgcgatgcggcggggctgccgatcgagatccagattcgcacccaggccatgcacgaccatgccgagcacggcgtggcggcgcattgggcctacaaggaggcaggtgtcaaaggctacgctggcgtctcggccaccagttcctacgacgccaagattgccgtgctgcgccagttgctggcgtgggagcgtgatctgtcgggcacttcggcgcaggatgtcggcctggatgaccgtatttatgtcttgacgcccgaggcggccattgtggagctgccgcaaggcgccaccgccgtcgactttgcctacagcgtgcacaccgatctggggcaccgctgccgcggagcccgaattgatggcgtgatggtgcctttgaacacgccgctaaaaaatggccagacagtggaagtgacggtggccaaggagggcgggccgtcgcgcgactggctgatggcagaacaaggctacctggtgagccaccgggcccgttccaaagtgcgcgcctggttcaacgcccaggccctgcatgaaacggttgccaaaggccgcgaggcggtggagaaactgctgcagcgcgagggtaagacagcgctcaaattgcaggacctggccgcgcaactggggtttaactcggccgacgatctgtttgaagtggtgggcaaggacgagttctcgctgcgtaatatcgagaccctgctgcacccgcccgagccggtgcaggccgacgatgggccgctgctgaagaagccgcgcagcgccagcaacccggccaagggtggcttgttggtggtgggtgttgattcattgatgacgcagttggccaagtgctgcaaaccggccccgcctgacccgatttgtggctttgtcacccgcggcaaaggggtcagcgtgcaccgtgccgattgctccaacctgcgcgagatgattgcccaaaatggcgagcgtgtgatcgaggtggaatggggccagcccccaggcagtgcgaatggatcggcgggcagcgcggtgtacccggtggacgtggcggtgcacgccatggacaggcagggcttgctgcacgacatttccgaggttttcaccaaggaaaagatgaacgtgatcggtgtgcagacgcagtccgtcaagggcatcgccttgatgactttcacggttgaagtgtcggatgccggacggctgcacaaggtgctgggtgtggtagcggagttgccgggcgtgcgctcggcgcggcggcgttga

SEQ ID NO: 1196 - DNA, 2253 bp, Polaromonas JS666
atgaaaagcaatgtgcttgggccggatggcccaacagctccccagaggccgaacgcctccatcgtcacggccacggccgacagcccgcctgaccagccgaatgcgctggcgcgcgcgcgtgcttttgccgagccactgattgccggcgaaacgttggataccggtgaaaacatcctggcgcatgccgatgccgtggcggccatcctcaaaggcatcggcggttcggaggccatgcaggcggccacctacctggtgcatgcgtgccagcatctgaccaagccgcaggaagtgattgccaaggctttcggagccaattacgctgcgctggcgatagaaacgaccaagctcgttcatgtgcagcggcaggcccgaacggcggacgccaaggcgcaactgctggacgatccggcggcccagaccgagaacgtgcgcaagatgctgctggcgttttcgcgcgacttgcgggtagtcatgctgcggctggcttcgcgcctgcagaccttgcgctattacgcggcaacccggcagtcggctccgctcgccctggcccatgagtcactgcatgtgttcgcgcccttggcgaaccgcctgggcatctggcagatcaaatgggaaatggaagacctggccttccgcttcctggagcctgacacctacaagcacacggcgcgcctgctggacgagaagcgtgtcgagcgcgaaggcttcatggagtccctgcgtgcgcagcttgaacgcgaactgaaccagaacggcattgccgcactggtgcaggggcggcccaagcacatctatagcattgtcaagaagatgcgcggcaagtcgctcggtttcgatcaggtgtttgacatccgcgccctgcgcgtgatcgcggccgacatcaatggctgctatgcagcgctggggtttgtgcattcgcgcttcacgcctgtcgcgggcgaatttgacgactacatcgccaagccaaaatccaatgggtaccagtccctgcacaccgtggtgcgggacgccgccggccgggccgtcgaaatccagatacgcacccaggccatgcatgaccatgccgagcatggcgtggccgcgcactgggcgtacaaggaggccggcaccaagggctacagcggcgtctcggccagcagcgagtacgacgccaagatcgccgtgctgcggcagctgttggcctgggagcgcgacctgtccggcccggcggccaagcagggcctgttcgaggaccgcatctacgtgctcacacccgacgccgccattgtggagttgcctcagggcgccacggcggtggactttgcctacagcgtgcacaccagcctggggcaccgctgccgcggcgcgcgcatcgatggtgccatggtgccgctcaacacaccgctgcaaaacggccagacggtggaggtggtcaccgccaaggaaggcggcccctcgcgcgactggctcaattccgaactgggttttttggccagccaccgggccaaatcgaaagtgcgcgcatggttcaatgcgctggcgatggagcaaaccgttgccaaaggccgggaggcggttgaaaagctgctccagcgcgagggcaagaccgccatgaagctggacgaccttgcgctgcaactggggttcaagaccgcggacgatttgtttgaggtggttggcaaggacgagctgtcgttgcgcaccatagaaaacatgctcaggccgccggagccggtgctgtcgcaggatgactacgtgctggccaaaaaagcgcgtcagcccgacaagtccagccagtcaggcaagggcggcaagggcagtgtgcttgtggtcggtattgattcgctgctgacccagctggccaagtgctgcaagcctgcaccaccggacgagattttggggttcgtcaccaagggtaaaggcgtgagcatccaccgaagtgactgcagcaactttcgcaacatggcgagtggaagtcctgatcgcgtgatcgaagtgcagtggagctcgtcgaaaaccgcggatggctcggtttatccggtagatgtggccgtcgaggctgccgaccggcaagggctgctgcgcgatatttccgaggtcttcgccaaggaaaaaatgaatgtgatcggcgtgcagactcaatcggtcaaggacaaccgcggcggcacggcctggatgacattcactgtggaagtggcgcagtcgggccgcctcaaccaggtgctaggcctcgtggccgacgtgccgggcgtgcgttctgctcgcaggcgctga

SEQ ID NO: 1197 - DNA, 2262 bp, Acidovorax avenae citrulli AAC00-1
atgagaagcatcgccgcgccccagccaccgcacgccgccgccggccaggaggccgtgccccagctcatcgcagccacctccctcgcgttgcccgagcaggccggcgccctggcgcgcgcccgggcgttcgccgaaccgctgctctccggcgagacgctggagaccggcgagaacaccttcgcccatgccgaggccgtcgccgccatcctgaagaccatcggcggctcggaggccatgcaggccgccagctacctcgtgcatgcctgctcgcacctgaacaagcccgaagaggtcatcgccaaggccttcggccagaacttcgccacgctcgccgtcgaaaccaccaagctcatgcgcgtgcagcaccatgcgcgcgaggcacagctcgccggccatgcggtggacgacccggccacccacaccgagaacgtgcgcaagatgctgctggccttctcgcgcgacctgcgcgtggtcatgctgcgcctggcgtcgcgcctgcagacgctgcgcttctacgcggccagcaagcggcccgtctcgccctccatcgcccgcgaggcgctgcaggtgttcgcgccgctcgccaaccgcctcggcatctggcagatgaagtgggagctggaagacctgtccttccgcttcctggagcccgacacctacaagcagatcgcccgcctgctcgacgagaagcgcgccgagcgcgaggtgtacatggagcagctgcgcggccggctcgaatccgaactgcgcgcgcgcagcatcagcgccaccgtgcaggggcggcccaagcacatctacagcatcgtcaagaagatgcgcggcaagtcgctcgacttcgaccaggtgttcgacatccgcgcgctgcgtgtggtcgttcccacggtgaaggactgctatgccgcgctgtcatgggtgcattcgcacttcaagcccatcgacgccgagttcgacgactacatcgccaaacccaagcccaacggctaccagtcgctgcacaccgtggtgcgcgacgaggcgggcaaggccatcgagatccagatccgcacccaggccatgcacgaccatgccgagcacggcgtggcggcgcactgggcgtacaaggaagccggcgccaagggctatgcgggagtttctgccagcagcgagtacgacgccaagatcgccgtgctgcggcagctgctggcctgggagcgcgacatggccggcgcggtgcagcaccgcggcctgttcgaggaccgcatctacgtgctgacgcccaatgccgaggtggtggaactgccccagggcgccaccccggtggacttcgcctacgccgtgcacaccagcgtggggcaccgctgccggggtgcgcgcgtggacggcgccatggttccgctcaacacgccgctgcacaacggccagacggtggagatcaccacggtgaaggagggccggccctcgcgcgactggctcaatcccgaactgggctatctcaccagccaccgcgcccgcgccaaggtgcgcgcctggttcaacgcccaggccacgcacgagaccgtggcgcgcggccgcgaggccgtcgaaaagctgctgcagcgcgaaggcaagaccgccatccggctggaagacctggccgtgcaactgggcttcaagaccgccgatgcgctcttcgaagtggtgggcaaggacgaattctccctgcgcaccatcgagaccctgctgcgcccgcccgagcccgtgctgcagcccgacgactacctgctgctcaagaaggcgcgcacgaacgagagcgctcccaagggcggcgtgctggtggtgggcatcgactccctcatgacccagctggccaagtgctgccgccccgcgccgccggacccgatccgcggcttcgtcacgcgcggcaagggcgtgagcgtgcaccgcgcggactgcagcaacttccgcgagatggccgcccgcagcgccgagcgcgtgatcgacgtcgaatggggcagcgcgggtggatccggtggcggagcgcagggaggcgggcagggcggccacccagccctcctctaccccgtggacgtggccgtcgaggccgccgaccgccagggcctgctgcgcgacatctccgaagtcttcgcgcgcgagaagaccaacgtcatcggcgtgcagacgcagtcggtgaagggcacggcgtggatgacgttcaccgtggaggtgtcggactccggacgcctgaacaaggtgctgtcgatcgtcgccgcggtgcagggcgtgcgctccgcgcggcggcgctga

SEQ ID NO: 1198 - DNA, 2244 bp, Acidovorax sp. JS42
atgaagagcagttccatcggccatctgcccatggggcagggcgcggccgccgggccccgacccgaggcggtgccgcagctcatcgcagccaccgcgcaggcgggaccggagcatgccgacgcactggtacgcgcccgcgcctttgccgagccgctcttgatcggcgaaacgttggaaaccggagagaacaccctcgtccatgccgatgcggtgtccgccatcctcaagcacctgggcggctcggaaaccatgcaggcggcggcctatctggtgtatgcctgctcgcacctgaacaagcccgaggaagtgatcaccaaggccttcggcagcaatttcgccgcgctggcgctggagaccaccaagctcatgcgcgtgcaactgcaggcgcgcgaggcgcaggtgatgggccagcaggtggacgatgcggccacgcagaccgagaacgtgcgcaagatgctgctggccttctcgcgcgacctgcgcgtggtgatgctgcgcctggcgtcccgcctgcagacgctgcgcttttacgccgcagccaagcgcccggtatcgccggccatcgcgcgcgaggcgctgcaggtgttcgcgccgctggccaaccgcctgggcatctggcagatgaagtgggagctggaagatctggccttccgcttcctggagcccgagacctacaaggaagtggcccgcctgctcgacgagaagcgcgtggagcgcgagctgtacatggagcaggtgcgcagccggctggagtccgaattgcgcgcgcgcagcatcagcgccagcgtgcagggccggcccaagcacatctacagcatcgtcaagaagatgcgtggcaagtcgctgaacttcgaccaggtgttcgacatccgtgcgctgcgtgtagtggtgccgagcgtcaaagactgctatgccgctttgagctgggtgcacagccagttcaagcccatcgaggcggagttcgacgactacatcgcccgccccaagcccaatggctaccagtcgctgcacaccgtggtgcgcgacgaggcgggcaaggccatcgagatccagatccgcacccaggccatgcacgaccatgccgagcatggcgtggccgcgcactgggcctacaaggaggcgggcaccaagggctacgctggcgtgtcggccagcagcgagtacgacgccaagatcgccgtactgcgccagctgctggcgtgggagcgcgacctggtgggctccgccagccgcagcgggttgttcgaagaccgcatctatgtgctgaccccggacgcggccgtggtggaactaccccagggcgccacgcccgtggacttcgcctatgccgtgcacaccagcgtcggccaccgctgccggggtgcgcgtgtcgacggcaacatggtgccgctgaacacgccgctgcaaaacggccagacggtggagatcaccaccgtgaaggaagggcgtccttcgcgcgactggctcaacccggaactgggctacctcaccagcaaccgcgcgaaggccaaggtgcgcgcgtggttcaacgcacaggccacccatgccacggtggcgcgcggccgcgagctggtggaaaagctgctgcagcgcgagggcaagacggccctcaagcttgacgacctggcggtgcagctgggcttcaagtcggccgaggccttgttcgaagtggtgggcaaggacgaattctcgctgcgcagcatcgagaccctgttgcgcccacccgagccggcggtcgatgagcctgacgtgctgctcaagaaggcgcgcacacccgacggtgcgcccaagggcggcgtgctggtggtgggcgtggattccctcatgacgcagttggccaagtgctgcaagcccgcgccgcccgatgagatccgtggtttcgtcacgcgcggcaagggcgtgagcgtgcaccgcgccgactgcagcaacttccgcgagatggcggcgcgcaatgcggagcgcgtgatcgacgtggagtggggaaagtcgcagcgcgccgccggagaagccgccgtctaccccgtggacgtggcggtggaagcctcggaccgccagggcctgctgcgcgacatctcggaagtgttcgcgcgcgagaagaccaacgtcatcggcgtgcagacacagtccgtcaagggaacggcatggatgaccttcaccgtggaagtgtccgatgcggggcggctcaacaaggtgctgggtatcgtggccgcggtgcagggggtgcggtcggcgcgccggcgatga

SEQ ID NO: 1199 - DNA, 2271 bp, Polaromonas naphthalenivorans CJ2
atgaaacataaagtggcggcaacgcacgcccccgcaatttccccggactcgctcagttccatcgtcgcggccacggccgacagcctgcacgggcagccgcatgtcctggtgcgtgcccgcgctttcgccgagccgctgattgccagcgaagtgatggacaccggcgaaaacatcctggcgcatgccgatgcggtggtcggtattcttaaaaccattggcggctccgaagcggtgcaggcggccacttacctggtgcattcctgccagcacctcaacaagccgcaggatgtcatcgccaaggctttcggccccagctatgccgctttggcggtggaaaccaccaagctgatctatctgcagcgacagacgcgcgccgtcgatgccaagtcgcagctgcacgatgaccctgccgcccagacggagaacgtgcgcaggatgctgctggcgttctcgcgcgacttgcgggtggtcatgctgcgcctggcttcgcgcctgcagaccttgcgctattacgcggccagccgacaggctgcgcccagggccttggcgcatgagtcgctgcatgtgtttgcgccactggccaaccgcctgggcatctggcagatcaagtgggagatggaagacctggcgtttcgttttctggagcctgacacctacaagcagatcgcccggctgctcgatgaaaaacgtgccgagcgcgaggtcttcatggaggccctgcgcgcgcagcttgaacgcgatttgaaccagaacggcattgccgcgctggtgcagggccggcccaagcacatctacagcattgtcaagaaaatgcgcggcaagtcgctgggctttgaccaggtgttcgacatccgggcgctgcgcgtgattgccgccgatgtgaagggctgctatgccgcgctggggtttgtgcattcgtgcttttcacccgtcaacggcgagtttgacgactacatcgccaagcccaagcccaacggctaccagtcgctgcacacggtcgttcgtgatgagggcgggcgggccatggaaatccagatacgcacccaggccatgcacgaccatgccgaaaacggcgtggcggcgcactgggcttacaaggaagccggaaccaaaggctacgccggcgtttcggccagcagcgaatacgacgccaagattgcggtgctgcggcaactgctggcctgggagcgggaactttcgggtccggctgcgcagcgtgcgcgggatgccaatcagggcctgttcgaggaccgcatctatgtgctgacgccggacgcagccatcgtcgaattgccccagggcgccacgacggttgactttgcctacagcgtgcataccagcttgggccatcgctgccgcggcgcgcgcattgacggcgtcatggtgccgctcaatacaccgctgcaaaacggccagacggttgaagtcatcacgaccaaggaaggcgggccttcgcgtgactggctcaacccggagttgggtttcctgtcgagcaaccgggcgaaatcgaaggtgcgcgcctggttcaatgcgctggccatggagcagaccgtggccaagggccgggaggcggttgaaaaactgctccagcgcgaaggcaaaacggccatgaagctgcaggatctggcgtttctgctgggcttcaagacggcggatgaactttttgaggtcgtgggcaaagacgagttttccttgcgcaccattgaaaacatgctcaggccccccgaacctgcgccgtcgccagacgactatgtgctggccaaaaaaacacggcagtccgaaaaatccagcgctgctggaaaaggcggcaagggcagcgtgctggtggtgggaatggactccctgctgacccaattggccaaatgctgcaaacccgcgcccccggatgtcattcttggttttgtcaccaagggcaagggcgtgagcattcatcgaagcgactgcagcaatttccgcaacatggccaccggcagccctgaccgtgtcatcgaggtggaatgggggtctgcaaaagccccggacggcgcggtttatccggtggatgtggccgtggaagcagctgatcggcaaggtttgctgcgcgatatttcagaagtgtttgccaaggaaaaaatgaatgtgatcggtgtgcaaacgcagtcggtcaaggacaaccgtggcgggacagcctggatgaccttcacggtcgaggtggcccaatcgggacggctcaaccgggtgctgggcatcgtggccgatgtgccgggcgtgcgttcagcccgaagacgctga

SEQ ID NO: 1200 - DNA, 2211 bp, Verminephrobacter eiseniae EF01-2
atgaaaatccacccgccaacccagcccccagccctgtccgacgctgcggcgcagctcatcgccgccaccgcaccacacccgttgcccgagccagcgcatgcgctggcgcacgcgcgcgcctttgccgagccgctgctggccggcgcaagcctggactccggcgagaacaccttggcccacgccgacgccgtggccgccatcctcaaaggcattggcggctccgaggcgatgcaggccgccagctacctggtgcaagcctgcatccacctgaacaaacccgaagaactgatcaccaagacctttggcgccaactttgccacgctggcgctggagaccacccaactcatgcgcgtgcagcggcaagcgcgcgcggcgcagccggtcgacgaccctgcgctacagaccgagaacgtgcgcaagatgctgctggccttctcgcgcgacctgcgcgtggtgctgctgcacctggcctcgcgcttgcagacgctgcgctttcatgcggccagcaaacgccccgtctcacccggcctggtgcgcgaatcgctgcaggtatttgcgccgctggccaaccgcctgggcatctggcagatgaaatgggagttggaagacctgtgcctgcgctttctcgaacccgatgtctacaagcaggtggcccgcctgctcgacgaaaagcgcggcgaacgcgaactgtgcatagagcagttgcgcgcccggctcgaagccgagttgcgcgcgcgcagcatcagcgccagcgtgcaggggcgccccaagcatatctacagcatcgtcagaaagatgcgcggcaaggcgctgaacttcgaccaggtgttcgacatccgcgcgctgcgcgtggtggtgcccacggtcaaggactgctacgccgcgctgagttgggtgcaccagcagttcaagcccatcgagcaagaattcgacgactacatcgcccggcccaagcccaacggctatcagtcgctgcacaccgtcgtgcgcgacgacaacggcaagccgatcgagatccagctccgcacccaggccatgcaccgacatgccgagcatggcatggccgcgcactgggtctacaaggaggccggcagcaaaggttacgccggcgtgtctgccagcagcgcctatgacgccaagattgccgtgctgcgccaactgctggcctgggagcgtgacctgtcaggcgccctgccccagcgggccctgttcgaagaccgcatctacgtgctgacgcccgatgccgccgtggtggaactgccccagggcgcgacgccggtcgactttgcctatgccgtgcacaccagcgtcgggcaccgctgccggggcgcgcgcgtggacggcgccatcgtgccgctgaacacggcgttgcaaaacgggcagacggtggagatctccaccgtcaaggaaggccgcccctcgcgcgactggctcaacgccgagttgggctacctggtcagctaccgcgccaaggccaaggtgcgcgcctggttcaacgcccaggccacgcacgaaaccatggcccggggccgcgaagcggtagaaaaactgttgcagcgtgagggcaagaccgccctcaagctcgacgacctggccgcacagttgggcttcaaatcggccgacgcgctgttcgaggtggtgggcaaggacgagttctcgctgcgcagcatcgaggccgtgctgcgcccgcccgaacccgccccgccaccgagcacgcagttgctgcacaaaaagacgcgcagccacgacccgccgcgcaaagacggcgtgctggtggtgggcatcgaatcgctgctgaccgaactggccaaatgctgccgccccgcgccgcccgacgccatcgtcggcttcgtcacacgcggcaagggggtcagcgtgcaccgcgccgattgcagcaacctgcgcgagatggccgcgcgcagcatcgagcgcgtgatcgatgtcgagtggggccagccccggccagccgtatcggccgccgtctacccggtcaacgtcgcggtgcaggccgccgaccgccagggcctgctgcgcgacatctcggaagtcttcgcgcgcgaaaagaccaatgtgatcggcgtgcagacccgctcggtcaaaggcacggcatggatgacctttaccgtggaggtcaccgacgccatccgcctgaacaaggtgctgggcatcgtggccgacgtgccgggcgtgcgctcggcgcgccgcccctga

SEQ ID NO: 1201 - DNA, 2289 bp, Methylibium petroleiphilum PM1
atgaagaccgtgcccgcggacgcggccctcgagaccgcgcccatcgtgctgctcgctggcgacgtggccggcgaggaggccctggcgcccggccagccggccggcgatgccgcgtcgcaggacgcggtgctggctcgcgcgcgtgccttcgccgagccgctgctggccggcgagcgcttcgacaccggcgaggacgcgctggcgcacgccgacggcgtggcggccatcctgcaggccatcggcgcggcgcccacgatgcgggccgcggcctacctggtctacgctggcgactacctcgccaagcccgaggaggtgatcgccaaggcctacggcgacagctatgcgagcctggtcgcgcacacccgcaagcttgtgcaggtgcagcgcagcgcgcgcgaggcgctcggcgacgcggcgctcgacgccgcgcagcaggccgcgcaggtggagcgcgtgcgcaagatgctgctggcgttctcgcgcgacctgcgcgtggtgctgctgcgcctggcctcgcggctgcagacgctgcgctactacgcggccagcaggcaggcgtgcccgcaggcactggcgcgcgagtcgatgcaggtgtttgcgccgctggccagccggctcggcatctggcagatcaagtgggagatcgaggacttggcgttccgcttccagcagcccgacgagtaccggcgcatcgccaggctgctcgacgagaagcgcgtcgagcgtgagcaggtggtggaggccgcgcgtgcccgtctcgtgacggtgctggccgaggtcggcgtgcgcgccgaggtgcaggggcggccgaagcacctgtacagcatctggaagaagatgcgcggcaagcacctggacttcgagcgcgtgctcgacgtgcgggcgctgcgcgtgatcgtcgacgacgtaccggcctgctacgccacgctcggccgggtgcacgaactctggcgctccctgcccgaggagttcgacgactacatcgcccgccccaaggccaacggctaccagtcgctgcacacggtggtgctggacgagcaggaccgcccgatcgagatccagatccgcacgaccgcgatgcacgagcacgccgagagcggcatcgccgcccactgggcctacaaggaagcgggcgcccgtggctatgccggcgtcagcgccggaggcgacttcgaggagcaggtggcgcaggcccgcaaggccgtgctgcgccagctgctggcctgggagcgcgagctggtcgagccgggtggcgacggtgcggtcggagccgggcagggcttgttcgacgaccgcatctacgtgttcacgccgcaggctgccatcatcgagctgccggccggcgcgacggcgatcgatttcgcctacacgctgcacaccgacctgggccaccgctgtcgcggcgcgcgtgtcgacggcgcgatggtcacgctgaacacgccgctgcagagtggccagacggtggagatcgtggcggtgaaggagggcgggccgtcgctcgactggctcaacggcgagctcggctacctgcgcagctcgcgcgccaagaccaaggtgcgtgcctggttcaacgcgctgacccagcagcacaccatcgcaaggggccgcgaggcggtggagaagctgctgcagcgggagggccgcacggcgatcaagctcgacgagttggcctcgcagctgggcttccgcaacgccgaggcgctgttcgaggtggtgggcaaggacgagtactcgctgcgcaacatcgagacgctgttgcgcccgccagagccgctgcccgaccccgacgaggcactggctcagcgcctgcgccgcgggccgagcagcgacgccacgcccaaggggggcgtgctggtggtcggcgtggaatcgctgctcaccacgctggcgcgctgctgccgtccggcaccccccgacgcgatcggcggctacgtgacgcgtggcaagggtgtggcgatccaccgcaccggctgctccaatttccggcagatggccggccgctcaccggagcgggtgatcagcgtggcctggggtcggccgcgcggtgatgccccgtccgtgtacccggtcgacgtggccgtggaagcagcggaccggcagggcctgctgcgcgacatctccgaactgttcgcgaaggagaagatgaacgtggtgggcgtgcacacgcagtcgctcaggggcacggcgtggatgaccttcacggtggagatctccgattccgcgcggctgcaggccgtgctgggctcggtgtgccaggtgagcggcgtgcgcagcgcgcgccgtcgctag

SEQ ID NO: 1202 - DNA, 2031 bp, Polynucleobacter necessarius asymbioticus QLW P1DMWA 1
atggcaaatacaccaagtcaatcagacaaaaccgcgatatttaaagatgcatggtttggcgagccagcagagagtcatgcggctgccgtaacaaagatactgcaatccttaaatctggatgaagccacgcttattgcagccagcaatatcgctaggactcatggcaaagaagctctgactaaattgattggtgatgagccagctaagctcttaatagggtatagagggcttcgtcaagcccaagcaaaattggttcgtgatgatggtggcttgagtgtttctggacaagaagaaatgctccgcaagatgctcctggcctttggcgatgatctacgagtggtattaatttacctagcctcccgtttggaaactcttcgctgggtgacacaagaaaaaatggcaatgtcagtcacatgggcacaagagatattaaatatcgatgcctcattggctaatcgtctcggtatatggcagatgaaatgggagatggaggatttggcttttcgagccctatctccagaaacttatcgcgagattgccaatatgcttgatgccaaacgaatcgagcgacaagcattcatcgagcgaattgttgtacagcttcaggaagaaattaaaactgcgcgtatcgatggtgaggtgctaggtcgaccaaagcatatttatagtatttggaaaaagatgcaaggcaagtcactcgactttgccaatctatacgatgttagggcgtttcgggttctggtagaggacgtaaaaacttgctatgccgttttaggcatcgtccataacatttggcagccagtaccacgtgagtttgacgactatattgctcgacctaagcccaatggttatcaatcccttcataccgtagtcatgaatgaggatggagcagcctttgaaatccagattcgtacccacgaaatgcatcaacaagctgagtatggattagcggcgcattggcgctacaaagagggcgcttacactggtatggcaacaccagccaatcctgccaaaacaaataaacccaacgtcagtcatcagcaaggcactcatagcgcagaagtggcttatgaacgtcagattgcctgggcgagacagctgatctcctggaaagaagatgcttgggagcaactcaagcaccatgagattgatgaccatatttatgtgcttaccccgctgggcaaagtaatctcattagaaaagggctctacaccaattgattttgcttatgctgtacataccaatcttggacatcgttgtcgtggcgcgcgtgtagatggagctatggttcctcttgagactgcactacaaaatgggcagacagtagagatcattgccgtgaaacacggtggcccatcacgcgattggattagtcctgataaaaattatttgcgctctcaacgagcacgtcaaagagtgcgcgcttggtttaatgcgcttgatgatgaagagggcggcttagtagcaaagacttccgacaagacggatataagtgccgagcaaaagcctacaccatctgcacccgaaatcgtattacgcaacagcagtcgcaagattggacaaggtggcgatgttttggtggttggggttgattctctattgacgcaattagcgcgatgctgtcggccagtgcctccagatgctattggtgggtttgtcactcagggcagaggcgtatccattcatcgacgctcttgcaagacctttagggggctcttggaaagagctcctgagcgagtgattcaaacagcttggactgcatcagctgctgaccccgtagtaaattcagagcaaaagcgagtgttccctgcggatttggtcgtttctggggtggatagacctgaattaatgagggagttgtttgaaattctgaccaggcaaggtgttcatgtcattgatcttcgaaaatcagctaaaaaaggcttggcccagatcctgttgactgtggaaattaaggattctgaagtacttcgtgtggttcaaaatagcctggaagaggtgaaaggcgtcacccaagtgcgtcgccggtga

SEQ ID NO: 1203 - DNA, 2250 bp, Delftia acidovorans SPH-1
atgaagaccgccagcagcgaggccgccgtgcaggcgccttcgcccgccgcagccgcgcagggccaggtgccggcggtgctgccgcacctgatcacggccacgtcgcagaccctgcccgaacaggtcaacgcgctggcccgcgcgcgcagctttgccgagccgctgatcgccaccgagaccatggagtccggcgagaacacgatggcccatgccgatgcggtggccgccatcctcaagaccatcggtggttccgaaacgatgcaggcggcgatctatctggtgcatgccagcgtgcacctgaatcgcccgcaggaagtgatcgccaaggcctttggcgagaacttcgccaccctggccgtggaaaccaacaagctcatgcgcgtgcagcagcaggcgcgcggtgccgagctgggcggccagtatctggacgatgaggccacgcagaccgagaacgtgcgcaagatgctgctgggcttctcgcgcgatctgcgtgtcgtgctgctgcggctggcctcgcgcctgcagacgttgcgctactacgcggccagcaagcgcccggtctctcccggcattgcgcgcgaggcgctgacggtgttcgcgccgctggccaaccgcctgggcatctggcagatcaagtgggagctggaggatctgtccctgcgcttcctggagcccgagacctaccgcgaagtggcccgcctgctcgatgaaaagcgcgtggagcgcgaagcctacatggagcagatgcgggcacggctggaggccgacctgcgcgcgcacagcatcagcgcaacggtgcagggccggcccaagcacatctacagcatcgtcaagaagatgcgcggcaagtcgctgaacttcgaccaggtcttcgacatccgcgccatgcgtgtcgtcgtgcccacgatcaaggactgctacgccaccctgtcctgggtgcatgagcagttcacgcccatcgaggcggaattcgacgactacatcgccaagcccaagcccaacggctaccagtcgctgcacaccgtggtgcgcgacgagacgggccgtgccatcgagatccagatccgcacccaggccatgcacgaccatgccgagcacggcgtggcggcccactgggcctacaaggaggcgggcaccaagggctatgcgggcgtcaccgccagcagcgagtacgacgccaagatcgccgtgctgcgccagctgctggcctggggcagcgacctggcgggcgcacaccatcgcggcctgttcgaggaccgcatctacgtgctcacgcccgacgcggccgtcatcgaactgccgcagggcgcaacgcccgtggactttgcctactcggtgcacaccagcctgggccaccgctgccgtggcgcgcgcgtggatggcgccatggtgccgctgaacacaccgctgcaaaacggccagaccgtggagatcaccacggtcaaggaaggccgcccctcgcgcgactggctcaacgccgacctgggctacctgaccagcaaccgtgccaaggccaaggtgcgtgcctggttcaatgcccaggccacgcacgagaccgtggcgcgcggccgcgaggcggtcgagaaactgctgcagcgcgagggcaagacggccgtcaagctggaggagctggccgttcagctcggcttcaaatcggccgatgccttgttcgaagtcgtcggcaaggatgaatactcgctgcgcaacatcgagaccgtgctgcgaccggccgaggcggaggaagaagtcgaggaattctccccggtgcgcaaggcgcgcggcacggactcgcccaagggcggcgtgctggtcgttggcgtggactcgctgatgacccagctggccaagtgctgcaagcctgcgccgccggacgacatccggggcttcgtcacgcgcggcaagggcgtgagcgtgcaccgctccgactgctccaacttccgcgagatggcggcgcgcaattccgagcgcgtgatcgatgtggcctggggtcagcccaaggcggccaccgtggcctcggccgtctacccggtcgatgtgtccgtggaggcggcggaccggcagggcctgctgcgcgatatctcggaagtctttgcgcgcgaaaagaccaatgtcattggcgtgcagacccagtccgtcaagggaacggcctggatgaccttcaccgtggaggtggccgattcgggtcgcctgagcaaggtgctgggcatcgtggccgccgtggcgggcgtgcgttcggcgcggcggcgttga

SEQ ID NO: 1204 - DNA, 2277 bp, Leptothrix cholodnii SP 6
atgaagacgacgcgcctcgacgtcggggccgagtcggcttcgccgatcctgcaactggccgatgcggtcggcacggccggccagcccgacgccggccaggaaaccgagcggctcgagcgggcccgtgcctttgccgtgcccttgctgagcgggcaccggttcgacaccggtgaagacgcgctcgaacacgcggacggcgtggcgcagatcctcaagagcgtgggtgccgcgccgtcgatgcaggcggcggtctacctggtctacgccggcgatttcctgaccgaccccgagacggtggtcagccaggctttcggcccgtcgtacgcgagcctggtgacgcacacgcgcaagctggtgaagctgcagcgcagcgcgcgcgatgccttgctcgaggaaaccgaccaggaggtgctggccgagcagctcgagcgcgtgcgcaagatgctgctggcgttttcacacgacctgcgggtggtgctgctgcggttggcgtcgcggctgcagacgctgcgcttccacgcggccagccgcacgccgtgcccgcgggccttggcgcgcgagagccagcaggtgttcgcgccactggccaaccggctcggcatctggcagatcaaatgggagctggaggacctggcgttcaggttcctgcagcccgagcagtacaagcggatcgcccgcctgctcgatgaaaaacgcgtcgagcgcgagaccggcatcgagcgtgcccgcgaacacctggcacaagccctggcgcaggcgggtgtgcaggcgcaggtacagggccggcccaagcacatctacagcatctggaaaaagatgcagggcaagagcctcgatttctcgcgggtcttcgatgtgagcgcgctgcgggtgatcgtcgccgatgtgcgcgactgctatgccgcgctcagccgcgtgcacgagctctggcatgcgctgcccgacgagttcgacgactacatcgcccggcccaaggccaacggctaccagtcgctgcatacggtggtgctcgacgacgagcagcgcccgttcgagatccagatccgcacccgcgagatgcacgaacacgccgagagcggcgtggccgcgcactgggcctacaaggaggccggcagcaagggttacgccggtgtcagcgcagcgggcgacttcgaggatcgcgtggccctggcgcgccgtgcggtgctgcatcagctgctggcctgggagcgcgatttcgccggccagagcgcggcccaggccgccgggctgggcgggcagggcgcaggcgccgggttcttcgaggaccgcatctacgtgctcacgccgcagggcagcgtgatcgagttgccggccggggccacggcgatcgacttcgcctaccagctgcacaccgacctcggccaccgctgccggggcgcgcgtgtcgacggggcgctggtgccgctgatcacgccgctcaagagcggacagacggtggagatcgtcgccgccaaggagggcgggccgtcgctcgactggctcaacccgcagctcggttatctgcagagccaccgcgcgcgggccaaggcgcgcgcctggttcaatgcccgtgccttgcaggacaccgtcgcacgcgggcgcgaggcggtcgacaagctgctgcagcgcgaaggccgcacggccatcaagctcgacgagctggccacgcagctgggtttccgtcatgccgaggcgctgttcgaggtggtcggcaaggacgagtattcgttgcgcaacatcgagctgcagctgcgcccgcccgagccggtggtcgaagacgacacgccggtgttcaagcggtcacgcagccatgccggcggcggcaatggcgtgctggtggtcggtgtcggatcgctgctcacgcaactggcgcattgctgccggccggcgccgcccgacgtgatcggtgggttcgtcacccgcagcaagggcgtggcggttcaccgcaaggactgcctgaactttcgcgagatggtggcgcgccaccccgagcgtgcgatccctgtcacctggggcagccagggcgcttctgacggacgcaatgcggtctacccggtcaacgtctcggtgacggccgtcgaccggcaaggcctgctgcgcgacatctcggaggtgttcgccaaggagaagatgaacgtcaccggcgtgcacacccgctcggtcaagggcacggcctggatgaccttcacagtcgaggtggccgactcggcgctgctggctcacgtgctgagcctggtcgcatcggtgaacggcgtgcggagcgcacagcgccgttga

SEQ ID NO: 1205 - DNA, 2037 bp, Polynucleobacter necessarius STIR1
atggcaaatcttcctagtaccccagctaagtcggccacaatcgtcgatgcttggtttgctgagccggcagagcttcatgcggctggtgttttgaagatattattgcaaacactcaacctagatgacgcaactcttacagcagcgagcaatatcgctcgcacgcatggtaaagaagcgcttattaagctcatcggtgaggaaccggccaagttgctgattggttatcgcggcttgcgtcaggctcaagcaaagctaatgcgtgacgatggcggcttaagtgttactggccaagaagagatgttgcgcaaaatgcttttagcatttggtgatgatttgcgggtagtgctgatctatcttgcctctcgcttgcagactctgcgttggattacgcaggaaaagattaagatgtccgcagcttgggcgcaggaaatcctcaatatcgatgcctccttagcaaaccgtctaggcatatggcagatgaagtgggagatggaggatttggcattcagagcgctctctccggatacctatcgtgaaattgccaagatgcttgatgcaaaacgcatagagcgccaagcatttattgatcaaattgtgttgcagctgcaaggtgaattaaagctctcacaaattgagggtgaagttcttgggcgaccaaagcacatttacagcatttggaaaaaaatgcaaggtaggtcattggattttgctaatttgtatgacgtcagagcatttcgggtgttggtggatgacataaagtcttgttatgccgcgcttggcatcgtgcacaacgtttggcaaccagtttcacgagagttcgacgattacattgcaagacccaagcccaacgggtaccaatcgctacatacggtagtcatggatgatgacggcactgcttttgaaattcaggtgcgcactcatgaaatgcatcaacaggctgagtatggtttagcggcacactggcgctacaaagagggtgcatatgttggtatggcgacgccaccgaatccgacaaaatctaataagcccagcattaaccatcagcagggcacacatagcgcagaggtggcctatgaaagacagatcgcatgggcgcgtcaactgatctcctggaaagaggatgcttgggagcaattcaagcatcatgagattgacgatcatatttatgtgctcacaccattgggtaaggtgatctcattggagaagggctcaacgccgattgattttgcctatgcggttcataccagtctcggccatcgttgcaggggtgcgagagtggatagtgccatggtgcctctagagacttctctgcaaaatggtcaaacagtcgaaattattgcggtgaagcatggtggaccatcgcgagactggatcagccctgataaaaattatctgcgctcacaaagagcctgccaaagagtgcgcgcttggtttaatgcattagatgatgaggaggctggccattccaataaggttattgatagcaaacaggaagtgagcccagaaattaaagcggttccaattgcgccagaaatcgtcttgcgtagtagcacgcataaatcagggcgaagtggcgatgtattggtggtgggggttgattcactgcttactcaattagcgcgttgctgcagacctgttcctcctgatgcgattgcgggatttgtgactcagggtagaggagtgtcgattcatcgacgttcttgcaaaacctttagaggtttactagagcgtgcgccagagcgggtgattcaaacagcctggacagcttcagtagcagaccccatcattaaccgagagcaaaaacgggtattcccggcagatttgctagtaatgggcttggaccgacacgagctcatgcgggagctctttgagattctgaccaggcaaggcgtgcacgttatcgatctgcgtaaatcggccaaaaaaggcttggctcagatccttttaacggttgaagtgaaggattctgaggtgttgcgtgtcgttcaaaatagcctagaagaggtcaaaggggtcacccaagtgcgccgccggtga

SEQ ID NO: 1206 - DNA, 2244 bp, Diaphorobacter TPSY uid29975
atgaagagcagttccatcggccatctgcccatggggcagggcgcggccgccgggccccgacccgaggcggtgccgcagctcatcgcagccaccgcgcaggcgggaccggagcatgccgacgccctggtgcgcgcccgcgcctttgccgagccgctcttgatcggcgaaacgttggaaaccggagagaacaccctcgtccatgccgatgcggtgtccgccatcctcaagcacctgggcggctcggaaaccatgcaggcggcggtctatctggtgtatgcctgctcgcacctgaacaagcccgaggaagtgatcaccaaggccttcggtagcaatttcgccgcgctggcgctggagaccaccaagctcatgcgcgtgcaactgcaggcgcgcgaggcgcaggtgacgggccagcaggtggacgatgcggccacgcagaccgagaacgtgcgcaagatgctgctggccttctcgcgcgacctgcgcgtggtgatgctgcgcctggcgtcccgcctgcagacgctgcgcttttatgccgcagccaagcgcccggtatcgccggccatcgcgcgcgaggcgctgcaggtgttcgcgccgctggccaaccgcctgggcatctggcagatgaagtgggagctggaagatctggccttccgcttcctggagcccgagacctataaggaggtggcccgcctgctcgacgagaagcgcgtggagcgcgagctgtacatggagcaggtgcgcagccggctggagtccgagttgcgtgcgcgcagcatcagtgccagcgtgcagggccggcccaagcacatctacagcatcgtcaagaagatgcgcggcaagtcgctgaacttcgaccaggtgttcgacatccgtgcgctgcgtgtggtggtgcccagcgtcaaggactgctatgccgccttgagctgggtgcacagccagttcaagcccatcgaggcggagttcgacgactacatcgcccgccccaagcccaacggctaccagtcgctgcacaccgtggtgcgcgacgaggcgggcaaggccatcgagatccagatccgcacccaggccatgcacgaccatgccgagcatggcgtggccgcgcactgggcctacaaggaggcgggcaccaagggctacgctggcgtgtcggccagcagcgagtacgacgccaagatcgccgtactgcgccagctgctggcgtgggagcgcgacctggtgggctccgccagccgcagcgggttgttcgaagaccgcatttatgtgctgaccccggacgcggccgtggtggaactgccccagggcgccacgcccgtggacttcgcctatgccgtgcacaccagcgtcggccaccgctgccggggtgcgcgtgtcgacggcaacatggttccgctgaacacgccgctgcagaacggccagacggtggagatcatcaccgtgaaggaagggcgtccttcgcgcgactggctcaacccggaactgggctacctcaccagcaaccgcgcgaaggccaaggtgcgcgcgtggttcaacgcacaggccacccatgccacggtggcgcgcggccgcgagctggtggaaaagctgctacagcgcgagggcaagacggccctcaagcttgacgacctggcggtgcagctgggcttcaagtcggccgaggccttgttcgaagtggtgggcaaggacgaattctcgctgcgcagcatcgagaccctgttgcgcccacccgagccggcggtcgatgagcctgacgtgctgctcaagaaggcgcgcacacccgacggcgcgcccaagggcggcgtgctggtggtgggcgtggattccctcatgacgcagttggccaagtgctgcaaacccgcgccgcccgatgagatccgtggtttcgtcacgcgcggcaagggcgtgagcgtgcaccgcgccgactgcagcaatttccgcgagatggcggcgcgcaatgcggagcgcgtgatcgacgtggagtggggaaagtcgcagcgcgccgccggagaagccgccgtctaccccgtggacgtggcggtggaagcctcggaccgccagggcctgctgcgcgacatctcggaagtgttcgcgcgcgagaagaccaacgtcatcggcgtgcagacacagtccgtcaagggaacggcatggatgaccttcaccgtggaagtgtccgatgcggggcggctcaacaaggtgctgggtatcgtggccgcggtgcagggggtgcggtcggcgcgccggcgatga

SEQ ID NO: 1207 - DNA, 2244 bp, Variovorax paradoxus S110
gtgaagcgcgagtcttcgagtcttcaaacggcgcacgcctccgatacggcggtggtggactatcccttgtccgctgccacggccgaccgcacgccggtcatggagaacatgctcgcccgtgcacgcgctttcgccgagccgctgatcgccgacgaaaagctcgacaccggcgagaacacgctggcgcatgccgatgccgtcgccgccatcgtcgccaagatgggtggctccgaggccatgcaggctgcgagctacctggtctacgcctgccagcacctcaaccgcccgcaggaggtgatcgccaaggtgttcggcgacaacttcgcggcgctggcggtcgaaaccaccaagctggtgcgcgtgcaggagcaggcccgctcggcttcgcagggccatcacctggccgaaggcgcagcgggtgcgcagaccgagaacgtgcgcaagatgctgctcgcgttctcgcgcgacctgcgcgtggtcatgctgcgcctcgcatcgcggctgcagaccctgcggcacgccgccgccagcaagcagccggcgcccgaaagcgtggcgcgcgagtcgctgcaggtgttcgcgccgctcgccaaccggctcggcatctggcaggtgaagtgggagatcgaagacctctcgttccgcttcctggagcccgagacctacaagctgattgcgcgcctgctcgacgagaagcgtgtcgagcgcgaaggccacgtcgagcagctgcgctcacagctcgaacgcgagctgcaggccgagggcgtgcgcgccacggtgcaggggcggcccaagaacatctacagcatcgtcaagaagatgcgcggcaagtcgctcgactttgcgcaggtgttcgacatcctcgcgctgcgcgtggtggtgcccgacgtgaaggactgctacgcggcgctggcctgggtgcactcgcacttcctgccgatcgacgaagagttcgacgactacatcgcgcggcccaagcccaacggctaccagtcgctgcacacagtggtgcgcgagatggtcgacggcaagcccggcaagccgatcgagatccagatccgcaccgaagaaatgcacgaccatgccgagcacggcgtggcggcgcactgggcctacaaggaggccgggcacaagggctatgcgggcgtgtgggcgagcggcgaatacgacgcgaagatcgccgtgctgcggcaactgctggcatgggagcgcgacctttcgggcggctcgcagggccaggggcttttcgacgaccgcatctacgtgctcacgcccgacgcggccatcgtcgaactgccgcagggcgcaacgccggtcgactttgcctacaccgtgcacaccacgctgggccaccgctgccgcggagcgcgcgtcgatggggccatggtgccgctcaacacgccgctgtcgaacggccagacggtggagatcatcgcggccaaggagggcgggccttcgcgcgactggctcaatgccgagctcggctaccttgcaagccaccgcgcgcgcgccaaggtgcgcgcatggttcaacgcgcagatcacgcacgaaaccgtggcgcgcgggcgcgaggcggtcgagaagctgctgcagcgcgaaggcaagacctccacgcgcctcgaggacctggcttctcagctgggcttcaagtcggcggaccacttgttcgaagtggtcggcaaggacgagttctcgctgcgcaacatcgaggtgctgctgcgtccgcccgagcccgcgcccaaccccgacgacggcgtgcagatcaagaagccgcgcgcgagcgagaagtccggcaagggcggtgtgctggtggtgggcgtgtcttcgctgatgacgcagctcgccaagtgctgcaagcccgcgccgcccgatgccatccgcggcttcgtgacgcgcggccacggcgtgagcgtgcaccgcgtcgactgcagcaacttccgcatgatggcctcgcgcgacagcgagcgcgtgatcgatgtcgaatggggcgccgcgaagggcggcgaagcgccggtctatgcagtcgacgtgtccgtcgaggcggccgaccgccagggcctgctgcgcgacatctccgatgtgttcgcacgcgagaagatgaacgtgatcggcgtgcagacccaatcggtcaagggcacggcatggatgaccttcaccgtggaaatctccgatgcggcgcggctcacgcaggtgctgggcgtggtgacggcggttgccggtgtgcgatctgcacgtcggcgctga

SEQ ID NO: 1208 - DNA, 4320 bp, Dechloromonas aromatica RCB
atgccgcgaggaatatccttcagaaagccgggattcgccagcagcctggtactgcgtatcggcctgctgattctgctttcactcgccgccttcacgatcagcctttactacctgatcggccggccaaccgtcgatcggttggcagaaacccagatgctgctcgcagctgagcagttggaagcccgctatacccgcctgttgaaaacggttgagatcacgctgcgcagcagccagggctggggaaaaaacagcgatatcgatcagacccgtctgctgcatttcaacgagtttttcttccccatcatcgccaaccatggcgaaatcacctcggtcatattcgcccatgaatcgggccgggaaattctcctgttgatgaccgacgacggtcgctggatcaaccggatcagcaacccggccgactggggcaaccagacctactggatcacctgggataaaaaccgccagatcgaaagcgtcgaaatgcgggagcgcaattacgatgcccgcgaacggccatggttcaagggggcgatggggctgcccgatgagcagagcgtgttctggaccgagccctatatctttttcacgaccaaggagccggggatcacggcggccatgcgctggcaggcagaagatggctccagctacgtcattggccacgatgtccggctgatcgacatcgccgaatttaccacccgcatgacggtcggatcgcatggcaaggccgggctgtttctgaaggaaggcaagctgatcgcgccgccccgcgatccgcgctttgcggaccgtaacgcgattaaccaggcattgctgaaaacctccgaagagctggaacttccggagtttgccgaagccttcaggctgtggcagatggaccctcatccgctcaagcgactgcacagcttcgatcgacccgatggccgctggatcagcttcttccagccgatctccggcaacaccagcgggatttcgctgggtgtcgtggccccggaaagcgattttgtcccgatatccagccaggatctgatactgctcggattgatcaccctctccgcactcgctctgggcatggcagtcgccattcgcattgcgaatcgcttcggtgaaccgctcattgcactggccgaagacagttcgcaaatcggcagcatgaatctggataaacccgtgaccaccgacgccccttggcgggaggtgatccagcttgctgccgccctcgaggaaatgcggcagcatctgcaaagttcccggcggacgcttgaagacaccaacatcgagcttgaactcaaggtggccaagcgcaccctcgccttgcggcaaaaccaggaaatcctgcagaaacgtgaggcatttttccgcgccatattcgacaatgcagcggtcggcatcatcagtctggacccggagcgcaagccggtactggtcaacccggccttcgcaaaatttatcgaccagccgatcaatacactgctttcgcacctggaaaacatcgccctgcccaaggaggtactggggcggatcaatgatctgctcggccaaacaggcagcgcccagcagcagagcctgcgcaatgaattcgaattcatcgacaaaaacggcgacacccactggggcgacgtccagattgctgccgtccgcgatgaaaatggcgagctcgattccctgctgatcaccgtgctggacgtttccgaccgtcgcgagatcgaagccgagttgatccggcagttttccttcctgcaggcactgctcgacaccatccccaaccccatcttctacaagggcgcgaacacccatttcctgggctgcaatcaggcctacgaagcgtttttcgggatcaatcggcgcgagttcgttggcaaacgggtagtcgatctcgaatacctcccggaagatacccgtcaggcttaccaaactgaagacgagcaagtcatcgaggcgggaagccggattagtcgcgaagtgagcttgccaggcgcggacggcaaactgcatgacgtgctctactcggtcagcggcttccactcccccgacggccgaccggatggcctgatcggcgtcatcgtcgatatcacggccctgaaggaagccgaacgcgaggccgaccgggcacgcgccacggcagaatccgccgcggcagccaaggcggatttcctggccaacatgagccacgagattcgtaccccgatgaacgccatcatcggcatgacccatctggccttgcagaccgagctgaattcccgccagaaaaattacctgaccaaggtcgacaacgcagccaagggcttgctcggcatcatcaacgacatcctcgacctgtccaagatcgaggccggcatgatgcatttcgaacatgcaccgttcagcctggatgccagcttggagcgcctcagcgacatgtgctccctgaaagcccgcgaacgaggactggaactgctctacgacattgcgccggaggtaccggatcaactgatcggcgattcgctgcgtctcggccaggtgttgctcaatctggtcggcaatgcgatcaaattcaccgaagccggtgaaatcacggtcacggtaaaactgctcgccaaccgtgaaaacgaggtcgacctcggctttgaagtcatcgacaccggcatcggcatgaatgttgagcagcagtcgcaactgttttccgcttttacccaggccgatacatcgaccacccgaaaatacggtggtaccggacttggtctttccatctgcaaacgcatcgtcgagctgcagggcggcagcatcggcgtcagtagccagccggggatcggtagccgctttaccttccagctgcagtttggaagagcgacggagcaaacgggaacaccacggcgcatcggcttgcccaacaatctgcgcgccctgatcgtcgacgacagtcatggtgcctgtgaagtcttcctgcacatgctcaccgtcttcgggatcgactgccatgccgtccgcagcgcaccggcagcgctgctcgaactggctgctgcggctgaaaccggtcaagcctatggcctgctcatcatcgactggaaaatgcccgacatggatggcgtcgaactggtcgagaagatcagtcagagcaatggaccagaaagaacagccgccatcgtcatggcgaccgcctacgaccatgaggaactgctggccgcactcggcaagcaccccgtcggtgccatcctcagcaagccggcgacgccatcctcgctgttcgacagcatcatggtcgcgttgcatcgtgagccgaccacgcaaatggtgcccaacatcactccaaccatgctttcagagcaatttgccggccggcacatcctgttggtcgaagacaacgaggtcaaccgggaattggccgaggaaatgctgggcaacatcggcttgctcgtcgacacggccgaaaacggccagcaggcgatcgaccgcattcgccaaaacgcctacgacctggtgctgatggactgccacatgccggtcatggatggctataccgcgaccgaatacatccgccacgagttgaagttgcctcagctacccatcatcgccatgacagccaatgctctgcacagcgatcgggagcattgtctggccgtcggcatggacgaccatattccgaaacccatcgacgtggcggtcctccatgccaccctgctgcgctggctcagtcaggctggcgagcggacaagcccatcgcctctgccagcagcaagccgcgacttgacgttgccggccggggaaattgatacggccacggccctcgcccgactgggtggcaaccgcagcctgtatgaccgcctgcttttgcgcttccaggaaaaccagggcagcgcaatcgaatgcctggcggccgaccgaaccagaggcgatagcgctgccatgattctgcgcgcccacaccctgcgcggcctggccggcaatatcggggcgaccggcctctcccggctggctggcgacctcgaggagcgcctcaaacagaatgcctctgtgaaggaggccggcatcgaaaacctgctgggcagcttggctgaaaacctgcccaaggttctggccgccgccgaaaagctgcgccaggaaacgccgcagatcacgccagcgccgctgcaagaagcacagcaaggcaccctatccgaactgcagcaccttctagataatgacgatgcggccgccgtgcggtatttcgagcaaatatctgcctggctcaaacaggagttcgagcctcgtctggttgatcaactggcccgccagatcaatcagtatgaattcgatgtagccatggaaacattgcagcaaatgaccatcaaccggcaacaagtctga

SEQ ID NO: 1209 - DNA, 3357 bp, Nitrosospira multiformis ATCC 25196
atgacaattcggaaaatgagttatattttttacctcgtaaccggagtacttatttccctgcttactctgtttgttgcgcttcgtttcttcgagctccggaaactgaacgaggccgaaaacgtgcgctatgccggcttccttgcagtggatgagctgcgccagtcttccgatgacttgacgcgcacggcccgagcctatgtcgccacaggcaatccaaagtttgaacaaatctacttcgatatattggccatccgcaacggcgataaggaacgcccgctgcattacgagcgcggccactgggatctgatcctcggtcatttgaacccggagtccgcgccggggcgcaggatttccttgagatcgcaaataaggaaactcggatttacggcgaccgagcttgcaaaacttacgaaagccgaaaatcgctcaaaccagttgacggagcgagagtacaaggcattcaatgccatgaaagggctatttcaggattcagccggagaattcggcgtgaagggtgcgcccgatgccgcattggccagcagcctgctgcatgatgagagctaccacacggccaaggccgagatcatacggttgttgaacgagtttcatgaattgctcgacaagcgtactcgcaataccatggctctcgcccaaaaccgcgccaatctttatatatccggcgtgtttttcatgcttgcctttctcatggcctggtttgccttttcgtatcgtgtcgtgcatcggaaggtgcaaaatcttgcatggctcgaagataaagcgaggaatatcggagaggcgagcaactcgcccagtttctacattgactcgaacgacgagataggtagcctttcccgcgccttcatcgtggctcaggctgaacgtgatcggtatttcaatcagtctctcaactttcttgcgatttccgggtttgacaatcgtttcaagcgggtgaatacagcctggaccaaagtttttggctattcggaggaggaattgctgtccaagccttttatggaccttgtcttctccggttcacgcgcagatacggcggcagagctggacaagctcgtcatgggtagcaatgtttcctttgaaagccagatgcggtgcaaggatggctcctttcgctgggttttgtggaatatagctgctgcgcaggatgtccgtgaattctacttttcgggccaggatatcaccgcaaggaagaatatcgagagagagctccagaatgcccgaaaagcggcagaggctgccaatcgggccaaaagcgagtttctggcaaatatgagtcacgagatccgcaccccgatgaacggcgtgctcggggcagtcgggctgcttttgaacaccacgctaaccccctcgcagcgcgagctggcgggactggctcgcgcgagtggcgaaacgctgctttgtataatcaatgacattctagatttctccaaaatcgaggccggtaaactcgttatttcaccggttccttttgatctgcttcaggccgttgaagaggtagccggcatggttgccatgcagccggcaagaaaggcaaatgtgaatgtaatagtacgttacctgccgaatgtgccgcgttatgtattcggcgacctcgggcgcattcgccaggtactgataaacttgaccaacaatgcaatcaagtttacagacaagggccacgtactcatcgatgtagaagccgaggctctcagtgaagatgaggtatcactccgcatcagcgtcgaagatagcggactgggaatcgcgccggataagctgcaaagcatcttcgacaaattcacgcaggcagatgcctctaccacgcggcgttatggcgggacaggcctgggactggctatcagcaagcaactggtccagctaatgggggggaccatcgctgcgaagagtcgggtgggcgctgggtcaacgttctggtttacgctacctttggccttgcagaaaaattggccgacggatgcgggtctgcacatcgacctgacacatgttcgggtgctgattgtggacgataacgcggctaatcgtctcgtgctgcaagagcagttgcgcagctggaggatgcgtatcggcagctgcccctccggggcagaagccttgcgggccctgcacacctctcacgcctccggtgatccctacaggattgcgattctcgatcatcagatgccggatatggacggagaaatgctgggccggaccatcaaggcggatccattgctccgcagtattcatctggtgatgttgagttccctgggacaggaaggcgatctcagagagcggcttcagaagatcggctttgcggcctatctggtcaagccggcgcggcaatcggaattactgtcgactctggtaaatatctgggacgcgcaacgccaccagcgaactataaatctcatcagtcagcctttcttcccggcgaatcccgagatgcaggccgcggatagctcgaatggtctgtttgccggtacacgcgtactgcttgctgaggacaatgctaccaatcagatcgtcggagcgatgatattgcgcaatctgggctgtctggtagatgttgccaccaatggccgtgaagccatggagatggtggatgcatttctctatgatatggtgtttatggattgcgagatgccagagatggatggttttgaagccactgccgcacttcgccgccgccctgacagcaaatcgcggcttcccgtcattgcggtaacggcacaggccatgcagggtgatagagaacgttgcctgcgcgcgggcatggacgattacatcagcaaaccggtaaagctggaggattttgcggcagcgttgaagcgctggatgccgggtagagaacaggggcagaaaagtgaaacatctcccacggcaaggcatgaaaagtcgatggcagacagcactccgaatcattccccaccaatagtcccttcctctctacccgtttcttcatccctttcgatgtcttccgcatcctctgcactgaatgcggaagtcgttgcaagacttcgatcgctcgcggaagcgaccgacccatccttgattacccagatattcacatcgtttctgagcgatggggcgaagcgcatcgatgcgctgaaggaggccctcgcaggaggaaatatggaacttctgcacaagactgctcatgccatcaaaggcgccagcgccaatatcggcgcgcattccctgacggatatggctcaaaagctggaactcgcaggcaaggccggcgacatgactggagcagttactttaattgagcaaattgaaatggaatttggacgcgtgcagcatgaaattacccagtcagagctcgattgcgtagcgctgccggatgcaactcgaccatga

SEQ ID NO: 1210 - DNA, 5292 bp, Shewanella amazonensis SB2B
atgcaggaaaataccgaaaaactctcaacctttcgaagccggatcctgttccagatagccgttcccctgatcattatcatgaccggggtatccggggtcactggttggctgaactacaaggccgaagaaaaagccttttttgctgacctggctgaaaaagcagattttgccgccaagcgtctcgagtttgagttgacgctggcccagcaggatacccaaaccctcgcctttacccttgggcacctcgatgccaaagcgcaattgcaacaggcgccctttctgtaccaattactcaccgatcgcctggctcgaaacgacagtttttatggctcggccgtcgcctttgtaccgggttttacgcccggacaggaacgatttgccccctatgtgtttcgtcaggatttgacgattgccaccctggatataggcaaagaagcctatgactacaccaacggtgagtgggactggtggacggaagccctcaaacgccccaaggggtactggactgctccctactacgacgacggcgctggcaacattcagatgatcaccttctcccagccctttggtgatgaggagccgcttggggtagtgaccacggatctggcgctgtccagtttgcccatccgtctgggtatcgatcccaaaaagctgttggtgctcgatgccaggggcacgcttatttaccatcccgacaacaacctgacccgtaacgccaccatcagcgactggctggtgaaagatgtcgccagcgaggaagccgccaaaaaagtgcttgagggtgaggctcaggaagtcgccctgaaagatctgaacggcgttcagtatctggccagtattgccaaggtgtcgccactggcatggcgggtattggtcatcacgccccaaaccgaattggtcgaaactttcttaaaaggattcagttccttaaccttgagcctcctggtactggctttgattctgctggtgaccagctattacagtgccaagcgcctgaccgagcccctggaagccctggaaaccggtattgtcgacttcagtaagggacttatcaaacgcttgcaaaaacccgagggggtagtgcgggaaatcgccacgctgagtcataagttcaacgagatggccgaagtgctggaagagcgggaacaggcgctgctggactcccgcggcaaccgttttgccaccctgatagacggcatgagcgacaagtcgttttattgctccatgaccccagacggcaatatcgaccaggtcagtgccggggtagaaaaggtgctggggatttcgccggaagtgctgaaacgcaagtaccagcgcctcttttccagcaacgccatcaacgagcaaaactggcagtttatggagatggcgctgcggggcgaggcggttcctccccatcaggtggaaatggccggcgccgatggcagcctcaggcggctcgacctctttatgcagccgcttttggatgatgaaggacagctgatctccgtggagatgctgtttaacgatgtgacagagcagttttccgccgccgcctggtccaatgcggtgctggaagcggcccccgaagccatgctgatagtggatgaatcggggcaactcgtgttcagtaacagtcgttgccaggagctgttcggttacagcggcgaggaaatgctgaacctgaacatagatgcgcttattcccgagaatgagcgccatggccatcagggcaagcgccagctctttattgaaggtggcagagacaaggtgatggccaatggtaagccgctgcatgctcttaaatgtggcggcgagcagtttccggtgcaaattggcctgagtctgttgcccgccgacagtcggggtcagcgtcaggtggcggcctccattcgcgacctgacagagcaattggcggtcgagcgccaaatccgcgagagtgagagccgctttcgcggtttggtgtccaatatcccgggcgctgtgtatcgcacccgcattaatggcacctggaccatggaatatgtcagcgacaacatcactgagctgaccgggtaccctgcctggcactttattgagagcaaaaagcgcagctttggttcgctaatccttgatgaggacgcagagcgctgcgacgcgattatttccggcgccctcgctgagcagcatgcctttgaggtggagtaccgcattcgccaccgggatggcagccttcgctgggtccatgaaaagggcaaggcaagctacgatgaagacggcaatccggtgtggtttgacggcagcctgaatgacatcaccgagagcaagctggctcaggagcgaattgagcaatcacgggagcagctggaaaccatcaccgagtctgtgcccagcactgtgtaccagttggtgtggcgctctgagcgtgacagacgctttaccttcctctcaagcgcggccatggcgaccctgggtttccatcgcaatgaggtgctggataacttcgagctggtggccgagcgcatcgtggaagaagacaggggcgagatcattcaaatgctcgccggtcgtcacggcatgcagtggaccaaggccttcagataccatttcccttccggtgagttgcgctggctggaggcgggtgcccggggcagcaagcagcaggatgcgttggtgtggaacgggtatctgatggacatcagcggccgtaaacgcatggagactgagctagcccaaagcgaggcccacttcagggcactgtttgataacgccggtatcggcattgttaaccttgacgacaggggcattatcaaggattgcaacggccagtttgtcagtgatttgggcataagcagcgacagcttgaagcgtaagcagctggcggacctgatgcacccagaggacagagcacttgccactggcctgtatcaggccctggctgagagtgagcagggcagtatcagcggtgagtggcgcatgctcgatggcgatggcgagctgatgtggatggcggtgattgcttctgtgctggaagaaggcgacggcggtgagcgctccgtggtgatgagtatcgccaatattacccgcctcaaactgctgtccgacgagctgatggctgccaaggaggatgcggatgcggccaaccaggccaagagcgatttcctcgccaacatgtcccacgaaatccgcacccccatgaatgccatcattggtatgtcacagctgtgcctgcagactgagctcgacagaaagcagcgcaactatgtggaaaaaatcgagcgggcgtccaagtcgctcctcggtatcatcaacgacatcctcgatttctcgaaaattgaagctggtaaactggatatcgaagtggtgcccttccagctggacaccattttggaagacctcggcgacatgttttcggtgaaagccgccgataagcagctggagctgctgttttcggttgcccccggcgtgccaacacaccttgaaggtgacccgctgcgtctcagccaggtgctgattaacctgatgaataacgccattaaattcactgaacgcggtgaggtgatgttgtccatcagcgagctggcccgggatgaggatcaggtgcagctcaagtttgccgtgcgcgacagcggcatagggctcaccgcagaacaacaggccaagctgtttaagtcattcagtcaggcagatacctccaccacccgcaaatacggcggcaccggtcttgggctggccatttgcaaacagctggtggagctgatgggcggcgagattggggtcgacagccagtttggcaatggcagtaccttctatttcactgtgtcggtcaaggtggcgcaaaacgcccagttgaatgttgaacaggaactggaaggcatggcggtgctggtggtagacgacaacagcaccgccagagacattcttcgcaccacgctgcaaagcatgggcttttccgtcgacagcgcccgcagcggcatggaggcattggagaagtgtgccgagcgggattaccgcatcgcccttatcgactggaaaatgcccgagatggatggcactgaaaccgcggcacggatgcgggaactcaagcagccgccccttattctgatggtttctgcccatgccaacagcgagtttatcgacaaggtggaggagatgggcatcaatggctacatcaccaagcccatcagcgcttcccgtttgctggatggcatcatgtcggcgctgggtcgtcagggacacaaacccgtgcggcgcaaggcgcagcccatggatgcccagaaactgtccggcctcaagggcaaacgtatcctgctggtggaagacaatgagatgaaccaggaggtggccagtgagtttttggagcaggtgggggtggtgctttccatcgccgacaacggtcagattgcgctggaaaaactcggtcaacaaagcttcgatttggtactgatggattgtcagatgccggtgatggatggttatcaggccacccgggagctgagaaaactgcccgggcttgcggagctccccgtggtcgccatgacggccaacgccatggctggcgataaggaaatgtgtttgctcgcggggatgaacgaccatatcgccaagcccattgaggtggggatcctctatcagaccctgctgcagtatctctgccccgaggccaaagggctggagtcagcagacgctgacgccgcggcagaccaggaggtgacatcgctcaccagctggcctgagcatgaagatttggacatcgaccggggattgcagttggtacaaaactcagagcgcctctatcgccgcattctggagcgtttcgtcaccagccaggcccaggcaggtaagaaaatccgcaaggcccttgcactgggacagcaggaagatgccgttcgtttggcccacaccctcaaaggcgtggcgggcaacctcagcgccgacaccctggtagaggaggcccgacaactcgaggccaaactcgcacagggagaggcctgcgaggccgagttggaagcggtggaaacccggttggtaaccatagtggcagccatcgaacgttggatgacagaaggtgttgaagagcagggcgtggagagtggtgagcctttgtctgcggacgcccttaaagaggtgctcaataccctggtgacacagcttgaggacgccgacgccgatgcggtgtcgacccttgagtcgctctctggacaagtggtagcgggcatatgggccaggcttaagccggtaagccagatggtggcgggctaccagtttgatgatggcgccgatttggtgcgggaactgatacaggaacttgagaccgacggcgaatccgcctga

SEQ ID NO: 1211 - DNA, 3801 bp, Halorhodospira halophila SL1
gtgtccgagagcgcgccccactctgatcgccgggccgacgaatggcgcatcctgttcgaccacctcccggacgccaccctgctcatcgcgccggacaccggtcgagtgctggaaggcaacccggccgccgccgcgcacctcggctatactccggaggctctgcgcgggctgaccatcgccgatttcgaggccgccgaaaccccggcagagatcgccgcacatatcgagaagatccagcgcgccgggcgcgacgacttcgagagccagcaccggcgccgcgatggcaccctggtcgatgtccagatcacggtgtcacaggtcgaattcgcgggacacccccgcctgctcgccgtcttccgggatatcaccgagcgcaaggaaaccatccgagccctgcggaccagcgagcaacgtttcctggatgtggtcgacgcggccggggagtacatctgggagatcgatcgcgacggcacctaccagctggtgaccgcgcagatcgagcccctgctgggccgctccacggcggagatcatcggtcgctccccggtcgatttcatgccgagcgccgaggccgaacggatccagacgatgctctcggaacgagcccagaccggtgcggcctggcaggggctggagcatgaatccgtgcgccccgacggcacccgagtctggcagcgcgtcagcgggctaccgatcttcaatgaggccggcgaactcatcggtttccggggcaccggtcgggatatcaccgccgagcggcaggcccagcagaacgaaaagcgcctcaatgagcggcttcgcctggccaccaccgcggcccgcatcggcgtctgggaactcgaccgggcgacggaccgactcgagtgggatgccggatcggcgcggatcttcgggacggacccggctgcgttcaaccaccgtcttgccaacctccaggcgaccctgtgggacgagaaccggacaatcgccgaggggctgatcgagcgcagtctccacagcgcggaaccgtgcgaggccgagttccgaatccgtcgcaaaagcgacggtgcgattcgccacatccggtctgtcagcctctccatccccgatgaacacggccaggttcagcgcctggtagggatcaacgaggacatcaccgaccgggtccaggcccgcgagcaactggccgcgcaggaggcgcgattccgcggcctcttcgaactcgccccagtggggctggccatgaccgacttcgagaccggcgccttcctggacttcaacgaccaggtctcggaggctgccggctatacccgggaggccttcgcacagctcacctattgggacgttaccccgcgcgaatacgagccgaaggaacgcgaacacctggaagcgatggcgcgcaccgggtactacgggccgtacgagaaggagttcatccaccgagacgggcaccggttcccggtcctgctcaatgggttccggatgacagacccgcagaccggacgagtggtggtctggtcggtcatccaggacatctccgagcgcaaagccgtggagcaggccctgcaccaggccaaggaggctgccgaggccaacaaccgcgccaagagcgacttcctggccaacatgagccacgagatccgtaccccgatgaacgcggtcatcggcctgggccaactcctgatcgagacggacctcgatcccgttcagcgcaattacgccgagaagatgcacaacgcatcgcggatgctgctggggatcatcaacgacatcctcgactactccaagatcgaggccgacaggctgaccctcgacccccacccgttcgacctccacgagctgatggatcagatggctaccctgttcggggaccaggccggcgaaaagggcctggagctgttcctgcgcgtcgaaccgaccatcccctcaagcctcgagggcgatgccctgcgcctgagccaggtgctgagtaatctgctctccaacgccatcaagttcaccaagcacggccaggttggactcagcatcacgcagctcggtcaggatcctgaaggggtgcggttgcacttccaggtggaggataccgggatcggtatcacccccgagcaacagcgcaatctcttccaggcgttctcccaggcggacacctcgaccacccgcaactacggaggcacgggcctcgggctggtcatcagtcagcggctggtggcgcacatgggcggcgagcttcggctagaatccacccccggcgaaggcacacgctttgcgttcgagctccacctgcccatcgccgggacgggcccgtggacactggatgcgccgagcctgcccggtggccacgtcctggtggtcgacgaccacgatgtcgcgcgccagatcctccgcgagtatcttgaggcctgggggtacaccgtcaccgaggcggacagcggcccggcggggatcgaggcggcgctggccgccgagcgcagccgccagcccttcgacctgatgctgatcgacggccacctgcccggcgaagcggatggctggggcacggcccggcgcctgcgcaccctgcatgagcgcggcgacctacccaccaccagggggccgatgatcctggtcagcgcctatcagctggacgaccggtccgtaggcgatcccttcgacggttgcttgcccaaaccggtgacagcctcgacgctcttcgatgtcgtccagaacaccttcgtcggcgcacctgccgcgacaccggtcaccacgagcggggccattccgaatctctcggatcgatccctgctgctggtggaggacaacgccatcaaccaggaggtggcccagcgcctgctagagcagaccggggcgcggatcaccctggccagcaatggcgccgaggccgtggcgtggacgcgggaggccaccttcgatctgatcctgatggatctgcagatgccggtgatggacggctacgaggccacccgggagatccgccgcgagcacccgaacctgcccatcctggccctgacggctgcggtgctggataacgaccgcgccggggcccgggacgcgggcctggacgaccacatcggcaagcccatcgacagccggctgctgtaccaacggctggtccactggctcggcgccgagggcacggcatcgccctccgtgaacggcccgaccccgcccggcgcggatggcgaggacgccgcgctgcccgagcagctttcggggatcgaccagacaaccggcctgcgccacctggagggggatcgcgccttctatcggcgcctgctccagcgctttgccagccaactcgagggtgagctcggccagctgcccgccgccctggatcggggggacccggagaccgcccgccgggtggcgcacaccctgaagggcacggccgccaccgtaggggccacccggctcgccgaggctgcggccggcgttgaccgctgcctcaaggccggagagagcgtttccgatgagctgcaccgggagctgcgtgcggccctggacgaagtctccgcgggccttgaggtgctggccgatgcggccaccacctcggcgccgcaaccgccgttggatgcgacggcggcccgtgaggcgctaaaccgcctgtacacggccctgcgagcgaacgaactcgtcgacgaggccctggtcgatgccgcgctccaccacctccgtgcgctcagcgacgaggcgaccgtgcgccgagtccggcagcagatcgaccagttcgactacgacgccgccaccgaggtgctggctccccacgccgccctcacaccggacagcgcagcgtctggggagtctccccccgcacgcgaccgatga

SEQ ID NO: 1212 - DNA, 4749 bp, Shewanella woodyi ATCC 51908
atggataagttgcttcaaattgccttacttgtggtcatgttacttgcgctttgtgttgtgttttggcgtttgcgtttattaacgattaaagacaaagagaaattttctggttatgcacgctatggtcgtttagcgggtgcaggggtgattatttttgtcaccatcatttttcttatcgccaagattggactcattgttgcggacaaaaatgatagagagaagagcggccagtcactattaggggtcgttgatgttgccgatgcagcgattgaagcttgggtatcgggatgggaagatagaattttaagtgtcgcgtttaaccccatacttcatagccatgtggaggatctgctccatgcgccgagagacagggagagcttactgctcgactccgatgtggagtgggctcgctcagcttactttcgttacagtaaaccgtttggcaccatgggcttttttattatcgcaccagatgggataaaccttgcgtcaaaccgagatgcaaatttagggttgatcaatattgttcagactaaatacccggagcttttggccagtgcttttaatggggagatagtgataaccccaccgatgcactcagatgttgagcttgaaactcccgatggtagcttcaataaaaacactccaaccatgtttgtgatgagccctattgagttcgttaatggcactatccccgcagtgctagcgctgcgcattaatccctataaagagttctcaaaactgaccagtagtgctcatgtgggggacactggagattcatattttgtcgatgaccgtggtcgtttattaaccgaaagtcgttttaacagcaagctagttgaccttggtctattaaaaaaggggcaaacatcagtattgaatcttacctctcaaatccccaaaagcagttatgaagctgcggggatcactcctagctcaagtgatcaggtccaccttactgagagcgccaagcagatccgcgaccatttagatggcgaggacttttcgggttatatcgattttaagggggataaggttatcggtgcttggcgctggagcgataaatatggctttggcatcgtatctgaactcactctaaaagaggcaagaaaaaactacaccagctttcagcggattgtttacagcatgtttgctgtggttgttttgctcgtctgtatcatctttatgggctcagtttgggtagggcgcagaattcatgaacagctcaaagcggtcaacgagaagcttgaagatagagtgaatacccgcaccttggagctgcaggagagggagactcgtttgtgggatctctatgagcactcaccggtggcttacgcctcattggacattaagggcaattttatcaagcacaatctggcttttgctcagttaacgggtcgagaacgtgaggagttttctcatcttaagtttaatgatgtcattaagcatagcgaagagtttacccaagagttacttgatcatgtgctctctggtgaggtgacctcagatattagagttgagcttttcagggatgataaacagaaaaaattcgcctctatgacggtgatctctaaattagatgagcagggcaagctagaggatattcgtctttcactgctggatgtgactcaaagagagatggtacgaaaagagctgaaatataatcaagcccagtttagctctatggtcagtaatatccaaggtgctgtatttagatatagattaagtgaagattggcgcacctccgagatgctctataccagtcccaagatggctcagataactggttatgagattgagtttttcttaggggatgcccctcaagttaatctgtttgatctgatacacccagccgatgtggatgagtttaatctgcagatggagtccagtcgattagatggttcctctttaagagccgacgttagaataattaacgcttcaaatattgaacgctatgtgcagtttcgtgcgcttttctctgttaatgcttccgggagtgctgaatatcttgatgtcagtatttttgatattaccgagcagaaaagcagtgaattgaagctacatgaatcagaggagagactcgatgtcgcctccagtagtgcccagcttggtatgtgggactcttttccgttagagagcaaggtgctgattaaccatgtctgcgtcacgatgctgggttataagatggatgatctctgcatcagtaatgataagtggtctgaattaaagagtggtaacaggacttggcttggtttgatccaccccgatgaccgtgagctttatactgagttaattgaagctcatattactgggaatgaagagatctatcgtcaagagcttaggctacttaatcattcgggccaatatgagtggatgttaagtgtcggcaaggtatttgaacgtgataatcaagggcgggcgataagaataagcggtatcaatgtgaatattgatgccgccaaacagttggagaaggagctggagctgtccaagcagaaggctgacagtgccaatcgggctaagagtgactttcttgccaacatgagccatgagataagaactccgatgaacgccattattggtatgtctcatcttgcgttagagacagatcttgatcgaaagcagcgaaactatatcgataaagtgaaccgttcagctgagtctttactggggattattaatgacattctcgatttttctaagatagaggcgggtaagttagatattgaaaagattgacttctctttggaggatgtccttgaagatgtcagcgatcttgtcggttttaaagcaaaagataaagggattgaactgctttttaatactgaatcctctttacccttctattttaacggtgatcctctgcgtttatcgcaagtgctcactaacttgagtaataatgcgattaagtttacggagcagggagaggtacagataaaggtgtacgctcactccatcaatgaaaccaatatagagctggcctttgagatctcagacacaggtattgggatgtcaaaagagcagcagttgaagctgtttaaggcattttcacaggctgactcatccacgacccgtaagcatggcggcacgggtttaggcttagtgatcagtcaaaacttggtcgagcttatggggggagttatcagctttgagagtgaggagggcgtgggaagttgtttcaagtttattctgcctttaacaccagcttcagcgcttgaaactcagagcttcgataaggtttcccttgaaaatattcatgtgcttgtcgtggatgataatgccaatgctagggagatctttgccaatatgttagaggggcatgggatctcatactcgttagcggcgaatggccagcaagcgatggcattacttgagcaggagggggcctcataccaagtggtgcttctagattggaagatgcctggcatgagtggtgtcgatacggctagggctatccaagagtcgtcgttaattacagaaaaacctaaagtgttaatggtaaccgcctatggtagagaggagttaatcaatctatcccaaggggtcaattttgctggagtgctaaccaagcctattacctcctcacacctgcttaataccatacttgagtccttaggtagggaggtcaataaacgcagtaagagctcggcgaaagagatgatgtaccgcgctgcgttaaagcagcttgcaggagcgcatatcttaattgccgaagataacgatttaaatagagagctgattgtcgacctgctctcaaataaccagatcacctccgtagtggctatgaatggacaggaggctatcgattgtctgctcaaggagtcatttgatggtgtgttaatggattgccagatgcccgtcatggatggatacacagcaacgaagaagataagagaagtagaggggttatcagctttgccaatcatagccatgacagctaacgcaatggctggagacagagaaaaggctattggttgtggcatgacagatcacatctcaaagccgataaacgttcaaaatacctttatcacaatggcgaactctattaagccgaaacacccagtgaaagttcaagatgaggtagcggataatgctcacaaggagctgggatgtgatatcgagatgctccagtttaatagtattgataccaagtctggcttagagcgaacacaaggggatggtgcgctgtaccgtaaagtgcttaagcgctttaacggctcaacagactcatttgaaagtgatttaatgcaggcattaacccagaccgatcttattgctgcagagagagttgtccataccctaaaaggggttgcaggcaccataggggcgacagatttggccattgaggctgcccaattagagtcttgtgttaagcagcgtagcgtcgctgacactgagatggtggcgcttaacgctcagcttgaaaaggtcaaagctcaattaaaagaggttagaagtgagctggctgattattttgatggcttcagtgaagcggtggcgagtcagccatcagaggataacttgtcagatgatgaagtgagagataagttgaacagattagataccatgttagagaactatgaggctgaagtgggagactttatcttcgatgaactatattttctaaaaggtgggagtttagataaagcgtttaatgagctgagtaagcagatagaaaactatgattttgaagctgcaagagctgtggttgcctcaatgttatcgtcactaaatgagaagctagattaa

SEQ ID NO: 1213 - DNA, 4647 bp, Desulfovibrio vulgaris  Miyazaki F
atgcccacccccccgggccccatgctgttccgccatctttccgtcttccagcggctgctcatctgcacgctgctcatcgtcgccttcagcatcgtcctcgggtacagcaccctgagcctgatgcgcgacatggccgaagacgccaacaccgtctaccggcacaccttcatcgccaccagcagtctgcagcaggccaaggaaagcgtggagcgcatgcgcgcggccatgcgcgagcagatcatcgaggtggacgaggccatcaaggccgagcaggtggccaccctgcggcgagaggaacgcctgttccacgactgcgtggaagccgtgcgcgccaatttccggggcgagccggccctcatagacgccttggcaagccactacgacgacttcctgtccatgcgtgaccgggccatgaccatgtccgaaaaccgcgaaatacaggaagcctggcggcttaccgaatcctcgccccagaacccggcggaccgtctgctgcacgccatcgacgacctgatgcacgcggcccgcgccacggcagaacatttcttccagtcctcggtggcggaaaaccggaccacacagctcaaggccattgcggcgtccggactgttctgcgccatggtcgtggccatcacctatcttgtcagctggagcatccggcggcgcctgctggccctgaccggctgcgtcaaggccctggccgacggcgacctcgacgtgcagatcccctacggcgaggaacgcaacgaaatgggggccatggcccgctcgctgcaagtgctgctgggcgtttcgcgccagatggaacagcagcgctggatcaaggcccagatgtccgagacggccaccacgctgcaacaggcgggcgacctggattccttcggccagcgactgtccgccgtggccgcacaggtatccggcgccccctacgcggcgctgtacgtgcccaacgacgacggcgtgcatctcgatctggtggcctcgctgggcggcatcgtcggcggcccacccgccagcatacccaagggcggcgggctggtgggtcgttgcgccgccacgcgcgcaccggtggagctcacgccgccggaaggggaaaccctgcgcttcgccaccgggctgggcgacgtgcaccccgcttcgttgcgggcctatccgctgctgctgggcgaacggttgctgggcgtgctggaactggccaccctggggccgctgcccccgcgcgccgccaccctgttcgaggacatgctgcccatggccgccctgtcgcaggaagtgctggagcgcaacctgcacacccgcagcctgctggaccagacccgcaggcaggcaacggaactggaggaaagccgcgaactgctgcgccgcagcgaggccttcttccgcgccgtgttcgaaacggcgggcatcggcatcgtcagcgagcgcaggggccttggcatcgaccgggccaatcccgccttcagcgacttcatcggcatcagtgaaccggaactgcgcgggcgcgaccttgaggatttctttcaccccgacgaccgcgaggcgctggaagccctgctgagccgcctggaccccgacaagctggaatacgccgtcccgcggcacggaaacccggaacgtgacgggctggacgccggcgagccggaccaggcccgctccaccatcacggtgcgggcagagcaccgctacctgcgccccgacggcgaggtgcgctgggccgacgtgcgttgtgcgctcatcggagacagggacatcaccccccgccgggtcaccctgatcaacgacatcaccgaactcaaggagcagcaggcggaactgaaggataccgaggcctggtaccggggcatcgtgcattcggccccggacgccatggtggtggtggacggagaagggcgcatcgtgctgtgcaacccgcagcttgaacggctgctgggttatgagatgggcgaacttaccggacatctggtcgaacagttcctgcccgaagaagtgcgtgaacgccacgtgaagctgcgcaacgacttcctggcctcgccgctacaggtcatcgggcatgagcgcgaggtgattggcgtgcgcaaggacggcacccgcctgccgctggaaatcagcctcagcaagctgcccccgtccgaccggcaccccatgagcgcctgcggcgccctgcgcgacatatccctgcgcaagcgatccgaggccgaactgcgccgggccaaggaaatggccgaagaagccacccggctcaaaagcgacttcctggccaacatgagccacgaaatccgcacccccatgaacgccataatcggcatggcccacctggccctgaagacggagctggacccgcgccaggccgactacgtgcgcaagatacgcgcctcgggccagcacctgctgggcatcctcaacgacatcctcgacttctccaagatcgaggcgggcaagctgacggtggagaacaccgagttcgaactggaaaccgtgctcgacaccgtggccaacctggtttcggaaaaggccgccaccaaggggctggaattcgtgctcgatgtggccgccaacgtgccccccgtgctgcggggcgacccgttgcgcctggggcagattctcatcaactacgccaacaacgcggtgaagttcaccgagcacggcgaaatcgtaattcatgtggaaacgctggaaacgggcgataccgacgtgctgctgcgctttgccgtgcgcgacacgggcatcggactcaccgacgagcagaaggcccggctgttcgtctcgttccagcaggcggacacgtccaccacccgcaagtacggcggcaccggccttggccttgccatcgccaagaagctggcggacctgatgggcggcggcgtgggcgtggacagcgtccccggcgggggcagcaccttctggttcacggcccggctgggcctgggctccggacggcgggccctgctgccgcgcatcgacctgcgcggtttgcgggtgctggtggtggacgacaacccccaggcccgcatggtgctggcccacatgctggaaggcatgaccttccgcccggtcatggcggacggcggcgagaccgcgctggacctgctgcgcgaagcccgggacgcggacacccccttcggcatggtcttcctggactggcagatgcccggcatggacgggctggagactgcccgcaacatccgcaccctggcgccggacctgcccgtggccatcgtcaccgctcacgggcgcgaagagattttcgccgcgtccgagggagtgggagtgtccgccgtgctggtgaagccggtgcagccgtccctgctgttcgacacggccatgcgtctgctgggcgcggtgcacccggctccgcgcgccgccgtgcccccgccggatacccgccccgccatgctcgacggcgtgcgcggctcgcgcgtgctgctggtggaggacaacgaactgaaccgcgaggtggccctggggctgctggccgaggccgggcttgtgcccgatgcggcggaagacggggcgcaggcggtgcgcatggtcatggagggtgactacgacctcgtgctgatggacgtgcagatgcccgtcatggacggatacgaggccacccgcatcatccgccgcagccgggaagccgacagcctacccatagtggccatgaccgccaacgccatgcggagcgaccgcgaggcgtgcctggcggcgggcatgaacgaccacgtggccaaacccatcgatccggacgaactgttcgcggccctgatccgctggctgccccgacggggcgaggcggagcggcagcaggatgccgcagacaccacagcccccggcacacagcccgccacgcaggcggacacgttgtccggcgcatcccccgacacgtcgcctgcctccggtcctgtcagacaacacggacaaaacgggcagggcaggcaaaacgggcagaacgacgccaggcacgtcctcgacccggaagcgggactgcgccgggtgctgggcaagcaggccacctaccacacattattgcggcgcttcgtttcccagcacgccgacgcggccacgcgcatcgccgggttcatccagtccggcgacggagcgggggccacgcgcgaggcgcacaccctgaaaggcgtggcgggcaccctgggcgcccgcgcggtacagtcccaggccgccgacctggaagcggcactgcgccacgcggcctcgcaagagcacacgacagaggtgctggcactgctgcgcatatcgctggacgaggcggtgcgggccatgcaccgcctgctggacgccacacggcccgacccgaatggcgccgcaccgggcaccgtgccggatgcccccgttcgacgcgatgccggatcaggtgacgcagcaggcgacgggcacgaagccggacaagacaccggaccggaaaggaacctggcagacagcgatctgtcccgcgcactgcccgaagggcttctcgaccagttggaaacgctcatcgaggaagacgacagcgaggccgtcgacctcttcaacacccactcggaagccctgcgcgccgctctggggcagcctctggtaaccggcatgggcgaggcgttgcgcgccttcgaattcgaaaccgccctggagatgctgcgctcggcccgcccaccgcacgacggctga

SEQ ID NO: 1214 - DNA, 2601 bp, Thioalkalivibrio HL EbGR7
gtgaacgatcccagacaacgcccgagcggctcgggccaggcctcgccgtcggcgctagccatgattcgccagcgcctggcctcccgtgccgacagtgaacaccagcaggcgctgctgcgcctggtcatcggcctggcggtgttcgtctatttccactcgcccctgttcgcggcggtggtggatccccccgccctggaatacgcccgtctgggcagcaccctgttcctggccttttccctgggaatcttcctggccatcctgctgtggccggaacccagtccctcgcggcgtctgctgggtctggcgggggacatgaccggcgcctccctgagcctgctgctgggtggcgaggccggcgcgccgatcctggcggtgtacctgtgggtcatcgtgggcaacggttttcgctacggcctgccctacctgtacgccgccacggtgatggccctggccgggtttgcggtggtgtttacgctcagtcccttctggtccacccacccggtgttcagcttcagcctgatgctggtgctgatcctggtgcccctgtataccgccaccctgctgcgcaccctcaagggcgccatcgaccgggccaacgaggccaaccaggccaagccccgtttcctggccaacatgagccacgagctgcgcaccccgctcaacggcgtgatcggcatgagcgacctgctcatggacacgccgctcaacgacgagcagcgcgacctgggtcgatccatccacacctccgcccgggtgctgctgggcctgatcgagaacatcctggacatctcgcgcatcgagtcaggcaagctcagcagtgagcgggaggatttcgacctgcatcgcctggtgcacggcaccctgggcatgttcgaggcccaggcccgcggcaagggtctgcacctgggcgcgcgcatcgaccccagcgtgccctttgccctgcatggcgacgccctgcacctgcgccaggtgctggtgaacctgatcggcaacgcgctgaagttcaccgaacggggccaggtggagctctccgtgcagctgctggaagcgcccgccgaggatgcggtgcgcctgcgcttcaaggtgcgcgacacgggcatcggcatcccggaggaggcccaggcgcgcatcttcgagagcttcgagcaggcggacaccaccgtcacccgtcgctatggcggcaccgggctcggcaccaccatcgcccggcagctggtgcagctgatgggcgggaccatgggcctggaaagccgcgtgggagagggcaccaccttctacttcgacctgcccctgggccggcaggcgatcccggaggaggcaagccacggcgcgctggcctcggaaggcagccgggtgctcatcctggccgaggacaagctcgccgccggtctcggcgaactgctcacgggctggggactggtgccggagtccgcggaaagcccgccccaggccctggcacgcctgttccacggcggcgagaacccgtctgagccccatgcggtggtgctggtccagcggcgcatgctgggcgccgatcccgcccatttcctgggcctgctgcgtcaggacgcgagcctgcgacgcctgcccctgatcctgctggatgagggcgcggcgggtccggcccaggacgtctggctgcgtgccggctattctgccgtgctgggggcgccgccggacaagaccctgctgttcaacgccctgcacgcggcacaaagtgcgacggagcccgcggaaaacgtggtctccctggccgaccattatcgcagccgtgccggcggtgtccgtgccctgcgcatcctggtggccgaggacaacacggtcaaccagcaggtcatctcgggcatcctcgagcgggccggccacaaggtgacggtggtcggcaacggcgaggcggcgctggacctgctgtccgcccgggcgcgggatttcgatctcatgatcctggacatgaacatgcccgtgatgggcgggctggatgtgctcaaggccaggggcttcatggccgaggaggccaggttgccggccatcgtgctgacggccgatgccaccacggaggccctggtggcctgccgcgaggcaggcgccgaggcctacctgaccaagccgctggacgcccggcgcctgctggacacggtggcggggctggccctgcagggcgccacgagacctgcaaccctggagacgcggcccgagccagccgcgccacaaactgcgacaaaggaggtcgatgtgctcaattcggaagtcctggacagcctggtgcgcctcggttcggggccggtgttcctgatggatctgctggatggtttccggcgtgatggcgagcaacagcttgccgacctgcgtcaggcggtcaccatgaacgattacccgcgcatgcgcgacgccctacatgccctcaagggcagcgccggggagatgggtggcgccctgctggtgcgcctgtgccaggcggcggaggggctcaagccctatgaactgggcacggacaagcccgccacctacgtgacccacatcgaacaggccttccgcgagacctgtgccggggtggacgcctacctgcgccgccggcgcggcgatgccgatgcgctgacctga

SEQ ID NO: 1215 - DNA, 3093 bp, Azotobacter vinelandii DJ
atggatctgcctggcaaaacgactggaacggatgccaagattcccggagcgaacgtgaaactcggaaagcccagcaccctcgcctccctgctcgccgtacttctgctgctgttctcctcgctgaacgccgtgcgtaccgtcctgctggcccaggagcgccgcgaagtcctgcaggcgctggcccacggcgtcggaagcccggccacgaccggggacgggcgcgatccggaggccttccaggccggggaggacatagcccgcggaaaggccctggagcgcctcgcggcccgtctggaacggctcgacggccaggtcgactccgccatgcgcatcgtcgcggccaccctgctgcccggcctgctgctggcggccttcgccctgcacggccgccaccggcggcgttcgccgcgcgaccagccgcgcacgcccccggagcaggccggcagcgacgagtcggaactccagcgggtgctgttcgacagcatccccttcccgctcttcgtcaaggaccgggaggcccgttacatccgcttcaaccgggccttcctgaacaacttccgggtccgcgccgaggaactgaccggcaagaccatcctggatttcctggaactgcccgccgaagaacgctcccgctaccaggccgccagcgagcggctgctgcgcgaaggcggcctgttcagcaccgaacggcgaatccgctatgccgacgggcgcgagcacccatccatctacaccctcgccggctaccccggcggcgacggccgtccggccgggctgctcggcatgctgatcgatatctcggcacagaaggcgtccgaacgggccctggccgaagccaaggagctggccgaggaggcgacgcgcatgaagtccgacttcctcgccaacatgagccacgagattcgcacgccgatgaacgtgatcatgggcatgacccagttggcgctggacagcgggctggacgagcgccagcgcaacttcgtcgaaaaggcccacgacgcggcccggagcctgctcggcatcatcaacgacatcctcgacttctcgaagatcgaggccggcaagatgcgtttcgagcaggtggacttccagctcgagagcgtgactgatcacctggccgacctgtccgtcctcaaggcccaggaaaagggcctggagctgctcttcgacatcgccaccgacgtgcccaccgcgctgatcggcgacccgctgcgcctcggccaggtgctgagcaacctgctcgataacgcgatcaagttcaccagccggggcgagatcactctgcgcatccgcaaggaatgcgaggacgaacggggcgtccggctgcgcttcgaggtgcgcgacaccggcatcggcctcaacgagacgcagcgccggaagctgttccgggccttcacccaggccgactcctcgacctcccgccagtacggcggaaccggtctcggcctggccatctgcaagcacctggtggccatgatggacggcgagatcggcgtcgactccagccccggggtcggcagcaccttccatttcgatgcccgcttcgagcggcaggcgaaccagcgcgaactgctggcggacagcgccgatctcctcggcatgcgcgtactggtggtggacgacaacgccagcgccctggaaatcttcgccggcatgctgagcgcgctgcgcttcgcggtgaccacggcggacaacgcgccgcaggcgatccggctgctggagcgggcccagcaggaggacaacccttaccgcctggtaatcatggactggctgatgccgggcatggacggcgtccaggcggtcggcgcgatccgcgccgccccgcggatcgccgagactccgctgttcgtgatggtcacctcgtacggccgcgacgagttgctcgaacgcctcggcaaagtccccgtggagggcctgctggtcaagccggtcactccttccagcctgctcgacggcatcctcgacgcctgcagtcgcaggatgaggaccgcgccgaacagccgaaaagcgctggaaagcgaggccgaacaggcccgggaggccctgcgcggtgtccatctgctgctggtcgaggacaacccggtcaaccaggaaatggccatggaactcctcgccaccgcggggattcgcgtggatgtcgccaacgacggcgccgaggccgtcggcaaggtcatggcgcatgcctacgacggcgtgctgatggactgccagatgccggtgatggatggcttcgaggccacccggcggattcgccgggcaggcctcgtcgacctgccgatcctggccatgaccgccagcaccatggctggtgaccgggaacgctgcctggccgccgggatgcacgcgtacatcgccaagcccatcgacgtcgcccagttgttcgtcaccctgcgccactgggtcgggagcgggcggccgctggccctaccggctcctctcgccatcggcgggagcgtgcccacagcgtcggcgaacaccgccctggagcgggccggagccttgcggcgcctgggcggcaaccgcgccctgctcgaccggctgctggcgcgtttcgcggcgacccaggccgacgccgccgcacggctcggcgccgccctcgcggccggcgaccgggaaggcgcccggcgtatcgcccataccctcaagggactggccggcaatatcggcgccacggagctggcgacccaggccgccaccctcgagcaatgcctcgggcagaaccggcagcctcccgccgaaaccctggacgatctggaaaggacgctcggcgccctgtgcgcatccatcgccgccccggccgccggcaatccggcacccatcgtggcggaaacgccgcaggagctgtccgcactcgacgaaggactccgaaccctggaggccttgttgcgcgacgacgatgccgacgccgtggcgcaactgcgcgccctgggcccccggctggccgcccgcggcctcggcgaacgggccggcgagctacaggccctggtcgcccgctatgacttcgaggccgccctggccagcctcgcggccatccgccggaacctcgctccgcgggacgccgaggcagccggcccgcagagaccgcgccgatga

SEQ ID NO: 1216 - DNA, 1677 bp, Brucella suis 1330
atggcccggtccaatactacggaattcgtctttctgccgctcggcggtgtaggcgaaatcggcatgaatttggccatgtatggttttggtcctgcggataaccgcgaatggctggtcgtggatatgggggtcagctttgccgggccggaacagccgggcgccgacctcattctgccggatattcgctatctcgaagctgaaaagcacaatctgcgcggcattgtcatcacccatgcgcatgaagatcattttggtgcgctgcttgatctttggccgcgcctgaaagttcccgtctatgcgacgccgttcacagctggtttgctggaagccaagcgccagtcggaagacagtgcgccggaaattccgatcacgatctataaggccggcgagacgtttgaagtcggcccgttcaagattgaagccgtcgctgtcacccattcgattccggagccggtttcgctggccatcaccacgccgcttggcacggtggtgcatacgggcgactggaaaatggatcccgagccatcgcttggccccgtcattgacgaagcgcgctttcgcgccataggtgaggccggtgttctggcgctgatctgcgactctaccaatgcgctgcgtgaaggtgagtccccatcggagcgccaggtgggtgaaagtctgcgcgaactgatccagaatgcgcgcggacgtgtggcgatcacaactttttcctccaatgtggggcgtatccgttcgatcacggaagctgcccgcgatgcgggccggcaggttctggtggtggggcgttcgatgaagcgcgccatctcggttgcaaccgaacttggttatatggaaggcctgccggaatatctcagcgaagaggattacggctatattccgcgtgaaaatgtggtgatgatcctgaccggcagtcagggcgaaccgcgcgcggcactggcgaaacttgcccgcgatgagatgcgcagcctcgccctgacggcgggtgatacggtcatctattcgtcgcgggccattcccggcaacgaaaaggccattctcgacatcaagaaccggctgatcgatcgcggtatcaagatcattggcgatgaggacgccctcgttcacgtttcaggccatccgcgccgcagtgagttgcgccgcatgtattcctgggttcgtccgcagattctcgtgccggtgcatggcgaggccgctcatctggtcgcgcaagggtctctgggtgcgatggagggcatcgagcagatcgcacaggtgcgtgacggcgacatgctgcgccttgcgcccggcaaggccgagatcattgacgaagcgccagtgggccgcctctacaaggacggcaagctgatcggcgacgaagaagaaatcggtatggtggagcggcgcaagctcgcctatgtcggccatgtcgcggtatcggttctgctcgaccgggagcacaagatgctggacgaacctgaccttgtggccttcggcctgcctgaggaggacaggcagggtgaactgatggaagacattctgctggatgcagccattgaggcgatcgacagcataccgcgcgttcgccgcaaggatattgagacggtgcgcgagtctgttcgccgcgccgtccgggctgcggcaaatgaagcctggggcaaaaagccggtagtgaccgtcttcgtgaataggatacggtaa

SEQ ID NO: 1217 - DNA, 1674 bp, Nitrobacter winogradskyi Nb-255
atgatagcgcggcctgatgagttgatgtttgccccgctcggcggtgtaggcgagatcggcatgaacctgtcgatctacgggctcggcaaccgtcaccagcgaagctggctggcggtcgatctcggcgtctccttcggcgacgaggaacatctgccgggcatcgatctgatcatgccggatatccggtttctcgaacaggaacgaaaaaatctcgtcggcctcgtgctgacgcacgcgcatgaggatcacttcggcgccatcatcgatttgtggccgcgcctgaaatgcccgatctacgcgacgaagttcagcgcggctttattcgaggccaaatgcgcggccgaacgcaatccgccggacatcccggtgactgtcgtgccctcggggggacgcattgaggttggtccctttggcgtcgaattcatcccggtggcgcattcgattccggagtcccatgcccttgcgatccatacggcggctggaatcgtcgtgcataccggcgactggaagatcgatccgacgcccatcatcgggccgccgaccgacgaacggcgcttgcgtgaactcggcgacgagggcgtgctggcgctgatcggagattccaccaacgcggtgcgggacgggcgctcgccgtccgaagccgaggttgcgcgaaccatcgcggatctggtgaaggcggcgaagggccgggtcgcggtgacgaccttcgcgtccaatgtcgggcggctgcgcgccgtggctgacgccgcgcgtgaagcggggcgcgaggtcgtggtggtcggccgcgcgatggcgcgcgtggtgcaggtggcgcgcgagaccggacatctgaacgggatgcaggattttcgcagtgccgatgtctatggccatcttccgcacgacaaggttctggcgctgtgcacgggcagccagggtgagccaagggcggcgctcgcccgcatcgcgagggatgatcatccggaggtcactctgaaccgtggcgacaccgtgatcttttcctcacgcaccattccgggtaacgagaaagccgtcggcgcgatcatcaacggtcttgtggcccagggcatcgaggtcatcaccgatcgcacccaactggttcatgtctccggccatccacgctgcgacgaactgcgggacatgatctcctgggttcgtccaggtctgctgatcccggtgcatggcgaggcgttgcatctttccgaacacgcgcggctggcgcgcgcttccggcgtgccgaaagtcctgatctgcaagaacggcgatctggtccggctcgggcccggagaaccaggcatcatcgatgaattgccgtcaggacggctttataaggatggcgccatcctggaggattcgaagtcgcgcgcggtcgtcgagcgtcggcgcatggcgtttgccggctgcgttttcgtcgcgatcgccgtcacggccaagggtgaactgatcgaggatcccgaagtcgatctcgtcggcattccggaaaagaacatggccggcgaggtgctcgacgacatcgttttcgacacggtggtctcgacggcgaaagggttctcgcggacgctgcggcgcgatcccgatgcgatggctgaatcattgcgccgcgctgtgcgggctgccgtcgcggaacagtggggcaagaagccactctgctatgttcacgttctggtgatctga

SEQ ID NO: 1218 - DNA, 1671 bp, Rhodopseudomonas palustris HaA2
atggcacgacccgacgatctggtttttgcaccgcttggcggtgtcggcgaaatcggcatgaatttgtcgatctacgggctcggcaaccgccagcagcggagctggcttgcggtcgatctcggcgtgtcgttcggcgacgaggagcatctgcccggcatcgatctgatcatgccggacatccgctttctcgagaaagagaagaagaacctcgttggcatcgtgctgacgcacgcccacgaggatcatttcggcgccatcatcgatctgtggccgaagctgcgctgtccgatctacgccaccaagttcagcgcctcgctgttcgccgccaagctcgcggccgagcgcaccacgctgaagatcccgatcaccgtggtgccgtccggcggccgcatcgacctcggcccgttcaacgtcgagttcatcccggtcgcccattcgattccggaatcgcacgcgctggcgatccgcacctcggcggggctggtgctgcacaccggcgactggaagatcgacccgactcccgtggtcgggccgccgaccgacgagaagcggctgcgcgaactcggcgacgagggcgtgctggcgctgatcggcgattccaccaacgcggtgcgcgacggccactcgccgtcggagaccgaagtgggggcgtcgctgaccggtctgatcaaggccgccaaaggccgcgtcgcagtcaccaccttcgcctccaatgtcgggcgcatgcgcgccgtcgccgacgccgcgaaggcggcgggccgggaagtggtgctggtcgggcgcgcgatggatcgcgtctcccaggtcgcgcgcgagtgtggttatttcgacggggtgcagggctttcgcggctccgaatattacgggcattttccgccggacaaggtgctggcgctgtgcaccggcagccagggcgagccccgcgcggcgctggcgcggattgcgcgcgacgatcaccccgacgtcacgctgaacaagggcgactgcgtgatcttctcctcccgcaccattccgggcaacgaaaaggcggtcggcagcatcatcaacgggctggtcaatcagggcatcgaggtgatcaccgaccgcgatcatctggtgcacgtctccggccatccgcggcgcgaggaattgcgcgagctgatctcgtgggtgcggccgcaattgctgattccggtgcacggagaagccctgcatctcaacgagcacgccaagctggcgcggcagatgggcgtgcccaaggtgctgacctgccgcaacggcgacctgatccggctcgggccgggcgatccggcgatcatcgaccaattgccggctggtcggctgtacaaggatgggaccatcctggaagaggaaaagtcgcgcgcggtcgccgagcgtcgcaagatggcgttcgccgggtgtgccttcgtggcgctggcgctgacgcaggcaggtgagatggtcgacgatccggaagtcgaattgatcggcgttccggaaaacaacagtgccggcgagccgcttgacgacatcgtgttcgacgccgtggtcgccaccgtcgagggcctgccgaaagcgcgccggcgcgatccggatgccgtggccgaatcggtgcgtcgcaccgtgcgctcgacggtgcaggcggagtggggcaagaagccgctgtgtttcgtgcacgtgctgaaggtttga

SEQ ID NO: 1219 - DNA, 1671 bp, Rhodopseudomonas palustris BisB18
atgacacgaccagatgaactcaccttcgcaccattggggggcgtcggtgagatcggcatgaacctttacctttacggcatcggcaaaggttcgcagcgcaagtggctcgcggtcgatctcggcgtgtcgttcggcgacgaagagcatctgcccggcatcgacctgatcatgccggacatccgcttcctggagaaggagcgcaagaacctggtcgggctagtgctgacccacgtccatgaggaccatttcggcgccatcctggatctgtggccgaaattgaaatgcccgatctacgccacccagttcagcgcggcgctgttccgggcgaaatgcgaggccgaacgcaatccgccgaagatcccggtcaccgtggtgccgtccggcggcaaggtcgacctcggcccgttcaacgtcgaattcattccggtggcgcattcgattccggaagctcatgcgctggcgatccgcacctcggtcggcgtggtgctgcacactggcgactggaagatcgacaagaccccgatcatcggcaagccgaccgacgagcgccgcttgcgcgagctcggcgacgagggcgtgctggcgctgatcggcgattccaccaacgcggtgcgcgagggcacttcgccgtcggagaccgaggtcgccaagaccctcgccgaactggtgaagaacgccaagggccgggtggcggtcaccacctttgcctccaacgtctcacggctgcgcgcggtggccgatgccgcccgcgcggtcggtcgcgaagtggtggtggttggccgcgccatggagcgcgtggtgcaggtggcgcgcgagtccggctatctcgacggcgtgcagaatttccgcggcgccgatctgtatgggcattttccgccggacaaggtgctggcgctgtgcaccggcagccagggcgagccgcgcgccgcattggcgcggatcgccaacgacgaccacccgcaggtcacgctgaacaagggcgactgcgtgatcttttcgtcgcgcaccatccccggcaacgagaagtcggtcggcggcatcatcaacgggctgatcaagcagggcatcgaggtgatcaccgaccgcacccatctggtgcacgtctccggccatccgcggcgcgacgaattgcgcgagatgatctcctgggtgcggccgcagctgctgatcccggtgcacggcgaagcgctgcatctgttcgaacacgccaagctggcgcgggcctgcggcgtgcccaaggtgctgacctgcgtcaacggcgatctggtgcggctcgggccgggcgatccggcgatcatcgaacagatcccgtcggggcggctgtacaaggacggcaacattctcgaagacgccaagtcgcgcgccgtggtcgagcgccgcaagatcgctttcgccggctgcgccttcgtggcgatcgcgctcgacgccaagggcgaactggccgacgaccccgaggtcgaactcgtcggcatcccggagaaaaacacggcgggcgagccgctcgacgatctggtgttcgagctggtgatctcgacggtggagacgctgcccaaggcgaagcggcgcgatcccgatgcggtcggtgaatcggtgcggcgcgcggtgcgttcggcgctcaacgagcagtggggcaagaagcctttgtgctacgttcacgtgctgacggtttga

SEQ ID NO: 1220 - DNA, 1671 bp, Rhodopseudomonas palustris BisB5
atggcgcggccggacgaacttacttttgcgcccttgggcggtgtcggcgaaattgggatgaatctgtcgatctacgggctcggcaaccgccatcagcggagctggctcgcggtcgatctcggcgtgtcgttcggcgacgaggaacacctgcccggcatcgatttgatcatgccggatgtccgttttctcgagaaggagaagaagaatctggtcgggctggtgctgacccacgcccacgaagaccatttcggcgccatcatcgacctgtggccgaagctgcgctgcccgatctatgcgacaaagttcagcgcggcgctgttcgccgccaagctcgcggccgagcgcaccacgctgaagatcccgatcaccgaggtgccgtccggcggtcgcatcgatctcgggccgttcaacatcgagttcatcccggtcgcgcattcgattccggaatcgcacgcgctggcgatccgcacctcggccggccttgtgctgcacaccggcgactggaagatcgacccgaccccggtggtcggcccgcccaccgacgaaaagcggctgcgcgaactcggcgacgagggcgtgctggcgctgatcggtgattccaccaatgcggtgcgcgacggacgttcgccgtcggagaccgaggtgggcgcgtcgctcaccggcttgatcaaggccgccaagggccgcgtcgcggtgacgaccttcgcctcgaatgtcggtcgcattcatgccgtcgcccaagccgctaaggcggctgggcgggaagtggtgctggtcggtcgcgcgatggaccgcgtctcgaacgtcgcgcgcgaatgcggctatctcgacggcattcagggtttccgcgggcccgaatattatggccatttcccgccggacaaggtgctggcgctgtgcaccggcagccagggcgagccgcgcgcggcgctggcgcggatcgcgcgcgacgatcatcccgagatcaccctgaacaagggcgactgcgtgatcttctcgtcgcgcaccattccgggcaacgagaaggcggtcggcagcatcatcaacgggctggtcaaccagggcatcgaggtgatcaccgaccgcgatcatctggtgcacgtctccggccatccgcgccgcgaagaactgcgcgagatgatctcctgggtgcggccgcaactgctgattccggtgcacggcgaggcgctgcatctcaacgagcacgccaagctggcgcggcagatgggtgtgcccaaggtgatggtctgccgcaacggcgatctggtccggcttgggccgggtgacccagcgatcattgaacaattgccgtcgggccggctctacaaggacggcgccatcctcgaagaggaaaagtcgcgcgcggtggtcgaacgtcgcaagatggcgttcgccggctgcgccttcgtgacgctggcattgacccaggccggcgagctggtcgacgatccagaagtcgaactgatcggcattccggaaaacaacagcgccggcgagccgctcgacgacatcgtgttcgacgccgtcgtgtcgacggtcgaagggttgccgaaggcgcgcaggcgcgatcccgatgcggtcgcggaatcggtgcggcgcacggtgcgctctgtggtgcagacggagtggggcaagaagccgttgtgcttcgtgcacgtgctgaaggtttag

SEQ ID NO: 1221 - DNA, 1674 bp, Nitrobacter hamburgensis X14
atgatagcgcggcccgatgaactgatgttcgctccgctcgggggtgtgggtgagatcggcatgaacctgtcgatctacgggctcggcaaccgccatcagcgaagctggctggcggtcgatctcggtgtgtccttcggcgacgaggaacatttgccgggcatcgatctcatcatgccggacgtccggtttctcgaaaaggaacggaagaacctggtcggtctcgtgctgacccacgcccatgaggatcacttcggcgcgattatcgagttatggccgcgcctgaaatgcccgatctacgccaccaaattcagcgccgcattgttcgaggccaaatgcgcggcggaacgcaatccgccggacatcccggtgaccgtggtgccctcgggtgaccgcatcgatctcggtccttttggtgtcgaatttgttccggtggcgcattcgattccggaatcccatgcgctggcgattcatacggcggcgggaatcgttgtgcataccggcgactggaagatcgatccgacccccatcgtcgggccgccgaccgacgagcggcgattgcgcgaacttggcgacgagggcgtgctggcgttgatcggcgattccaccaatgcggtgcgagacgggcgctcgccgtccgaaaccgaagttgccaaaaccattgcggaattggtgaaggcagccaggggccgggtcgcggtgacgacgttcgcttccaatgtcgggcggctgcgcgcggtggccgatgccgcgcgcgcggcgggacgcgaggtcgtggtcgtcggccgcgccatggagcgcgtggtgcaagtcgcgcgcgagaccggacatctggacgggatgcaggaattgcgcagcgccgacgtgtatggccatcttccgtcggacaaggtgttggcgctgtgcacgggcagccagggcgagccgcgggcggcgctcgcgcgtatcgccaaggatgatcatccgcaagtcacgctgaaccgtggcgataccgtgatcttttcctcacgcaccattcccggcaacgagagagctgtcggcgcgatcatcaatggtctggtgacccagggcatcaaggtcattaccgatcgcaccgaactggttcacgtgtccggccatccgcgccgcgacgaactgcgggacatgatcgcgtgggttcgcccgcagttgctgatcccggtgcacggcgaggcgttgcatctctccgaacatgcgcagttggcgcgcgccgcgggcgtgccgaaagtcctgatttgcaaaaacggcgatctggtccggcttgggcccggagaccctggcatcatcgatgaattgccgtcgggacggctttacaaggatggcgccattctcgaggattcaaagtcgcgcgcggttgtcgagcggcggcgcatggcatttgccggctgcgtgttcgtggcgatcgccgtcacggagaagggtgaactggctgatgatcccgagattgatctcgtcggtataccggagaagaatacggtcggcgaggtgatcgacgacattgttttcgatacgattgtctcgacggtgaaggcgttgccgcgaacacggcggcgcgatccggatgcgatggccgagtcattgcgccgcgccgtgcgggcagtggttgcggaagagtggggcaagaagccgctctgctacgttcacgttctgttgatctag

SEQ ID NO: 1222 - DNA, 1683 bp, Rhodospirillum rubrum ATCC 11170
atggctgacaattccccgcccgtgccgccccgtttcgaaaaaaacgccctttatttcgtgcctttgggcggcgccggcgagatcgggatgaacctcaatctctatgctcatcagggtaaatggctgatggtcgaccttggggtgaccttcggcaacgaaaccaccccgggcgtcgacatcatcctgcccgatccgtcgttcatcgaggaacgcaagggcgatctggtcggcctggtgctgacccatgcccatgaggaccacgtcggcgccgtggcctatctgtggccctatctggaatgcccggtctacgccacgccctttaccgccgagttcctgcgccacaagctgcgcgaggagggcatcgagcccgacgtgaaattgatcgagattccgctgggcggccgcttcaccgtcggccccttcgatatcgagatgatcaccaccacccattcgatccccgaacccaaccatctggcgatccgcaccacggccggaacggtgctgcacaccgccgattggaagttcgatcccgagccgctggtcggcccgccggccgacgaggcggccttgcggcgcctgggcgacgagggcgtgctggccatggtcggcgacagcaccaatatcttcaccgaaggccattccgcttccgaaggcgatgtccggcgctcgatgatcgatctgttcgcccgcttccagggccgcatcgccgttggctgcttcgcctcgaacatcgcgcgcatggaaaccatcgccctggccgccaaggccaatggccgcgaggtcgccctggtcgggcggtcgctgtggcggatgatggagacggcgcggacctgcggttatctcaagggctgcccggccttcctcggcgacgaggaggcggccaagctgccgcgagacaaggtggtgtacatctgcaccggcagccagggcgaaccgcgggcggcgctcaagcgtatcgccagcggtagccacccctatgtcagcctgtcggccggcgatgtggtgatcttctccagccgggtcattcccggcaatgagcgctcgatcctgcagctgcaaaaccagttggtcgagatgggcgtcaagctcatcacctcgcgcgacgccatggtccatgtctcgggccacccgggcgcggaagaggtgcgcagcctgtatggcatggtgcgtccgagcatcgccctgccggttcacggcgagttcctgcatcttgatcaccatgccgatgtcgcccgcgatctgggcgtcgcccatgtggtgcggatcaccaatggcgccgtcgtccgccttgacggcgcggaacccaccgtggtcggcaaggtgccctttggccgtttggcgctggatggcgatcggcttttgcagatcgattgcgagatcatccgcgatcgcaagcgcatgggctataacggctccgtcgccgtttcgctggcgatcgacgacaagggcaagctgctgggaacccccaagatcagcgcccgtggtctgcttgaccccgaagacgacgccgatgaggtcgccgatctgaccaaccgggtgcgcggcgccgtcaacgccgtccgccccgccgaccgcaaggacgacgccgccgtggccgaggcggtgcggctggcggtgcgccgggtcttccgtcaggggcagaaccgccgcccggtgaccgatattcacgttttgcgggtatga

SEQ ID NO: 1223 - DNA, 1668 bp, Mesorhizobium BNC1
gtggcgtccgacgaagcggaactggttttttgccctttgggtggtgtcggcgagatcggcatgaatttggccctctatggttacgggccgcgcgacaatcgcacctggatcatgatcgattgcggtgtgagctttccaggcgagaacctgccgggcgtcgatctcattcttccggatgtcagcttcatcgaggaccagcttgaaaatctcgcgggcataatcatcacccacgcgcatgaggaccattacggcgcgttgctggacctttggccgcgcctcaagaccaatgtgtggatgacgccgttcacggcaggccttctcgaggccaaacggcagggtgaggtgaacgcgccgaaagtgccggtgacgatctacaaggccggcgagaccttcaccgtcggccccttcgccatcgaggcgatcgccgtcgcccactcgatccccgagcctgtctctctcgccatcaccacgccggcgggaacggtgatccataccggcgactggaagatcgatcccgcgcccgaactcggccccaaaacggacgaggcacgcttccgcgccctgggagagaagggcgttctggcgctcatctgcgattccaccaatgccatgcgcgagggtgtttccccctcggagcaggatgtcggccgggggctgagggaggtgatcgagaaggcgccgggtcgcgtggccgttaccaccttctcctccaatgtcgggcgcatccgctcgatagccgaagcggcgcgcgatgcaggccggcaggtgctggtgctcgggcgctcgttgcaacgcgtcatcgatgtcgccgacgagctgggatatctggacggattgccacccttcctcgtcgaggaggatttcggttatatcccgcgcgagaacgcggtgatcctctgtaccggcagccagggcgaagcccgcgcggcattggcaaagcttgcgcgcgacgagatgcgcaatgtggcgctctcgccgggtgatacggtcatcttttcctcgcgcaccattccgggcaacgaaaaggcgatcctcaccatcaaaaaccagctgatcgaacaggggatcagggttgtcgaggatagcgacgcgctcgttcatgtttccggccatccgcgccgcaacgaattgaagcagatgtatgaatgggtaaggccgcgcatcctggtgcccgtccatggcgaggccgcccatctggttgcgcagggatcgctcggcgccatgtccggaatccccgaggtggcccaggtgaggaatggcggcatgctgcgcctggctccaggtccggccgaaatcatcgaccaggttccgtttggccgcatctaccgggacggcaaggtgattggcacggacgatgaagtgggcgtgcgcgacaggcgcaagctttcctttgccggccatgtggctgtcaatgtcgtgctcgatgaccgctatgatctggcgggcgatccagatctggtggcaatcggcctgccgcaggcggactctgcgggtgagccgatggaggatatcatgctggatgccgcggtgggagccgtgcgcagcatcccgcgcggcaaccgcagggaccttgatctcgtgggcgaggcggtgcggcgcgcggtgcgtgcggccgccagtgacgcctggggcaagaagccgatcgtgacggtctttgtcacccagtaa

SEQ ID NO: 1224 - DNA, 1671 bp, Maricaulis maris MCS10
gtgaccgatagcctctacttcctgccgcttggcggatccgatgaaatcggcatgaatctcaatctctacggctacgggccggagggaaaacaaaaatggatcatcgtcgattgcggggtcactttcggcgatctgacgacgccgggtgtcgacctgatcatgcctgatccgcgcttcatcgaagagcggcgcgacgacctgatcggcatggtgctgacccatgcgcacgaggatcacatgggcgctgttgcccatttgtggcgccgcctgcgctgtccgatctgggcgacccccttcaccgcctggctggtccgtgaccggctgcgtgagtacgggcttctcgacgaggtcgagctgcacgagatggcgctggattgccgctttgatctgggacccttcaacctgcaattggtgacgctgacccactccattcccgaacccaatggcatcgccatccgcacgccggccggaatggtgctgcacaccggcgactggaagatcgacccggcgccgatgattggcgaggcgactgatatcgacgcgctgaccgcaatcggcaatgaaggcgtgctggccatggtctgcgacagcacgaatgtgttctcgccgggcgagagcggttcggaaggcgatgtccgggaagagctgatcaaggtcgtcggcgagtgcaagaccggcaaggtggcgatcgcgtcgttcgcctccaatgtcgcgcgactgcaatcctccatcgaggccgccgaggccaatggccgccgcgtctgtctggtgggccgctcgatgcaccgcatgacggctgccgccaaggctgtcggcatgttgaagcatgtgaaggatttcgtcagcgaagaagaggcgtcgtccttcccggcctccaagattctctacctgtgcaccggatcacaaggtgagccgcgcgccgccctgtcacgcatcgcggcgggcaatcaccgcaatgtctcgctgagcagggacgacaccgtcattttctcgagccgtgtcattccgggcaatgagctgggaattttcgagctgcagaaccagctggccgagcgtggtgttcatatcatcaccgagaagacccggccgatccatgtctccggccatccctgccgcgacgagctggcgcagatgtatgcctgggccaagccgagtgtggccatccccgtgcacggcgagcgccgtcacctgctcgagcatgccgattttgcccgtgagctgcaggtgccgcattcggtctccgtgcgcaatggcgacatggtgcagatacgctccgacggcaccgcctcgattgtcgacgaggcgccggccagccggctgcatgttgatggcaatttcatcgtcgatgccgacgccgcctcgatgcgcgagcgccgcaagctggcccatgccggtcaggtgaccctgtcgatggcggtcagcgagaagggcgagattgtctcgggcccggaagtgcgcctgcagggtgtgccggaagacgacaacatgtccctcgatgatttcgccgacgccatggccgacgaggccgaacgtgccttcgaccgcctgtccaagcgcgaccgccgcgatgtcgagcgggccgaggaagaagtccgccgcgcggtccgccgcgaggccaaccgcatctggggcaagaagccctgggtcgagatcatgatgctggaagtctga

SEQ ID NO: 1225 - DNA, 1671 bp, Bradyrhizobium BTAi1
atggcgcgtcccgacgaactgacatttgctccgcttggcggggtcggcgagatcggcatgaatctgtcgatctacggcctcggcaaccgccaccagcgctcctggctcgcgatcgatctcggcgtctccttcggcgacgaggagcatctgccgggcatcgacctgatcatgcccgacgtggcgtttctcgagaaggaacgcaacaatctggtcgggctggttctgacgcacgcccatgaggaccatttcggcgccatcatcgatctgtggccgcggctgaaatgcccgatctacgcgaccaagttcagcgccgcgttgttcgaggcgaagtgcgaagccgagcggctgccggccaagatcccggtgacggtgatcccctcgggcggccgggtcgatatcggtccgttcaacgtcgagttcattccggtcgcgcattcgattccggaatcgcatgcgctcgccatccacaccgaggtcggcaccgtcctgcacaccggcgattggaagatcgatccgacgccggtgctgggcgcgccgactgacgagaagcggctgcgcgagctcggcgatgccgggctgctggcgttgatcggtgactccaccaacgccgtccgcgagggacgctcgccgtccgaggccgaagtcgccaagaccatcgcgatgctggtgaaggaagccaagggccgcgtcgcggtcaccaccttcgcctccaatgtcgcgcgcatccgtgccgtcgctgacgccgcacgcgaggccgagcgcgaggtcgtcatcgtcggccgcgccatggaacgcgtcgtccaagtcgcgcgcgagaccggctatctcgacggcgtgcagaattttcgcggcatggacctgtacggtcatttcccggccgacaaggtgctcgcgctgtgcaccggcagccagggcgaggcgcgcgcggcgctggcgcgcatcgccaatgacgaccatccgctggtgaccttgaacaagggcgacaccgtcatcttctcctcgcgcaccattcccggcaatgagaaggcggtcggcgccgtcatcaacgggctggtgcagcagggcatcgagatcatcaccgaccgcaaccatctcgtccacgtctccggccatccgcgccgcgacgagctgcgcgacatgatcgcctggacgcggccgcagctcctgattcccgttcatggcgaggcgctgcatctgcacgagcacgcgcggctggcgcgcgcctgcggcgtgccgaaggtgatcacctgccgcaatggcgacctcgtcaagcttggtccgggcgagcccgggatcatcgacgagctgccggcgggccgtctctacaaggacggcagcatcgtcgaggacgcgaaatcgcgtgccgtggtcgagcgtcgcaagatggcgtttgccggttgcatcttcgtggcgctggcgatcaccgagaagggcgaactggcggacgatcccgaagtcgacatggtcggcatccccgagaagaacgcggccggcgaggagatggacgacatcgtgttcgacgccgtggtctcgaccttcgaaggcctgccgcgggcgcggcggcgcgatccggatgcggcggcggaatcggtgcggcgggcggtgcgcgccgcggtcaacgagcaatggggcaagaagccgatctgcctcgttcacgtcctggaagtctga

SEQ ID NO: 1226 - DNA, 1677 bp, Brucella ovis
atggcccggtccaatactacggaattcgtctttctgccgctcggcggtgtaggcgaaatcggcatgaatttggccatgtatggttttggtcctgcggataaccgcgaatggctggtcgtggatatgggggtcagctttgccgggccggaacagccgggcgccgacctcattctgccggatattcgctatctcgaagctgaaaagcacaatctgcgcggcattgtcatcacccatgcgcatgaagatcattttggtgcgctgcttgatctttggccgcgcctgaaagttcccgtctatgcgacgccgttcacagctggtctgctggaagccaagcgccagtcggaagacagtgcgccggaaattccgatcacgatctataaggccggcgagacgtttgaagtcggcccgttcaagattgaagccgtcgctgtcacccattcgattccggagccggtttcgctggccatcaccacgccgcttggcacggtggtgcatacgggcgactggaaaatggatcccgagccatcgcttggccccgtcattgacgaagcgcgctttcgcgccataggtgaggccggtgttctggcgctgatctgcgactctaccaatgcgctgcgtgaaggtgagtccccatcggagcgccaggtgggtgaaagtctgcgcgaactgatccagaatgcgcgcggacgtgtggcgatcacaactttttcctccaatgtggggcgtatccgttcgatcacggaagctgcccgcgatgcgggccggcaggttctggtggtggggcgttcgatgaagcgcgccatctcggttgcaaccgaacttggttatatggaaggcctgccggaatatctcagcgaagaggattacggctatattccgcgtgaaaatgtggtgatgatcctgaccggcagtcagggcgaaccgcgcgcggcactggcgaaacttgcccgcgatgagatgcgcagcctcgccctgacggcgggtgatacggtcatctattcgtcgcgggccattcccggcaacgaaaaggccattctcgacatcaagaaccggctgatcgatcgcggtatcaagatcattggcgatgaggacgccctcgttcacgtttcaggccatccgcgccgcagtgagttgcgccgcatgtattcctgggttcgtccgcagattctcgtgccggtgcatggcgaggccgctcatctggtcgcgcaagggtctctgggtgcgatggagggcatcgagcagatcgcacaggtgcgtgacggcgacatgctgcgccttgcgcccggcaaggccgagatcattgacgaagcgccagtgggccgcctctacaaggacggcaagctgatcggcgacgaagaagaaatcggtatggtggagcggcgcaagctcgcctatgtcggccatgtcgcggtatcggttctgctcgaccgggagcacaagatgctggacgaacctgaccttgtggccttcggcctgcctgaggaggacaggcagggtgaactgatggaagacattctgctggatgcagccattgaggcgatcgacagcataccgcgcgttcgccgcaaggatattgagacggtgcgcgagtctgttcgccgcgccgtccgggctgcggcaaatgaagcctggggcaaaaagccggtagtgaccgtcttcgtgaataggatacggtaa

SEQ ID NO: 1227 - DNA, 1668 bp, Sinorhizobium medicae WSM419
atggcgcagaatgaagaattggtgttcctgccgcttggcggggtgggcgaaataggcatgaatcttggcctctacggctatggacggccgggcagccgccaatggatcatggtcgattgcggagtgactttccccggcccggatctgcccggggtcgatctggtcctgcctgacatcgcgtttctggccgaagaacgccgcaacctcaaggcgatcattatcacgcatgcgcatgaggatcattacggagccttgaacgatctgtggcccggcttgaacgttcccgtttacgcctcgccgttcaccgcgggcatgctggaggcaaagcgggcattcgaaaagtctcgcagcgaaatcccgattacgatcttcaagcagggcgaccgcataaatgtcggacccttcagcgtcgaagccgttggggtcaatcattcgatccctgagccgatggcgctcatcatccgcacgcagctcggtaccgttgtgcacacgggcgactggaagatcgacctcgagccttcgctcggccccttgaccgacgagaagcggcttcgtcagatcggtgaggaaggcgtactcgcgctcatctgcgattcgaccaatgccttgcgcgaaggcgtatcgccctccgaacggcaggtctccgaaagcctctccaagatcatcgccgacgccgagggccgggtcgggatcaccaccttctcctccaatgtcgggcgcatccgttcggttgcccaagcggcggaggccgcgggccgggaggtgctcctgctcggcagctcgatgaagcgcgtcgtcgacgttgcccgggacgtcgggctgatggaagggctgagaccatttctggccgaagacgagttcggctacatcccgcgcgacaaggtcgtggtcatcctgacgggcagccagggagagccgcgcgcggcgcttgccaagatcgcccgtgacgagatgcgcaacgtggccttctcggccggcgacacgatcgtcttttcctcgcgcacgatcccgggcaatgaaaaggcgatcaacgatatcaagaacgggctgatcgagcagggcattcacatcatcacggatagtgaggcgctcgtgcatgtgtccggtcacccgcggcgcaacgagctccagcagatgtaccaatgggtcaagccgcaaatcgtcgtgccggtgcatggcgaggccgcgcatctgacggcgcatgcggagcttgcactgcaatcgggcatcccgagcgtcccgagactgcgcaatggcgaaatgctacggctcgcgccgggaccggcggaagtcgtcgaccaagcacctcacgggcgcatctacaaggacggcaccctcatcggtgacttcgaagagatgggcatcggcgagcgccgcaagctctcttttgccggtcacgtctccgtcagtgtcgtgctcgacaaccgctacgacttcctgggcgatccggatgtcgtcccgatcgggctccccgaatatgatgacgagggagagtcgatggaggatacgctctatgatgcggttctcggagcggtggaaagcattccccgggcaaagcggaaggacctcgccatgctgcaggaagccgttcgccgcgccgtacgcagcaccgccaatcaggtctggggcaagaagccggtcgtcaccgtgtttgtcacgaaggtctga

SEQ ID NO: 1228 - DNA, 1677 bp, Ochrobactrum anthropi ATCC 49188
atggcccgatccaatactactgaactcgtctttctgccgcttggcggcgtaggcgaaatcggcatgaatttggccatgtatggcttcggtcctgcggataaccgtgaatggctggtcgtggatatgggggtgagctttgcggggcctgaacagccgggcgctgatctcatcctgccggatatccgctatctcgaggctgaaaagcacaatctgcgcggcatcgttatcacccatgcgcatgaagaccatttcggtgctttgctcgatctgtggccgcgcctgaaggttccggtttatgcgacgccattcaccgccggtctgcttgaagccaagcgacagtcggaacacggcgcgcccgagattccgatcacgatctacaaggcaggcgagaaattcgaagtcggcccgttcaaggtcgaggctgtcgcggtaacgcactctattcccgagccggtttctctggctatcacgacgccgctcggcacggtcgtgcatacgggtgactggaagatggacccggaaccatcgctcggaccggttatcgacgaggcgcgtttccgcgctatcggtgatgcaggcgttctggcgctgatctgcgattcgaccaatgctttgcgcgagggcgagtctccttcggaacgtcaggtgggcgagagcctgcgcgagttgattgaaaatgcgcgcggtcgtgtggccatcaccactttctcttccaatgttggtcgtatccggtcgattaccgaagcagcacgcgatgcgggccgtcaggtgctggtggttgggcgttcgatgaagcgcgccatctccgtcgccacagaacttggctatatggaaggcttgccggaatatctcagcgaagaggattacggctatattccacgcgaaaacgtggtgatgatccttaccggcagtcagggcgaaccgcgcgcggcactcgccaaactggcgcgtgacgaaatgcgcagcctcgcgctgacggcgggcgatacggtcatctattcatcgcgcgccattccgggcaatgaaaaatccattctcgacatcaagaaccgcctgattgatcgcggtattaagatcatcggtgatgaggatgcattggtccatgtgtcgggccatccacggcgcagcgaattgcgtcgcatgtattcctgggttcgtccgcaaattctggtgccggtgcatggcgaagccgctcatctggtcgcgcaaggttctcttggcgcgatggagggcatcgagcaggtcgcgcaggtgcgtgacggcgacatgctgcgtctggcacccggcaaggccgaaattatcgatgaagcgccggttggccggatttacaaggacggcaagctgatcggtgacgaggaagaaatcggcatggtcgagcgtcgcaagctcgcttatgtcggtcatgtcgccgtttcggtgctgctggaccgtgaacacaagatcatcgatgagcccgaccttgtgactttcggggtgccggaggaaaacgcacagggcgatctgttggaagacatcctgctggatgcagccatcgaggccatcgacagcattccgcgcgttcgccgcaaggatatcgagcttgtccgggagtccgtgcgccgtgccgttcgcgctgcggcaaatgaagcatggggcaaaaagccggtagtgaccgtattcgtgaataggatacggtag

SEQ ID NO: 1229 - DNA, 1704 bp, Parvibaculum lavamentivorans DS-1
atgagtatgtctgcttccgttgcctccccccatgcgcccggcgcgcatgatgagctgatctttctgccccttggcggctcgggcgagattgggatgaacctcaatctctatggctttggcccgccaaaggcgcgtcagtggatcatggtcgatctcggcgtgaccttcggcgacgaccgcacccccggtgtcgacgtcatcatgccggatcccgccttcattgtggagcgcaagaaagacctgctcggcatcgtgctgacccacgcccatgaggatcacataggcgccgtcgcgcatatctggccgcgtctgcgctgccccgtctacgccacgcccttcaccgccgccatggtgcgcggcaagctcatcgaggccggcatcgaaaacgaagtgccgatgcacatcatccccctcggtcaccgcttcgccctcggtcccttcgacatcgaactggtaacgctcacccattcgatcctggagccgaacgggctcgccatccgcacgccgctcggcctcgtcatgcatacgggcgactggaagatcgaccccgatcccgtcgccggcgacgacatggacatcgcccgcctgagcgaaatcggcgacgaaggcgtccgcgccatcgtctgcgactcgaccaacgtcttctcgcccggcacctccggctccgaggccgatgtcgcgtcgagcctcatagaactcatcaaatcctgcgagggcagggtggccgtcaccaccttcgcctccaatgtcgcccgtctcgaaagtatcgcccgcgccgccgaagcctgcgatcggcacgccgtgctggtcggccgctccatgtaccgcgtcgtcggcgccgcccgcgaatgcggttatctcaccggcctcgcgcccttcgtcagcgagcatgacgccgcttatcttccgcgagacaaggtgctgttcatctgcaccgggtcgcagggcgagccgcgtgccgcgcttgcccgcatcgccgaggacggtcatccccacatcgtgctggaggagggcgacaccgtcgtcttctcgtcccgcatcatccccggcaatgaaacctcgatcttcgacctgcagaacctgctggccgagcgcggcgtccgcgtcgtcaccgagaaggaccacttcgtccacgtctcgggccatccctgccgcgatgagctcgcccgcatgtatcaatggatcaggccggaagtcgccgtgccggttcatggcgaggcccgccacctcgcggaacatgccgtcctcgcgcgcgagcttcaggtgccggagcaggtggtcatccgcaacggcctcatggtccgcctggcgccgggcccggccgaaattgtcggcgaggtcccctcgggccgcatctatctcgatggcgatgtattgaccgagtccgatgagggcgcggtccgcgaaaggcgcaagctcgccttcgccggctccgtcttcgtcagcctggtgctggacggcaagggagaggtccgtggcgagccgcaggtccgcctcatgggcctgcccgaggaagatggcaacggcgtctccttcgaggaccgggcgctggatgcggtggaggacgccctcgaccgcctgccgaaaaagcgccgcggcgacgacgatgccgtagcggaattcctgcgccgcgccgtccgtggggatatccgccgctactggggcaaaaaggcccaggtcgccatcgccgtcatccgcatctga

SEQ ID NO: 1230 - DNA, 1671 bp, Xanthobacter autotrophicus Py2
atggcaccaaccgacgaactggtcttcgcccccctcggtggggtcggcgagatcggcatgaacctcggcctctacggctttggcccgcgcaaggcccgcacctggctcatcgtcgatctcggcatgagcttcgcgggcgaggaggcgccgggggtcgacctcgtcctgcccgacatccgcttcctggaggccgagaagaagcacatcgccggcctggtcctcacccatgcccacgaagaccatatcggcgcggtgctggacctctggccgcgcctgaagtgtcccatctacaccacccgcttcacggccgggctgctggaagccaagcgcgcgggcgagcctggcgcgccgtcccagctgccgatcaccgtggtgcgcagcggcgggaccgtggacatcggccccttcggggttgaattcatcccggtcgcccactcgatcccagacagccacgccctggcgatccgcactgccgcagggctggtggtccacaccggcgactggaagctggacccgaccccggtggtgggcctgcccacggatgtcgcccgactcaaggcgctgggcgacgagggcgtccgcgccatcatctgcgattccaccaacgccgtgcgcgacggcgtttcgccgtccgaggcggatgtggcggcctcgctccggaagattgtcggcaaggcgaagcaccgggtggcctttaccaccttctcctccaacgtggcgcgcatccgcggcatcgccgagtcggcctacgccaatggccgtgaggtggtggtggtgggccgtgcgctggagcgcgtcatcggcgtcgcccgcgagcagggcctgctggacggggtgcccgcgttccgcaccgccgaggcctatggctacctgccgcgtgagaaggtcgtggccatcctcaccggcagccagggcgagcagcgcgccgcgctgcgccgcatcgccgacgacgaccacccggagatcgctctgtcgcccggcgacctggtggtgttttcctcgcgcaccattcccggcaacgagaaggtggtgaaccacatcatcaacgccctcaccaaacggggcgttgaggtgctgaccgaccgcaaggcgctggtccatgtgtccggccatccgcgccggggcgagcttgcggaaatgtaccgcatggtacggccgcaggtgtcgatcccggttcacggcgaggcgctgcacctgcatgagcatgcccagctggcgaagagcctcggcgtgcccgaggtggtcaattgctatgacggcaacgtcatccgcctcgcccccggcccggcggagcgggtggacgacgtgcccttcggccgcctttacaaggacggccggctgctgatccccgatggcggccgctcgatcccggagcggcgcaagctctccttcgtgggtgcggtgtcggtcgccgtcgccgtggaccggcagggtgggcttgccggcgacccgtcggtggagatcaccggcgttccggagcggggggagggcggcatcgacatgcttgaccacgtgctcgacaccgtggtggcgacgctcgacaacctgcccaaggcccgccgccgcgatcctgatgcgctggcggaaaccctggagcgcgcggtgcgcagcgccgtgaacgcggtgtggggcaagaagccggtgtgccacgtccatatcctggaggtgtga

SEQ ID NO: 1231 - DNA, 1674 bp, Methylobacterium extorquens PA1
atgacgacacggcaggacgaactcgtcttcgtgccgctcggcggcgtgggcgagatcggcatgaatgcgggcctctacgggatcggacccgagaagcagcgcaaatggatcatggtcgattgcggaatgggctttgccggcgaagagggattgcccggcatcgacctgatgttccccgatctcaccttcatcgaggagcgcaagaaggaccttctcgcaatcttcatcacccacgcgcacgaggaccatatcggcgcgatctccgagctgtggccgcgcatcaaggcgccggtctacgccacgcgattcgccaagaacctgcttgagacccgccgtctctccgagcccggcgcgccgaaggtggatctccgcgagatcaagccgggccgtcgggtgaccgtcgggccgttcgagatcgaattcgtgccggtggcccattcgatcccggaatcgaacgcggtggcgatccgcaccgagcacggcctcgtgctccataccggcgactggaagctcgacgacaccccggtggccggcgactcgacgtcccccgaggcgttcacggctttgggcgacgagggcatcctcgcgctcatctgtgactccaccaacgtgctgcgcgagggccgctcgcccagcgagtccgaggtctccgcgaccctgcacaagctgatcgagaacgcgccccaccgcgtggcggtgacgaccttcgcctccaacgtcgcgcgtatccgggccgtggcggaagcggcgcaggcctgcgggcgtcaggtgatcgccgtcggccgcgccatggaccgggtgatcgatgtcgcccgcgagtgcggctacctcgacgggctgccggacttcctctcggccgagtcctactcccacatcccgcgcgacaaggtggtctgcctgctcacaggctcgcagggcgagccgcgggcggcgatgtcgcgggtctcgcgccacgatcatccggcgatctcgctcacggccggcgaccgggtgatcttctcgtcgcgcgccatccccggcaacgagcgcgatgtcggctcgatcatcaacgacctgatcgaggacggcatcgaggtcatcaccgaccgcaccgaactcgtccacgtctccggccatccccgccgcgaggagatggtgacgatgtattcctggacgcggccgaaggcggtcgttccggtgcacggcgaggcgctgcatctcgacgaacatgcgcgctttgcccgttcgcagggcgtcgagtcggtggtgaaggcccgcaacggtgcggtggtccgcctcgcgccgggcaagccggaggtggtcgagcacgtccgcgccgggcggctctacaaggacggcaacgtcctcatcgactccaaggaccgggcgatccccgagcggcgcaagctctcgcagaccggcatcgtctcggtggccatcgccatcgacgagcgcggtgaggtgatcggcgatccggcggtcgacatcatgggcctgcccaatcgcggccggaccggcgagccgctgctcgacaccgtggtcgatacggtcaaccgcaccctcaacggtctgccgcgcggcaagatgaaggattcggaggcggtcgagaacgcggtcgatcgcgccgtgcgctccgccgtcaacgaggcctggggcaagaagcccgcctgccacgtgcaggtggtggaggtgtga

SEQ ID NO: 1232 - DNA, 1674 bp, Methylobacterium radiotolerans JCM 2831
atggttaaaggacaggaggagctggtcttcctgccgctcggcggcgtgggcgagatcgggatgaacgcggcgctctacgggttcggcccggagaagggccggaagtggatcatggtcgattgcggcatgggcttcgccggcgaggagcagatgcccggcgtcgacctgatgttccccgacctctccttcatcgaggagcggcgcaaggatctgctggggatcttcatcacccacgcgcacgaggaccatatcggggcgatctcggaactgtggccccggctcaaggcgccggtctacgcgacccgcttcgccaagaacctgctggagacccggcgcctctccgagcccggcgccccgaaggtcgagctgcgggaggtgaagcccggccggcgcgtgaccgtcggcccgttcgagctcgagtacgtgccggtctcgcactccatcccggaatcgaacgccatcgccatccgcacggcggccggtctcgtcctccacaccggcgactggaagatcgacccgaccccggtggccggctccgtgacgtcgccggaggcgttcacggcgctcggggacgagggcgttctcgcgatcgtgtgcgactcgaccaacgtcgtgcgcgagggcttctcgccgagcgagaagaccgtcgccgagaccctgaagacgctgatcgcggacgcgccgcaccgggtcgcggtgacgaccttcgcgtcgaacgtggcccgcatccgcgcggtcgccgaggccgccgccgcctgcgggcgcgaggtcatcgcggtcgggcgcgccatggaccgggtgatcgacgtcgcccgcgagtgcggctacctcgacggcctgcccgagttccgccgctcggattcgtggaagagcctgccccgggagcgcgtcgtcgccctgctcaccggctcccagggcgagccgcgggcggcgctcgcccgcgtctcccgccgcgaccacccggatatcagcctcaccgccggcgaccaggtgatcttctcctcgcgcgccatcccgggcaacgagcgcgatgtcggatcgatcatcaacgacctgatcgagcagggcgtcgaggtgatcaccgaccgcaccgacctcgtccacgtctccggccacccgcgccgggacgagatggtcgagatgtaccggtggacccgcccgggcaccgcgatcccggtccacggcgaggccctgcacctcgacgagcatgcccgcttcgcccgggcgcagggcgtgcagaacgtggtcaaggcccgcaacggcagcctgatccgcctgagccccggcaagcccgaggtgatcgaccacgtgaaggccggccgcctgttcaaggacggcgacgtcctgatcgacgagaaggaccgggcgatcccggagcggcgcaagctgatgcaggccggcctggtctcggtggcgatcgccatcgacgaggacggcgtcgtgctcggcgagccggccgtggacatcatcggcctgccgaaccgcggccggtccggggagccgctgatcgagaccgtggtggacgcggtctcccgcaccctctcggggatgtcgcggggcaagctgaaggactcggagagcgtcgagaagacggtcgaccgggccgtgcgcaccgcggtcaacgaggtgtggggcaagaagccggcctgccacgtgcaggtggtggaggtgtga

SEQ ID NO: 1233 - DNA, 1674 bp, Methylobacterium populi BJ001
atgacgacacggcaggacgaactcgtcttcgtgccgctcggcggcgtgggcgagatcgggatgaacgcgggcctctacgggatcggaccggagaagcagcgcaagtggatcatggtcgattgcgggatggggtttgccggcgaggaaggcttgcccggcatcgatctgatgttccccgacctcaccttcatcgaggagcgcaagaaggaccttctcggcatcttcatcacccacgcgcacgaggaccatattggcgcgatctcggaactgtggccgcggatcaaggccccggtctacgccacgcggttcgccaagaacctgctggagacccgccgcctctccgagcccggcgcgccgaaggtcgatctgcgcgagatcaagccgggccggcgcgtgacggtcgggccgttcgagatcgagttcgtgccggtggcgcactcgatcccggaatcgaacgcggtggcgatccgcaccgagcacggtctcgtgctgcataccggtgactggaagctcgacgacacgccggtcgccggcgactcgacctcgcccgaggccttcaccgcgctcggcgacgagggcatcctggcgctcgtctgcgactcgaccaacgtgctgcgcgagggccgctcgccgagcgagaccgaggtctccgcaacgctgcgcaagctgatcgagaacgtgccccaccgcgtcgcggtgacgaccttcgcctccaacgtcgctcgcatccgtgccgtggcggaggccgcccaggcctgcggccggcaggtgatcgcggtcggacgcgccatggaccgggtgatcgatgtcgcccgcgagtgcggttatctcgacggtctgccggacttcctctcggccgattcctactcgcacctgccgcgcgacaaggtggtctgcttgctcaccggttcgcagggcgagccgcgggcggcgatgtcgcgggtctcgcgccacgaccatccggcgatctcgctgacggccggcgaccgggtgatcttctcctcgcgcgccattcccggcaacgagcgcgatgtcggcgctatcatcaacgacctgatcgaggacggcatcgaggtcatcaccgaccgcaccgaactcgtccacgtctccggccatccgcgccgggaggagatggtggcgatgtattcgtggacgcggccgaaggcggtggtgccggtccatggcgaggcgctgcacctcgacgagcacgcgcgcttcgcccgctcgcagggcgtcgagtcggtggtgaaggcccgcaacggcgcggtggtccgcctcgctccgggcaagccggaggtggtcgagcacgtccgcgccggccggctctacaaggacggcaacgtcctcatcgactccaaggaccgggcgatcccggagcggcgcaagctctcgcagaccggcatcgtctcggtggcgctcgccattgacgagcgcggcgagatggccggtgagccggcggtggacatcatgggcctgcccaatcgcgggcgcggcggcgagcccttgctcgacaccgtggtcgatacggtcaaccggacgatcaacggcctgtcgcgcggcaagatgaaggactcggaggccgtggagaacgcggtcgatcgcgccgtgcgctccgccgtcaatgaggcctggggcaagaagcccgcctgccacgtgcaggtggtggaggtgtga

SEQ ID NO: 1234 - DNA, 1671 bp, Rhodopseudomonas palustris TIE 1
atggcgcgtccggacgagtttacatttgcgccgctcggcggcgtcggcgagatcggcatgaacctgtcgatctatggccttggcactcgccatcagcggagctggctggcggtcgacctcggcgtgtcgttcggcgacgaggagcatctgcccggcattgatctgatcatgccggacgtccgctttctcgaaaaagagaagaagaacctggtcgggctggtgctgacgcacgcccacgaggaccatttcggcgcgatcatcgatctgtggccgaagctcggctgcccgatctacgccaccaagttcagcgcctcgctgttcgccgccaagctggcggccgaacgcaccacgctgaagatcccgatcaccgaagtgccgtcgggcggcacgattgatctcggcccgttcagcgtcgagttcatccccgtggcgcattcgattccggagagccatgcgctggcgatccgcacctcggtcggcaccgtgctgcacaccggcgattggaagatcgatccgacgcctgtggtcggaccgccgaccgacgaggcgcggctgcgtcagctcggcgacgaaggcgtgctggcgctgatcggcgactccaccaacgcggtgcgtgacggtcgctcgccgtcggaggccgaagtcgcagtctcgctcgccggcctgatcaaatccgccaagggccgcgtcgcggtgacgaccttcgcatccaatgtcggccgtatccgcgccgtcgccgatgcggcgaaggctgcggggcgcgaagtggttctggtcgggcgcgcgatggaccgcgtcgcgcaggtcgcgcgtgagaccgggcatctcgatggcgtgcagagcttccgcgggcccgaatattacgggcatttcccgcccgacaaggtgctggcgctgtgcaccggcagccagggtgagccgcgcgccgcactggcgcggatcgccaaggacgatcaccccgagatcaccctcaacaagggcgactgcgtgatcttctcgtcacgcaccattccgggcaacgagaaggcggtcggcagcatcatcaacgggctggtgacgcaaggcatcgaggtgatcaccgatcgcgatcatctcgtccacgtctccggccatccgcgtcgcgacgagctgcgcgagatgatctcctgggtgcggccgcaactgctgatcccggtgcacggcgaggcgctgcatctcaacgaacacgccaagctggcgcggcagatgggcgtgcccaaggtgatgacttgccgcaacggcaacctgatccgtctcgggccgggcgatccggcggtgatcgatcagctgccgtcgggccggctgtacaaggacggcaccatcctcgagcaggacacctcgcgcgccgtcgtcgagcgccgcaagatggcgtttgccggctgcgccttcgtggcgctggcgctgaccgagaccggcgaacttgctgacgacccggaggtcgatctggtcggcatgccggagaacaacaccgctggcgaaccgctcgaagacattgtgttcgatgcagtcgtctccaccgtcgaggggctgccgcgggcgcggcggcgcgatccggacgccgtcgcggaatcggtgcgacgcacggtccgctcgatcgtccaggcggaatggggcaagaaacctttgtgcacggtgcacgtgctgacggtttga

SEQ ID NO: 1235 - DNA, 1674 bp, Methylobacterium sp. 4-46
atgacgacgaagggagatgaactcgtcttcgtgccgctcggcggcgtcggcgagatcgggatgaatgcggccctgtacggctacggcccgcccaattcccgcaagtggatcatggtcgattgcggcatgggcttcgcgagcgaggagcacatgcccggcgtcgacctgatgtacccggacctgagcttcatcgagaagcagcgcgagaacctgctcggcatcctgatcacccacggccacgaggaccatatcggggcgctggtcgaactctggccgcggctgaaggtgccggtctacgcgacgcggttcacgaagagcctgatcgagacccgccggctcagcgagcccggggcgccgaagatcgacctgcgcgagatccaggtgcacgagcgccaccgcttcggtccgttcgagatcgagtacatcccggtcgcccactcgatccccgaggcgaacgcgctggccatccgcaccgcccagggcctcgtcctgcataccggcgactggaagctcgacgacgggcccgtcgccggcaacgtgacctccgaggaggcgttcacgcagctcggcgaggagggcgtgctcgccctgatctgcgattccaccaacgtgacccgggagggccgctcgccgagcgagaccgaggtggcggcccagctcgccgagctgatccggaacgcgccgcaccgggtcgcggtgaccaccttcgcgtcgaacgtcgcccgcatccgcgccgtcgccgaggccgccaaggcctgcggccgcgaggtggtggcggtcggccgcgccatggaccgggtcatcgacgtcgcccgggaatgcggctacctcgacgggctcgacgagttccgcgagcccgaggcctacggctacctgccgcgcgagaagatcgtcgccctgctcaccggctcgcagggcgagccgcgggcggcgctggcgcgcgtctcccgcgaggagcacccggagatcgccctctcgccgggcgaccgggtcatcttctcctcgcgggcgattccgggcaacgagcgctcgatcggcgcgatcatcaacgacctgatcgatgccggggtcgaggtgatcaccgaccgcacggagctcgtccacgtctcgggtcatccgcgccgggacgaactcgccgccatgtatcgctggaccaagccgcgcatcgcggtgccggtccacggcgagcccctgcacctcgccgagcacgcgaccttcgcccgcaagcagggcgtggagcaggtggtgaaggcccgcaacggcaccctgatccgcctcgccccgggcgagcccgagatcatcgaccacgtcacccgcgggcgcctctacaaggacggcatggtgctgatcggcgagagcgaccgcgccctgccggagcggcgcaagctctccttcacgggcatcatctcggtcgcgctggccgtcgaccagcacggggagatgaagggcgagccggccatcgacctgatgggcctgccgacctacggccgcaagggcgaggcgatcatcgacctcgtcgaggaggtggtcgagcgcaccttcgacggcctgtcgcgccagaagcggcgcgattccgaggcggtcgagaacgccatcgaccgggccatccgggccgccgtcaacgaggtctggggcaagaagcccgcctgccacgttcaggtggtcgagatctga

SEQ ID NO: 1236 - DNA, 1671 bp, Rhizobium leguminosarum bv  trifolii WSM2304
atggcgaaacaggacgagttggtattcctgcctctgggcggcgttggcgagatcggcatgaatctcgctctttatggctacggcccgcccgagcatcgccaatggatcatggtcgattgcggcgtcacctttcccggccccgacctgccgggcgtcgacctcgtgctgcccgatatccgcttcctcgccagtgagcgcaagaacctcaaggcgatcatcatcacccatgcgcatgaagaccattatggcgcgctcgccgatctctggccgggcctgaatgtgccggtctatgcctcgggctttaccgctggtctgctcgaagccaagcgcaatttcgaaaaggccaggatcggcgaagtgccggtgacgccgttcaaggcaggcgacacgatcaatatcggccccttcagcatcgaaggcgtggccgtcaaccattcgatccccgagccgatgtcgctgatgatccgcacgccggtcggcaacgtcatccataccggcgactggaagatcgaccacgagccctcgctcggcccgttgaccgatgagacgcggttccgccagctcggcgacgagggcgttctggcgctgatgtgcgattctaccaatgcgctgcgtgacggtgtttcgccctccgaaaaggatgtctcggaaagcctgcgcaagatcatcgaggatgccgagggccgggttgcgatcaccaccttctcgtcgaatgtcggacgcatccgcaccgttgccgaagccgccgaggcggctggccgcgaagtgctgctgctcggcagctcgctgaagcgggtcgtcgacgtcgcccaggatatcggcctgatggagggcgtaaaacccttcatctccgaggaggaatacggctacatcccgcgcgacaaggtcgtcgtcatcctgaccggcagccagggcgaggcgcgggcagcgcttgccaagctctcccgcgacgagatgcgcaatgttgcctttgcggcaggcgatatcgtcgtcttttcctcccgcgccattcccggcaacgagaaggcgatccaggacatcaagaacggcctcgtcgagcagggcgtgcacatcatcaccgataccgaggccctggttcacgtttccggccatcctcgccgcaacgagctgcagcggatgtacgagtggacgcggccgaagatcgtcgtgccggtgcatggtgaggcgacccatctgacggcgcataaggaacttgccgagcaatccggcatcgccctggtgccgcgcgtgcgcaacggcgatattctgcggctggcgcccggtccagccgaggtgatcggccaggcgccgcatggccgcatctacaaggacggctcgttgatcggcgattttgacgagatggggatcggcgagcgcaagaagctctcctatgtcggccatgtcgcggtcagcgtcgtgctcgacgcccgctatgacatcgtcggtgatcccgatctcgtttcgatcggcctgcctgtttatgacgacgagggcgaagagatggaagatacgctcttcgatgcggcgatcagcgccatcgaaagcattccgcgcgcccgtcgcaaggatatcgacatggtgcaggaggccgtgcgccgcgccatccgcgccgcggcaaaccatgcctggggcaagaagccggttgtcaccgccttcgtcaccaaggtctga

SEQ ID NO: 1237 - DNA, 1671 bp, Methylocella silvestris BL2
atgaatgcggcaaatgacgagctcgtcttcgcgccgcttggagggttgggcgagatcggcatgaatctcgccctctatggcttcggccccaagggccggatgaaatggctgatggtcgactgcggcatcgccttcgcgggccccgagcatgctggcatcgacatcatcattccggacgtctccttcatcgagaagatgcgcgaggatctggtcgggctggtcatcacccatgcccatgaggaccatatcggcgccgtcgccgacatctggccgaagcttggctgtcccctttatgcgacgcgcttcgccgcccaattgctgcggacgaagcggctgtcggagccaggcgcgcccgaggtgccgatcgagatcgtgccccagggcggacatatcaaggtcggccccttcgccgtcgaattcatcgccatggcgcattcgatcccggaaagctgcgcgctggcgatccggacgccgctcgggacggtgattcattccggcgattggaagatcgacgccgagccgggccttggcgcgccgacggacgcacggcggctctcggagatcggcgacgaaggcgtgctggcgcttgtctgcgattcgaccaacatcctgcgcgagggcatcagcccctcggaaggcgaggtcgccagaaccttgcgcgaagtgatcgcgggcacaaccggccgcgtcgtcgtgaccaccttcgcttccaatgtcgcgcgcatccgcgccgtggcgctcgccgccgctgcggccggccgcagcgtcgtcctcgccgggcgcgccatggagcgggtcgtcgcggtcgcgcgcgactgcggctacctcgatggcgtgcccgatttcttcgggatcgacgccttcgcccatctgccgcgcgaccgggtggcgctgatcgcgaccggaagccagggcgaaccgcgcgccgccatcgcccgcatatccgaaggcgagcatccggcgatctcgctcaccgccggcgacaaggtgattttttcctcgcggacgatccccggcaatgagcgagaggtcgggcgcatcatcaataatttcatccgctccggcattgagatcgtcaccgaccgcaacgcgctggtgcacgcctccggccatccgcgccgcggcgaggtgtcggagctttacgcctgggtccggccgcagatcgcaatcccggcgcatggcgaggatctccatctcgccgaacatgcgattttcgcgcgggcgatgggcgtgcctcacgtcattccggcgcgtaatggcgacatcgtcgcgctggcccccggacaagcggcgatcgtcggcgaggcgccgtccggccggttgctcaaggacggcaatatattcgtctccgcgaccgacgaggcgccgcggatgcgccagaaactcgccgcctcgggcattatcaccatcgcccttgcggtgacggcgaagggcgatctcgccggcgtgccggatgtgatgaccgccggcattccgacgcgcgggcatggcggcgccccaatggacgccatcgtcgatgacgccatgttccagaccttcgatcatctgccgcggcaaaagcggcgcgacgccgacgtcgtttcgagcgcgatcgaaaaggccgtgcgcaacgcggtcgcccaggcttggggcaagcgtccgtcggtgcatgtgctcgtcgtcgaaatatga

SEQ ID NO: 1238 - DNA, 1674 bp, Methylobacterium chloromethanicum CM4
atgacgacacggcaggacgaactcgtcttcgtgccgctcggcggcgtgggcgagatcggcatgaatgcgggcctctacgggatcggacccgagaagcagcgcaaatggatcatggtcgattgcggaatgggctttgccggcgaggagggattgcccggcatcgacctgatgttccccgatctcaccttcatcgaggagcgcaagaaggaccttctcgcaatcttcatcacccacgcgcacgaggaccatatcggcgcgatctccgagctgtggccgcgcatcaaggcgccggtctacgccacgcggtttgccaagaacctgctcgagacccgccgtctctccgagcccggcgcgccgaaggtggatctccgcgagatcaagccgggccgtcgggtgaccgtcgggccgttcgagatcgagttcgtgccggtggcccactcgatcccggaatcgaacgcggtggcgatccgcaccgagcacggcctcgtgctccataccggcgactggaagctcgacgacaccccggtggccggcgactcgacgtcccccgaggcgttcacggctttgggcgacgagggcatcctcgcgctcatctgtgattccaccaacgtgctgcgcgagggccgctcgccgagcgagtccgaggtctccgcgaccctgcacaagctgatcgagaacgcgccccaccgcgtggcggtgacgaccttcgcctccaacgtcgcgcgtatccgggtggtggcggaagcggcgcaggcctgcggacgtcaggtgatcgccgtcggccgcgccatggaccgggtgatcgatgtcgcccgcgagtgcggctacctcgacgggctgccggatttcctctcggccgagtcctactcccacatcccgcgcgacaaggtggtctgcctgctcaccggctcgcagggtgagccgcgggcggcgatgtcgcgggtgtcgcgccacgaccatccggcgatctcgctcacggccggcgaccgggtgatcttctcgtcgcgcgccattcccggcaacgagcgcgatgtcggctccatcatcaacgacctgatcgaggacggcatcgaggtcatcaccgaccgcaccgaactcgtccacgtctccggccatccccgccgcgaggagatggtgacgatgtattcctggacgcggccgaaggcggtcgttccggtgcacggcgaggcactgcatctcgatgagcatgcgcgctttgcccgttcgcagggcgtcgagtcggtggtgaaggcccgcaacggcgcggtggttcgcctcgcgccgggcaagccggaggtggtcgagcacgtccgcgccgggcggctctacaaggacggcaacgtcctcatcgactccaaggaccgggcgatccccgagcggcgcaagctctcgcagaccggcatcgtctcggtggccatcgccatcgatgagcgcggtgaggtgatcggcgatccggcggtcgacatcatgggcctgcccaatcgtggccggaccggcgagccgctgctcgacaccgtggtcgatacggtcaaccgcaccctcaacggtctgccgcgcggcaagatgaaggattcggaggcggtcgagaacgcggtcgatcgcgccgtgcgctccgccgtcaacgaggcctggggcaagaagcccgcctgccacgtgcaggtggtggaggtgtga

SEQ ID NO: 1239 - DNA, 1671 bp, Methylobacterium nodulans ORS 2060
atggcgaagggagatgaactcgtcttcgtgccgctcggcggcgtcggcgagatcgggatgaatgcagcgctctacggattcggtccgccgacggcgcgcaaatggatcatggtcgattgcggcatgggcttcgcgagcgaggagcacatgccgggcgtcgacctgatgtatccggacctgagcttcatcgagcaacagcgcgagaacctgctcggcatcctgatcacccacggtcacgaggaccatatcggcgcgctagtcgagctgtggccccgcctgaaggtgccggtctacgcgacgggcttcaccaagagcctgatcgagacgcgtcgcctcggcgagccgggcgcgccgaagatcgacctgcgcgaggtcaggccgaacgagcgcatgagcttcggtcccttcgaggtcgagtatgtcccggtggcgcactcgatccccgaggcgaacgcgctggcgatccgcaccgcgcacggcctcgtggtgcatacgggcgactggaagctcgacgacgcgccggtcgtcggcaacgtcacctcggaggaggtgttcacccgcctcggcgaggagggcgtgctggcgctggtctgcgattcgaccaacgtcacccgcgagggccgctcgccgagcgaggccgaggtcgcggcccatctggcggagctcatccgctcggcgccgcaccgggtcgccgtcaccaccttcgcgtcgaacgtcgcccgcatccgggcggtggcggatgccgcgcaggcctgcgggcgcgaggtcgtggcggtcgggcgcgccatggaccgcgtcatcgatgtcgcgcgcgaatgcggctatctcgacggcctgcccgagttccgcgaacccgaggcctatggctatctgccgcgcgagaaggtggtggccctgctcaccggctcgcagggcgagccgcgcgcggctttgtcccgcgtctcccgcgacgagcatccggagatcgccctgtctcccggcgaccgggtgatcttctcgtcgcgggcgatccccggcaacgagcgcgcgatcggggccatcatcaacgacctggtcgaggccggggtcgaggtcgtcaccgaccgtacggaacttgtccacgtctcgggccatccgcgccgggacgaactcgccgccatgtatcgctggacgaagccgcgcatcgccgtgccggtgcatggcgagccgctgcacctcgccgagcacgccaccttcgcgcgcaagcagggcgtcgaggacgtggtgaaggcccgcaacggcaccctgatccgcctcgcgccgggcgcgcctcagatcatcgaccatgtcagccacgggcgcctctacaaggacggcatggtgctgatcaccgagacggaccgggcgctgcccgagcgccgcaagctctccttcacggggatcatctcggtggcgatcgccatcgatcagcatggggagatgaagggcgagccggcgatcgacctcatgggcctgccgacctacggccggaacggcgaggcgatcatcgacatcgtcgaggacgtggtggagcggaccttcggcgggttgtcgcgccagaagcggcgcgattccgaggccgtcgagaacgccgtcgaccgcgcgatccgcgcggccgtcaacgaggtctggggcaagaagcccgcctgccacgtccaggtggtggagatctga

SEQ ID NO: 1240 - DNA, 1668 bp, Agrobacterium vitis S4
atgacaaagacagacgaactggtatttctgccgctgggcggcgtaggtgaaatcggcatgaacctggcgctttacggctttggcccgccgaagaaccgggaatggatcatggtggattgcggtgtgaccttccctggtcccgatctgcctggtgtggatctggtgctgccggacatccgcttcgttctctcgcagaaaaacaggctcaaggcgatcttcatcacccacgcgcatgaagatcattatggtgggctaaacgatatctggccgggcctgaatgtgccggtctatgcctcgggttttaccgctggcatgttggaagccaagcggaattatgagggaacccgggctgaaattccggtaacgcccttcaagccaggcgacaaggtccatgtcggcccctttgttgtcgaggcttcggacgtcaaccattccattcccgagccgatgtcgctgattattcgcacaccgcttggcaatgtcatccatactggagactggaagattgaccatgcgccgtcgcttggcccgctgaccgatgaggcgcggttccgcgctcttggtgacgagggcgttctggcggtgatgtgcgatagcaccaacgcgatgcgggagggcgtttcgccctccgagcaggaagtctcggaaggattgcgcaagatcatccaaacagcagaggggcgcgtggcgatcaccacgttttcctccaatgtcggacgtatccgctcgattgccaaggcagccgaggcagcaggccgcgaagtcctgctgttgggcagctccctgaagcgggtcgtcggtgtggcgcgcgatgtcgggctgatggaaggcgtgcagccctttatcgccgaggacgaatatgggtacattccccgcgataaggtcgtggtgatcctgacaggtagccaaggtgagtcgcgcgcggcgcttgccaagctatcgcgcgatgaaatgcgcaacgtggcgctgaccaaaggcgacacagttgttttttcgtctcgcgctattcccggcaatgaaaagccaatcaacgatatcaagaatggcctgatcgagcagggcgtcaccatcgttaccgatagcgacgcgctggtgcatgtctccggtcacccacgccgcaacgaacttttgcagatgtaccaatggacgcgcccgcaaattcttgtccctgttcatggcgaggcggcccatctaacggcgcagcagaaactggctctggaggcggggattgcgcaggtgccgaaagtccgcaatggcgacatcctgcggttggcgcctggtcctgccgaagtcatcggtgaagcgccgtatggcagagtcttcaaggacggcaagctgctgggcgatttcgagcagatgggcattggtgagcggcgtaagctgtcttttgcaggccatgtgtctgtcagcgttctcctggacgaacgctttgagttccgcgacgatccggaagtggttgcccatggcctgccagcggaagatctggaaggtgatgacatggaggacattctctatgacgccgtgctgagcgccgtcgagagcattccgcgcactcggcgcaaggatcttggcgctttgcgtgaaagtatccgtcgtgctgtgcgctctacggccaacgagtgctggggcaagaagccggtcgttacggtttttgtgaccaaggtctga

SEQ ID NO: 1241 - DNA, 1671 bp, Rhizobium leguminosarum bv  trifolii WSM1325
atggcgaaacaggacgaactggtattcctgcctctgggcggtgtcggtgagattggcatgaatctcgctctctacggctacggcccgcccgagcatcgccagtggatcatggtcgattgtggcgtcacttttcctgggcctgacctgccgggcgtcgacctcgtattgcccgatatccgcttcctcgccagcgaacgaaagaacctcaaggcgatcattatcacccatgcgcatgaagaccactatggtgcgctcgccgacctctggcccggcctcaacgtgccggtctatgcctctggttttacatcaggtctgcttgaagccaagcgtaatttcgagaagtctaagatcggcgaagtgccggtgacgccgttcaaggccggcgatacgattaatgtcggccccttcagcatcgaaggtgtggccgtcaaccattcgatccccgagccgatgtcgttgatgatccgcacgccggtcggcaatgtcatccataccggcgactggaagatcgaccacgagccttcgctcgggccgctgaccgacgagacacgtttccgccagctcggcgatgagggcgtgctagcgctgatgtgcgattccaccaatgcgctgcgcgacggtgtttcgccctccgagaaggatgtgtcggaaagcctgcgcaagatcatcgagaatgccgagggccgggtggcgatcaccaccttctcgtcgaatgtcgggcgtatccgcaccgttgccgaagctgccgaggcggcaggccgcgaagtgctgctgctcggtagttcgctgaagcgcgtcgtcaacgtcgcccaggatatcggcctgatggaaggcgtgaagcccttcatctccgaggacgaatacggctacatcccgcgcgacaaggtcgtcgtcatcctgaccggcagccagggcgaggcgcgggctgcccttgccaagctctcgcgcgacgagatgcgcaatgtggcgtttgcggcaggcgatatcgtcgtcttttcctcgcgcgccattcccggcaacgagaaggcgatccaggacatcaagaacggcctcgtcgagcagggtgtgcacatcatcacggataccgaggcgctggtccacgtttccggtcatccgcgccgcaacgagttgcagcggatgtatgagtggacgcggccgaagatcgtcgtgccggtgcatggcgaggcaacacatctgacggcgcataaggaacttgccgagcaatccggcatcgcactggtgccgcgagtgcgcaacggcgatatcctacggttggcgccgggtcccgtcgaggtgatcggcgaggcgccgcatggccggatttataaggacggcacgctgatcggcgatttcgacgagatgggcatcggcgagcgcaagaagctctcctatgtcggccatgtcgcggtcaacgtcgtgctcgacgcccgctatgacatcgtcggcgaacccgacctcatttcgatcggcctgccgacctacgatgacgagggcgaggatatggaggatacgctcttcgacgcggcggtcagcgccatcgagagcattccgcgcgcccgccgcaaggatatcgacatgctgcaggaggccgtgcgccgcgccatccgctcggccgcgaacaacacctggggcaagaaacctcttgtcaccgccttcgtcaccaaggtctga

SEQ ID NO: 1242 - DNA, 1146 bp, Prochlorococcus marinus NATL2A
atggagcaaagccagaatgaagcaaatttaagttctgaagaaattgacaggtatgcaagacatataagtctcccagagataggtatcaaaggccaagaaaaattgaagacaagctcagttgcttgcattgggacaggagggctgggatctccactcttaatttatcttgcagcagctggaattggacgtatcggaataattgattttgatgtcgttgaatactcaaatttacaaagacaaatcattcatacaacagattcaataggtctattaaaaacagattcggccaaacagcatatacgcaaaataaatccttcttgtcgagttgatttattcaatcaaaagctaacaagtagtaatgctttggaaatacttaaagcttatgatgtgatatgtgattgttcagacaatttcccaacgcgttacctgattaatgatgcttgtctaatacttaacaaacctaatatatatggttcaatcgcaagattcgaaggacaagtaagtgtatttaatttgaaggaagatagccctaactatagagaccttatccccacgccccctccacaagaattaattccatcttgctctgaagcaggagtgatgggaattcttccaggaattattggtacaattcaagcagcagaagctataaagataataacaaatattggttatccacttaacggtaggatcctcatttttaatgcattaaaaatgcaatttaaagagctaactttgaaatctaatccagaaaataaaaatatccataaattaatagattataaaagtttctgttcagaagttaaagttaaagatgaagtagaatgtgatatagaaagtatttcaattaaagaattaaaagtacttcttagccaatcttcaaaagaaatattattaatagatgttcgtaaccaaaatgaatataatcaatgttcaattacaggttcgttactcatgcctcttagctctattgaaagtggtaaagccattgatgaaattaaaatccttaccgcaaaaaaaaatctttatgtattatgtaaaagtggaaaaagatcattgcttgcattaaagcatttaaacaaatttggaattataggtattaatattcttggaggtattgatgcgtggaatagcgaaaaaaattaa

SEQ ID NO: 1243 - DNA, 1173 bp, Anabaena variabilis ATCC 29413
atgcttaatcccaacctggaagatatccagttaactaaagacgactacgaacgctactcccgccacctgattttgccggaggtgggagtggaaggacaaaaacggctcaaagctgccagtgtactgtgtatcggtacaggtggactgggttcaccactactgttatatttagctgccgccggtattggacgcatcggtattgtcgatttcgatgtggttgatacttccaacctgcaacgccaagtcatccacggtacatcctgggtaggtaaacccaaaattgaatctgcaaaaaaccgcatacacgagattaacccctattgtcaggttgacctctacgaaactcgtctcagttccgagaatgccctagatatcatcagaccttacgatattgtggtggatggtacagataactttcccaccagatatctagtcaacgatgcttgcgtattattgaacaaacccaacgtctacggttccattttccgctttgaaggacaagccacagtatttaactacgaaggcgggccaaactaccgcgacttgtacccagaaccaccaccaccaggactagttccctcctgtgcagaaggtggggtattagggattttgccagggattatcggcgtaattcaagccacggaaacagtgaaaattattttaggtaacggtaataccctcagtggtagattattgctgtacaacgctttagatatgaaattccgcgaattgaagttacgtcccaaccccatacgcccagtcattgaaaagctgatagactacgaacaattctgcggtattcctcaagccaaagcagccgaggcgcaaaaaatgcaagaaatccaagaaatgacagttacccaactcaaggaattgctggatagtggggcgaaggattttgtcctgctagatgtgcgtaaccccaacgaatacgaaatcgccaagattcctggttctgtattaatacctttaccagacattgaaaatggtaatggtgtggctaaagtcaaagaagccctcaacggacaccgcttgattgctcattgtaagatgggtgggcgatcggcgaaagccttagccatcctcaaagaatcggggattgtggggacaaacgtcaaaggcggaatcaccgcttggagtcgggaagtagacccatcagttcctgagtattaa

SEQ ID NO: 1244 - DNA, 774 bp, Nitrosococcus oceani ATCC 19707
atgaacgaccaacaactcctacgctacagccggcaaatcttactaccccaaattgatatcgaaggccagcaaaaattgctcgattcccggattctagtggtgggcgtgggcggtttagggtcacctatcgccttgtatctagctggagccggggtaggacaattgactctcgttgaccccgatgaggtagagctttccaatctgcagcggcaaattttgcacgatagcaacgtcatcggcttacccaaggtagaatcggcacgccgccgcctgcaggctctgaaccccgaggtggaagtgcggccaatagccgctcggttggagggaaaggacttagaagcggtgattgcccaggcggacgtagttgtggatgggagtgataatttcgctacccgctttgccttgaatatcgctagcgcccgggtaggccggcccctggtttctggcgccgccattcgcatggaaggacaggtggcggtgtttgatagccggcaaccggacggagcttgctaccattgcttgtttcaggaaggcggggagaacgaagaagagacctgttcccaaaccggcgtactagcccccttgctaggaattatcggcagcgtccaagcgatggaaacccttaagttgctattgggtataggacgaagtttgcataatcggctattattactcgatgggctgagcatgcgctggcgcgaaacccgaattcagcaagatccccagtgccctatttgtaacggctcgcgagagagatggcgggagttggcttaa

SEQ ID NO: 1245 - DNA, 1167 bp, Synechococcus sp. CC9902
atgcagccaagtcatcccaccccaaatcagagcctgtcctctgatgagcgggggcgttacgcccgacatctcattcttccggaagttggccttgctggtcaggagcggcttaaggctgcagcagtgctctgtgttggcgcaggaggtttgggctccccccttctcctttatttagctgcagcaggggttggtcgtattggcatcgttgatggagatgctgttgagctctcgaatctgcagcgtcaagtgattcatcgctccgatgctgtcggtcgctctaaagccagatctgccgcagagagtgttcatgcgctcaaccctcattgccagattgatgtgcacgacgtgatgcttgatatcaccaatgtgatggatctgatcgcggactacgacgttgtctgcgacggaaccgacaatttcgccagccgatacttaatcaatgacgcctgtgtgttgtcagataagccattgatttatggctctgttcaacgctttgaaggtcaggtcactgttttcaattgcaatcctgaaagtcctaatttccgcgatttgttgcctgttcccccttcgcctggtgcgatcccctcatgctcagaggcaggggtgatgggtgtgatgccgggtttgattggcctccttcaggccactgaaacgatcaagttgatcactggcattggtcgttgcctcgatggccgtttgctggtggtggatgctctatctatgcgttttcgagaactcacgctgcggcgggatcttgatcgtgctccgatcaaggacctgattgactactcgcagttctgtagtgcagccacaactgagatggatccttctgtgatggaaacgatcagtgttactgagctcaaggctcttcttgaaggagatgctggggatttggcgcttgttgatgtgcgtaacccggctgaagcagagattgttgtgattccttctgcggtgctgattccgctctccacgatcgaaagcggagaagcgattgagcaagtccgatccttggcagaagggcgccgtctttttgtgcactgcaagttagggatgcgatcggcgaaagccgctcaactgcttgctgagcatggaatcttcgcaatcaacgtgacaggaggtattgacgcctgggctcaagaggtggatccaacgttgccccgttactaa

SEQ ID NO: 1246 - DNA, 1137 bp, Synechococcus sp. CC9605
atgcatgaccaaccgatgctgagtgctgatgagcgggggcgttacgcccgccatctgattcttcctgaggttggtccggccggtcagctccggttgaaggaggcttctgtgctgtgtgttggcagtggagggctgggatctcccctgctgctgtacctggccgcggcaggcgtgggccgtattggaatcgtggatggagatgtggtggagctctccaatctccagcgccaggtgatctacagctccagcggggttggcggctccaaggcccgctcagccgcagcacggatccacgacctcaacccccactgccaggtggaggtgcatgaacacatgctggatgtgggcaatgccctggacctcatcgctgactacgacctggtctgtgacggcaccgataacttccccagccggtatctgatcaacgacgcctgtgtgttgcttggcaagcccctggtctatggctccgtgcagcgcttcgacggccaggtgagcgtgttcaaccgcacgccgacgagccccaattaccgcgatctgctgccggaaccacctccgccggatgctgtcccttcctgctcggaggctggggtgatgggtgtgatgccgggactgatcggtctgcttcaggccaccgaagcgatcaagctgatcaccggcattggcgaatgcctggatggtcggctgctggtggttgatgccctggcgatgcgatttcgcgaactcaccctccgcgttgatcccgatcgagcgaaggtcgagagcctgattgactaccgccagttctgccgtccggcgtcatcggagatggaagccatcactgtcacggagctgaaggctctgctcgactccgctccagacgagattgcgctggttgatgtgcgcaatcctgctgaagcagagatggcttcgattgaaggaagccacttggttccgttggcctcgctggagagtggagaggcgatcgatcgcgttcgtgcattggcagagggacgacgcctcttggtgcactgcaagcttggggggcgctctgcgcgtgccgttgagctgttggctcagcagggcatcgcggcaacgaatgtgaccggtggaattgatgcctggtcacagcaggtggatcctgcaatccctcgctactga

SEQ ID NO: 1247 - DNA, 810 bp, Geobacter metallireducens GS-15
atgttcactgaagagcagatcgaacgctactcccgccacatcatcctgaaagaggtgggaggaaagggacagaagaaactcctggaggggaaggtgatggtgatcggcgccggcggcctcggtgcccccatcgcactttatctggccgcagccggggttggcaccatcggcattgccgacgccgacgtggtggatctttccaatctccagcgccaggtgatccacttcacccccgacgtgggtaagccgaaagtggagtcggcccgggagaagatggaggccatcaaccccgacgtgacggtgcggacctaccaggagtggatctccgccgccaacatcgcccggatcatcgccgactatgatttcgtcatcgacggcaccgacaactttgccgccaagttcctcatcaacgacgcctgcgtcatggcggggaaaccgtactcccacggcggcatcctccagttcgtgggccagacaatgaccattaagccaggggaatccccctgctaccgctgcatcttcccggctccgccgccaaaggacgccattcccacctgctcccaggccggtgtcatcggcgtcctgccaggagttatcggcactatccaggccaccgaggcgatcaagtacctgctcggaaaaggtgcgctgctgaccggtcacatcatgatgtatgacgccctggagatgaacttccggaaggtgaagctcaaccggaaccgcaagtgccccgtatgcggcgataaccccaccgtgacggaactggtggacgaactcgacgccctgaacgtctgcgacctggagaagtga

SEQ ID NO: 1248 - DNA, 1176 bp, Synechococcus elongatus PCC 7942
atgctcaacctcgacacggactctattcaactcacccaagacgactacgcccgctactctcggcatttaatcctgccggaagtgggtctggaaggtcaaaagcgtctcaaggctgccaaggtgctctgcatcggtaccggtggtctgggttcaccactgctgctctatctggcggcggcaggaatcggacggattgggattgtcgattttgatatcgtcgaccactccaacctgcaacggcaagtcattcacggcacctcgtgggtgggcaagcccaaaattgaatcggcgaaaaaccggatccacgagatcaacccctactgtcaagtcgatctctacgaaacggcactgagttccgaaaatgcgctgtcgatcctcgaaccttacgacgtgattgtcgacggcaccgacaacttcccgacgcgctacctcgtcaatgacgcctgcgtgctactcgggaagcccaacgtctatggctcaatcttccgctttgaaggccaagcgacggttttcaactacgaggatggccccaactaccgcgacctctatccagaaccgccgccaccgggcatggtgccctcctgcgctgagggcggtgtgctcggcattttaccggggatcatcggtgtgattcaggcaaccgagacggtcaaaattattctgggtcaaggccaaactctgagcggtcgcctactgctctacaacgcactggatatgaaattccgcgagctaaaactgcggcccaatccagagcgtccggtgatcgatcgcctgatcgattaccaagagttttgtgggatcccccaagcgcaagcagccgaagcagctgccacggactcgatccccgagatcagcgtcacggaactcaaggccatcctcgatcgccaagatccggaagtcttgctaattgacgtgcgtaacccccacgaagcagagattgccacgattccaggagccatcttggtgccactgcccgacatcgaagccggtgcaggtgttgagacagtgcgtgaactcctcaacggcaagcgcgagctgatcgttcattgcaagatgggagggcgatcggccaaagccctcggcattctcaaagaggcggggatcaccggcacgaacgtggctggcgggatcaacgcttggagtcaagacgtcgaccccagcgtgccgcagtactaa

SEQ ID NO: 1249 - DNA, 1173 bp, Nitrosospira multiformis ATCC 25196
atgcagctatcaccgctggtacatccctcggaagaattgagtaaagaagaaatttcgcgctacagccgccatctgctgattccggatgtcggtctggaagggcagcagcgtctcaagaacagcaaggtcctggtaatcggcgccggagggctgggatcgccgacgctcctctatctggccgcagccggcgtgggaaccttgggcattatcgatttcgatattgttgatgaatccaatctacagcggcaggtcattcatcggcagcaggatatcggcagacccaaatgccggagtgcgcaggactcggtcaaggccctgaatccctatatccaggttcggattcacgatgaacgactcgaaacaacaaatgctattgacatcatatcggactacgatctggtaatagacggaacggataacttctccacccgctatctcgtcaacgatgcctgcgtgctggctggaaagccctatgtctgggggtccattttccgcttcgaagggcaggcctcggtcttctgggaagatgcgccaggaggacgcggcctgaactaccgcgacctttatcccgaacccccgccgcccgaaatggccccgtcgtgtgcggaaggcggcgtgctgggcatactgtgcgcatccatcggcgcgatcatggctaccgaggccatcaaattgattaccggtctgggcaataccctgctcggcaggcttgctgtctacgatgccctggatatgaccttcagattcatcccgctgcggcgagccccggtcaggacaccgatcacccggctgatcgattaccaggcattttgcggcctcccgcagtcaacgacgggcggcaaaccgaacgtacccacgatcagcgccctggaattgaaagagatgcgggattgcagcgtagccatgcagcttatcgatgttcgcggaatccaggaatggaacatcgtgcatatcgaaggggcaaatcatattcccaaggacaggatgatgtccgaggaagttttagcccgattgaacaaggatgagcttatcgtgcttcactgcaaaatgggcgtgcggtcccgggatattctcatggagatgcgcaagcgggggtttacgaatgtcaaaagcctggatggcggaatcctggcgtggatcagggatgtggatcagacattgccaagttattga

SEQ ID NO: 1250 - DNA, 1176 bp, Trichodesmium erythraeum IMS101
atgttaaatcctaatctggaacaaatccagttaaatacagaagaatatcaacgttattcgaggcacctgattctaccggaagtaggattagatggtcaaaaacgtctcaaggcagctagtgttctatgtataggcacgggaggtcttggttctccactattgttatatctagcagcagcaggaattggaaatattggaattgtagattttgatattgtcgatagttccaatttacaacgacaggttattcatggtacttcctgggtgggtaagccaaaaattgaatctgctaaaaatcggattcatgaaattaatccttactgtcaggttgacctttatgaaaccaggttaagtgctgaaaatgcccttgacattctcaagtcttatgatgtgattgttgatggtactgataatttcccgactcgttatttggttaatgatgcctgtgttcttttgaataaacctaatgtctacggctcaattttccgctttgagggtcaggcaactgtgtttaattatgaaggtggaccgaactaccgtgacctttaccctgaacctccacccccaggaatggtaccttcttgtgcagaaggtggggtgttgggtattttaccaggaataattggggtgatccaagcaacggaaactatcaaagttgttttgggtaaaggtaagactttgagtggtagattgttactttataattccctagatatgactttccgagaattgaaattgcgtcctaatccgatacgaccaattattgaagagttgattgattatgagcagttttgtggtattcctcaagctaaagcacaggaggcagaaactaaaatggctattccagaaatgacagttcaagatttgaagcaattatttgatagtgggaagaaggatgattttgttttagttgatgtacggaaccccaatgaatatgatattgccaaaattcctgggtctgttttagtaccattgccagatattgagcagggccctggtgtgacaaaggtgaaggagttaatgaataatcgctctttaattgctcattgtaagatgggggggagatcggctaaagctttaggtattcttaaagaacatggtattgagggtactaatctcaagggtggaattactgcttggagtaaggaaatagattcttctgtacctcaatattaa

SEQ ID NO: 1251 - DNA, 1443 bp, Alkalilimnicola ehrlichei MLHE-1
atgtctgaaaccagcgtaaccgtgcgcctgccggcgccgttgcggcccttcgccggggaccagccggaactgcacgtcccgggcgccagcgtgggcgaggtgctcgaggccctggcccgcgactacccgctgctgcacgcccgtctggtggatccggacggcgagttgcgggccttcgtcaatcttttccggggtgagcaggacgtacgggagctggcggggcagaggacgccgctgcggccgggcgatgtgctgaccgtgttgccggcggtggccggcggggcgccctccgccctggagcgcctctcggcgcggattcgccgggaggtgccggaggtcacaccggcggaggcgcagaagctggcggcgcagggggcagtgctgctggatgtgcgggaggccggggaggtggcagagggcagccccaccggcgcgctgcgcatcgaccgcaactggctggagttgcgcatcgaggaggcggtgcccgagccggaacggcccatccttaccctgtgcgccgtgggacagcgctcgctgctggcggcggacgacctgcgtcgcctgggctatcgcgacgtgcgcaacatcgccggcggctttaaccgctggaaggacgaaggcctgcccttcgaggtgccgcgggtgctggatgacgcctcgcgggcccgctacgcccgccacctgcgcatgcccgaggtgggtgaggcggggcagctgcgcctgggcgagagccgggtggtgctggtgggggccggagggctgggttcgccggcggcgctctatctggccgcggccggggtgggcaccctggtgctggtcgaccatgacgtggtggaccgcagcaacctgcagcgccagatcctgcataccgacgaccgggtcggccagcccaagacggagtccgggcggcaggcggtggccgcgcttaacccccaggtgcgcgtggaggccgtccaggcccggctgaacagcgagaacatcgaggccgtgctcgccggcgccgacttggtgatcgacggctcagataactttcccacccgctacctggtcaatgacgcctgcgtgaaactgggcctgccgctggtctacggcgcggtctaccggttcgagggtcaggtcacggtgttcaatgtggatgacgggccctgctaccgctgcctctatccggagccgcccccggcggagctggccccatcctgtgcccaggccggggtgctgggcgtgctaccgggggtgattgggctgctgcaggccacggaggcggtcaagctcctgctgggtgtgggggagccgctgtccggtcgactggtgcactacgatgcgctgcgggggcagtttcagcaattgcggatgaaggccaaccccgattgccccgtttgcgcccccgggcgtccgttcccaggttatgtggactacgaggccttctgcagcagttcggcctga

SEQ ID NO: 1252 - DNA, 1230 bp, Prochlorococcus marinus MIT 9303
atgaggttgcgcatttgggacagtggtaagggcatagctagcggcactctttcccctatgggtcttcacgaaaccgttgatgttggcctgagccccgatgagttagagcgtttttctcgccatctcaccctgccagaggttgggatgaatggtcagaaacgactcaaggcggcttctgtgttgtgcgtgggtagtggcgggctcggttcgccgttgctgctttatttggctgctgctggtgtaggccatatcgggattgttgatttcgatgttgttgagctttctaatttgcagcgccaggtgatccatggcacgagttgggtaggtcaaccaaaaacgcattctgctcgggctcgcatccttgaaatcaatccccattgccaagtggatctctacgagaaagcgctgacgcgagataacgcttttgagatcattcatccgtacgacattgtttgtgactgcactgataatttccctagccgttacctggtgaatgacgcttgtgtgcttttaggtaagcccagtatttatggatcgattcatcgctttgaaggtcaggccacggtgtttaaccttgatgctgagagtcccaactatcgtgatctggtgcccgaaccgccacccgctggcttggtgccttcttgcgtcgaaggcggtgtgatggggatccttccgggattgattggtttaattcagtccgcggaggtcattaaaatcattactggtatcggcacgacgttgagtggtcggctgttggttgttgatgccttggcgatgacgtttcgggagatggctttgcgcccgagtcaaccgcgagttgtgattgatcagctgattgattatcaagacttttgtgcttctggtgctgatcaaccagctcaagagaaggctgctgggttggagagtatttcagttcaggatctcaagtctttactcgatcttggcgctgaggattttgccctggtggatgtgcgtaatcccaatgaggctgagattgcttgcattgctggttcagaattgatcccgttgaacaagattgagagtggtgaggcgattgagaaggttcggcagttggcctctggccgtcgactatatgtctactgcaagttgggtggtcgctcggcaaaggctttgaccactctcaagcgtcatggcattgaaggtgtcaatgtgactggtggcattgatgcttgggccaaggaagttgacaactcattgcctcgctactga

SEQ ID NO: 1253 - DNA, 1146 bp, Prochlorococcus marinus NATL1A
atggagcaaagccagagtaaggcaaatttaagttcagaagaaattgccaggtatgcaagacatataagtctcccagagataggtatcaaaggccaagaaaaattgaagacaagctcagttgcttgcattgggacaggagggctaggatctccacttttaatttatcttgcagcagctggaattggacgtatcggaatagttgattttgatgtcgttgaatactcaaatttacaaagacaaatcattcatacaacacattcaataggtctattaaaaacagattcggccaaacaagctatacgcaaaataaatccttcttgtcgagttgatttattcaatcaaaagctaacaagtagtaatgctttggaaatacttaaagcttatgatgtgatatgtgattgttcagacaatttcccaacgcgttacctgattaatgatgcttgtctaatacttaacaaacctaatatatatggttcaatcgcaagattcgaaggacaagtaagtgtatttaatttgaaggaagatagccctaactatagagaccttatccccataccccctccacaagagttaattccatcttgctctgaagctggagtgatgggaattcttccaggaattattggtacaattcaagcagcagaagctataaagataataacaaacattggttatccacttaacggtaggattctcatttttaatgcattaaaaatgcaatttaaagaactaactttgaaatccaatccagaaaataaaaatatccataaattaatagattataaaagtttctgttcagaaatttcagttaaagatgaagtagaatgtgatatagaaagtatttcagttaaagaattaaaagtacttcttagacaatcttcaaaagaaatgttattaatagatgttcgcaaccaagatgaatatcatcaatgttcaattacaggttcattgctcatacctcttaactctattgaaagtggtaaagccattgatgaaattaaaatccttaccgcaaaaaaaaatctttatgtattttgtaaaagtggaaaaagatcattgcttgcattaaagcatttaaacaaatttggaattagaggtattaatattcttggaggtattgatgcgtggaatagcgaaaaaaattaa

SEQ ID NO: 1254 - DNA, 813 bp, Clostridium thermocellum ATCC 27405
atgaactttaccaatgagcagatggagaggtattccagacatataattttaaaagatgtaggggtaaaagggcaaaaaaagcttctggagtcgaaggttctgattataggaacgggcggccttggagcacccgctgccatgtttctggctgctgcgggggtcggcacaataggtcttgtggattttgacgcggtggagctttcaaatcttcaaagacagattattcaccttaccaaagatgtgggaaaacccaaagttatatcgggaaaggaaaccatcaatgaaatgaatcccgatgtgaatgttgttacatatcaggagtgggtaagttcggccaacataaaagatattatcaaggacagggattatgattttattatagacggcaccgacaatttcccggcaaagtttttaataaatgatgcctgtgttcttacgggaaaacccttttcccatgcaggaattataaggttccagggtcagaccatgacctatgttccgggtaaagggccgtgctataggtgcatattcgagaatcccccaccaccggataaagttcccacatgcaaacaggccggtgtgctgggcgtaatgggcggagttatcggaactattcaggcaacagaagctatcaaatatttgcttggcattggtgaactgcttacaggctatattttaacttatgacgcaaaagcgatggagtttagaaaagttaaattgccgtggaacaaaaggtgtcaggtttgcggtgaaaatcctaccataaaagagcttatagactatgaacaggcagtgtgcgatttgaaatcctga

SEQ ID NO: 1255 - DNA, 813 bp, Geobacter uraniumreducens Rf4
atgctgagcgaagaacagattgcccgctattcacggcacatcatcctcaaggaagtcggcggcaaagggcagaagaagttgtttgacggccgggtaatgatcatcggcgccggcggcctcggctcgcccatcgccctttatctggctgcggcaggtgtggggacgatcggcatcgccgacgcggacgtggtggacctgtccaacctccagcgccaggtgatacaccagaccaaggacgtggggattgccaaggtcctgtcggccaaggaaaagatgcaggcgatcaatcccgagctgaaggtcaacacctaccaggaatggatcagcgccgccaacatcgccgacatcatcagtgagtacgacttcgtcatcgacggcaccgacaactttgccgccaagtttctcatcaacgatgcctgcgtccttgccggcaagccttactcccacggcggcattctccagttcgacggccagaccatcaccatcgagcctggcaagtccccctgctaccgctgcctctttcccgctccgccgcccaaggacgccattcccacctgctccactgccggggtgatcggcgtgctgcccggggtgatcggtaccatccaggcgaccgaggcgatcaagtacctgctcggcaaaggggaactcctcaccggccgtctcctaacctacaacgcgctgcggatgcggttccgcgaggttcccgtcaagaaaagcgcaaagtgtcccatttgcggcgagaacccgaccataaccgaacttaaggacgagctggacgccctgaccgtatgcgatctggaaacaaaataa

SEQ ID NO: 1256 - DNA, 1140 bp, Prochlorococcus marinus MIT 9211
atgaagtctataaaagccaataatatgcagctgagccctgaagaatttgctcggtactctcgacatttatcattaccagaaattggaattaagggtcaaaagaaactaaaaggcagttctgtactttgcattggctgtggagggcttggttctccagtactgatatatcttgctgcggctggcataggtaatcttgggattgtagataatgatttggtagaagagtcaaacttacaaagacaaatcattcacactcacaagtcaattggtaagtcaaaaatagaatcagcacgatctcgaataattgatattaatccttattgtaaagtaaccatttttagtgaattactaaataatgaaaatgccctagaaattattaaaccatatgatctagtatgtgactgcacagataactttgaaagcagatatttaataaatgatgcctgtgttttgcttggaaagccatatatatatggagcaatttcaaagttcgaaggtcaagcctctgtttttaatctagataaagatagtccaaattttagagatttaatccctcaacctccctcaatggatttactaccttcatgtagtgagtctggtgttataggggttcttccaggtattattggattaatacaggctacagaaataattaagattatagctgggataggtaccactttaagtggaaggatattgatatttaatgcgctagaaatgaagtttaaagagctaaagttaaagaaggattatgctgcaaagccaattacagaattgattgattataaggatttttgtggttcttctggtgtaacaaaagtcgaagacagtattaaaagtatttcggctaaaaagcttagagttttacttgaagataatcccaacaaaaatatcttattagatgttcgtactgaggaagagtttaaattaaatgcaatcaaaggatcaatattagtgccactcaaaaatattcaaaatgggcaagagatagataaaattcgaaaactagctagcaataaaaatatatttgttcattgtaagactggtaaaaggtcgaggaaagcaatactgagtttacgatcaaatggaattgatgctgtcaatctggaaggtgggataaattcttggaatgaaagctaa

SEQ ID NO: 1257 - DNA, 855 bp, Natranaerobius thermophilus JW NM WN LF
ttgcttgaaactatcacagaaaagtggggtgaactgatgaactttaatgaagcacaactagaacgttattccagacaaatcattttatccgaggtgggtgtcgagggacagcagaaattgctagactcaaaagtgttaatcattggcactggaggccttggggcgcctgcagccatgtatttagctgctctgggaattggtacaattggtttggtagatggtgataaagtcgaactttcaaatttacaacgtcaaattattcatcaaactaaagatataggtaaacttaaagcggaatcaggaaaggaaacaatactacacatgaatccagatgtagaagttattccgcataatacctggattaattcacaaaatatccaggatataattgaagactatgatttcgttattgatggcacagacaattttgcagccaaatttttaattaacgatgcatgtgtaatgtcggaaaaacctttttgtcatgcgggtataattcgattccagggtcaagtgatgacttatgttccaaatggtaatggggttactccttgttatagatgtgtttttaatgagcccccgcctgacggggtggttccttcttgccaggaagctggtgtccttggacttctagggggagtgattggtggcttacaagctacagaagcggttaaatacttattaggaataggagacaatttgacaggtgaattattagtttatgatgctttaaaaatggattttagaaaaattgaattacattcagacagggattgtaaaatttgcggaactaacccagaaatcaaagacttggttgactacacgggtcctaaatgtaacctacaaacaaagtga

SEQ ID NO: 1258 - DNA, 807 bp, Chlorobium phaeobacteroides BS1
atgattgattttactcagtcgcagctggaaagatacagccgccatattttgcttgactctgtcggtgttgaagggcagcagaaactcttgagttcaagggtgatgataatcggtgccggggggcttggcgctccggcggcgctttattgtgccgctgccggtatcggcacgataggcattgtcgatgccgatgccgttgagatatccaatcttcagcggcagattattcacttcactgatgatatcggtaaagccaaagtggcctccgccagggaaaagatggaggccataaatcccgatgtgaaagtcgagccgttacgagcgtttgtcaacgcatcgaatatcagcgacatcatcgacggttatgactttgttatcgatggtacggataatttcgcgacaaaatttctgatcaatgacgcctgcatcatgaaaggtattcctttttcccatggaggaattcttcggttcaatggtcagacaatgaccgtactgccgaaagaaagcgcctgctatcgctgtgttttccacaaaccgccgcccaaaaacatgattcctacctgttcagaggcgggtgtgcttggtgctattgccggaatgctcgggacgattcaggcggctgaagcattaaaatgtataacgggagccggggaaattctcgcggacgcattgctgactttcgatgcacttcccatgaatttcaggaaagtgaagctgcagaaaaacccgaaatgcgctgtatgttcagaaaacccatccattacggtgcttcaggatgaagagcagcaggtctgtgacttgaaataa

SEQ ID NO: 1259 - DNA, 813 bp, Geobacter bemidjiensis Bem
gtgaagctcagcgaagaacagatcacccgctattcccggcacatcctgttgaaggaagtcggcggtaaggggcagaagaagctgcttgaggggcgcgttctcatcatcggggctggcggcctcggttccccgattgccctgtacctggcggcagccggtgtcggcaccatcggcatcgcggacgccgacgaggtggacctctccaacctgcagcgccaggtcatccacaccacccctgacgtggggaaggcgaaggtgctctcggccaaggaaacgatgctggcgatcaaccccgagctcaccgtgaacgcctaccagacctgggtttccgccgagaacatcgccggcctcatcgccgactacgacttcgtcatcgacggcaccgacaacttcgcggccaagttcctcatcaacgacgcctgcgtcctcgccggcaagccctactcccacggcgggatactgcagttcgacgggcagaccatgacggtcaagccgggggaatccccctgctaccgctgcatcttcccggagcctcccccgaaggacgtgatcccgacctgctcgcgggcaggggtcatcggcgtcctccccggcgtgctcggcacgcttcaggccaccgaggcgatcaagtacctgctgggagccggcgatcttttgaccgggcgcctgcttacctacaacgctctcaggatgcgcttcagggaaatcccggtgaagaagagcgccaagtgcccgatctgcggcgaccaccccaccatcaccgagctgaaggacgagcttgacgccatgaccgtctgcgacctgggacactga

SEQ ID NO: 1260 - DNA, 810 bp, Desulfitobacterium hafniense DCB 2
atgggtttcagtgacgaacagctggagcggtattcccggcatatcatccttaaagaggttggggttaaaggtcagaaaaaattgctccagtccagggtcctgattatcggtacgggcgggctgggagcgccggcagctatgttcttggcggccgcgggtgtcggtaccatcgggctggtggactttgacggagtggagctttccaacctgcagcggcagatcattcacctgaccaaggatgtgggcaagcctaaagtgatatcgggccgggagaccattggggaaatgaacccggatgtggaagtggtgccttatcaggaatgggtcagctccggcaatatccaggatattatctgggaccgggattatgattttatcatcgacggcacggataattttccggctaagtttctgatcaacgacgcctgtgttctcagcgggaagcctttttcccatgccgggatcatccgcttccagggacagaccatgacttatgtgcccgggcaggggccatgctaccgctgcattttcaagaatcccccgccgaccgacagcgtaccaacctgcaaacaggcaggggtgctgggggttatgggagggatcatcggcaccattcaggccacggaagccatcaaatatattctgggcctcggggacttgctgaccggcgccctgctgacctatgacgcccttaaaatggagtttcggagagttaagctgcctcataataaaaaatgccaggtatgcggggaagaaccctcgatcacagaactgatcgattacgagcaggctgcctgcgatctgaattga

SEQ ID NO: 1261 - DNA, 813 bp, Anaerocellum thermophilum DSM 6725
atgaagttaacagacacccaacttgagagatactcaagacacatcatcctaaacgaggtcggcgcaaaaggacagcaaaaacttttggaatctgaggttttgatcattgggactgggggacttggttcccctgctgcaatgtttttagcagctgctggtgttggtacaattgggcttgttgatttcgacgcagttgagctttccaatcttcaaagacaaataatacattttacacccgatgtaggcaagccaaaggtgttttctgcaaaagaaaagataaaccaaatgaatcctgatgtggaagtagtaacttatcgtgaaatggtaaattcaagcaatattatagacatcatcaaggatagagattatgattttataatcgacggcacagacaactttccagctaaatttttgataaacgatgcctgtgtaatactaaaaaaaccattttcacatgcaggtatcataagatttgatgggcaaaccatgacttatgtgccagagaaagggccgtgctttagatgtatctttcaaaacccaccgccacctgatgcagttccaacttgtagacaggcaggagttttaggtgtgatgggtggtataattgggacaattcaggcaacagaagcaattaaatatttgcttggaattggtgacctgctaacaggatatatcttaatttacaacgctttgaagatggaatttagaaaagtaaagataaacaagagagaaagctgtgagatatgtggtaaaaatccaacaataaaagaattaatcgactatgaacagcctcagtgtgatttaaaaggttaa

SEQ ID NO: 1262 - DNA, 813 bp, Geobacter M21
gtgaagctcagcgaagaacagatcacccgctattcccggcacatcctcttgaaggaagtcggcgggaaggggcagaagaagctgcttgaggggcgcgtgctcatcatcggggcgggggggctcggttccccgattgccctgtatctggcggcagccggggtcggcaccatcggcatcgcggacgccgacgaggtggacctctccaacctgcagcgccagatcatccacaccaccccggatgtggggaaggcgaaggtgctctcggccaaggaaacgatgctggcgataaaccccgagctcacggtgaacacctaccagacctgggtttgcgccgagaacatcgccggcctcatcgccgactacgacttcgtcatcgacggcaccgacaacttcgcggcaaagttcctcatcaacgacgcctgcgtcctcgccggcaagccctactcccacggcggaatcctgcaattcgacgggcagaccatgacggtcaagccgggggaatccccctgctaccgctgcatctttcctgagcctcccccgaaggacgtgatcccgacctgctcgcgggcaggggtcatcggcgtgctgcccggcgtgctcggcacccttcaggccaccgaggcgatcaagtacctcctgggagccggcgacctcttgaccgggcgcctgcttacctacaacgccctcaggatgcgcttcagggaaatcccggtgaagaagaacgccaactgtccgatctgcggcgaccaccctaccatcaccgagctgagggacgagctggacgccatgaccgtctgcgacctggggcactga

SEQ ID NO: 1263 - DNA, 801 bp, Candidatus Methanosphaerula palustris E1 9c
atgaaagatgaacagatagaacgatacagcagaaatataattttaaaagaggttggaggaaaaggtcaggaacgtcttcttcagtcaaaggttctaattatcggtgccggtggattgggttctccagccgctctctatcttgcagcagccggagtgggaacgattggtattgtcgatggcgaccgggtcgacctgagcaacctccagcggcaggtcatacactttactgcggatgtaggtacctacaaggcagattctgcccgagataagattactcaactcaatccggacgtaacggttcagatccataaggagatggtttcctcatcgaacatacgggagatcattaccgactatgattttatcattgatggtacagacaatttcccagcaaagttcctgatcaacgatgcctgcatccttctggggaaaccattttcccatgctggaatattgcggttcaacggccagacgacaacggtgatccctgataagagtgcttgctaccgctgcatcttcaacaccccaccgccagtggggacggttcccagttgcagcgagtccggggttatcgggagtatggccggagtcatcggaaccctccaggcgatggaggcgatcaaatacctcctcgggataggagacctcctgacaaaccgacttcttgtattcgaagcgcttccgatgaatttccgggagatcaagattaaaaagaatccaaaatgcccggtgtgtggagaacatccgaccatcacctcactcatcgattatgaacaaaaggtttgtgagttgcggaaatga

SEQ ID NO: 1264 - DNA, 2061 bp, Bacillus cereus ATCC 10987
atgagtaaaattcgagtgcatgaatatgcgaaaaaacataatatctcaagtaaagatcttatgacaaaactaaaagaaatgaatatcgaggtttcgaatcatatgacaatgttagacgatgaagtagtaaacaaattagataatgagtatcaaactgaaaaaccttctgttgcagatgagtttgaagtagaagaaaaagttgttcgtagtaaaaagaacagcaataagaaaaagaaaaaaggcaaaggaaacgaagacaagcgtcaagagaactttgctggaagacaacaaacacaaactgtagaaacaccagataaaattactttctctggaagtcttacagtaggtgatcttgctaagaaattaagtaaagagccatctgaaattattaaaaagctcttcatgcttggaattatggcaacaattaaccaagacttagataaagatacaattgagttaattgctaacgactacggtattgaagtagaagaagaagtaattgtaagcgaaactgagtttgaaacattcatcgatgagcaagatgatgaagagaacttaaaagagcgtccagctgtagttacaatcatgggacacgttgaccatggtaaaacaacattgcttgactctatccgtaactctaaagtaactgctggtgaagcgggtggaattactcagcatattggtgcataccaagttgaagtaaatgacaagaaaattacattcttagatacacctggtcacgcggcgtttacaacgatgcgtgctcgtggtgcacaagtaacggatattacaatccttgttgttgcagctgatgacggtgttatgccacaaacagttgaagcaattaaccatgcgaaagcagcaggagtaccaattattgtagctgtgaataaaatggataaaccagctgcgaaccctgatcgcgtaatgcaagaactaacagaatatgaattagttccagaagcatggggcggagacacaattttcgtaccaatttctgcgattcaaggcgaaggaattgacaatttactagaaatgattcttcttgtaagtgaagtagaagagtataaagcaaatccaaaccgctatgcaactggtactgtaattgaagcccaacttgataaaggtaaaggaactatcgcgacattacttgttcaaaacggtacgcttcgagtaggagatccaatcgttgttggaactacattcggtcgtgttcgtgcaatggtaagtgatattggtcgtcgtgtaaaagttgctggtccatcaactcctgttgaaattacaggtttaaacgaagtaccacaagcaggagatcgtttcatggcattcgctgatgagaagaaagctcgtcaaatcggtgaatcacgtgcacaagaagcgctacttgctcaacgtggtgagaaatctaaattaagccttgaagatttattccaacaaatccaagagggcgatgtaaaagaaattaacttaattgtgaaagcggacgtacaaggttctgtagaagcaatggcagcatcactacgtaaaattgatgttgaaggtgttaaagttaaaattatccatacaggcgtaggtgcgattacagaatctgatattattttagcttctgcatctaatgcaattgtaattggatttaacgtacgcccagatgtaaatgcgaagcgtacagctgaattagagaacgttgatattcgtttacaccgcattatttataaagtaatcgaagagatcgaagcagcgatgcaaggtatgctagatccagaatttgaagaaaaagtaatcggtcaagcagaagtacgtcaaacgtttaaagtaacaaaagttggaacaatcgcaggttgttacgtaacagatggtaaaattacacgtgatagcggcgtgcgtattatccgtgatggtgtggtaatctatgaaggtcaacttgatacgttaaaacgtttcaaagacgacgtaaaagaagttgctcaaaactatgagtgtggtattacaattgagaaatacaacgatcttaaagaaggggacatcattgaagcgtacattatggaagaagtgaagcgatga

SEQ ID NO: 1265 - DNA, 2349 bp, Listeria monocytogenes 4b F2365
atgagtaaagttcgtgtatatgaatacgcaaaagaacatcaagtatcaagcaaaaaagtcattgaagcattaaaagacttaggtattgaagtggcaaatcacatgtccacgattaatgaaaatgcattaagacaattagataatgccattgatggcacaaataaaaaagccgaagcaccaaagaaagaaactactagcaacgaaaatggaaatagtaaggggccaaacaaaccaaatatgacaaatagtaatgaaaaatcgaataaaccaaataacccagcagggcaagctaataaaccagcaactgcaaacaaaagccaaggtgcaaaaccagcgacaaacaaaccagcaaatacaagtaaacaaacacaatcaagtggtaaccaacaacaagctggcggacaaaaacgcaacaacaataacaacagcaatcgtccaggcggcggcaatccaaaccgtccaggcggtaacaatcgcccgaatcgtggcggcaattttaataataaaggtcgtaacacgaagaagaaagggaagctaaaccacagtacagtaccgccaactccgccaaaaccaaaagaacttcctgaaaaaattgtgttcagcgaatctctaacagtagcggaattagcgaaaaaattatacagagaaccatctgaactaatcaaaaaactatttatgcttggtgttgttgcaacgattaaccaatcattagataaagatgcaatcgaactaatttgtgatgactacggtgtgcaagtagaagaagaaattaaagtcgatgtaacagatttagatgtgtactttgaaaatgaactaaatgaagcggttgacgagtctaaacttgttgaacgcccaccagttgttactattatgggacacgttgaccatggtaaaacaacattactagattcccttcgtaatacaaaagttactttaggagaagctggtggtatcacccaacatatcggtgcttaccaacttgaaatccatgacaaaaaaatcactttccttgatacaccgggacatgctgcctttactgcaatgcgtgctcgtggtgcacaaatcacggatattacgattttagttgtagcagcagatgatggtgttatgccacaaacaattgaagcaatcaaccacgcaaaagctgcgggaatgccaattattgttgctgtcaacaaaattgataaaccacaagcaaaccctgaccgcgtaatgcaagaactaacagaatatgaattagttcctgaagcatggggtggcgatacaattttcgcgccaatctcagctaaattcggtgaaggtcttgaaaacttgttagatatgattttacttgtttctgaagtagaagaattaaaagcaaatccagatcgtcgtgctatcggttctgttatcgaagcagaacttgataaaggccgcggtccagttgcgactctactagtacaagatggaacgcttaatattggagacccaattgttgttggtaacacgtttggtcgtgttcgtgcaatggtcaatgatttaggccgtcgcgtgaaaaaagttggtccaagtacaccagttgaaatcactggattaaatgatgtgccgcaagctggcgatcgctttgttgtttttgaagatgaaaaaacagcaagaaatatcggtgaaactcgtgcaagccgtgcgttagtagcacaacgttccgcaaccaaccgcgtaagtttagacaacttatttgaacatatgaaagctggcgaaatgaaagaagttaacgttattattaaagcagacgttcaaggttctgtagaggctcttgctgcatctcttcgcaaaattgatgtagagggtgttaacgttaaaattattcatactgctgttggtgctatcaatgaatcagatatcacacttgctgcagcttctaatgcaattgttattggatttaatgttcgtccaaccgctcaagctcgtgaagcagcagaaaacgaaagtgtagacattcgtttacaccgtgttatctataaagccattgatgaaattgaagcagcgatgaaagggatgcttgatccagaattccaagaaaaaattattggtcaagcgcaagttcgtcaaacaatcaatgtttccaaagtgggtacaattgccggctgttacgtaacagatggtaaaattactcgtgatagtggcgttcgtattatccgtgacggaattgttgtctttgaaggcgaaattgctacacttaaacgctttaaagatgatgcgaaagaagttgcaaaaggatacgaatgtggtatcacagtacaaaacttcaacgatatcaaagaagatgatgtcattgaagcgtacgttatggaagaaattgaaagaaaatga

SEQ ID NO: 1266 - DNA, 2061 bp, Bacillus anthracis Ames 0581
atgagtaaaattcgagtgcatgaatatgcgaaaaaacataatatctcaagtaaagatcttatgacaaaactaaaagaaatgaatatcgaggtttcgaatcatatgacaatgttagacgatgaagtagtaaacaaattagataatgagtatcaagctgaaaaaccttctgttgcagatgagtttgaagtagaagaaaaagttgttcgtagtaaaaagaacagcaataagaaaaagaaaaaaggcaaaggaaacgaagacaagcgtcaagagaactttgctggaagacaacaaacacaaactgtagaaacaccagataaaattactttctctggaagccttacagtaggtgaccttgctaagaaattaagcaaagagccatctgaaattattaaaaagctcttcatgcttggaattatggcaacaattaaccaagacttagataaagatacaattgagttaattgctaacgactacggtattgaagtagaagaagaagtaattgttagcgagactgagtttgaaacattcatcgatgagcaagatgatgaagagaacttaaaagagcgtccagctgtagttacaatcatgggacacgttgaccatggtaaaacaacattacttgactctatccgtaactctaaagtaactgctggcgaagcaggtggaattactcagcatatcggtgcataccaagttgaattaaatgacaagaagattacattcttagacacacctggtcacgcggcgtttacaactatgcgtgctcgtggtgcacaagtaacggatattacaatcattgttgttgcagctgatgacggcgtaatgccacaaacagttgaagcgattaaccatgcgaaagcagcaggagtaccaattattgttgctgtgaataaaatggataaaccagcagcaaatcctgatcgcgtaatgcaagaattaacagaatatgaattagttccagaagcatggggcggagacacaattttcgtaccaatttctgcaattcaaggcgaaggaattgacaacttactagaaatgattcttcttataagtgaagtagaagaatataaagcaaatccaaaccgctatgcaactggtactgtaattgaagcacagcttgataaaggtaaaggaactatcgcgacattacttgttcaaaacggtacgcttcgagttggagacccaatcgttgttggtacttcattcggacgtgttcgtgcaatggtaagtgatattggtcgccgtgtaaaagttgctggtccatcaactcctgttgaaattacaggtttaaacgaagtaccacaagcgggagatcgtttcatggcattcgctgatgagaagaaagctcgtcaaatcggtgaatcacgtgcgcaagaagcgttacttgctcaacgtggtgaaaaatctaaattaagccttgaagatttattccaacaaatccaagagggcgatgtaaaagaaattaacttaattgtgaaagcagacgtacaaggttctgtagaagcaatggcagcatcacttcgtaaaattgatgttgaaggtgttaaagttaaaattatccatacaggcgtaggtgcgattacagaatctgatatcattttagcttctgcatctaatgcaattgtaattggatttaacgtacgcccagatgtgaatgcgaagcgtacagctgaattagagaacgttgatattcgtttacaccgtattatttataaagtaatcgaagagatcgaagcagcgatgcaaggtatgttagatccagaattcgaagaaaaagtaatcggtcaagcagaagtacgtcaaacgtttaaagtaacaaaagttggaacaatcgcaggttgttacgtaacagacggtaaaattacacgtgatagtggcgtgcgtattatccgtgatggcgtagtaattttcgaaggacaacttgatacgttaaaacgtttcaaagacgacgtaaaagaagttgcacaaaactatgagtgtggtattacaattgagagatataatgatcttaaagaaggggacattattgaagcatacattatggaagaagtgaagcgatga

SEQ ID NO: 1267 - DNA, 2061 bp, Bacillus anthracis str Sterne; identical to SEQ ID NO: 1266

SEQ ID NO: 1268 - DNA, 2061 bp, Bacillus thuringiensis konkukian
atgagtaaaattcgagtgcatgaatatgcgaaaaaacataatatctcaagtaaagatcttatgacaaaactaaaagaaatgaatatcgaggtttcgaatcatatgacaatgttagacgatgaagtagtaaacaaattagataatgagtatcaagctgaaaaaccttctgttgcagatgagtttgaagtagaagaaaaagttgttcgtagtaaaaagaacagcaataagaaaaagaaaaaaggcaaaggaaacgaagacaagcgtcaagagaactttgctggaagacaacaaacacaaactgtagaaacaccagataaaattactttctctggaagccttacagtaggtgaccttgctaagaaattaagcaaagagccatctgaaattattaaaaagctcttcatgcttggaattatggcaacaattaaccaagacttagataaagatacaattgagttaattgctaacgactacggtattgaagtagaagaagaagtaattgttagcgagactgagtttgaaacattcatcgatgagcaagatgatgaagagaacttaaaagagcgtccagctgtagttacaatcatgggacacgttgaccatggtaaaacaacattacttgactctatccgtaactctaaagtaactgctggcgaagcaggtggaattactcagcatatcggtgcataccaagttgaagtaaatgacaagaagattacattcttagacacacctggtcacgcggcgtttacaacgatgcgtgctcgtggtgcacaagtaacggatattacaatccttgttgttgcagctgatgacggcgtaatgccacaaacagttgaagcgattaaccatgcgaaagcagcaggagtaccaattattgttgctgtgaataaaatggataaaccagcagcaaatcctgatcgtgtaatgcaagaattaacagaatatgaattagttccagaagcatggggcggagacacaattttcgtaccaatttctgcaattcaaggcgaaggaattgacaacttactagaaatgattcttcttgtaagtgaagtagaagaatataaagcaaatccaaaccgctatgcaactggtactgtaattgaagcacagcttgataaaggtaaaggaactatcgcgacattacttgttcaaaacggtacgcttcgagttggagacccaatcgttgttggtacttcattcggacgtgttcgtgcaatggtaagtgatattggtcgccgtgtaaaagttgctggtccatcaactcctgttgaaattacaggtttaaacgaagtgccacaagcgggagatcgtttcatggcattcgctgatgagaagaaagctcgtcaaatcggtgaatcacgtgcgcaagaagcgttacttgctcaacgtggtgaaaaatctaaattaagccttgaagatttattccaacaaatccaagagggcgatgtaaaagaaattaacttaattgtgaaagcagacgtacaaggttctgtagaagcaatggcagcatcacttcgtaaaattgatgttgaaggtgttaaagttaaaattatccatacaggcgtaggtgcgattacagaatctgatatcattttagcttctgcatctaatgcaattgtaattggatttaacgtacgcccagatgtgaatgcgaagcgtacagctgaattagagaacgttgatattcgtttacaccgcattatttataaagtaatcgaagagattgaagcagcgatgcaaggtatgttagatccagaattcgaagaaaaagtaatcggtcaagcagaagtacgtcaaacgtttaaagtaacaaaagttggaacaatcgcaggttgttacgtaacagacggtaaaattacacgtgatagtggcgtgcgtattatccgtgatggcgtagtaattttcgaaggacaacttgatacgttaaaacgattcaaagacgacgtaaaagaagttgcacaaaactatgagtgtggtattacaattgagagatataatgatcttaaagaaggggacattattgaagcatacattatggaagaagtgaagcgatga

SEQ ID NO: 1269 - DNA, 2061 bp, Bacillus cereus ZK
atgagtaaaattcgagtgcatgaatatgcgaaaaaacataatatctcaagtaaagatcttatgacaaaactaaaagaaatgaatatcgaggtttcgaatcatatgacaatgttagacgatgaagtagtaaacaaattagataatgagtatcaagctgaaaaaccttctgttgcagatgagtttgaagtagaagaaaaagttgttcgtagtaaaaagaacagcaataagaaaaagaaaaaaggcaaaggaaacgaagacaagcgtcaagagaactttgctggaagacaacaaacacaaactgtagaaacaccagataaaattactttctctggaagccttacagtaggtgaccttgctaagaaattaagcaaagagccatctgaaattattaagaagctcttcatgcttggaattatggcaacaattaaccaagacttagataaagatacaattgagttaattgctaacgactacggtattgaagtagaagaagaagtaattgtcagcgagactgagtttgaaacattcatcgatgagcaagatgatgaagagaacttaaaagagcgtccagctgtagttacaatcatgggacacgttgaccatggtaaaacaacattacttgactctatccgtaactctaaagtaactgctggcgaagcaggtggaattactcagcatattggtgcataccaagttgaagtaaatgacaagaagattacattcttagatacacctggtcacgcggcgtttacaacgatgcgtgctcgtggtgcacaagtaacggatattacaatccttgttgttgcagctgatgacggtgttatgccacaaacagttgaagcaattaaccatgcgaaagcagcaggagtaccaattattgttgctgtgaataaaatggataaaccagctgcgaatcctgatcgcgtaatgcaagaactaacagaatatgaattagttccagaagcatggggtggagatacaatcttcgtaccaatctcagcgattcaaggcgaaggaattgacaacttactagaaatgattcttcttgtgagtgaagtagaagaatataaagcaaatccaaaccgctatgcaactggtactgtaattgaagcacagcttgataaaggtaaaggaactatcgcgacattacttgttcaaaacggtacgcttcgagttggagacccaatcgttgttggtacttcattcggacgtgttcgtgcaatggtaagtgatattggtcgtcgtgtaaaagttgctggtccatcaactcctgttgaaattacaggtttaaacgaagtaccacaagcgggagatcgtttcatggcattcgctgatgagaagaaagctcgtcaaatcggtgaatcacgtgcacaggaagcgttacttgctcaacgtggtgagaaatctaaattaagccttgaagatttattccaacaaatccaagagggcgatgtaaaagaaattaacttaattgtgaaagcagacgtacaaggttctgtagaagcaatggcagcatcacttcgtaaaattgatgttgaaggtgttaaagttaaaattatccatacaggcgtaggtgcgattacagaatctgatatcattttagcttctgcatctaatgcaattgtaattggatttaacgtacgcccagatgtgaatgcgaagcgtacagctgaattagagaacgttgatattcgtttacaccgtattatttataaagtaatcgaagagatcgaagcagcgatgcaaggtatgttagatccagaattcgaagaaaaagtaatcggtcaagcagaagtacgtcaaacgtttaaagtaacaaaagttggaacaatcgcaggttgttacgtaacagacggtaaaattacacgtgatagtggcgtgcgtattatccgtgatggcgtagtaattttcgaaggacaacttgatacgttaaaacgtttcaaagacgacgtaaaagaagttgcacaaaactatgagtgtggtattacaattgagagatataatgatcttaaagaaggggacattattgaagcatacattatggaagaagtgaagcgatga

SEQ ID NO: 1270 - DNA, 2868 bp, Thermobifida fusca YX
gtggcgaaggtccgggtatacgagctcgctaaagagtttggtgtggagagcaaggctgtcctggccaaactccaggagatgggcgaattcgtacgttcggcgtcctcgacggtagaggcgcctgtggtacgtcgactcaaggaagctttcagccagagcagcgagagcactgagggcgcgaagggcggacaggagaagaagaagcccagccccaaaccgcagcccagcccgcagcagcagactaaggcctcggccccgtcggccggtggtgagacgccacgtccggcggtgcctaagcccggccccggcctcaagccgggaccgcgtccggtgcccaagccgggaccgcgccccggtccccggcctgagggcggtgcgggcaaggccggtcagcagccttccggtgcccaaggtcccgcacgtcctgaatctgggaagacgccgcgtccggtgcccaagccgggaccgcgtccgggcaacaaccccttcagttcgaccgccagcggtatgggcacgcggcctacgccgcgtccgccggcgtccggcggtacgggtgcgcctcgtccggggccgcgtccgcaccccggcatgatgccgccccgccccggtgcgagtgcaggcgggccgccgcgtccccaggcaccgcgcccccaggcgccgcgtcctggtcctggcacggctggcggacgtcccggctcgagcgcaggcgggccgccgcgccctgtcccgcgtcccggtccgcggcccagcccgatgaacatgcctgcgtcgcggcccaccccgcctggtggggcccgtccgagcacgtcgagccgtagcggcggcggtcgcggccgcggtggtggcggcggcgctggaccgcgcggtggcggagcgggcggcggcgcgccgcgcaccggtttcggcggccgccccggtggtggtcgcggtcgcggcggaaccgctggagcgttcggccgtcccggtggccgtccgagccgttcccgcaagtcgaagaagcagcggcgtcaagaactcaaggacatgcaggcgccgtcgttcggcggtgtcaagatccccagcggtaacggcaaggtgatccggctgtcccgtggggcgtcgctggccgacttcggtgagcgcatcgacgtcaacccggcctcgctggtgcaggtcgtcatgacgcaactgggcgagatggtcacggccacccagtcgctgccggacgagaccctgcaactgctgggcgaggagctcaactacacggttgaggtcgtcagccccgaggacgaggaccgcgagctgctggagtcgttctccatcgagttcggtgaggacatcggcagcgaggaggacctcaagccgcgtgcgcccgtggtgaccgtcatgggtcacgtcgaccacggtaagacccggctgcttgacgcgatccgcaacaccaacgtggccagcggtgaggccggcggcatcacccagcacatcggcgcctaccaggtcaccaccacggtggacggggaagagcgcaagatcaccttcattgacaccccgggtcacgaggcgttcaccgcgatgcgtgcccgcggtgcgcaggccaccgacatcgcggtgctggtggtcgcggccgacgacggtgtcaagccgcagacggcggaggcgatcgaccacgccaaggcggccgacgtgccgatcgtggtggcggtcaacaagatcgacctgcctaccgctgacccgcagaaggtgcgcgcccagctcaccgagtacggcctggtggctgaggagtacggcggtaacgtccagttcgtggacatctccgcgaaggagaacctcaacatcgaccagctcctcgaggccatcatcctgacggcggacgccgagctggacctgaaggccaacccggacatgccggcccagggcctggcgatcgaggcctacctggaccgcggtcggggctccatggccaccgtgctggtccagcgcggcacgctgcgcgtcggcgactcgatcgtctgcggtgacgcctacggccgggtccgcgcgatgcttgacgagaacggcaaccgggtcaaggaagccgagccgtcccgtccggtccaggtgctgggtctcaccaacgtgcccagcgcgggcgacagcttcctggtggtcaaggacgaccgggtggcgcgccagatcgcgcagcagcgcgaggcccgcgagcggttcgcccagcaggccaaggccagccgccgggtcaccctcgacaactggcagaagaccctggaggagggccagcgcgaagagctgctcctcatcatcaagggcgacatgtctggttctgtcgaggcgcttgaggagtccctcctcaagatcgacccgggcaccgatgaggtcgcgattcgggtgatcggccgcggtgtcggtgcgatcacgcagaacgacatcaacctggctgcctcgtccggcgcggtcatcatcggcttcaacgtccggcccgagggcaagaacagcgagctggccgagcgcatgggcgtggacatccgctactactcggtcatctaccaggccatcgaagaggtcgaggctgccctcaagggcatgctcaagcccgagtacgaggaagtccagctcggtaccgcggagatccgcgagatcttcaaggtgccgcgggtcggcaacgtcgccggtgcggtggtccgcagcggtgtcatcaagcggaacgccaaggcccggcttatccgcgacggggtggtcgtctccgacaacctcaccgtcgagtcgctgcgccggttcaaggacgacgtcaccgaggtccgcgagggcttcgagtgcggtatcggaatcggctacaacgacatccgcgtcgaggacatcatcgagacgttcgagatgcgggagaagccgcgcgactga

SEQ ID NO: 1271 - DNA, 2844 bp, Pelobacter carbinolicus
atgggtaaaaaaatacgagtatatgaattagcacaaaaaatgggtgtcgataataaagtgttgctggaaaagctccacgaagccggcattgacgcaaaaagccacatgagtgtcttgagtgaggaagatgtcgagaagcttgatgaagcacccgccaaggtggaacgcgtagaagaacgccgcattaccgccggcgtcattcggcgtcgtcgcaaagaagtcccccaggaagagaaggcggcgccccccgcagctgccgaagaaccttcctctgtagacaccgctgtcgccgaagaagctcccgcagaagaagtgcaacccgtctctgatcaaccggagatcgctgttgagcccccccccgcgggcaaacaggaagaggttgcagcgcctgcgccggaacccaaggcggaggagccggtcgtagaagaagtaatcgcggagcctgcagtggaggaagtggtcgaagagccatctgctgttgagcaggaagaacatgttgagacaacaccggtcgccgaagaagagccaaaggtagaggaacaaccgtccgttgaagctgaaagcaaggctgtttccggggagctcgaagaatcaaaaacggccgatcaatcaaaagggcagtcggaagcggctgaagtttcggtgaccaaggaaaaacccaaagtagaaaaagctacggctaatcgtgccaaaattctcggccgcgtggagctctccacgctgacctcgcctcccaaacgccaggaacgcgctaaaaatggcaaaggacgccccgaacgtcccaagggagcaaagccttccggcggtccggcgcctcgcgctaaagaagccgcaccccaggcggctgtgccatttgacggcggtccggcccctgataaagaggttcgcggaggcaaaaagggtaaaaagggcaaaggcaattcgtacgataaggataaaggctttgccgacggcggtaaggggcgtcgtgctcgcaggcaggtttacgagccggaacgcgatgaacgtcgtatgcgtcgcggtaaaaagactcccaagccgcaaaagaaaactgaggttaccgtctccaaggcgatcaaacgtatcatccgcatcagcgatgtcattaccgtcggtgaactggccaagcgcatgggggtcaagagtaaggaccttatcaccgaacttatgcgccaggggcaaatggtcaccatcaatcaccccctcgatttcgaaaccgctgccatcctcgcttccgaattcaattacgaagtggaaaacgtggctttcgacgaagaaaacctgctggcggatactgccgctgtcaccgaagaaggcgatagtgaagaagggtgcgtgcccaggccgccggtcgttaccatcatgggccatgtcgaccatggtaaaaccagtttgctggatgcgattcgagccaccaatgtaaccggcggagaggccggcgggatcacccagcatatcggtgcctacgacgttagtgtggatgacaagaagatcaccttcctcgatacgcctggtcacgaagcctttacctccatgcgagcccgtggagccaaagttaccgatatcgttattctggttgttgctgccgatgacggtgtcatgccgcaaaccaaggaagccatcaaccattccaaggctgccggcgttcccattatcgtggctgtcaacaagatggataagcccgacgccaattccgatcgcgtcaagcaggaactcaccgagttcgaaatgatcccggaggaatggggtggcgataccatctttgtcgaggtgtccgctaaaaatcgcaccaatctcgattctttgctggaaatggttctgcttcaggcagaggttctggaacttaaagccaatccgaacaagcgtgcaaaaggtgccattgtagaagcgcgtctcgatcgtggacgcggtcccgtagccacggttctggtggaggaaggcaccttgcgtatcggcgatcctatcgtttcgggtctgcactacggtaaggttcgcaccatgaccaacgatcgtggggaacgtctggaggaagccggaccggcttgccccgtcgaggtcacaggtctttccggaacgccaacggctggtgattctttccatgctgtcgagtccgaaaaagacgccaaggaagtggccacccacaggcaacgcaaagtccgcgagcaggaattggcatctaccagcaagatatctttggaacaactctatgcccgcatgcaggaaggcgaggttcaggagcttaaagttatcatcaaggccgatgttcaggggtccgtggaagccgttcgcgattcgctggtcaagctttccaccgatgcatgtcgactggttgtcattcataccgccgtcggtggtatcaatgaaagcgatgtgtctcttgcctctgcttccgatgccatcattctcggcttcaatgtgcgcgccgaatccaaggcggcagctcttgcagaaacagagggcgttgatatccgcttctataatgtcatttatgatgcggtaaatgatatccgggatgctatggaaggcttgcttgccccgacgctgagagagaaacatctcggtaaggtggaagttcgtgaaaccttccatgtatccaaagtggggacgattgccggttgttacgttaccgaaggcaaggtgctgcgcaatgcgcaggtgcggttgatccgtgatcacgttgtgatttgggaaggtaagcttgcatccttgaaacgttttaaagatgatgcccgcgaagttcagaatggttatgaatgcgggttgagccttgagaactacaatgacatcaaggtcggcgatattatcgaagtctttgaaatggaagaggtgaaaacctctctctga

SEQ ID NO: 1272 - DNA, 2853 bp, Anaeromyxobacter dehalogenans 2CP-C
atgtccaagaagcgggtccacgagctcgggaagcagctgaaggagcagggcatcgagctctccaaccaggagctcgtcgagaagctccatgcgctcggttacctcgaagtgaagagtcactcctcgtccctcgaggacgatcaggcccacgcggcctacgagaagatcctggccgagcggaagccgaagcccgcgccggcgcgtccatcgggccccggcttcgtggtgcgcaagcgcgcccacgtcgagccgcccaccgtcaccgcgcccgcggcgccgccgtcgcccgagccggagtacgcggagccgcagtacgcggagccgcaggcggagcaggcctacgagcccgagccgcaggccgcgcagcccgaggccggcgccgagccggccgccgccccggagccgccggcggaggccgcgccgctcgccgcccaggccgcgccgtcgccgggcgccgaggccgcggcgcccgccgcgccgcaggcgcagcccgcccagccggccgcgcccgccgcgccgcccgcgcccaccgcgcagccgtccgcgccgccgccggccgccgcgcagcccaggccgccgcagccgtccgcgccgtcgcgcccgccgccccccggctaccggccggcaccgccgcccggcgcgcgcccgcccgtctccgccgccccgggggcgcccggtcagcccggcgccgccggccagccgccgcgtccgccggtggacccgcgcacgctccgccccacctccacgcaggccgtcgtcatctcgcggccgctcgtgccggtgcgccgcgtgacgccgcccacctccgcgcgccagcagttcccggtcgccccgggcccccgcgcgctcggcgaggtccgcgagctcaaggtggtccccggctcgctcggccgcgagcgcgagttcatcgacgtctcgcgcgacaagcgccgcggccgccagcccggccggcccatctccgaggagcaggccaagagcctgagcggcaaggagctgctccaggccgccatcagcgatcgcgcctacatcccgatccgcggcaagaagaagaagccgaccaagaagggagccaagacgcagatcaccgagaaggccgagcacaagaaggtcatccgcatcgaggagtcgatctcggtctccgagctctcccaggtgatgggcgtgaaggcgtccgacctcatccgcaagctgatgcagatggggaagatggtcaccatcaacgcgcagatcgacgccgacaccgccgcgaccctggcgctcgagcacggctacaccgtcgagaagaagggcttcgaggtcgaggagttcatccccgaggtcgaggtggacgagtcgaagctcgtcatccggccgccggtggtgacggtgatgggccacgtggaccacggcaagacgtcgctgctcgacgccatccgccaggccgacgtggccgccggcgaggccggcgggatcacccagcacatcggcgcctactcggtgaacacgccgcagggcccgatcaccttcctcgacacccccggccacgaggccttcaccgcgatgcgccagcgcggcgcgcaggtgaccgacctggtggtgctggtggtggccgcggacgacggcgtgatgccgcagacggtcgagtccatcaaggcggccaaggcggccggggtcaccatcctggtggccatcaacaaggtggacaagccgcaggccgcgcccgagcgcgtcatgcagcagctcaccgagtacgagctggtcgccgagcagtggggcggcacgaccatcatgctgccggtctcggcccgcacgaagcagggcatccccgagctgctcgagtacatcgcgctgcagtccgaggtgctcgagctcaaggcgaacccggacaagctcgccgccggccgcgtcatcgaggccaagctggagaagggccgcggcccggtcgccaccgtgctggtcgaggagggcaccctccgcgtcggcgacgcgctcgtcaccggcgtccacttcggccgcgtccgcgccatgatgaacgagcgcggcgagcaggtggacaacgtcggcccgggctatccggtcgaggtgctcggcctctccggcgtgccggtcgcgggcgacgagttcgacgtggtcgaggacgagaaggcggccaaggaggtcgcccagcaccgcgccaccaagcagcggcagaaggagctgggcggcgtcaagaaggccacgctcgaggacctgttcgcgaaggccaagacctccgcccagaaggtgctcaacctggtggtcaaggcggacgtgcagggctcctccgaggccgtcagccaggcgctggagaaggccgccaccaagaaggtgggcgtcaagatcctcgagtccgcggtgggcgcgatcaccaagtccgacgtgctgaccgcggccgccggcaacgcggtgatcgtgggcttcaacaccaagcccgagaccgagatcgagaacatcgccagccagcagggcgtgaagatcctcatgttcgggatcatctacgaggcggtggaccggatccgcgaggagatggccggcctgctcgagccgatcatcaaggagaagccgctcggcaaggccgaggtccgccaggtcttcaacatcccgcgcgtgggccagatcgccggctcggcggtcaccgagggcgtggtgaagcgcgccggccacgtccgcgtggtccgcgaccgcaaggtggtcttcaccgggaagatcggctcgctgaagcgcgtgaaggacgacgtccgcgaggtcgcgcagggcttcgagtgcggcatcggcgtggacggcttctccgacgtgaagcagggcgacgtcctcgaggtctacgagctcgaggagatccgccagtcgctcgactag

SEQ ID NO: 1273 - DNA, 3189 bp, Frankia CcI3
gtggcaggaaaggcccgcgtacacgagctcgccaaggagcttggtgtcgacagtaagaccgtgctcgccaagctcaaggatctcggcgagttcgtgaagtccgcttcgtccactgtcgaggcacccgtcgtccgcaaattgaaggaagcgttccccgccgacggcgcacccacttccccgggccgggccaccagccgtccgggaccgccgggtggcggcgctcgtccgaccccgccgtcccgtcctggtctggcgcctcggcccggtccgcgcccggttcccgggcggcctggtcccctcggccggcccggtccggcgaccccggcgccgtccccctcgcccgcgtccccgccgctaccggcctccccggtgcaggcttcgccggtgcaggcctccccggtgcaggcttcgccgacgtctgcacccgccgctccccgtccggccgcggcctccgccgtgcccgcgccgccgatgccgtccgtgccgtccgctccctccgggccgcgacccgggccgaacgctccgcgtcccggtgccccgcagggcggtggccgtccgcgtcccggcaccccggttcctccctcgggtcccaccgctggcggtccgaccgctggcggtccgaccgctggcggtccgaccgcaggcggcccccggcccgggccgcgtcccggaccccggtcggctgcgcccggtaacaacccctacacgacgccgtccgctgggccgcgtccgtccgctgggccgcgtccgtcggccgggcagtcgggtccgccatcgacgcccactccccggcccagcgccccgcggtcgggtaccccccggccaggtaccccccggccgggtggaccgcgccccggtggcaccggtgccggtggtccacggcccactcccggcgggatgccaccacgtcccggcggtccacggtcaggagcggggggcggcatgccgccccgcccaggtggcaccggggggccgcgccccaacgcgaacatgttccagcctcggcccgccggtggccctcccggacgcccgggcggtggtggcgcgcccggtcgtcccggcggtggtggcgcgcccggtcgtcccggcggtggcggcggtccgcgtcccggcggattcgccgggcggggtggtgcgcccggtcgtcccggtggtggtggcggcggtggtggtgcgcccggtcgtcccggtggtggtggcggcggtggcggtgcgcccggtcgtcccgcggccggcggccgtggccgcggtgggaccacggcgggcgccttcggccccggtggccgtggtcgccccggtcgccagcgcaagtccaagcgcgcgaagcggcaggaatgggagagcgggctcgaagcgccgcgcatgggcgcgatggtgccccgcggcaacgggcaggccatccggcttccccgtggcgcctcgctggccgatttcgccgacaagatcgacgcgaacccgggcgctctggtccaggtcgtgttcacccagctcggcgagatggtgaccgcgacccagtcctgcaccgacgagacgctgcagctgttgggtgtcacgctcggctacgaggtccagatcgtcagcccggaggacgaggacaaggagcttctcgagagcttcgacctctccttcggcggggagtacggcgacgacgtcgagctcagctcccggccgccggtcgtgaccgtcatgggtcacgtcgatcatggtaagacgaaactgctggacgccatccgctccaccgacgtggtcgggggcgaggccggtggtatcacccagcacatcggtgcctaccaggtgcgggccaaggtcgacggcgacgagcgtccgatcaccttcatcgacactccgggccacgagaccttcacggccatgcgggcccgcggtgcgcaggtgacggacatcgtggtcctggtcgtggccgccgacgacggggtgaagccgcagaccatcgaggcgctgaaccacgcccaggcggccggcgtcccggtcgtggtggcggtcaacaaggtcgacaaggagggcgccgacccggccaaggtgcggggtcagctcaccgagtacggcctggtggcggaggagtacggcggcgacacgatgttcgttgacgtctccgcccgcaaccggacgaacatcgacggcctgctcgaggcgatcgtcctgaccgccgacgcatccctggacctgcgggctccgaccgaggtcgaggcgcagggtgtcgccatcgaaggtcggctcgaccggggccggggtccggtggcgaccgtgctggtccagcgcggcacgctgagggtcggtgactcggtcgtcgccggcgaggcgttcggtcgggttcgggcgatgctcgacgaacacggtggtcaggtggtcgaggcgggcccggcccgacccgtccaggtcctggggttcaccagcgttcccgacgcgggtgacaacttcctggtggtgcccgaggaccgggtggcccgtcagatcgccgaacggcgtcaggcccgcgagcgtaacgcggagctggcgctgagccggggccgtccgacgctggagacgatcctcgagcggatgaaggagggcgagaagacccagctcaacctcatcctcaagggcgatgtgtccggttcggtcgaggcgctcgaggacgccttgctcaagatcgatgtcggtgacgaggtcggtctgcggatcatcgaccgtggggtcggcgcgatcactgagaccaacgtgatgctggcgtcggcgtccgacgcgatcatcatcggcttcaacgtccggccgcagggcaaggcgacggagctggccgaccgtgagggcgtcgaggtccggtactactcggtgatctaccaggctatcgaggacatcgagaacgccctgaagggcatgctcaagcccgtctacgaggaagcgcagctcggtaccgccgaggtccgcgaggtcttccgcgtgccgcggatcggcaacgtggccggctctctggtccgttccggcgtcatccggcggaacaccaaggccaggctcatccgcgacggcgtcgtcgtggccgacaacctcacggtcgagtcgctcaagcgtttcaaggacgacgcgacggaggtccgcgagggctacgagtgcggtatcggtctcgggtcgttcaacgacatcaagatcgatgacgtgatcgagacgttcgagcaacgggaggttccccgcgcctga

SEQ ID NO: 1274 - DNA, 3036 bp, Candidatus Koribacter versatilis Ellin345
atgaagattcgaattaacgatttagcacgagagctggaagtgaagagcaaggctattctcgatgcgctgaccaaggtcggcgtgaccgagaagaagacccactccagttcgattgaagatcacgaagccgtgctggtgaagaagtacatccatgagcacgggaccgaagaatcgccgcgtcggcgaagcgccggagaagacgagttcaagccgaagatcgatctctcaaagatttcgaagcccggcgatgtgctcaaggcgctcacgcagaaggctgcccctccgccgccacctccgcctccgccacgcccagccgtgaaggcgccgagccctgtttcgcaggagccgcgtccgccggccgttccgcccgcacctcagaagcccgccgtgtttgcgcgtccggcctccgagacggtgcatacgccgcctgagccaccaaagccgcgtttcattacgccagcgagcgttgccgcgcagcgtccggtgatcacgcctccgaagccgccagttccgcccgcgcctccggtagccgtcgcgccgccggcagtgattgaaccggccgctccggccgaagagccaaaggccgctgcgccagctacgactgcgccggaagcgcccgaagttaaagcgccggtttcgccggagcgagtcgctcccgccgcggacactggcgcacacgtaaccgcaaagccggaagccccagcagctccaggcgcagccactcccgcgcctacgccgggacgtccgctgccgggtgtgccgttgcgccaacagacgccgggtcgtcgcatgatcgttccgcaaaccggaccacgtccggtttacagcgcgccgccgccggcaccaccgcgtccgactccgccgccgcaaatgtcgcagggagcaggtacgcgtccgggtatgccggtgcgcggtcagcccattttccagcgccgtccgcaaagcggtcctggtggtggttcgggaggtccaggtggattccagcgtcctggcggtccgccgcgtccgggggatcgcccgcgtggtccgcatccaacgcggcagttccccagcggtccccgtccgatgggcgggatcggcctagcgcctccgggagcacccgcgaataagccggcaggccgtccggcaccggcacggcgtccgggccagcgttatgtcccgcgtggacaaaaagaaggcccaatgaagggctttgttccgccaccgcggttgtcgctctccaatgagccgctaccgatcacgcggaacatcacgatctccgaaggtatcagcgtgaaagatctcgctgagaagctcgggattcgcgcgaaagacctcatcgcccgtttgttggcgcgtggcgtattcgctaccgtcaaccagacgctcgaagccagtcttgccagtgaaatggcgaaccacttcggcgcctcgacggacgtcattaccttcgaggaccaacttgcgcaggagactgccaaggctgccggtgagactccggaagaagcggccgcgaacgctgtcgtgcgtcctccggtcgtcaccatcatgggccacgttgatcacggtaagacgagcttgctcgacgcaatccgcgcgaccgacgtagcgggtggcgaagccggtggcatcacgcagcacatcggcgcttacaaggtagcgatcggtgatccgaactctccggcgtttggccgcgagatcgtattcctcgataccccaggtcacgaggcgtttacccgcatgcgtgcccgcggctcgaagatcacggacatcgttgtgatcgttgtcgctgctgatgacggcgtcatgccgcagacggtcgaggccatcgaccacgcgagagcggcgaacgtgccgatcatcgtggcggtgaacaagatcgacaagccagacgctatgcccgagcgcgtgaagaagcaactcgctgatcgtggcctgatgccggaagattggggtggcaacaccgtgttcgtcgacgtatcggcgaaacagaagaccaatctcaacctgctgatggaaatgatctgcctggttgccgacctcggcgacctgaaggcgaatcccgatcgcatggcgagcggtacagttgtggaagcgaaacttgatcgcggacgcggtccggttgcaaccgtgctggttcagaatggcacgctcaggaccagcgacaacttcgtggtcggcaacgcattcggcaaagtccgcgccatgtttaacgatcgtggtgtgtcgctcgacaccgctggaccttcgactccggtcgagatcattggtctcgagacactgccgcaagccggcgaccagttcacggtcgtagccgatcgtgagaaggcccgcgacatctccgagtaccgcgaaggccgcgctcgcgaagcacagcttgcgaagagctcgcgcgtttcactcgaaggcttggctgaacagctcaagaccgccggacagaaggacctgccgatcatcctcaagggcgatgtgcagggctcggtcgaagtgctgaatgacttgctgagcaagatgtcgacggaaaaggtgaagatcaccatgatccgtagcggagtgggtgcgatcaccgaatccgacgtgctgctggcctcggcgtcgaacgcgatcatcatcgggttcaacgtgcgaccggagcgcaaggcgcaagagctcgccgtacaggagggggtcgacatccgcctgcactcgatcatctacgagttgcaggacgagatgaagaaagccatgctcggcttgctcgaaccgatcatcaaggaaacctaccaggggcgcgcggacgtcaaagacaccttccgcatcccgaaggtgggtaccatcgccggttgccaggttgcggatggcatcatcaaacgcgactcgcacgtgcgcttggtgcgtgacaacgtggtgatctacaccggcaagatcggatcgctgaagcgtttcaaagacgacgccagcgaggtccgtaacggcatggagtgcggtatcggtatcgcgggttacggcgacattcgcagcggggacgtgatcgaagcgttcaccagcgaaaagattgctgccgactcgctgcactag

SEQ ID NO: 1275 - DNA, 2070 bp, Rubrobacter xylanophilus DSM 9941
atgagtaagcgcgtctacgagatcgccaaggagctcgacctggacaccaaggaggtcataggccgcctgaacgccgccgggatcgaggtgaagaaccacttcgccacggtcgaggacccggactacgagcgggtcttcggcgggggcaacggccgctcggaggccggggaggagcgcgggcgcaagggccggcagaagaagcggcgccgggtggtgatcgacgcgagcgccacgaaccgcgggcccagggccgccgccccctcgcgcccgtccaggggccggggggccgcccgggaggaggccccggccgccgaggagcgggaggccccggaggtcgtgcgggtcgagccgggggccacggtgcgggatctgggcgaggcgctgggggtgccgcccacgcggatcatccagatcctcatggggctcggggagatgaagaccgtcacccagacgctctccaccgaggagatagagctggtggccgaggagctcggccgcagggtggaggtgggcgcgctcgaggagcccgccccggaggagataggccccgaggactcccccgaggacctcgtcgagaagcccccggtcataaccgtgatgggccacgtggaccacggcaagacctcgctgctggacaggatccggcgcaccaacgtggtctccggggaggccggcggcataacccagcacatcggcgcctaccaggtggagcacgaggggcgcaggatcaccttcatcgacaccccgggccacgaggcattcaccgagatgcgggcccgcggcgcgcgggtgacggacatcgtggtgctggtggtcgccgccgacgacggggtgatgccgcagaccgaggaggcgatcgagcacgcccgcgcggcgggggtgcccatcgtggtggccataaacaagatcgacgtccccaacgccaacccggaccgggtgatgggcgagctcgccgagcggggcctgacgcccgagcagtggggcggcgagacggtgacggtcccggtctcggccaagacgggcgaggggatcgaggatctgctggagaacatcctggtggtggccgagctggaggagctgcgggcgaaccccaaggccccggccagcggctacgtgatagagagccggctggacccgggccgcggcccggtggcgacgctgctcctgaaccggggcaccctgcacaggggggacgtggtgctcgcgggcaccgcctacggccgggtgcgggcgatgttcgactacaccggccagcgcatcaaggaggccggccccggcacgccggtggagatcctggggctctccggggtgcccgaggcgggcacgcgctttgaggtcgcggagaacgagcgggccgcgcgctcgcgggcgcagcaggcggaggagcggctgcggcgccaggagctcgccgcgagcggcccccgcaggaccacgctggaggagctgctcggcgagggcggcgccgaggagctgaacctggtcgtgaaggccgacgtggccggctcggtggaggcgctcaaggaggcgctcgccaagctctccaccgacgaggtgcgcgtgaacgtggtccgcagcggcgtgggcgcggtgaccgactcggacatcatgctggcctcggccagcggcggcatcgtgatcggcttcaacgtccggccgaccaacaccgccaagcaggtcgccgagcgggagggcgtggagatccggacctacgacgtgatctacaaggtcatcgaggagatcgaggcggccatgaagggcatgctcgcgccggagaccgccgagcgcgagaccgccaccgccgaggtccgggcgaccttccgggtgccgaacgtgggcacggtggccggctgctacgtgacgagcggcgagatccggcgcaacaaccgggtccgggtggtgcgcgacgggacggtggtctacgacgggcagatagcctccctgaagcgcttcaaggacgacgtgcgcacggtgcgcgagggcttcgagtgcggcgtgggcatcgagaacttcaacgacgtcaaggagggcgacgtcctggagttctacgaggtcgtcgagataccccgctag

SEQ ID NO: 1276 - DNA, 2889 bp, Syntrophobacter fumaroxidans MPOB
atgacgcgaatgagggtgcatgagcttgcgaaagaactcaacatggacaataaagacctgatcgatcgcatccttaagctggggatacaggtcaagaaccacatgagcactctgaccgactccgccgtcttgaagatccgtcagcagttttccgaggcgaagaccgagaccgttgaagaaaagcgtatcggcagagccgtgatccgaagaagaaagaagctgaccgaaggagaatccgccgctgcgcccgccgaaggtgaggaacgcgtcgcgtccgaggcgttgcccgtggaggcggagatgcccgctcaaccggtggaggcgccggagttgatcgcggaacccatctcgaagcttccccccgaggtgggcgtcgcccagccgcaactccccgaagaacccgagccggcacctgagcccctcattccggcagtaaaacccgaagaggccgccgcctcggaactcgccgtggaaccccagacagtcgttcccccggtcgctgcgcccgcggcggaagtcaaaccggcccgtccgccgatggaggcgcctgcgccggcacgcaaaccccccgaggagaaggaaacgaaggtgaaacacgctgaacccgaatcgctcgctgaaccgctgccctcccccgcccccgttgagctcaccctcgtgcctgccgagtctgccgccggccaggttgccgaaagaaccgacgaggaagaagaggaagacgacaaggccagaccgaagaaggctaagaagagacggcgcaagaaggtgcgcaaggatgagcctgcgcggatcatcaagctcccggagatcatcccggaggaacccgaagaggaagcggtcctgcccgctcacctggcgacccgcatccaggtcaagaccgaagaggtcgaggtcaaggaagctccccgcaagaagcggccccgtcccgaggaattcgagaaggaggctgccgaacgcaaggccaagggcacccggcgcaaggaggttttcgagcgcgaagacctttactcgaaacaggagatcgccgcccaggacgatcgcggtcggctcaagggggacaagagacgaccttttgcgaaggagccggcgcggcccgaaatcgccgtcgtgaagccgggaaagcgtaaaatccgggtcgacgaagccataaccgtggcgaacctggccaaacagatggggataaaggccacggaactgatcaagaagctcctgctgctgggcctgcccgccaacatcaaccaggctgtcgattttgacacggccgccctgctggcctcggagtttgaattcgaagtcgagaagaccgggttcgaggaagaggaactcctccaggtccgtgaggaccgggtcgaagacctcatccgaaggccacccgtcattaccgtcatgggccatgtcgatcacggcaagacctctctgctcgacgccattcgcgatacgaacgtgatcggcggggaagccggcggcatcactcagcacatcggcgcctactatgtgatgctccccaacgggaacgtcgtctttctcgacactccgggccacgaagcgttcacttccatgcgggcccgcggggccaaggtcacggacatcgtgattctggtggttgccgcagacgacggcgtcatgcagcagacgatcgaggccatcaatcacgccaaggcggcggaagtgcccatcattgtcgccatcaacaaggtggacaagcccaacgccaacatcgaccgggtcaagagggagctcgccgagcacgggctgatcccggaagaatggggtggaaacgtcaccatggtgggaatatcggccaagaaacgcacgggtatcgaggaactgctggaaatggtcctgctccaggccgagctgctcgagctcaaggccaaccctgcaaagccggcgcgcggccgggtgatcgaagcgaagctggacaagggaagagggcccgtcgcgaccatcctgatccaggaaggcaccctgcgcaccggcgacgtctacctgtgcggcgtgaattccggtcgtgtcaggaacatgttcagcgaccgcgggcaacggctggatgaagcgggaccgtcaatgcccgtggaagtgctcgggctgtcgggcgtgcccaatgccggagacgatttcatcaccctgccggacgagaggcaggcgaagatgatcgcggaacaccgcctcgtcaagctccgcgaaaaggagctgtcgcggaccagcaaagtcaccctggagagtctgttcgaacagatccaggaaggcgaaatcaaggaactgaacctgatcctgaaggccgacgtgcatggctctctcgaggccatcacggattcgctgctcaagctgtccaccccggaagtcaaggtcagtctgatccatttcggtaccggtgccgtcattgaaacggacgtgatgctcgcatccgcctccaatgccatcgtgatcggtttcaacgtcaggtcggagacgaaggtgcaggaactggcggatcaggagaacgtggatgtgcgctactacgatgtcatctatcaactcctgagcgacgtcaaggacgccatggtcggcatgctcgaacccgtcttcaaggaaaacgtgatcggccgcgccgaagtgcgacagaccttccaggttcccaagatcggcatgatcgcgggcagcttcgtcctggaagggcgcgtggaaagaaacgccaaatgccgcgtgctccgggatcacgtggtcacctatgacggaaaaatcagttcgctgaggcgattcaaggatgacgccaaggaagtgaaggcgggcttcgaatgcggaattggcgtcgaaaacttcaacgacatcaaggtgggtgatatcctcgaagtctatgaacttcaggagatgaagcccgtcctggaatccccgccgggggacaaatga

SEQ ID NO: 1277 - DNA, 2640 bp, Acidothermus cellulolyticus 11B
gtggccaaggttcgggtgtacgagctcgcgaaagagctcaacgttgagagcaagacgctcctcgccaagctgcacgagcttggggagttcgtccggtcggcatcgtcgaccattgaagcccccgtcgtgcgcaagcttcgcgaggcgtttccgccgccgccggagccggcggctgggaacggaagcgcggcgcagccgacggccaagccatcggccgccaagagcacgggtaaaaccaccgaacccgccgcggacgccgccgcaccgccggccgtgaccacgccgccgtccgctgctcccgccggtgcgacgacgagcgcgccgagcgacgccggcggggagaagatcgcgacgccgccgcgtcccgtgaaactgccgcagccgccgcgccccgcgcccgcggtgccgaaaccgccgtccgggccgccgcgcatgggcaacaacccgttcaccagcccgatgccccggccgatgccgcctcgcccggtccaacggcctaccgggacgccgggcacgccgggcattccccgcccgccgctgcggccgggcgctcccggacggccgactccgggtgccatgcctcctcgaccggcggctggccgtgccgctcccggtcgaggcgcacccatccggcttcccggtggtctgggccgggcgccggcgccgccaagcgccggccggccgggtgtcggcggccggggtcgcggtgccccgggcggtgcattcggccgcggcccgggagcgaaaccgagccggccccacaagtccaagaagcagcggcgtcaagaattcgacaacctgcaggcgccggtcatcggcggtatccaaattccacggggcaacggccaggtcgtccgcctgccccgcggcgcctcgcttgccgattttgccgacaaaatcggcgcgaatcccgcgtcgctcgtgcaagtggcgttccaccttggcgagatggtcaccgcaacccagtccgtcaacgaggaaacccttcagttgctgggcgcggagctcggatacgaggtacagatcgtcagcccggaggatgaagaccgcgagcttctggagagtttcgacatcgaactcggcaccgaccagggcgatgaggccgcgcttgtgccgagacccccggtggtcacggtcatgggtcacgtcgaccacgggaagacgaaactgcttgacgcgattcgcaacaccaacgtggcggcccgcgaacacggcggtatcactcagcacatcggcgcataccaggtgaccgcgcagaccgccgacggcccacggcaaatcaccttcatcgacacgccgggacacgaagcattcaccgcgatgcgtgcccggggtgcccaggtgaccgacattgccgttctggtcgtcgccgcggatgacggcgtcatgccgcagaccgtcgaagcactgaaccacgccaaggcagccgacgtgcccatcgtcgttgcggtcaacaaaatcgacaagccgggtgccgacccggttaaagtccgcggccagctcaccgagtacggcctggtggcggaggagtacggcggcgacacgatgttcgtggacgtgtccgcgttgaccgggcagggcattgacgacctgctcgaagccatcctcctcaccgcggacgccgccctcgacctgcgggcgaatccgaaccagcccgcccagggggtcgccattgaagcccacctcgaccgcggtcgcggtccggtcgccacggtgttggtgcagcgcggcacgctgcgggtcggcgattcgatcgtcgccggtgaagcgttcggccgggtccgggccatgctcgacgaattcggccagccggtcgaggaggccggaccgtcccgtcctgtgcaggtcctcgggttcaccagcgtgcccgacgccggtgacaccttcctcgtcgtaccggaagatcgtgtcgcccggcagatcgcggaacgacgggccgctcgggaacgcaacgcccagcttgccgccagccgccgtcggcgcaccctcgaggacatcctcgagcggatggagaaaggggaagtcgccgagttgcggctcattctcaaaggtgacgtctccggttccgtggaagcgttggaggatgcgctcctcaaaatcgacgttggtgacgaggcgcggattcgggtgatcgaccgcggcgtcggcgcgatcaccgagaacaacgtcatgctcgccgtcgcatcagacgcgatcatcattggcttcaatgtgcgcccggaaggaaaagcccgcgaactcgccgagcgggagggcgtcgacgtccggtactactcggtcatctaccaggcgatcgaggacgtggaggccgcgctcaagggcctgctcaagccggtgtacgaggaggtgcagctcggcaccgccgaggttcgcgaagtcttccggtcgagcaaattcggcaacattgctggatgcctggtccgctccgggacgattacccgcggcgccaaggcccgcgtggtgcgcgacggcgtcgtcgtcgccaacgacgtgtcgatcgcctcgttgcggcggttcaaggacgacgtcaccgaagtgcgggaagggttcgaatgcggtgtcggtctgggctcgttcaacgacatccgggtcggcgatgtgatcgagacgtacgagatgcgggagaagccgcggagctga

SEQ ID NO: 1278 - DNA, 3240 bp, Desulfovibrio vulgaris DP4
atgacggaaaacaagaccaaggtgaaggatctcgcggccgaactgggcgtgacgacgaaggagctgggtcaggtgctcaaggatatgaacatctcggccaagacctccaccagcgtcatcgctcaggaagacctgccgcggatcaaggagcgcgttcaggcgcaacgcgacggtggagcccgcaaagagggcaaccccgacgtgatcgtgcgccgtcgccatcgcgacggcgacagggcgtccgcacgcgccgaggcaaaggcccccgagcaggaggccacagccgccatgcccgagacctccgcgcccgaaagggccgaagaagccgacaagcccgctgtggcgaagcccgccaaggctccggagacggaagcccacgcgcgtgcccgcaaagagccgcaggcggaacctgtcaaggcgcgcatcatccgccgccctgacgagcccgcccctgtggcgaaggtcgtcgaggctgcacccgcagagacacccgcccccgaagcgcccgccgtaaaggcgaccgtcacggccgaagcagcccctgcgaagaccgtagagcccgaatccgaacgcccgcaggccgacaagcccgccacggcgcgtgtcgtgcgtcctgccacgcccgacgcctcggccgtgccggacggtacgtcctctgcccccacgctgcctgtccgttccgccgaaccttccgacaccgtcgaacgtgcagacgccgacgcggatggtgatgacgacgatgcacagcagcgtcgccgcaagaagaagcgtcgccagcctgaagccgtggtgccgcaggttcgcgtcatctcgcgtcccgaccctgccgctgtggcccaacagcagatgcagcagcaggcggcacagcaacagcgtgaagcaggcggctatcgccccggcggtcagcgtcccgagggcggctaccgtcccgaaggccagcgcgaaggcggctaccgccccgaaggccagcgcgaaggcggctaccgccccggcggcgcaccccgccccgaaggtggctaccgtcccggtggtccgcgccctgaaggcggctaccgccccggcgcaccgcgccccgaaggcggctacaggcccgctggcggtccccgccccgagggtcagcgtgaaggtggctaccgccccggcgcaccgcgccccgaaggtggctacaggcccgctggtggcgcaccgcgtcctgaaggacagcgtgagggcggctaccgtcccgccggtggtcctccccgtccgggtggcgcaccgcgtcccggcggcttcggcggtgcacccggcggcatgcccgtacccggtgccgatggccgcggcgaccagagcaagaagaagcggcagaagggccgtcgtaccgtagattttcaggctgacgggcctcgtggtcgcagcgatgacgacgtgatgcgcggcccccgcggccggggcaagcgcggcaagaaggacgtacgtcccgccgcgacccagccgctgaaggccatcaagcgcaagatcaaggtcgacgaggccatccgcgtggccgacatggcccaccagatgggtctcaaggccaacgagatcatcaaggtgctcttcggtctcggcgtcatggcgacgatcaaccagtcgctcgacatcgatacggcaactgtcgttgccggagagttcggctacgaagtggagaaggtcggcttctcggaagacgactacctcgtgcccaaggaagaggacgcgcccgagacgctggtcacccggcctccggtcgtcaccatcatgggtcacgtcgaccacggcaagacctccctcctcgacgccatccgcaagtccaacgtgacggctggcgaagcgggcggcatcacccagcacatcggtgcctaccatgtgaccaccaagaagggcgagatcgtgttcctcgacacgcccggtcacgaggcgttcaccgccatgcgcgcacgtggtgcccagatcaccgacctcgtcgtgctcgtcgtcgccgccgatgacggcgtcatggagcagacccgcgaagccgtgaaccactcgaaggctgcgggcgtgcccatcatggtcgccgtcaacaagatggacaaggaaggggcaaaccccgaccgcgtcatccgcgagttgtccgaactgggtctcgtggcggaagactggggtggcgataccatcttcgccaaggtctcggcaaagacccgcgaaggtctcgacgaactgctcgaactcatcgccattcaggccgaaatcctcgaactgaaggccaaccccgacaaggccgcccgtggtcacgtcgtcgaggccaagctcgacaagggccgtggccctctcgccacggtgctggtgcaggaaggcactctccgtcagggcgacgccttcgtctgcggcgtgttcgcaggccgcgtgcgcgccatgttcgacgaccagggccgcaaggtgaaggaagccggtccctcgactccggtcgaggtgcagggctttgacggtgtcgtcgaagccggtgaggagttcgtgagcgtggccgacgacaaggtcgcccgccgcatcgccgaaagccgcgccgtcaagcagcgcgagcgcgaactcgccaaggaatcgaaggtcaccctcgaaaccttcctgtcgcgccgtgccgacgccgccgaggcgctcacgctcaacctcgttctcaaggccgacgtgcagggcacgctcgaggccatcagcgaggccgtgcgcaagctcagcaccgagaaggtcaagatcaacatcatccacggcggtgccggtgccatcaccgaatccgacatcctgctggcatcggcctccgacgccatcatcatcggcttcaacgtccgcccgacctccaaggtcaaggacatcgccgagcaggagaacgtggacatccgcttctacgacatcatctacaagctcgtggatgagatcaagagcgccatggcgggcatgctcgccccggtgcagcgtgaagtgtacctcggccaggccgaagtgcgcgagaccttcagcgtgcccaagatcggcgtcatcgccggttgccacgtggccgacggcaaggtcacccgcaacgcgggtgtgcgcctgctgcgcgacggtgtggtcgtctacacgggcaagatcacgtccctcaagcgcttcaaggacgacgtccgcgacgtgcagaagggctacgagtgcggcatgggcctcgagaacttcaacgacatcaaggtcggcgacgtcatcgaagccttcgaaatggtcgaagaggccgctacactgtag

SEQ ID NO: 1279 - DNA, 2070 bp, Bacillus cereus cytotoxis NVH 391-98
atgagtaagattcgagtatatgaatatgcaaagaagtacaatatttcaagtaaagagattattacaaaactaaaagaaatgaatattgaggtttcgaatcatatgacaatgttagacgatgaagtagtaaacaaactagataatgagtataataatgaagtgaaaaaaccttctgttgcagatgagtttgaagtagaagaaaaggttgttcgcagcaaaaagaacagcaataagaaaaagaaaaaaggcaaaggaaatcaagataaacgtcaagagaactttgctggaaaacagcaagcgcaaactgtagaaacaccagacaaaattactttctctggaacgcttacagtaggagaacttgcgaacaagcttggcaaggagccatctgaaattattaagaagctctttatgctagggattatggcaacaattaaccaagatcttgataaagatacaatcgagttaattgcaagtgactacggtattgaagtggaagaagaagtagtcatagatgaaattgagttcgaaacatttatcgatgaacaagatgaagaggaaggggacttaaaagagcgcccagctgttgtaacaattatgggtcacgttgaccatggtaaaacaacattacttgactctatccgtaattcaaaagtaactgctggtgaagcaggcggaattacgcaacatattggtgcataccaagtagaagtaaatgataagaaaattacattcttagatactccaggtcacgcggcgtttacaacgatgcgtgctcgcggtgcacaagtaacggatattacaattcttgttgtagcagctgatgatggtgtgatgccacaaacagttgaagcgattaaccacgcaaaagctgcaggagtaccaattattgtagcggtgaataaaatggataaaccagcagcaaatccagatcgcgttatgcaagaattaacggagtatgagttagtaccagaagcttggggtggcgatacaatcttcgtaccaatctcagcgattaaaggtgaaggaattgacaatttattagaaatgattcttcttgtaagtgaagtggaagaatataaagcaaatccaaatcgctacgcaacaggtactgtaattgaagcacaacttgacaaaggaaaaggtgcaatcgcaacattacttgtacaaaatggtacacttcgcgttggtgatccaatcgttgttggtacaacatatggtcgtgttcgtgcgatggtaaatgatattggccgtcgtgtaaaagttgctggaccatctactcctgttgaaattacaggtttaaatgaagttccacaggcaggagatcgttttatggcatttgctgacgagaaaaaagcacgccaaattggtgaatcacgtgcacaacaggcattgcttgcacaacgtggtgaaaaatctaaattaagcctggaagatttattccaacaaattcaagagggcgatgtaaaagaaattaacttaatcgttaaagctgatgtacaaggttctgtagaagcaatggctgcatcacttcgcaaaattgatgtagaaggcgttaaagtgaaaattattcatacaggcgtaggtgcgattacagaatctgatattattttagcttctgcatctaatgcaattgtaattggatttaacgtacgtccagatgtaaatgcgaagcgtacagctgaatctgaaaatgttgacattcgcttgcatcgtattatctataaagcaatcgaagaaattgaagcagcaatgcgcggtatgcttgatccagaatttgaagaaaaagtaatcggtcaagctgaagttcgtcaaacgtttaaagtaacaaaagttggaacgatcgctggatgctatgtaacagacggtaaaattacacgtgatagtggcgttcgtattattcgtgacggtgttgtcatttatgaaggacagcttgatacattaaaacgttttaaagatgatgtaaaagaagttgcacaaaactatgagtgcggtattacaattgagaagtacaatgatattaaagaaggagacatcattgaagcattcattatggaagaagtgaagcgatga

SEQ ID NO: 1280 - DNA, 3141 bp, Frankia EAN1pec
gtggcaggaaaggcccgcgtacatgagctcgcgaaggagctcggcgtcgacagcaagaccgtgctcgccaagctcaaggatctcggtgagttcgtgaagtccgcctcgtccacagtcgaggcacccgtggttcggaaactgaaggaggccttccccgcggaaggctccgctccgtcctcgcgtcccggcggtcgtccgggcaacggcgcacgaccgatgccgccgccccgtccggggcccgccatcggccgtcccggcccaggttccggcaccggtccccggcccggccctggtggccgtccggttcccggtcgccccggtccggccccgctgcccggggcatcgcgcccgtccaccccgacggccgcgccccagtcccagccggctcagacccagccgccccagtcccagccggtggcgccgcagccgtcgcaggctccgcgccccgccgcggccgcggcatccgccgcggcgccggccccggcaccctcggctcccgccccggcaccctcggctcccgccccggctccgatcacctcggccccgacggccgccacgccgccggccgcaccgcagcggccgactcccggtggcccgcgcccgggtcccgccgcgccgggtcgtccgcgtaccggcggccccggtggtcctggtggccccggcggcggcccgcgtcccgggccccggcccggcccgcggccggccgcgcccggtaacaacccctacacctccccggcggccggcccgcgtgccgcgtccggtcagggtggttccccctcggcaccgccgcgtcccggcgcgccgcgtccgggcggtccgcgtccgggcggtccgcgtccgggtgggcccggtggccagcgtccgtcgccggggcagatgcccccgcgtccgggcggctccggcggtccccggccgaccccgggccagatgcccccgcgtccgggcggctccggtggcccgcggccgaactcgaacatgttccagccccgtccggcgggtggcgccccgggccgccccggtggcggtggcggccccggccgtcccggtggcggtggcggtggcccgcgtcccggtggcggtgggttcgctccccgtgggggagcccccggccgtcccggtggcggcggtggcgctccgggtcgtcccggtggcggcggtcccggtggcggcggtcgtccggccgccggtggccgtggtcgcggcgggacgacggcgggtgccttcggtcctggtggccgtgggcgtcccggccggcagcgcaagtccaagcgcgcgaagcggcaggaatgggagagcgggctcgaggcgccgcgcatgggggcgatggtcccgcgcggtaacgggcaggcgatccggctgccgcgtggcgcgtcgctcgccgacttcgcggacaagatcgacgcgaaccccggtgccctcgtccaggtggtcttcacccagctcggcgagatggtcacggcgacgcagtcctgcacggacgagaccctgcagctgctcggtgtgaccctgggctacgaggtccagatcgtcagccccgaggacgaggacaaggagctgctggagagcttcgacctgtccttcggcggcgactacgccgacgacgtcgagctgtcggcccgtccgccggtggtgaccgtcatgggtcacgtcgaccacggcaagacgaagctgctcgacgcgatccggtccacggacgtcgtcggcggcgaggccggtggcatcacccagcacatcggcgcctaccaggttcgtgcggtcgtggacgggaccgagcgcccgatcaccttcatcgacaccccgggccacgagaccttcaccgcgatgcgtgcccgtggtgcgcaggtgacggacatcgtggtcctggtggtggccgccgacgacggtgtgaagccgcagacgatcgaggcgctgaaccacgcgcaggcggccaacgtgccgatcgtggtggcagtgaacaaggtcgacaaggagggcgcggacccggcgaaggtccgcggccagctcaccgagtacggcctggtcgcggaggagtacggcggcgacacgatgttcgtcgacgtctcggcccgcaaccggacgggcatcgacgagctgacggaggcggtcatcctgaccgccgacgcctcgctcgacctgcgcgccccgaccggtaccgaggctcagggcgtcgcgatcgaaggtcgtctcgaccgcggtcgcggcccggtggccacggtgctcgtccagcgtggcacgctgcgtatcggtgactcggtcgtcgccggcgaggccttcggccgcgtccgggcgatgctcgacgagaacggcgcccaggtgtccgaggcggggccggcgcggccggtgcaggtcctcggtttcaccagcgtccccgacgccggcgacaacttcctggttgtgccggaggaccgggtcgcccgccagatcgccgagcgccggcaggcccgcgagcgcaacgccgagctggcgctgagccgtggccgtccgacgctcgagacgatcctcgagcggatgaaggagggcgagaagacccagctcaacctcatcctcaagggcgacgtctccggttcggtggaggccctcgaggacgccctgctcaagatcgacgtgggcgacgaggtgggtcttcggatcatcgaccgcggtgtcggcgcgatcaccgagaccaacgtcatgctggcgtcggcctccgacgcggtcatcatcggcttcaacgtccggccgcagggcaaggcgacggagctggccgaccgcgagggcgtcgaggtccgctactactcggtgatctaccaggccatcgaggacatcgagaacgctctcaagggcatgctcaagccggtgtacgaggaggcgcagctcggcaccgccgaggtgcgcgaggtcttccgcgtaccgcgggtgggcaacgtcgccggttcgctggtccggtccggcatcatccgccgcaacaccaaggcccgcctcatccgggacggcgtcgtggtcgcggacaacctcaccgtcgagtcgctcaagcggttcaaggacgacgcgaccgaggtccgcgagggctacgagtgcggtatcgggctcggctcgttcaacgacatcaaggtcgatgacgtgatcgagaccttcgagcagcgggaggttccccgcacctga

SEQ ID NO: 1281 - DNA, 2655 bp, Candidatus Desulfococcus oleovorans Hxd3
atggcaaaaatcagaatatttgaacttgccagatcgctcaatatgactaacccggatcttttggacaggctgaaagagatgggtattgaggcaaagagtcacctgagctctctggaggacgatattgttgaaaaggtgcgacaaggcgtcttccgcacggaggttgagaagccggaaaaggtcgagcagaaacgggtgcggtccaacgtcattcgcaagagacggcagccggtaaaaagcgaggccgagccggaagcggaagcaccggccgcccaggcccctgaagccgaagaagtgacggcgccaacagccgaggaagcggtaccggaagaggccgcagatgcggatgtttccgcgaaagcagagacgccaacggcccccgagaccccggaagaagccgagatatcggtttccgaagaggcccccgtggaggaggcggctgaccaggtgccgccgacggatgaagccgtcgacccggccgaagcggccccggcggaggaggagagctcaccgtcccggaaaaaggcaaaagcgaaaaagcaccaggccgcgaaaattatcaagtttccggatgcgccccagcgactttccaacaagggcgtgctggaagtggtcgatgatacggccccggccgacagtcccgcggcgccggccgcggcgactccggccggagaaaaagacaaaaaaccctcccgcaaggatcgcaagaagcggggaaaaacagagagtgtggagaccgaggaagcggtaccggtcaagaagaagggggttttcaagcgcaaggagattgttgaaggggtggccctctacgaccggacccggggccgcatgcgcaaaaaaggcaaaggcggcgccaaggtgccgggcggcgcaaaaacccagatcacaacccccaaggcgatcaagcggaaggtgcgcatcaacgaatcgatcagcgtggccgaactggccaaacgcatgggcgtcaaagccagcgaggtcattgcccgattgatggggatgggcgtgatggccacattgaaccagcaggtggattttgactcggccgcgctggtggcggcggagtttgagtacgaggtggaaaaggcgtccgccacggaagaggagctgcttgagttgaacgtggaagaggatcagggaaacctgaagaagcgcgcgccggtggtcaccatcatgggccacgtcgatcacggcaagacatccctgctggacgtgatccgtcagtcccgcatcacggaaggagaagccggcggcattacccagcacattggtgcctacaaggtgaatacggccaacggcgaagtggtgtttctcgacactccgggtcatgaggcctttaccgccatgcgggcccggggggcccgggccaccgatattgttatcctggtggtggcggcggatgacggcatcatgccccagaccatagaagccatcaaccattccagggccgccggcgtgcccatcgtggtggcggtcaacaagatcgacaaggaaggcgccgatcccgaccgggtcaagcgggaggcctccgatcacggcctggttcccgaagactggggcggcgataccatgtttgtcaatgtgtcggccaaacagaagctcggtatttccgatctattggacatggtgctgcttcaggcggaaatgctggagctgaaggccaatcccgacaagaaggccaggggcgttgtcatcgaagccaagctggatccgggccgggggccggtggccaccgtgctgatccacgaagggaccctctccgtgggcgaaaccgtagtctgtggcattcattacggaaagatccgcgccatgtttgacgacaagggcgcgcccctcgaccaggccgggccggccacgccggtggagctcatcggcctgggcggagtggccacttccggtgacgacctgtttgccgtgggtgatgagaagagcgccaagacggtcagtgaaaaccggcagcagaagcagcggaccgaggatctggccagaaaagacagcatcagcctggaaaacttttttgaaaagatgcaggaaaaagaggagaaggtcctcaatatcatcataaaggccgatgtgaacggctcctgtgaagccattgccgattcgctgcagaagttctcctccggagaggtgaagattcacgtggtccactcggcgccgggcacgattatcgagtccgatgtgaccctggcgtcggcgtccaacgcgattgttctcggcttcaacgtgcggccgagccccaaggtgcgggcactggccgccgaagagaacgtggatatccggtcctatgatattatttatgacctgatcgacgacatcaagaaggccctcaccggcatgatgtcttccaccttcgaggaagaggtgctgggccgggccgaggtgcgggagctgttcgtcattccgaagaagggcaccattgccgggtcctacgtgctggacggaaaaatcgagcggggccggccggcccggctgctgagggacggcgtgattgcctataacggcgtaatcggttccctgcggcgtcacaaggatgatgccaaggaagtggccagcgggtatgaatgcggcatcggtattgaaaattacaacgacatcaagcccggtgacgtgatcgagtgctacttcctccgggagatcaagcctgagttgtga

SEQ ID NO: 1282 - DNA, 2988 bp, Salinispora arenicola CNS-205
gtggcaggcaaggcccgcgtacacgagctcgcgaaggagctcggggtcgaaagcaagaccgttctcgccaagctcaaggagatgggcgagttcgtgaagtccgcgtccagcaccgttgaggcgccggtcgcccgacggctgcgtaacgcgttcgtcaacaacgccggctcgccagcgccggccgccccgccggcggttgccccgccgaccccgaccccaacccctccccggaccccgactccggcgccacccccgggtggaccccgcgtgtcggcaaaacccatgccgccgcggcggcaaggtgtcccgactcccggcccgaagcccaagggtccggtgccgggtccgccgcagtccgcgacgccggtcaccaagccggcgagcgcccacgacatcgaggtggcggccgccgaggcgcgtgccgccgcgctgaaggccgagcaggaggccgcggtcaaggccgcacaggctgcccggcagcagcagcgggaaaacgtccggcgggagccgcccaccgagggtggtccgcgcccgggtccccgtcccggccccggcacgatgccgccccggcccggttccccggccgccggacgctccggtgcgcctgctccggggcccggcccccggcccggtggtcgtccgccggcgcgtggcgccggtaacaacccgtttggcattcagggtggccagcaacgtccgccggctgccggcgcgggtggtccgcggccgagtccggcgtcgatgccgccgcggcccagccccgcgtccatgccgccgcggccgagcccggcgtccatgccgagccagcggcccggccgccccggcggtcccggttccggtcgcccaggctcgggcgccggtcgcccgggtggcggtggcggtggcggttaccgcggcggtggcggcggtggcggtggcggtggttaccgcggcggccccggcggtggcggtggcggcggcggtgggttccgcggcggccccggtggcggtggcggtgggttccgcagcggccccggtggcggcggccgtcccggtggcggtggccgtggtcgcggtggcggcgccgcaggtgccttcgggcgtccaggtggccggccgacccgtggccgcaagtcgaagaagcagcgcagacaggagttcgacaacctgtccgcgccgaccatgtcctcgggcgcaccccgtgggcagggccaggtcgtccggctgtcccggggcgcctccctgtcggacttcgccgacaagatcaatgccaatccgggttctttggtccaggagatgttcaacctgggcgagatggtgaccgcgacccagtcctgctccgacgacaccctgctgctgctgggtgagcacctgggcttcgccgtccagatcgtcagcccggaggacgaggaccgcgagctgctcgcgcagttcaacatcgacctggacgccgaggtggcggaggaccggctggtcagccggccgccggtggtgaccgtcatgggtcacgtcgaccacggtaagacgaagctgttggacgcgatccgtaaggcgaacgtcgtggccggtgaggcgggtggcatcacccagcacatcggtgcctaccaggtccacgtcccgcacgacggcgaggaccgggcgatcaccttcatcgacactcccggtcacgaggcgttcaccgccatgcgtgcccgaggcgctcaggtcaccgacatcgtgatcctggtcgtcgcggccgacgacggggtgatgccgcagacgatcgaggcgttgaaccacgccaaggcggccgaggtgccgatcgtggtggcggtcaacaagatcgacaagccggaggccaacccggacaaggtccgtcagcagctgaccgagtacggactggtcgccgaggagtacggcggcgacacgatgttcgtcaacgtggctgccaagccgggtaccggcatcgagagcctgctcgaggccgtgctactgaccgcggacgcgtcgctggagctgaccgctccgacggacgggccggcgcagggtgtggcgatcgaggcccacctggacaagggccggggcgcggtggcgacggtgctggtgcagaagggcaccctgcgggcgggcgactcgatcgtcgccggtggggcgcatggtcgggtccgggcgatgctcgacgagaacggcaaccaggtcgccgaggcgggcccgtcccgtccggtactggtgctgggtctgaccgcggtcccgggcgcgggcgacacgttcctggccgctgaggacgaccgcaccgtgcggcagatcgccgagcagcggcaggcgcggcggcgggcggcggcgttcgccaactcccgtggccgggccaccctcgaaacgctcatggagcagctcaaggcgggcgagaagacctcgctcaacctggtgctcaagggcgacgtctccggttctgtggaggcgctcgaggacgccctgttcaacctcgacatccccgaggaggtccagctgcggatcatccaccggggcgtcggttcgatcaccgagagcgacgtcatgctcgcgagcgcctcgtcggaggcggtcacgatcatcggcttcaacgtccgggccgcgaacaaggtccgcgagatggccgaccgcgagggcgtggagattcggtactacaccgtcatctaccaggccatcgaggagatcgaggcagcgctcaagggcctgctcaagccggagtacgaggaggtcgagctgggcaccgcggaggtccgcgaggtgttccgttcgtccaaggtcggcaacatctccggctgcatcgtccggtcgggcctcatccggcgcaacgccaaggcccggctgctgcgcgacggtgcggtggtggcggacaacctcaccatcggctcgctcaagcggttcaaggacgacgcgaccgaggtacgcgagggcttcgagtgtggtctgaccctgggtggctacaacaacgtccaggtcggcgacgtgatcgagaccttcgagatgcgggagaaggcacgcgcctga

SEQ ID NO: 1283 - DNA, 2067 bp, Bacillus weihenstephanensis KBAB4
atgagtaaaattcgagtacatgaatatgcaaaaaaaaataatatctcaagtaaagatcttatgacaaaactaaaagagatgaatatcgaggtttcgaatcatatgacaatgttagaagatgaagtagtaaacaaattagataatcaatatagcgctggagcggaaaaaccttctgttgcagatgagtttgaagtagaagagaaagttgttcgcagtaaaaagaacagcaataagaataagaaaaaaggcaaagcaaatgaagataaacgtcaagataactttgctggaagacaacaaacaccaatagtagaaacaccagataaaatcactttctctggaagccttacagtaggtgaccttgctaaaaagttaagcaaagagccatctgaaattattaaaaagctcttcatgctaggaattatggcgacaattaaccaagacttagataaagatacaattgagttaattgctactgattacggtattgaagtagaagaagaagtagttgtaagtgaaactgaatttgaaacattcatcgatgagcaagatgatgaagaaaacttaaaagaacgtccagctgttgttacaattatgggacacgttgaccatggtaaaacaacattgcttgactctatccgtaattcaaaagtaactgctggcgaagctggtggaattactcagcatatcggtgcataccaagttgatgtaaatgataagaaaattacgttcttagatacaccaggtcacgcggtatttacaacaatgcgtgctcgtggtgcacaagtaacagatattacaattcttgttgttgcagctgatgacggtgttatgccacaaacagttgaagcgattagccatgcgaaagcagctggagtaccaattattgttgctgtgaataaaatggataaaccagcggcaaatcctgatcgtgtaatgcaagaattaacagaatatgaattagttccagaagcttggggcggagacacgattttcgtaccaatttctgcaattcaaggcgagggaattgacaacttactagaaatgatccttcttgtgagtgaagtagaagaatataaagcaaatccaaatcgctatgcagctggtactgtaattgaagcacagcttgataaaggtaaaggaactatcgcgacattacttgttcaaaacggtacacttcgagttggagatccaattgttgttggaacatcattcggtcgtgttcgtgcaatggtaagtgatattggtcgtcgtgtaaaagttgctggtccatcaactcctgttgaaattacaggtttaaatgaagtgccacaagcgggagatcgtttcatggcattcgctgatgagaagaaagctcgtcaaattggtgaatcacgtgcacaagaagcgttagttgcacaacgtggtgagaaatctaaattcagcctggaagatttattccaacaaatccaagagggcgatgtaaaagaaattaacttaattgtgaaagcagacgtacaaggttctgtagaagcaatggcagcatcacttcgtaaaattgatgttgaaggcgtaaaagtaaaaattatccatacaggcgtaggtgcgattacagaatctgatattattttagcttctgcatctaatgcaattgtaattggatttaacgtacgccctgatgtgaatgcgaagcgtacagctgaattagagaaagttgatgttcgtttacaccgtattatctataaagtaatcgaagaaattgaatcagcaatgcaaggtatgctggatccagaattcgaagaaaaagtaatcggtcaagcggaagttcgtcaaacattcaaagtaacaaaagttggaacaatcgcaggttgttacgtaatagacggtaaaattacacgtgatagtggcgttcgtattatccgtgatggcgtagtagtcttcgaaggaaaacttgatacgttaaaacgtttcaaagatgacgtaaaagaagttgcacaaaactatgagtgtggtattacaattgagagatataatgatcttaaagaaggggacatcattgaagcatacgttatggaagaagtgaagcgatga

SEQ ID NO: 1284 - DNA, 2061 bp, Bacillus cereus AH187
atgagtaaaattcgagtgcatgaatatgcgaaaaaacataatatctcaagtaaagatcttatgacaaaactaaaagaaatgaatatcgaggtttcgaatcatatgacaatgttagacgatgaagtagtaaacaaattagataatgagtatcaagctgaaaaaccttctgttgcagatgagtttgaagtagaagaaaaagttgttcgtagtaaaaagaacagcaataagaaaaagaaaaaaggcaaaggaaacgaagataagcgtcaagagaactttgctggaagacaacaaacacaaactgtagaaacaccagataaaattactttctctggaagtcttacagtaggtgatcttgctaagaaattaagcaaagagccatctgaaattattaaaaagctcttcatgcttggaattatggcaacaattaaccaagatttagataaagatacaattgagttaattgctaacgactacggtattgaagtagaagaagaagtaattgtaagcgaaactgagtttgaaacattcatcgatgagcaagatgatgaagaaaacttaaaagagcgtccagctgtagttacaatcatgggacacgttgaccatggtaaaacaacattgcttgactctatccgtaactctaaagtaactgctggtgaagcgggtggaattactcagcatattggtgcataccaagttgaagtaaatgacaagaaaattacattcttagatacacctggtcacgcggcgtttacaacgatgcgtgctcgtggtgcacaagtaacggatattacaatccttgttgttgcagctgatgacggtgttatgccacaaacagttgaagcaattaaccatgcgaaagcagcaggagtaccaattattgttgctgtgaataaaatggataaaccagctgcgaaccctgatcgcgtaatgcaagaactaacagaatatgaattagttccagaagcatggggcggagacacaattttcgtaccaatttctgcgattcaaggcgaaggaattgacaacttactagaaatgattcttcttgtaagtgaagtagaagagtataaagcaaatccaaaccgctatgcaactggtactgtaatcgaagcccagcttgataaaggtaaaggaactattgcgacattacttgttcaaaacggtacgcttcgagtaggagatccaatcgttgttggaactacattcggtcgtgttcgtgcaatggtaagtgatattggtcgtcgtgtaaaagttgctggtccatcaactcctgttgaaattacaggtttaaacgaagtaccacaagcaggagatcgtttcatggcattcgctgatgagaagaaagctcgtcaaatcggtgaatcacgtgcacaagaagcgttacttgctcaacgtggtgagaaatctaaattaagccttgaagatttattccaacaaatccaagagggcgatgtaaaagaaattaacttaattgtgaaagcggacgtacaaggttctgtagaagcaatggcagcatcacttcgtaaaattgatgttgaaggtgttaaagttaaaattatccatacaggcgtaggtgcgattacagaatctgatatcattttagcttctgcatctaatgcaattgtaattggatttaacgtacgcccagatgtaaatgcgaagcgtacagctgaattagagaacgttgatattcgtttacaccgcattatttataaagtaatcgaagagatcgaagcagcgatgcaaggtatgctagatccagaatttgaagaaaaagtaatcggtcaagcagaagtacgtcaaacgtttaaagtaacaaaagttggaacaatcgcaggttgttacgtaacagatggtaaaattacacgtgatagcggcgtgcgtattatccgtgatggtgtggtaatctatgaaggtcaacttgatacgttaaaacgtttcaaagacgacgtaaaagaagttgctcaaaactatgagtgtggtattacaattgagaaatacaacgatcttaaagaaggggacatcattgaagcgtacattatggaagaagtgaagcgatga

SEQ ID NO: 1285 - DNA, 1977 bp, Dictyoglomus turgidum DSM 6724
atgaaaaagagaatatatgaattaagcaaagaattaggaattgataataaggacttattgaagatattagcagatttaggagtcaatgtgaagtcagcattaaatgttattgatgaagaggtggaagaaattgtaaaagaacttgttttaggaaaaaccgaaattacagaggaaaaagccgagaaaccagaaactccccccgtggaaaaggaagaaagaaaagttcaagaagaaactgtagaagttatagaactaccaaaagaggagaagaaggaaaaagttctaaaaatacaaggtagtatgagggtaaaagacttagcagaagctctttctatatctcctacggagcttataatggaacttttaaatatgaaaattttggccaatgtaaatcaaatgctcgacccagatatcataaaagaattagcaaagaagcatgattataaagttgaggaagtaaaaccacaagtaagtttaaagaagaaaatcctttctcccgaagaagaagcaagattaaaatcacgtcctcctgtggtagtagtaatgggacacgtagaccatggtaaaactacactgcttgatgcaataagacaaacaaaagtagcagaaaaagagtatggaggaataacgcagcatataggtgcatcaatggtagaacataatggaagaaaaatagtcttccttgatacaccaggacatgaagcttttactgctttaagagctcgtggagctcaagttacagatatagcagttcttgtagttgctgctgatgatggggttatgcctcaaacaattgaagctattaatcatgctaaagcggcaaatgtacctataattgttgctataaataagatagataagccagaggcaaatcctgaaagagtaaagcagcaattatcagaatacggactaatacctgaagaatggggtggagatactataatggttcccatttctgctaagagaaagcaaggaatagaccagcttttagagatgatattactactttcagatatattagagctaaaagcagatccagataaacctgcaaaaggagcaataatagaaacgaaaatggataaaggtagaggtcctgttgctacagtgataattcaagaaggaactctccgattgagggatgtatttgtagctggaaatgtaatgggaagagtaagaactatgtttgatgataaaggtagaccactaaaagaagctcttccttcctggccagtagaagtctcaggttttgatgaattgccccaagcaggtgatatattagaagttgtagaaaatgaagaagttgcaaaggcaattcttgaggagagaaaacaaaagaaagaaacttccaatattgaagtttggggacttggagagaaaattttgcctattattgttaaagcggatactcaaggttctttagaggcaatattgcaaactattgataagatgcatacagaggatattaccataaaggtgatacattcaggcgtcggcggaataacagaaagtgatgtaatgcttgcttcagcctcaaaagggataataataggtttcaatgttagacctgactcaaaagctcaacaggcaatagctaaagagaaagtcatagctaaaacctatagaataatttatgagataattgaagatctccagaattatattaaaggtcttaaagaaccccaaattaaagaagtaataattggaaaaggcgaagtcaaagcaacctttaatgtaccaaaagtaggaaccgtagcaggagtttatgtaagagaaggtaaaatccagagaaatgctaaggttaggttgataagagatggaaaaataatatatgatggaagaattgcttcgcttaagagatttaaagatgatgtgaatgaggtattaactaactttgaatgtggggttgggttagaaaactttggtgatattaaacctggagatatattagaagtttatgttctacaacaaactcaatag

SEQ ID NO: 1286 - DNA, 2061 bp, Bacillus cereus B4264
atgagtaaaattcgagtgcatgaatatgcaaaaaaacataatatctcaagtaaagatcttatgacaaaactaaaagaaatgaatatcgaggtttcgaatcatatgacaatgttagacgatgaagtagtaaataaattagataatgaatatcaaactgaaaaaccttctgttgcagatgagtttgaagtagaagaaaaagttgttcgcagtaaaaagaacagcaataagaaaaagaaaaaaggcaaagggaacgaagacaaacgtcaagagaactttgctggtagacaacaaactcaaattgtagaaacaccagataaaattactttctctggaagccttacagtaggagatcttgctaaaaaattaagcaaagagccatctgaaattattaagaagctcttcatgcttggaattatggcaacaattaaccaagacttggataaagatacaattgagttaattgctaacgactacggtattgaagtagaagaagaagtaattgtgagcgagactgagtttgaaacattcattgatgagcaagatgatgaagagaacttaaaagaacgtccagctgtagttacaatcatgggacacgttgaccacggtaaaacaacattactggattctattcgtaactcaaaagtaactgcaggcgaagcgggtggaattactcagcatatcggtgcatatcaagttgaagtaaacgataagaagattacattcttagatacacctggtcacgcagcatttacaacgatgcgtgctcgtggtgcacaagtaacggatattacaatccttgttgttgcagcggatgacggtgttatgccacaaacggttgaagcaattaaccatgcgaaggcagcaggagtaccaattattgttgctgtgaataaaatggataaaccagctgcaaaccctgatcgcgtaatgcaagaactaacagaatatgaattagttccagaagcttggggcggagatactattttcgtaccaatttctgcaattcaaggcgaaggcattgacaacttactagaaatgatccttcttgtaagtgaagtagaagaatataaagcaaatccaaaccgctatgcaactggtacagtaatcgaagcacagcttgataaaggtaaaggaactatcgcgacattacttgttcaaaacggtacgcttcgagttggagatccaatcgttgttggaacttcattcggacgtgttcgtgcaatggtaagtgatattggtcgtcgtgtaaaagttgctggtccatcaactcctgttgaaattactggtttaaacgaagtaccacaggctggagatcgtttcatggcattcgctgatgagaagaaagctcgtcaaattggtgaatcacgtgcacaagaagctttagttgcacaacgtggtgagaaatctaaattaagtcttgaagatttattccaacaaatccaagagggcgatgtaaaagaaattaacttaatcgtaaaagcagacgtacaaggttctgttgaagcgatggcagcatcacttcgtaaaattgatgttgaaggtgtaaaagttaaaatcattcacactggtgtaggtgcgattacagaatctgatatcattttagcttctgcatctaatgcaattgtaattggatttaacgtacgtccagatgtgaacgcgaagcgtacagctgaattagagaacgttgatattcgtttacaccgtattatttataaagtaatcgaagagattgaagcagcgatgcaaggtatgcttgatccagaattcgaagaaaaagtaatcggtcaagcagaagttcgtcaaacgtttaaagtaacaaaagttggaacaatcgcaggttgttacgtaacagacggtaaaattacgcgtgatagtggcgtacgtattatccgtgacggcgtagtaattttcgaaggacaacttgatacgttaaaacgtttcaaagacgacgtaaaagaagttgcacaaaactatgagtgtggtattacaattgagagatataatgatcttaaagaaggggacatcattgaagcgtacattatggaagaagtgaagcgatga

SEQ ID NO: 1287 - DNA, 2067 bp, Bacillus cereus G9842
atgagtaaaattcgagtacatgaatatgcaaaaaaaaataatatctcaagtaaagatcttatgacaaaacttaaagagatgaatatcgaggtttcgaatcatatgacaatgttagaagacgaagtagtaaataaattagataatgaatataacactggagcggaaaaaccttctgttgcagatgagtttgaagtagaagagaaagttgttcgcagtaaaaagaacagcaataagaaaaagaaaaaaggcaaaggaaatgaagacaaacgtcaagataactttgctggaagacaacaaacacaaatagtagaaacaccagataaaattactttctctggaagccttacagtaggtgaacttgctaaaaagttaagcaaagagccatctgaaattattaaaaagctcttcatgctaggaattatggcgacaattaaccaagatttagataaagatacaattgagttaatcgctactgattacggtattgaagtagaagaagaaatagtggtaagtgaaactgagtttgaaacattcatggatgagcaagatgatgaagaaaacttaaaagagcgtccagctgttgttacgattatgggacacgttgaccatggtaaaacaacattacttgactctattcgtaattcaaaagtaactgctggcgaagctggtggaattactcagcatattggtgcataccaagttgaagtaaatgataagaaaattacattcttagatacgcctggtcacgcggcatttacaacaatgcgtgctcgtggtgcgcaagtaactgatattacaatccttgttgttgcagctgatgacggtgttatgccacaaacagttgaagcgattagccatgcaaaagcagctggagtaccaattattgttgctgtgaataaaatggataaaccagcggcgaatcctgatcgtgtaatgcaagaattaacagaatatgaattagttccagaagcttggggcggagacacaattttcgtaccaatttctgcaattcaaggcgaaggcattgacaacttgctagagatgattcttcttgtaagtgaagtagaagaatataaagcaaacccaaatcgttatgcaacgggtactgtaattgaagcacagcttgataaaggtaaaggaactatcgcgacattattagttcaaaacggtacgcttcgagttggagatccaattgttgttggaacttcattcggacgtgttcgtgcaatggtaagtgatattggtcgtcgtgtaaaagttgctggtccatcaactcctgttgaaattacaggtttaaatgaagtaccacaggctggagatcgtttcatggcattcgctgatgagaagaaagctcgtcaaatcggtgaatcacgtgcacaagaagcgttagttgcacaacgtggtgagaaatctaaattaagccttgaagatttattccaacaaatccaagagagcgatgtaaaagaaatcaacttaatcgtaaaagcagacgtacaaggttctgttgaagcgatggcagcatcacttcgtaaaattgatgttgaaggcgtaaaagttaaaatcattcacactggtgtaggtgcgattacagaatctgatattattttagcttctgcatctaatgcaattgtaattggatttaacgtacgtccggatgtgaacgcgaagcgtacagctgaattagagaacgttgatgttcgcttacaccgcattatctacaaagtaatcgaagaaattgaattagcaatgcaaggtatgcttgatccagaattcgaagaaaaagtaatcggtcaagcggaagttcgtcaaacattcaaggtaacaaaagttggaacaattgcaggttgttacgtaattgacggtaaaattacacgcgatagtggcgttcgtattatccgcgatggtatagtaattttcgaaggacaacttgatacgttaaaacgtttcaaagacgacgtaaaagaagttgcacaaaactatgagtgtggtattacaattgagagatataatgaccttaaagaaggggacatcattgaagcatacgttatggaagaagtgaagcgatga

SEQ ID NO: 1288 - DNA, 3240 bp, Desulfovibrio vulgaris  Miyazaki F
atgacagacgacaagaccagggtgaaggacctgtccacggagctgggcgtgtccaccaaagatctgctccacacgctgcgcgacctcgacatcccggccaagagcgtgatgaccacgcttaccgccgacgaggtcagccgcgtgcgcgaacgccatcagggccagaccgccgaagcgggcgttgaccgcaaggtggttcagcccggcgtcatcgtgcgccgccgccgccgcgacggcgaagagggcgaagcccccgtgcgtcgtcgtgccgatgagggcgaagccgcatccggcattgccgacgccgaagcgcccgccgccaaggccgaagcgcccgtgccgcccgcagctgacgaacggcccgcccgtgccgcccgcgccgaagcccccgcggcgcccgaggcacgccctgccacgcccgccgcgcgcatcatccgccgccacgacgagcccgcaccggtcgcggaagcaccggcagagcccgtacaggtggcccccgtggccccggcagcccccgtgactcccgcgcccgccagtgcggacaagcccgccgatgtgcaggtggaagccgccccggcggttgctgcccagcaggccgaaaagcccgccacgcccaccgcgcgcatcatccgcccggcccggcccgacgcttcggccatgcccgacgccaccccccagccctccatcctgccccccgtggcggctgacgccgcaccgcgcggtgaaggcgtggatggcgacgaggacgacgccgacggcaaccgccgcaggaaaaagaagcgcacgcccgacgcgcccggaccccaggtccgcgtcatttcccgtcccgatccttccgctccggcgccgcgcccctacccgcaaggcgaccgcacggacaggggcgaccgccccgcctacggcgaccggcagggctaccagccccgctccggcggccccggcggcgatcgtcccagctacggtggcgaccggcagggctatgcgccccgccccggcggccctggtggccccggcggtgaccgtcccggttacgcgccccgccccggcggccctggcggtgatcggcccggctacgcccctcgtcccggcgggcccggtggtgaccgtcccggttacggtccccgtcccggtggtccgggtggtcccggcggccccggtggtgatcgccccggcggttatcgtccgggtggtcccggcggtccccgtcccggtggccccggcggccccggctacggtccccgtcctggtggtcccggcggccccggcggccccggcatgggccagcccccggcgggcggcgacgaaggccagagcaagaagaagcgcctgaagggccgccgcacggtggacttccagcccggtgccgatcgcaccacgcgtggccgcgaggacgacgatttcccgcgtggcggcgcccgccgcggcaaggggcgcaagggccgcgacatgaaggtcgccaccgccacccagccgctgaaggcagccaagcgcaagatcaaggtcgaggaagccatccgcgtggccgacatggcccaccagatgggcctgaagtccaccgaaatcatcaaggtgctgttcggccttggtgtcatggcgaccatcaaccagtcgctggacatcgaaaccgccaccctggtggcctcggaattcggctacgaagtggaaaaggtgggcttctcggaagacgactacctgatcccaaaggaagaagacacgcccgagaccttgcaacatcggcctcccgtggtcaccatcatgggccacgtcgaccatggcaagacctcgctgctcgacgccatccgcaagaccaacgtcaccatgggcgaagcgggcggcatcacccagcacatcggcgcgtaccacgtgaccaccaagaagggtgagatcgtgttcctcgacacgcccggccacgaagcgttcactgccatgcgtgcccgaggcgcgcaggtgaccgacatcgtcgtgcttgtggtggccgccgacgacggcgtcatggagcagacccgcgaagcggtgaaccactccaaggccgctggcgtgcccatcatggttgccgtcaacaagatggacaaggaaggcgccaacccggaacgcgtgcagcgcgaactggcggaaatgggcctggtgtccgaagcctggggcggcgataccgtgttcagccatgtgtcggccaagacccgccagggcctggacgaactgctggaactgctggccctgcaagccgaaatccttgagctgaaggccaaccccgacaagcccgcccgtggccacatcgtggaggccaagctggacaagggccgtggccccgtggccaccgtgctgatccaggaaggcaccctgaagcagggcgacacctttgtgtgcggcgtgttcagtggccgcgtgcgcgccatgttcaacgaccagggcaagaaggtgaaggaagccggccccgccatgccggtggaagtgcagggcttcgagggcgtgcccgaagcgggcgaggaattcgtgtgcgtgacggacgaaaagctcgcccgccgcatcgcggaaacccgcgccgtgaagcagcgcgaaaaggaactggcccgcgaatccaaggttaccctggaaacgttcctgtcccgtcgcgtcgacgaccaggaagccctggtgctcaaccttgtcgtcaagtccgacgtgcagggctcgctggaagccatctccgaggcgctgcgcaagctcagcaccgaaaaggtgcgcatcaacatcatccacggcggtgccggggccatctccgaatccgacatcctgctggcatcggcctccgacgccatcatcatcggcttcaacgtccgcccgaccgccaaggtcaaggacatcgccgagcaggaaaacgtggacatccgcttctacgacatcatctacaagcttgtggatgaagtgaagagcgccatggaaggcatgctcgccccggtgcagcgcgaagtgtacctgggccaggtggaagtgcggcagaccttcggcgtgcccaaggtgggcaccattgcgggctgccacgttgcggacggcaagatcacccgcaacgccggcgtgcgcctgctgcgcgacggcgtggtggtctacaccggcaagatcacgtcgctcaagcgcttcaaggacgacatgaaggaagtcatgaagggctatgaatgcggcgtgggccttgaaaacttcaacgacatcaagataggcgacatcatcgaagccttcgagatggtcgaagaagccgccacgctgtaa

SEQ ID NO: 1289 - DNA, 2856 bp, Anaeromyxobacter dehalogenans 2CP 1
atgtccaagaagcgggtccacgagctcgggaagcagctgaaggagcagggcatcgagctctccaaccaggagctcgtcgagaagctccatgcgctgggttatctggaagtgaagagccactcctcgtccctcgaggacgatcaggcccacgcggcctacgagaagatcctggccgagcggaagccgaagccggcgccggtgcgcccgtcgggcccgggcttcgtggtgcgcaagcgcgcccacgtcgagccgcccaccgtcaccgcgcccgcggcgccgcccccggccgagcccgagtacgcggagccgcagtacgcggagccgcagcaggcggagcaggcctacgagcccgagccgcaggaggcgcagcccgaggccgcgcccgagccggtcgccgccccggagcagcccgccgaggccgcgccgctcgccgcccaggccgcgccgtcgcccggcgccgaggccgcggcgcccgccgcgccgcaggcgcagcccgcgcagccggcggccccggtcgccccgcccgcgccctccgcgcagccgtccgcgccgcagccccccgcggcgcagccccggccgccgcagccgccgatgccgtcgcgcccgccgcccgccggctaccgcccggcgccgccgcccggcgcgcgcccgcccatgtccgctgctccgggggcgcccgcgcagcccggcgccgcaggccagccgccgcggccgccggtggatccgcgcacgctccgccccacctccacgcaggccgtcgtcatctcgcggccgctcgtgccggtgcgccgcgtgacgccgcccacctccgcgcgccagcagttcccggtggcccctggcccccgcgcgctcggcgaggtcagggagctgaaggtggtccccggctcgctcggccgcgagcgcgagttcatcgacgtctcgcgcgacaagcgccgcggccgccagcccggccggcccatctccgaggagcaggccaagagcctcagcggcaaggagctgctccaggccgccatcagcgatcgcgcctacatcccgatccgcggcaagaagaagaagccgaccaagaagggagccaagacgcagatcaccgagaaggccgagcacaagaaggtcatccgcatcgaggagtcgatctcggtctccgagctctcccaggtgatgggcgtgaaggcgtccgacctcatccgcaagctgatgcagatggggaagatggtcaccatcaacgcgcagatcgacgccgacacggcggcgatcctggcgctcgagcacggctacaccgtcgagaagaagggcttcgaggtcgaggagttcatccccgaggtcgaggtggacgagtcgaagctcgtcatccggccgccggtggtgacggtgatgggccacgtggaccacggcaagacgtcgctgctcgacgccatccgccaggccgacgtggccgccggcgaggccggcggcatcacgcagcacatcggcgcctactcggtgaacacgccgcagggccccatcacgttcctcgacacccccggccacgaggccttcaccgcgatgcgccagcgcggcgcgcaggtgaccgacctggtggtgctggtggtggccgcggacgacggcgtgatgccgcagaccgtcgagtcgatcaaggcggccaaggcggccggcgtcaccatcctggtggccatcaacaaggtcgacaagccgcaggcggcgcccgagcgcgtcatgcagcagctcaccgagtacgagctggtcgccgagcagtggggcggcacgaccatcatgctgccggtatcggcccgcaccaagcagggcatccccgagctgctcgagtacatcgcgctgcagtccgaggtgctcgagctcaaggcgaacccggacaagctcgccgccggccgcgtcatcgaggccaagctggagaagggccgcggcccggtcgccaccgtgctggtcgaggagggcaccctccgcgtcggcgacgcgctcgtcaccggcgtccacttcggccgcgtccgcgccatgatgaacgagcgcggcgagcaggtggacaacgtcggcccgggctatccggtcgaggtgctcggcctgtccggcgtgccggtcgcgggcgacgagttcgacgtggtcgaggacgagaaggcggccaaggaggtcgcccagcaccgcgccaccaagcagcgccagaaggagctcggcggcgtcaagaaggccacgctcgaggacctgttcgcgaaggccaagacctccggccagaaggtgctcaacctggtggtcaaggcggacgtgcagggctcctcggaggccgtcagccaggcgctggagaaggcggccaccaagaaggtgggcgtcaagatcctcgagtccgccgtgggcgcgatcacgaagtccgacgtgctcaccgcggccgccggcaacgcggtgatcgtgggcttcaacaccaagcccgagagcgagatcgagaacatcgccagccagcagggcgtgaagatcctgatgttcggcatcatctacgaggcggtggaccggatccgcgaggagatggccggcctgctcgagccgatcatcaaggagaagccgctggggaaggccgaggtccgccaggtcttcaacatcccgcgcgtgggccagatcgccggctccgcggtcaccgagggcgtggtgaagcgcgccggccacgtccgcgtggtccgcgaccgcaaggtgatcttcaccgggaagatcggctcgctgaagcgggtgaaggacgacgtccgcgaggtcgcgcaggggttcgagtgcggcatcggcgtggacggcttctccgacgtgaagcagggcgacatcctcgaggtctacgagctcgaggagatccggccgtcgctcgactag

SEQ ID NO: 1290 - DNA, 3105 bp, Actinosynnema mirum DSM 43827
gtggcaggcaaggcccgcgtgcacgagctcgccaaagagctcggtgtcacgagcaaggaactgatgaccacgctcgccagtcagggcgagtacgtgaagtccgcgtccagcaccgtcgaggcgccggtggcgcgacgactgcgcgacgcgcacgccaagggcgagggcaagaagccgtcttccggcgcccgcccctcggcccccaagccgcaggccccgtccgccccccagggcggctccgaggccccgcgtccctccatgcccatgggcaagcccggtccgcgccccgtgcccggcccgcgcccccaggcgcccaagccgcagaccccggcgaagccggctgcggccgagcaggccccccaggccccggcggcgaccccggtcgccccggctccggccgcgcaggccgctccggctccggccgcgcaggcccccaaggccccggcggctccggccgccgagcgccagcagggtccgcgcccggcgtccggcccgcgtcccggccccaggcccggcccgcgccagcagccccagcagcagcagcccgcggctgccgccgagaacccctcggtggtgccgcccaggccgcagtccccgaagccgcagggcccgcgcggcccccgtccgggcaacaacccgttcggtgtcggcggcggcgcccccgccccccgtccgcaggccccgcgcccgcagggcggtcccggtggcggcgagcgcggcgaccgcggctccaagcccggtgacccgcgtcccggcggcccgcgtccggccggtccccgtcccggcggttccgccggttccggcggcccgcgcccgaaccccggcaacatgcctccccgcccgaaccccggcatgatgccgggccggtcggccgcgccccgccccggtggcggcggcggtggtcgtcccggcggcggtcccggtggcggcggtcgcggccccggtggcggcggcggtggcggtggcttccgcggcggtggcggcggtggcggtggcggcggcttccgcggcggcggtggcggcggcggcggtggcggcttccgccccggcggcggcggccccggtggcggtggcggcggtggcggcttccgccccggcggcggcggtggcgccccggccggtggtggcggcggtggcttccgcggtcgtcccggtggcggtggccccggtggccgtggcggcacggcaggcgcgttcggccgtcccggcggtcctgcgcgtcgtggacgcaagtccaagcgccagaagcgccaggagtacatggacaacatgcaggcgccttcggttggtggcgtccgtctgcccaagggcagcggcgagaccatccggctgcctcgtggcgcctcgctgaccgacttcgccgacaagatcaacgccaacccggcctcgctggtgcaggtgctgttccacctcggcgagatggtcaccgcgacgcagtccgtctccgacgagatcctggagctgctcggctccgagatgaactacgtcgtgcaggtcgtgtcccccgaggaggaggaccgcgagctgctcgagacgttcgacatcacctacggcgaggacgcgggcggcgaggacgacctggccatcaggcccccggtcgtcaccgtcatgggtcacgtcgaccacggcaagacccgcctcctcgacaccatccgcaagacgaaggtggccgagggcgaggccggcggcatcacgcagcacatcggcgcgtaccaggtgcagaccgagctggagggcaacccccggctcatcaccttcatcgacacgccgggtcacgaggcgttcaccgccatgcgtgcccgtggcgcgaactccaccgacatcgcggtcatcgtggtggcggcggacgacggcgtcatgccgcagacggtcgaggcgatcaaccacgcccaggcggcgaacgccccgatcgtggtcgcggtcaacaagatcgacaaggagggggccaaccccgccaagatccgccagcagctcaccgagtacgggctggtcgccgaggagtacggcggcgacaccatgttcgtcgacatctcggcgaagcagggcgtcaacatcgacggcctgctggaggcgatcctgctgaccgcggacgcctcgctggacctgcgtgccaaccccggcatggaggcccagggcgtcgcgatcgaggcgcacctggaccgcggtcgcggcccggtcgccacggtgctggtgcagcgcggcacgctgcgggtcggcgactcgatcgtcgccggcgacgcgtacggccgcgtccgccgcatggtggacgagcacggcgacgacgtcaccgaggcgtacccgtcgcggccggtgctggtcatcggtctgacctcggtcccgagggcgggcgacaccttcctcgtggtcgaggaggaccgggtcgcccggcagatcgccgagcgccgccaggcccgcacgcggaacgcgctcaacgcggcccgccgcaagcgcgtcagcctggaggacctggacgccgcgctgaaggagaccagccagctcacgctgatcatcaagggcgacaactccggtaccgtcgaggcgctggaagacgctctgatgaagatcgaggtcggcgacgacgtcgagctgcgggtcatccaccggggcgtcggtggcatcaccgagggcgacatcaacctcgccgtcgccggttccgccatcgtcctgggcttcaacgtccgggccgagggcaaggccaccgagctggccaaccgcgagggcgtcgacgtccgctactacacggtgatctaccaggcgatcgacgagatcgagcaggccctcaagggcatgctcaagccggagtacgaagaggtccagctgggccgcgccgaggtccgcgaggtcttcaagtcctccaaggtcggcacgatcgccggttgcctcgtcctctcgggcgagatccgccgcaacgcccgtgcccgcctgctgcgcgacaacaacgtcatccaggagagcctgccgatcagctcgctgcggcggttcaaggacgacgcgaccgaggtccgcgagggctacgagtgcggtctgacgctcggcaactacggcgatctcaagatcggcgacgtgatcgagacgttcgagatgcgcgagaagccgcgcgcctga

SEQ ID NO: 1291 - DNA, 2823 bp, Desulfomicrobium baculatum DSM 4028
atgtccactagattgcgggtgagagaccttgccacggagcttgatatctccagcaaggatttaatgacgttattgcgggaactcaaaatcccggccaagagccatatgagcagcctgaccgacgaagaagtcggacaggtccgcaatcaccaccagaaccgggccgcaacgccccaggtcgtggacacgcgcgccaccacgggcgtcatcgtgcgcaagcggcacaaggtcgcggccactgaaaccccggccgaagagcccgccccgatcgaggtggaagcgcccgaagagacggtggagaagcccaagacgcgcaagccttcacgtgcggtcatcgtcactccggcgcgcatcatcgaggaagccccgagcagcgcagccgaggcagacaagcctgcggtggaagaggcccctgcggccgaagccccggtcaccgaagcacctgccgccatggaagaggcccctgagcaggctgttgccgcggaatcggccactgtcgctcccgccgctgcggaagaaaaggtcacggcatccgccgagactcccggcgaaaccgctgcggaaaccgaaggcgaatcggaagaagccgggcgcgcccgcaagaaggccaaaaaagccaagcccgctcctccctccgttcaggtcaagatcatctccagacccaccatcgtcgaatttcccgatacccgtgtcgatggccagccagtccgccccatgggaccggcagcgcgccccatgggaccggcaggctataccccgcgtccctccggacccggcacgcgcccctccggcccaggcggtcctggtggccccggtggcccgcgtccgagcaccccgcgtccctccggtccgcccagcctcggcgctccgccccgccccgctcccgaaagtgaaggcgccaaggacagccgcggcaagaagaagaagggccgccgcacggtggaggctgccgatctgtaccgcaaggaagaattctccatgggcaagggcaagaaggcccagcgcgccgaggcgcgcagagccggcggagcccgggcccaggcccagaacacgcagccgctcaaggcatccaagcgcaagatccggatcgacgacaccatccggttgacggacctggcccatcagatgggcatcaaggcccaggacctgatcaaaaaactcttttccctgggcgtgatggccaccatcaaccaatccctggattttgacacggccctgctcctggccgccgaattcaagtacgaagtggagagggccggtttctccgaagacgatttcctgctgcccaaggaagcggacaaggccgaagacttgaagccccgtccgcccgtcgtgaccatcatgggccacgtcgaccacggcaagacctcgctccttgacgccatccgctccaccagcgtcgcctccggcgaagccggcggcatcacgcagcatatcggcgcctaccatgtggccacctcacggggcgagattgtcttcctggacacccccggccatgaggcgttcacgaccatgcgcgcccgtggcgccaaggtcacggacattgtcgtcctggtcgtagcggccgacgacggcgtcatggaacagaccaaggaagccgtcagccactccaaggcggcgggcgttcccatcgtcgtggccgtgaacaagatggacaaggaaggagccgatccggaccgcgtcaaacgcgagctgtccgatctgggcctgatgcccgaggactggggcggagacaccatcttcgcccacgtctcggccaagaagcgcgaaggcctggacgaactcctcgaacttatcctgctgcaggccgaagtgctcgacctcaaggccaacccggacaaacccggtcgcggtcacatcgtcgaggccaagctggacaagggtcgcggtcccgtgggcacggttctcatccaggaaggccagatcacccagggcgacgcctttgtctgcggcatgatcagcggcaaggtccgcgccatgttcgatgaccagggccggcagatcaagaccgccggaccggccatcccgaccgagatccagggctttgaaggcatccccgaggcaggcgacgagttcgtcatcgtcaaggacgagaaggttgcccgcaagatcgccgaggaccgccgcgtcaagcatcgcgataaggagctggccaaggaatccaaggtcacgctggaaagcttcctggccaccaaggccggtgaagaggcccagaacctgaacctgctccttaaagccgacgtgcagggctcgcttgaggcaatttccgaagccttgcgcaagctgtccacggacgagatcaagatcgtcctcatccatggcggcgccggagccatcaccgagtccgacattctgctggcatcggcctccaatgccatcatcatcgggttcaacatccgccccacggccaagatcaaggaagtggcggagcaggaaaaggtcgacatccgcttctacgacatcatctacaaactggtggatgacatcaaggcggctatgtccggcatgctctcccccgacatcaaggaagtgtaccttggtcaggccgatgtgcagcaggtcttcagcgtgcccaagatcggcaatatcgccggctgcatggtcagcgacggcaagctcaggcgcaatgcgggcatccgcctgctgcgcgacggcgtggtcatctacaccggcaagctcagctccctgaagcgattcaaggacgacgccaaggaagtgaccaagggctacgattgcggcgcgggcctggagaacttcaatgatatcaaggtcggcgatatcatcgaagccttcgaactggtcgaggaagcccggaccatctag

SEQ ID NO: 1292 - DNA, 2199 bp, Geobacillus WCH70
atgtctaaaatgcgtgtatatgagtacgcgaaaaaaaacaatgtaccgagtaaagacgtcattcataaattgaaagaaatgaatattgaagttaccaatcatatggcaacgttggaaccagaagttgtcgaaaagcttgatcatacgtacaacaaaaaaaatgagcggccgcaagcttctgctccaaaggaaaaacaaaaggcgccagtaaaaccgaaaaattatgtcgatgattttgatgacgaagatgaagaagtagtgaaaacaaaagttccgaagaaaaaatcggcaaacaaaaagaaagaaggaaaaaaacacgatttgcaattacagcagcaagaaaagaaaattttccatcaacagaaaaagaaaattaaagggaaggcaaaagcgaaagaacagcagcctgtacaacaagagcagccaatgaaaaaagaaaaagagcttcctaagaagattacgtttgaaggaacattaacggttgccgaactagcgaaaaaacttgggcgcgaaccttcagaaattattaaaaagctatttatgctcggcgttatggcaacgatcaatcaagagttagataaagatgcgatcgaacttatttgttccgattacggagtagaagtcgaagaaaaagtagtcattgatgaaacgaattttgaatcgatcgaaattgtcgatgatcctgaagatttagtggaacgtccgccggtcgtcacgattatggggcacgttgaccatgggaaaacgacgctattggattcgattcgtcactccaaagtgacggagcaagaagcagggggtattacgcaacatattggtgcatatcaagtgacagtgaacgataaaaaaattacgttccttgatacgccaggacatgaggcgtttacaacaatgcgggcaagaggagcgcaagtaaccgatattgttgtcctcgttgttgctgcggatgatggggtgatgccgcaaacagtagaagcaattaaccatgcgaaagcggcaaatgtcccaattattgttgccatcaacaaaatggataagccggatgccaatccagatcgcgtgatgcaagaattaatggagtataatcttattccggaagaatggggcggagatacgatcttctgtaaactgtcagcaaaaacaggagaaggtattgacaatttattggaaatgattttgcttgttagcgaaatggaagaattaaaagcaaatccaaatcgtcgtgcaaccggaactgttatcgaggcaaaactggataaaggccgtggaccagtggcaacgttgcttgttcaagcaggaacgttgcatgtcggcgacccgattgttgttggctgcacatacggccgcgtgcgggcgatggtcaacgatacagggcgtcgtgtgaaagaagcaggtccttcgacaccggtggaaatcactggtcttcacgaagtaccgcaggctggagaccgtttcatggtgtttgaagatgagaagaaagcgcggcaaatcggagaagcgcgcgcacaaaaacaattaatggaacaacgcaacatgaaagctcgcgttagcctagatgacctctttgaacaaattaaacaaggtgaaatgaaagaattaaatattattgtcaaagcggatgttcaaggatcggttgaagcgctggttgctgccctgcaaaaaatcgaagtcgaaggagtgcgcgtcaaaattatccatgccgctgttggcgcgattaccgaatcggacattcttttagcaacgacctcaaatgccattgtcatcggctttaatgtccgtccggacgccaatgcaaaacgcgtcgccgaatccgaaaaagtcgacattcgtctgcaccgcatcatctataaggttattgaagaaattgaagcagcgatgaaaggaatgcttgatccggaatatgaagaaaaagtcatcggtcaagcggaagttcgtcaaacgtttaaagtatcgaaagttggaacgattgccggatgctatgtgacagatggaaaaattacgcgtgacagcaaagtgcgcctgatccgtcaaggcattgtcgtttacgaaggagaaatcgattccttgaagcgcttcaaagacgatgtcaaagaagtgatgcaaggatatgaatgcggtttgacgattaaaaacttcaacgatattaaagaaggagacgttattgaagcgtacattatgcaggaagtggaaagaaaatga

SEQ ID NO: 1293 - DNA, 3156 bp, Catenulispora acidiphila DSM 44928
gtggccaaggtccgggtctatgaactcgccaaggaactcggagtcgagagcaaggtcgtcatggccaagctccaggatctgggtgagttcgtccgctcggcgtcctccacagtagaggcgccggtcgtccgcaaactgatcgacagcatccaacaagcagaatccggcggcgccaagggcggcgccccgaagtcggctgcctccgcgcagtccggctccgccgcgaaggcggcgtcctccggcgccccgcgtcccggcggcgcccccaagcccggtccgcgtcccggtccggtcgcgcccaagcccggtccggcggttcccgcgcaggcccaggcggcggtcgaggcggccagcccggtcgccgaggcgcccgaggcgccggccgcacccgaggtccaggccgcaccggcagcaccggtcgccgaggcgccctccgcgccggctccggctccggcgcgcccggcttcgcagggccgtcccagccagggccagggcaccggcggggccatcccgccgcgccaggctccggccgccggcggcagcatcccgggccgtcccggcccgcgtccggccaccccggggcagcgccccggcggtgagcgcgaccgcggtgagcggaacgaccgcggcgagcgcggccagcgtccggctcccggcggcacccgtccgagcccggccggcgcccagcgtcccggccagggccagggacagggcggccgtcccggcggcgctccgaccccgggcccgcgtccggccggtccgcgtcccggcaacaacccgttcacgtcctccggctcgaccggtatgcagcagcccccgcggcccgcgccgcgtccgggcccgccgaccggcgcccagagcggcggcggcgaaggcggcccgcgtccgggcatgccgccgcgtcccggcggcggtgtccccggcgccccgcgtccgaacccgggcatgatgcccggccgtgccgcgccgcgtcccggtgccggccagggccgccccggcggtccgcgtcccggtgctccggcgggcggtcccggcggccgctccggcggtccgcgtcccggcgctccggccggcggtcccggcgcacgccccggtggcggcggcggtggcggcggttacggtgccccgcgtcccggcggcggtgctcccggcggcggtggcggcggttacggcggccgtcccggcggcggtggcggctacggccgcggcggccgggccggcggcggcggaaccgcgggtgccttcggccgtcccggcggtcgtccgggccgcggccgcaagtccaagaagcagcggcgtcaagagttcgacaacatgcaggcgccgtcgctcggcggcgcgatgctgccccgcggcaacgggcagaccatccggctgccccgcggcgcctcgctggtcgacttcgccgagcgcatcaacgccaacccggcgtccctggtgcaggtgatgttccacctcggcgagatggtgacggcgacgcagtcggtctccgacgacgtcttcgaactgctcggccaggagctcggcttcaccgtgcagatcgtctccccggaggaggaggaccgagtcctgctcgagtccttcgacatcgacttcggcgagaacgagggcggcgaggaggacctgcgggtccgtccgccggtcgtgaccgtcatgggtcacgtcgaccacggtaagacccgcctgctggacgccatccgcaagaccaacgtcatcgagggcgaagccggcggcatcacccagcacatcggcgcctaccaggtggtcgccgaggtcgcgggcaccgagcgggccatcaccttcatcgacaccccgggccacgaggcgttcaccgccatgcgtgcccgcggtgccaaggcgacggacatcgcgatcctcgtggtcgcggcggacgacggcgtcatgccccagacgatcgaggcgctgaaccacgcccaggcggccgatgtgccgatcgtggtcgcggtcaacaagatcgacaaggagggcgccgacccgacgaaggtgcgcggccagctcaccgagtacgggctggtggccgaggagtacggcggcgagaccatgttcgtcgacatctccgcgcgcgagggcctgaacatcgaccagctgctcgaggcggtcatcctgaccgccgacgcctcgctggacctgcgggccaacccggacatggacgcccagggcgtggcgatcgaggccaacctcgaccgcggccgcggcgccgtggccaccgtcctggtgcagcgcggcacgctgcgcgtcggcgactcgatggtcgtcggcgacgcctacggccgggtgcgcgccatgatggacgagaacggcgagaacgtcgccgaggccggaccctcgcgtccggtccaggtgctcggtctgaccagcgtccccggcgccggcgacacgttcctggtggtcgaggaggaccgcgtggcccggcagatcgccgagcgccgcgcgacccgcgagcggaacgcggccatggcccgctcccgcaagcgcgtctccatcgaggactgggagaacgtcatcaaggccggcgaggtccagcagctcaacatcatcatcaagggtgatggcgctggctcggtcgaggccctggaggactcgctgctcaagctcgacgtcggcgccgaggtcgacctgcgcgtcgtgcaccgcggcgtgggttccatcaccgagtccgacgtggacctggcgatggcctccgacgcggtcatcctgggcttcaacgtccgtcccgacggccgtgcgaagaccaaggccgaccgcgagggtgtggagatccgcttctactcggtcatctaccaggcgatcgaggagatcgaggcggccctgaagggcatgctcaagccggagttcgaggaggtgcagctcggtaccgccgagatccgcgccatcttccgctccagcaagatcggcaacatcgccggctgcatggtccaggacggtctgatccggcggaactccaaggcgcgcctcatccgcggcgggtccgtggtcgccgacaacctcaccatcgtggggctgcggcgcgagaaggacgacgccaccgaggtccgcgagggcttcgagtgcggtatcaacctcgggtcgtacaacgacatcaaggaaggcgacatcatcgagaccttcgagatgcgcgagaagccgcgcgcctag

SEQ ID NO: 1294 - DNA, 2817 bp, Saccharomonospora viridis DSM 43017
gtggcaggcaaagcccgcgtacatgagctcgcgaaagagctcggtgtcacgagcaaggaagtactcgccaagctgaaggagcagggcgagtttgtgaagtccgcgtcatccaccgtcgaggctcccgtggcccgacggctgcgtgacgcgttttcgaagaaggacgatcagcaggcggagaaggctcccgataagggcaagccctcgatggtgaggtcgacgacgccgaggcgtggcgagaccggtactcccacaccgaagccggcgccgccgcagccgcaggcggggcagcctcaggcgaagcccgagcagccaccggtgccgaagccggggccacggccggtgccgaagcccggtccgaagccggggccgatccccaagccgggtgagcaggctccggcggcgaaggcgacgccgaaggatcagcagggttccgtcgttccgccgaagccgcagggtccgaagcccggtccgaagccgggtccgcgcccgccacgggtcggcaacaacccgttcggtgtgggatccggtgctcccgctccgcgtcctgcgccgccacgtcctgggggcgggcagagtgatcgcgctccgcgtccgggtggcgagcgtccggcgagccccaagagcggtgctcccaggccgcatccgggcaacatgccgccgcgtcccaaccccggcatgatgccgccgcgtccgccgcgtccggccggcggccccggtgggcgtagcggtggtcccggtggccgcggcggccccggtggtcgtggtggagctccgcgtaccggcggcggtttccgcggtggaccgggcggtggtggcggcggcttccgtggcggtcccggtggcggcggtggtttccgtggcggccggggtggtcccggtggtcgtggtggaacggccggtgccttcgggcgtccgggcggtccctcgcgcaagggccgtaagtcgaagcggcagaagcgccaggagtacatggagaccatgcaggcgccgtcggtcggcggcgtgcgtctgccgaagggcaacggcgagaccatccggttgccgcgtggtgcgtcgttgaccgacttcgcggagaagatcaacgcgaacccgggctccctggtgcaggtgctcttccacctcggtgagatggtcaccgcgacgcagtcggtctccgaggacgtgctggaactgctcggctcggagatgaactacaacgtccaggtggtcagccccgaggaggaggaccgcgagctgctcgaggcgttcgacatcaacttcggtacggacgccggtagcgaggaggacctgcggcccaggccgccggtggtgaccgtcatgggtcacgtcgaccacggtaagaccaggttgctggacaccatccggcagacgaaggtcggtgaggccgaggccggtggcatcacccagcacatcggtgcctaccaggtcaagacggaggtcgacggcgaagagcggctgatcaccttcatcgacaccccgggtcacgaggcgttcaccgccatgcgtgcccgtggtgcgcaggccaccgacatcgccgtgatcgtggtcgcggccgacgacggtgtgatgccgcagacggtggaggcgatcaaccacgcgcaggccgccaaggcgcccatcgtggtcgcggtcaacaagatcgacgtctcgggcgcgaacccggcgaaggttcgccagcagctcaccgagtacggcctggtggccgaggagtacggcggcgacacgatgttcgtcgacatctcggccaagcagggcacgaacatcgacgggctgctcgaggcgatcgtgttgaccgccgacgcggcgctggacctccgggcgaacccggacatggaggcccagggggtggccatcgaggcgcacctcgaccgcggccgcggtccggtggccacggtgctggtgcagcgcggaaccctgcgagtgggcgactcggtcgtcgcgggcgacgcctacggtcgagtgcgacgcatggtggacgagtacaaccgggacgtcaccgaggcgaagccgtcgcggccggtccaggtcatcggcttcacatcggtgccgagggccggtgacacgttcctcgtcgtcgaggaggaccgggtggcccggcagatcgccgagcgccgccaggctcggatccgcaacgccgagaacgccgccaggcgcaagcgtgtcagcctggaggacctggactccgcgttgaaggagaccaacaccctcaacctgatcatcaagggcgacaactcgggtaccgtcgaggcgctcgaatcgtccctgatgcagatcgacgtcggcgacgaggtggagctcaacatcgtccaccgcggtgtgggtggtgtcaccgagagcgacatcgacctcgccacggcgtccgacgcggtcgtgatcgggtacaacgtgcgtgcgcagggcaaggcgaccgaacgcgccacgcgcgagggtgtcgacgtccggtactacacggtgatctaccaggcgatcgaggaaatcgagcaggccctgaagggcatgctcaagccggtgtacgaggaggtcgacctcggtagggctgaggtccgtgaggtgttcaagtcctcgaaggtcggcaccatcgccggttgtctggtcacgtcgggtgagatccggcgtaactccaaggcacgcctgctgcgtgacggcgtggttgtcggggagaacctcccggtcagctcgctgcggaggttcaaggacgacgtcgtggaggtccgcgagggcttcgaatgcggtctcacgctcggcaagttctccgacatcaaggtcggtgacgtgatcgagacgtacgagctccgcgagaagccgcgcgagtga

SEQ ID NO: 1295 - DNA, 2679 bp, Desulfohalobium retbaense DSM 5692
atgacaactaaaatgcgcgtgagagaattgtccaacgaattgggcctctccaataaggaacttctccacctgctcagagaactgggcattcaggtcaaaagccatatgagcgggctttcagatgacgaggtggatcaggtgcgccaacgtttccacgcaggcagccagagccaggattcggtgcaaaaacggactacccgctccggggtcatcgtgcgccgcagacggcgcgctgcgaaaagcgaatccgagcccgagccgcaaccggccgaagagccggaggccgaaccggaagccgcggcagaggccgcggcagcggaaccccagcccgaacccgctcccaccgcccggattgtcgaaccgccgcatgcggacgaagagcccgaggaaggtgaaccggaagctgaagaaccggaagctgaggagccccaacacccggaggagacgactcaggcggaacctgcacaggacactggcgtagcccaggagcctcaggagaccgaagagaccattcaggagcagcccgccgaggactcagaagagccctctgagacggaagccgggaaaaagaagaagaaaaagcggaaaaagaaaccggaatcgccggcagtcaaggtcatctccaaacccgaggtcaccgctgaagagccggcaccaagccctgctcctgccgaggcagccgataccgaggccgcttcaaagaagaaaaagaaaaaagacaagcgggtagtcgatttcagcagcacgcctgccgaagccgaaccgcaagacaaacgcaaggcctcgacccagtggaagaaaaagaaaagcgccggggtcaaggacaaaaccggaggcaaggaacgtcgcccggggcgcaagcgtcagcagcaaggcggcaaggcagaaccggttcgccccacgacccagccgaccaaggcctcaaagcgtaaaatcaagatcgacgaagccatccgtttgggcgacttggccaggcagctgggcgtcaaggtgcaggaactgatcaagtccctgatgcaactcggcatcatggccactatcaaccaatccttggatatcgagaccgccacagtcctggctgaagaattcggctacgaagtcgaaaaggtcggtttttcggaagatgaattcatcctgcccaaggaagaagacaaccccgaagctcttgaaccacgctggccggtggtcaccatcatgggccacgtcgaccacggtaaaacctcgcttttggacgccatccgagagtccaagatcacgacaaaagaggccggcggcatcacccagcatatcggggcctattatgtcggcacggatcgcggcgaacttgtcttccttgatacgcccggccacgaagctttcacggccatgcgggcccgcggagcgcaggtcacggatatcgtcatcctcgtggtcgccgctgacgacggggtcatggaccagacccgtgaggccatcaaccactccaaggccgctggcgttccgcttattgtagcggtcaacaagatggacaaagaaaacgccgaccccgagcgcgtcaagcgcgaactcgccgagttcgatctggtccctgaggaatggggcggcgacaccatttacgcctatgtctcggccaagtcccactccggtctcgacgatttgctcgagatggttctcctgcaggccgaggtccaggaactcaaggccaaccccgccaaacgggcccggggccacattgtcgaggccaaactcgataaggggcgcggcgcggtcgggactgtcctggtccaggaagggaccctgcatcacggcgacgcctttgtctgcggtctttaccacgggaaagtccgggccttgttcaacgaccggggcaagaacatcaaatcagccggcccctccatgccggttgaggtccagggatttgacggcgtccccgaggctggcgacgaattcgtggccgtgcaggacgacaaggttgcccggcgcattgccgaagaacggcaaacgaagcagcgggaaaaggacttggccaaggaaaccaaggtgactttggaaagcttcatggccgccaaggccgacgaagaggtcaaatccctgaacctggtcatcaaagccgacgtccagggttccttggaggcctgcatcgaggcggttcgcaaattgagcaccgacgaggtcaaagtggaaatcatccacggcggtaccgggtccatttccgaatcggacatcatgctcgcctcggcctcctccgccgtcctgatcggcttcaacgtccgtcccacggcacggatcaaggatatcgccgagcaggaaaaagtggacatccgcttctatgacgtcatctatcagatggtcaacgaagtaaaagacgccatggccggcatgctggccccggtggtcaaggaggtctaccttggtcaggccgaagtccgggacaccttcagtgtgcccaaggtgggcactgtggccggttgcatggtcgtggacggcaaactccaacgcaacgcccacacacggctgttgcgcgatggagtggtcatctacaccggcaaaatcgattctttgaaacgcttcaaagacgacgccaaggaagtccagaaaggcttcgaatgcggtgtcggcctggagaatttcaacgacatcaaatccggcgacatcatcgaggctttcgaagaggtccaggaaaaagcgaccctggattag

SEQ ID NO: 1296 - DNA, 1839 bp, Nakamurella multipartita DSM 44233
atgcaggccccgtcgatcggtggcgtggccctgccgcgtggcaacggatcgacgatccggctggcccgcggctcgtcgctggccgacttcgccgacaagatcgatgccaacccggcctcgatggtgcaggcgctgttccacctgggcgagatggtcaccgccacccagtcggtgtccgacgacatcctggagctgctcggctccgagatgggctaccaggtcgagatcgtctcgccggacgacgaggaccgtgagctgctggaatccttcgacctcacctacggcgaggacgagggcgacgagagcgatctggtcgtccggccgccggtggtcaccgtcatgggtcacgtcgaccacggcaagaccaagttgctcgacgccatccgcaacacccacgtggtggacaaggaagccggtggcatcacccagcacatcggcgcctaccaggtcgccacgcacctgggcgacgaggaacggctgatcaccttcatcgacaccccgggtcacgaggcgttcaccgccatgcgggcccgtggttcgcagtccacggacatcgtggtgctggtggtcgcggccgacgacggcgtgatgccgcagacggtcgaggcgatcaaccacgccaaggccgcggacgtgccgatcgtggtggcgatcaacaagatcgacaaggagggggccaaccccgacaagatccgccagcagctcaccgaatacgggctggtcgccgaggagtacggcggcgacaccatgttcgtggagatctcggccaaggccatgatcaacatcgacggcctgctcgaggccgtcctgttgaccgcggatgcggccctggacctgcgggcgaacccgaacatgaacgccgagggtgtggccatcgaggcccacctggaccggggtcgcggcgcggtcgcgaccgtcctggtccagcgcggcacgctgcgggtcggcgactcgatcgtcgccggcaacgcgtatggccgggtccgggccatgctcggcgatcacggcgagcaggtggccgaggccaccccgtcgcgtccggtgcaggtgctcgggttcacctcggtgcccggcgccggcgactcgttcatggtcgtcgaggaggaccgcgtcgcccggcagatcgccgagcggcggcaggcccgagcccgcaaggcgcagatcggcaaccgtcgccgcatctcgctggaggacttcggcaaggccctggccgagcagaagatcgagcagctcacgctgatcatcaagggtgacaactccggcaccgtggaggcgctggaggactcgctgctcaagctggacgtgggcgaggaggtcgacctgcgggtggtgcaccgtggcgtcggcggcatcacccaggacgacatcaacctggccgccaccaccgacgccatcgtcatcggcttcaacgtcaagccggttcgaggcgtgcaggagctggccgaccgcgagggtgtcgacatccgctactacacggtcatctaccaggccatcgacgaggtggaagcggcgctcaagggcctgctcaagcccgagttcgaagaggtccagaccgggtcggcggagatccgggagatcttccggtcctccaagttcggcaacatcgccggctgcatcgtgcgcaacggcgagattcgccgcaacgcccgggcccggctgctccgtggtggtgtcgtgctcaacgacaacctgcagatcgattcgctgcgccggttcaaggacgatgtcaccgaggtccgcgagggcttcgaatgcggcatcggcctgggctcgtggaacaacatcgagctggaggacaccatcgagacctacgaggtccgggagaagccgcgaagctga

SEQ ID NO: 1297 - DNA, 768 bp, Nitrobacter winogradskyi Nb-255
atgaccgccgatatccgcctgttcacctgcctcaccgataatttcggcgtgctgattcacgatcccgcaaccggtgcgaccgccgcgatcgacgcgccggaggccgagccggtcatccaggcgctggatcgcgaaggctgggtgctgaccgacattctgatcacccatcatcacagcgatcatgtcggcggcgtggcggaactgaaacggaagtacgcctgccgggtggtcgcgccgcatgacagaagcgcagagatcgccaacgtcgacctgcgggtcggccagggcgacatcatcaaggtcggaacgctgctgggacgcgtgctggaaacgcccgggcacacgctggatcacgtcagttacgtgttcgacgacgagaaagtggtattcgccgccgacaccctgttctcgatcggctgcggacgggtgttcgagggcacctatccgatgatgtgggattcgcttttgaagctgcgcgcgctgccggacagtttccggctctattgcggtcacgaatatactgattcaaacataaaattcgccctgaccatcgagcccaacaatccggttctcaaggcgcgcgccgaggaggtgacgcggctccgcgctgaaggcaggcccacggtgccgaccctgatgggcgaggagaagaaagccaacgtcttcctgcgcgccgacgatccggcggtggcggccggagtgcatatgaaaggcgccagcggggtcgaggttttcgccgagctgcgcgaacgcaagaacaagtcgtga

SEQ ID NO: 1298 - DNA, 768 bp, Rhodopseudomonas palustris HaA2
atggctgccgacatccgcatcgttccgtgcctcaccgacaatttcggctatctgatccacgacccgtcgagcggcgccacggcctcgatcgacgcgcccgaggccgcgccgctgatcgcggcgctcgagaaggaaggctggaagctcacggatatcctggtgacacatcatcacggcgatcacgtcggcggcatcgccgaactgaaggcgaagtatcactgccgcgtcgttgcgccgcacgacgccaacgccaagatcgccgacgccgatctgcgggtcgaggagggcgatgtcgtcaaggtcggcgggctcgaagcgcgggtgctggaaacccccggccatacgctcgaccacatctcctacgtgttcgccgacgaccgcgcgctgttcgccgccgatacgctgttctcgatcggttgcggccgggtgttcgagggcacctatccgatgatgtgggaatcgctgctgaagctgcgggcgctgcccgacgactacaagctttattgcggccacgaatacaccgcctcgaacgtcaaattcgcgctgacgatcgagcccgagaacgccgccctgcaggcgcgcgccaaacaggtcgagcagcagcgcggcgccggccggccgaccatcccggtgacgctcggcgaggagaaacaggccaatgtgttcctgcgcgccgacgtgccgtcggtcgcagcggccattggtttcgccggcgagagcgcggcggacgtgttcggtgaactccgcgagcgcaagaacaactcgtga

SEQ ID NO: 1299 - DNA, 768 bp, Rhodopseudomonas palustris BisB18
atggccgccgaaattcgcgtgttcacctgtctcaaggacaatttcggctacctggtgcacgacagcgacagcggcgccaccgcgtcgatcgacgccccggaagccgccccgatcctcgccgcgctcgcccgcgaaggctggacgctgaccgacatcctggtgacccatcaccacgccgaccacatcggcggcatcgccgagctgaaacaggcgaccaattgccgcgtggtggcgccgcacgacaatggcgcggcgattccgctggtcgatctgcgggtccgccagggcgacgtcgtcaagatcggcgggctgttggcgcgggtgctggaaacccccggtcataccctcgaccacgtcgcctacgtgttcgacgacgacaaggcgctgttcgccgccgacacgctgttctcgatcggttgcggccgggtgttcgagggcacttatccgatgatgtgggagtcgttgctgaagctgcgagtgctgcccgacgacatgcggctgtattgcggccatgagtacaccgccgccaatgtgaagttcgcgctgaccgtggagcccaacaacccggcgctgcaggcccgcgccgccgaagtggcgcatctgcgtaccgcggggctgccgaccattccgacgctgctcggcgacgagaaacgcgccaacgtcttcctgcgcgccgacgagccgacggtcgccgccggggtgcggctgaagggggccggcgcggtcgaggtgttcaccgaactgcgcgaacgcaagaacaagtcgtga

SEQ ID NO: 1300 - DNA, 768 bp, Rhodopseudomonas palustris BisB5
atggctgccgacatccgtatcgttccctgcctcaccgataatttcggctatctgattcacgatccgtcgagcggcgccaccgcctcgatcgatgccccggaagccgcgccgttgatcgcggcgctggagaaggaaggctggaagctgaccgacattctggtgacgcatcatcacggcgatcacgtcggcggcgtcgccgagctgaagaagaagtatcagtgccgcgtcgtcgcgccgcacgacgccaatgccaagatcgccgacatcgatctgcgcgtcgaggagggcgatgtcgttcgcgtcggcgggctgagcgcgcgcgtgctggagacgccgggccatacgctcgatcacatctcctacgtgttcgacgacgaccgcgcgctgttcgccgccgatacgctgttctcgatcggctgcggccgggtgttcgagggcacttatccgatgatgtgggagtcgctcctgaagctgcgcgagctgcccgacgatttcaaactgtattgcggccacgaatacaccgcctcgaacgtcaagttcgcgctgaccatcgagcccgacaacgccgcattgcaggcgcgcgccaaacaggtcgagcagcagcgcgccgccggccagccgaccattccggtgacgctcggcgaggagaagcaggccaatttgttcctgcgcgccgacgtgccgtcggtcgccgccgcggtcggtctgccgggtgaaagcgcggccgacgtgttcggcgaactccgcgagcgcaagaacaactcgtga

SEQ ID NO: 1301 - DNA, 768 bp, Nitrobacter hamburgensis X14
atgaccgccgacattcgcctgttcacctgcctcaccgataatttcggcgtcctgattcacgaccccgcgaccgatgcgaccgccgcgatcgatgccccggaggccgggccgatcatcgaggcgctggatcgtgagggctggacgctgaccgatattctggtcacccatcaccacgccgatcatatcggcggcatcgcggaactgaagcagaagtacaaatgcagggtggtcgcgccgcatgacaagaaagccccgatcgcgaacgtggacctacgcgtcggccagggcgatatcgtcaaggtcggaacgctgctgggacgcgtgctggaaacaccgggccacacgctggaccacatcagctacgtgttcgacgacgagaaggtggtgttcgccgccgacaccctgttctcgatcggctgcgggcgggtgatcgagggcacctatccgatgatgtgggactcgcttttgaaactgcgcgcgctgccggacgatttccgactctattgcggccacgaatacaccgcatcgaacgtgaaattcgcgctcaccgtggagccgaacaacgcagccctcaaggcccgtgccgaggacgtcgcgcggttgcgcgccgagaacaagccgacggtgccgaccctgatgggcgaggagaagaaggccaacgtgttcctgcgcgccgacgatccggccgtggcggccggcgtgcacatgaagggagccagcggggccgatgttttcggcgagttgcgcgaacgcaagaacaagtcctga

SEQ ID NO: 1302 - DNA, 771 bp, Maricaulis maris MCS10
atgagcgaactccttatccggcagtttccctgcctttccgacaattacggtttcctcatccatgaccccgacagcggagagaccgccaccatcgacacgcccgacgcggatgtgatcctgaacgaggctgatcaagccgggtggtcgatcactcagatctggaacacccatcaccatttcgaccatgccggtggcaatgagaccatccaggccctgaccggcgcaaaggtcgtcgcgccccggtatgaccggcatcgcattccgggaatttcgatggaggtcgaggatggtgacgtgatcagcctgggcgaccacaaggccaaagtattctacacgcccggccacaccatggggcatgtctgctaccacatgccaatggacggcattgcctttgttggagacacgctgtttgccttgggatgtggtcgcctgttcgagggcacgccggccgagatgtggcactccctgtcccggcttgccgccctgcctgacgagacccgcatctactgcgcgcatgaatataccgaggccaatgcccgtttcgcgttgagcattgatccggataatcacgaccttcaggtctacgccgccatggtcgagggtgagcgcgcccgcggcgaaccgactgttccgacgacgatcgcagccgaaaaggcggccaatcccttcctccgccccgacgatccggccattcgtgcccggctgggcatggaacatgatgacgatgaagaggtgtttgccgaaatccggcgccggaaggactcgttttga

SEQ ID NO: 1303 - DNA, 768 bp, Bradyrhizobium BTAi1
atggccgccgacatccgcgtcttcacctgcctgtccgacaatttcggctatctgatccatgacccggccaccggcgccaccgcgtcggtcgacgcgcccgaagctggtccgatcatccgccagctcgaggctgccggctggaccctgaccgacattctgatcacccatcatcaccacgaccatgtcggcgcggtcgccgaactcaaacagaagtatggctgccgggtggtcgcgccgcatgacaagacgaccgcgattgccgatgtcgatctgcgcgtcggccatggcgacgtcatcaaggtcggcgagttgcttgcccgcgtgctggagacgcccggccatacgcttgatcacgtctcctacgtgttcgatgccgacaaggcggtgttcgcggccgacacgctgttctcagtcggatgtggccgggtgttcgagggcacctatccgatgatgtgggactcgctcttgaaactgcgggcgctgccggacgatttcaggctgtattgcggccacgaatacaccgcctcgaatgtgaagttcgcgttgaccgtcgacggcgacaacgaggccctcaaggcccgcgccgccgaggtgacgcgtttgcgcgccgcgaacgagtcgacaattccgtctctgctcggggacgagaagcagaccaacgtgttcctgcgcgccgacgacccggccgtcgccatcaagctgcggatgaagggcgcgacggccgagcaggtgttcggtgaattgcgcgagcgcaaaaacaagtcctga

SEQ ID NO: 1304 - DNA, 771 bp, Sinorhizobium medicae WSM419
atggccgccctcgaactcgacctcttcctctgccgcaccgacaattacggtgtgctcctccacgatcggctgagcggcgcgacggcatcgatcgacgcaccggaagaaagaccgatcctcgacgcgctcgaacggcgcagctggcaactgacgcacatcctcacaacgcatcaccatggcgaccatgtggccggcaatatcggtctgaaggaacgcttcggcgtgaccatcatcggtccgaagaacgagtctccgaagatccctggtattgacagaagcgtgggccatggcgaccgcttcgacttcgccggccacccagtcgaggtcatcgaaacgccgggacatacggccggccacgtctgctaccatttccctgaggacaagctgcttttcgccgccgatacgctttttgctctgggatgcggccgtctgttcgaaggaacgcccgaaacgatgtggcagtcgctgagccgactgatggcgctaccggatgacacggccatttacttcggccacgaatacacgctcgcaaacgcgcgtttcgccgtcaccgtcgatccggaaaacacggcgctgaaggaacgagcggccgagatcgaggagacgcgatcggacggcggattcactgcgcccacaaccatgggccttgaaaagcggacgaacccgttcctgcgcgccgatgatccaaagatccgcgcctttctgggcatggacaaggcgagcgatgccgccgtcttcgcagaaatacgcaaacgcaaggacagtttttga

SEQ ID NO: 1305 - DNA, 771 bp, Parvibaculum lavamentivorans DS-1
atgacaaagctccagatccaccagtttccctgcctgagtgacaattacggctatcttgttcacgaaccttcatcgggaatgactgcggccatcgatacgccggaggtgaagccgatccttgatgcactggcggaaaagggatggaaactcacccatatcctcaatacgcaccatcatttcgaccatgccggcggcaatgcggagctgaaggagaagacgggctgcacaatcatcgggccgaagggcgaagagggagctatccccggcatcgaccgcgctgtacaggaaggcgatatagttgagctcggcgccgcccgggcccgcgttctcgacgtgccggggcacacgcgcggccacatcgcctacagcttcgacgacgatcacattgcctttgtcggcgacacattgtttgcgctgggctgcggccgccttttcgaggggacggcgcagcaaatgtggacgtcgctcggcaaattgatggccctgccggacgacacggtcgtctattgcgcccatgaatatacgcaatcgaacgcccgcttcgcactctccgtcgaaccgcagaacgaagcgctgattgcccgcgcgaaagaaatcgacgctaagcgggcgcgaggcgagtggaccgtgccgacgaccatcggtctcgagaaggcgaccaaccccttcctgcgcgccgcaagcgccgatttgcgccggacaatcgggcttgagaccgccgctgacgtcgatgtgttcgccgaaacccgcaaacggaaggacaatttctga

SEQ ID NO: 1306 - DNA, 849 bp, Xanthobacter autotrophicus Py2
atgccggccgcgtccgcaacccattcgggcgctgtgtcgaatgccgttccgctcgcgctccggagacccgagaccgtgccagccgaaatccgcctcgtcccctgcctctccgacaattatgccgtcctgatccacgatccggtcaccgaggcgaccgccgtggtggacgtgcccgaggcgactcccgtcatcgcggcgctggagaaggagggctggaacctcacccacatcctcgtcacccatcaccacgccgaccacacccagggcatcccggcggtgaaggcgcgattcggcgccaccgtggtggggccgaaatccgaggccgacaagatccccggcctcgacgtgacggtggtggacggcgatccggtggcggtgggctcgctggtagggcgggtgctggagacccccggccacaccgccggccccgccacctacctgttcgagggcgagaagctgctgttcgccggcgataccctgttcacccttggctgcggccggccgctggaatgcgagccgccggtgctgtgggactcgctgcagcgcctgcgtgcactgcccgaggaccttcaggtctacagcggccacgaatacaccctggccaatgcccgcttcgccgccacggtggacccggacaatcccgccctcatccgcctttatggcgatgcgcagcgcaagcgggacgccggctcccccaccattccctcgcggctgggcgacgaggtggccgccaaccccttcctgcgcgcggacgatcccggcatggcggagcgtctcggcatggcgggggccgagccggccctcgtcttcaccgagctgcggctgcgcaagaacgccttcaagggctga

SEQ ID NO: 1307 - DNA, 747 bp, Caulobacter K31
atgtcgctgaccatccaccagtttccctgcctgtcggacaattacggctttctcgtgcgcgacgacgccacggggacgacggccacgatcgacacgcccgacgccgatgccatcctggccgagctgaagaagctgggctggaaactggaccttatcctcaacacccattggcatcccgaccacgccggcggcaacgcggcgatccaggcggcgacaggcgccaccatcgtcggcccccaggaggtgagccgcatcgcgcccctggatcgccctgtcgtccaggacgacacggtgatgctgggcgaaacggccctgtcggtgatcgacaccggcggccacaccctgggccacatcgcctatcacgacgcggccgaccacatagccttcgtcggcgacaccctgttcgccctgggctgcgggcgcctgttcgagggcacggccgaacagatgtgggggtcgctgtccaagctgaccgccctgcccgacgacaccaccgtctactgcgcccatgaatacaccgcctcgaacgctcgcttcgccctgtcggtggaccaggatccggcgctgaaaagccgggcgaacgcggtgttcgccgcccgcgagcgcggcgaggcgaccgtgccgaccaccatcggcctggaaaaggcgaccaatccattcttgcgcgcgcccctgctgcggcctcatctccctcccgccgaagcgttcggcgagattcgcgccgccaaggacagcttcaagggatga

SEQ ID NO: 1308 - DNA, 771 bp, Beijerinckia indica ATCC 9039
atgagtgcccatatccaccaatttctttgcctcaaggataatttcggcgtccttgtgcatgatcccgaatcgcggcacacagcggccatcgatgcgcctgaagccggtccgatcctcgaggctctcgccgcacgggaatggaccctgaccgagatcctgattacccaccaccatcaggatcatatcggcggcattcccggcctcaaagccgaatttccagaggcacgcatcatcggccccgcgcgcgaggcggataagatcggccatctggatcaagcggtccgcgagggcgatcaggtgaaggttggccagctcgaggccatggttctggaagtgccgggtcatacatccggacatgtcgtctattggtttgaacaggacgatattctcttcaccggcgacacgcttttcgcgatgggatgtggccgcggtttcgaggagccagccaatatcctttataattcgctgatgaagctcgccgctttgccgggcgagcttcaggtctattgcggccatgaatatacgctctccaacgcggaattcgcgctgaccatcgaacccgacaatgtgctcttgcgtgaccgggtcgccgaagtcaggcaattgcgcgccgaaaaccggttcactttgccaacgaccatcaccatcgagctcggcaccaatcccttcctccgggtcgatgagcccagtgttcaggccgccgtcggcatgccgggcggcgatccggccgccgttttcgctgaattgcgtgagcgcaagaaccgggcttga

SEQ ID NO: 1309 - DNA, 768 bp, Rhodopseudomonas palustris TIE 1
atgcccgccgacatccgcatcgttccgtgtctcaccgacaatttcggctatctggtccacgatccggccaccggtgccaccgcttcgatcgacgcgccggaagctgctcccctgattgccgcattggacaaggaaggctggaagctgaccgacattctggtcacgcatcaccacggtgaccatgtcggcggcatcgcagagctgaagaagaagtatcagtgccgcgtccatgcgccgcacgacgccaacgccaagatcgcggacgccgacgtgaggctgcaggaaggtgacgtcgttcgggtcggtgacctcaccgcgcgggtgctggaaactcccggtcacaccctcgatcacctttcctacgtgttcgacgccgaccgtgcgctgttcgcggccgacacgctgttctcgatcggctgcggccgggtgttcgagggcacctatccgatgatgtgggaatcgctgctgaagctgcgggccctgcccgacgacttcaagctgtattgcggtcacgaatacaccgcctccaacgtcaaattcgcgctcggcatcgagcccgacaacgccgcgctgcaggcacgcgccaagcaggtcgaggcacttcgcgccgaaggtaagccgacgattccggtgacgctcggcgaggagaagcaggccaacgtattcctgcgcgccgacgtgccgtcggtcgccgccgcagtcggaatgcccggcgctcccgccgccgaagtgttcggcgagatccgcgagcgcaagaataacgggtga

SEQ ID NO: 1310 - DNA, 768 bp, Methylobacterium sp. 4-46
atgcccgagatccgcaccttcctgtgccggagcgacaatatcggcgtgctgatccgcgaccccgccacgggcgcctgcgcggcgatcgacgtgccggaggcgggggcggtgctgcgcgtcctcggggagaccggctggtcgctcaccgacatcctggtcacgcaccgccacttcgaccacgtcgagggcactcccgaggtgaaggcgcgcaccggggcccgggtcaccgcccccgccaaggccggcgacgccgtgccggaggtcgacgccacggtgcgggaaggcgacgcggtcaggctcggctccctcgtggcggcggtctgggagacgccgggccattgcgccgaccacgtcacctactggttcgagcgcgagcgcatcgccttcgcgggcgacaccctgttcacgctcggctgcgggcgggtgatggagagcccccccgaggtgctgtggcgctcgctcagccgcttcctcgccctgccggacgagaccgcgatctattcgggccacgattacgtgctctcgaacgcccgcttcgcgctggcggcggatccggacaacccgaacctcaaggcccgggccgaactggccgagcgggtgaagcgggacggccgcttcctgatcccgaccacgctcggggaggagaaggcgacgaaccccttcctgcgcgccaccgagcccgccctcgcccgcgccgtcggcatggccccgggctccgacccggccgcggtgttcacggccctgcgcgaatggaagaaccggttctga

SEQ ID NO: 1311 - DNA, 771 bp, Rhizobium leguminosarum bv  trifolii WSM2304
atgaaacctttggaattggacgtttttctctgccgcaccgacaatttcggcgttctcgtccacgacccggaaacaggatttaccgcggcgatcgacgcgccggaggaggcgccgatcctggaagcggcgacacgccgcggctggaagatcacccatatcttcaccacccatcaccacaccgaccatgtcgccgccaatctggcgctgaaggagcagttcggctgcgagatcatcggcccgatcaacgaggccattgccattcccggcctcgaccggacgatggccgatggagacagcttcctgttcggcgatcacacgatcaatgtcatcgagacacctggccacactgccggccacatctgctatcacttcgtcgacgacaagctgctctttgccgccgacacgctgtttgccctcggctgcggccgcctgttcgaacgccccgccgccgacatgtggcattcgctgcagaagcttgccgtgctgcccgatgagaccgccatctatttcggtcacgaatatacgctctccaacgcccgtttcgcactgacggtcgatcccggcaatgaacggctgaagggccgtgccgccgagatcgaggccttgcgcgccgacggcaaattcaccatcccgacgacgctggggctggaaaaggaaactaacccgttcctgcgcgccgccgatccggcaatccgccgcaatctgctgatggaaggcaagaccaatgaagaagtctttgccgagatccgcaagcgcaaggataatttctga

SEQ ID NO: 1312 - DNA, 771 bp, Methylocella silvestris BL2
atggcgccccatatccatcaattcatctgccttagcgataatttcggcgtgctggtgcacgatcccgagacgcgcgcgacctgcgcggtcgacgcccccgacggcgcgcccattctcgccgcgctcgcggcgcgcgagtgggagctgaccgatattcttctgacccatcaccacgccgaccatgtccagggggtcggcgcgctgaaagccgccttcccgaaagcgcgcgtggtgggcccgctgaaggaagcggaaaaaatagggggtctcgatctcaaggtcggcgagggcgatctcgtcatggtcggttcgctggccgcccgtgtgatcgcggtcccaggccacaccagcgggcatgtcgcttattggttcgaagaggaagatcttgcctttgtcggggacacgctgtttgcgatgggctgcgggcgggcgttcgaggagccgccggacgtgctgtttcattcgctctcgaagctcgccgcgttgccggacgagacgcaggtctattgcggccacgaatatacactcgccaacgccaaatttgcactgtcggtcgaacccggcaacacgcttttaaaagaacgcgccggggaagtcgcagcgctgcgcgccgccggcaaattcaccctgccgacgacgatctcgatcgagcttgcgaccaatccgtttttgcgcgccgaggagcccgagcttcaggccgcggtcggcatgccgggcgccgatccggctgcggtatttgcggtgctgcgcgagcgcaagaaccacgcatga

SEQ ID NO: 1313 - DNA, 768 bp, Methylobacterium nodulans ORS 2060
atgcccgagatccgcaccttcctgtgccgaagcgacaatatcggggtgctgctgcacgaccccgtcaccagcgcctgcgcggccatcgacgtgccggaggcgggcgcggtcctgcgtgccctgaaggagaccggctggaggctcaccgacatcctcgtcacccaccggcacttcgaccacgtggagggcatcccggaggtgaaggcccgcacgggcgcccgcgtcaccgcgccggccaaggcgggggatgccgtgccggaggtcgacgccacggtgcgcgagggggacgtggtcaaggtcggctccctcgtcgggacggtctgggagacgccgggccactgcgccgatcacgtcacctactggttcgagcgcgagcgcctcgccttcgcgggggacaccctgttcaccctcggctgcggccgcgtgatggagagcccacccgaggtgctgtggcgctcgctcagccgcttcctcgccctgccggacgagaccgcgatctattccggccacgactacgtgctctcgaatgcccgcttcgccctcgcggccgatccggacaacagcaacctcaaggcccgggccgagctcgccgagcgggtgaagcgcgacgggcgcttcctcatcccgacgaccctcggcgaggagaaggcgacgaatccgttcctgcgcgccggggagccggcgctcgcgcgctcggtggacatggctccgggctccgatccggccgcggtgttcgcagccctgcgcgaatggaagaaccgcttctga

SEQ ID NO: 1314 - DNA, 771 bp, Agrobacterium vitis S4
atgaaaagcccggatatcgaaatcttcccgtgtcgcaccgacaattacggtgtgctggtccattgcccagaaaccggcttgaccgcgtccatcgatgcaccggaggaaggcccgatcgtggccgctgccgaaaaacgcggctggcagatcagccatatcttcaccacccatcaccataatgatcatgtcgaagccaatctggcgctgaagcaacgatatggctgtgagatcatcgggccggtcaacgaggctgtcgccatacccggactggatcggtccgcctatgatggggaagagtttttattcggaccgcaccgggtccaggtgatcgaaacgccgggccacacggcaggccatgtctgctatcattttccagacgccaaactgctgtttgccgccgatacgctgtttgcgctcggctgcggacggctgttcgaacgccccgctgccgacatgtggcattccctgcaaaagctggccgtgctgccggatgaaaccgccatctatttcggccatgaatacacgcttgccaatgcccgtttcgccctgaccatcgaccctgacaatgagcggctgcaagcccgtgcccgcgacatcgaggcgatgcgggcgcaagggcagttcaccattcccaccaccatgtctctggaaaaggaaaccaatcccttcctgcgggtggccgatccaaaaatccgccgcaacctggtgatggaaagcaagagcaatgaagaggtgtttgccgaaatccgcaagcgcaaggacaatttctga

SEQ ID NO: 1315 - DNA, 771 bp, Rhizobium leguminosarum bv  trifolii WSM1325
atgaaacctttggaaatagacgtttttctctgccgcaccgacaatttcggcgttctcgtgcacgatccggagacaggctttaccgcggcgatcgatgcgccggaggaggcgccgatcctggaagcggcgacacgtcgcggctggaaaatcacccatatcttcaccactcatcatcacaccgaccatgtcactgccaacctggcgctgaaggaacaattcggctgcgagatcatcggcccgatcaacgaggccgtcgccattcccggcctcgatcggacgatggccgatggcgacagcttccttttcggcgatcacaccgtcaacgtcatcgagacacccggccacaccgccggccacatctgctatcacttcgtcgatgacaagctgctgtttgcagccgacacgctgtttgcgctcggctgcggccggctgttcgaacgcccggccgccgatatgtggcattccctgcagaaactcgccgtgttgcccgatgagaccgccatctacttcggccatgaatacacattgtccaatgcccgcttcgcgctgaccgtcgatcccgacaatgagcgactgaagagccgcgccgccgagatcgaggccttgcgcgccgatggcaaattcaccatcccgacgacattggggctggaaaaggaaaccaacccgttcctgcgcgccgccgatccggcgatccgccgcaatctgctgatggaaggcaagaccaacgaggaagtctttgcagagatccgcaagcgcaaggaccatttctga

SEQ ID NO: 1316 - DNA, 789 bp, Arthrobacter FB24
atggactggttcaacaccatcatccgcaccttcttcgacttcggcgcaatggccgaagtcctaccccaactgctgggggtcggtcttcttaataccctcatcatctccgtcgccgccaccatcattggcgtggcgctgggcatggtcgtcgcagtcatgggtatatccccttcgaaatggctccgcgtcccggcccggatctacaccgacctcttccgcggcctgcccgcaatcctgaccatcctgttgattggccagggattcgcgcgtctcagccagtctatttttgggccctccccctacccgctgggaatcattgcgctgagtctcatcgccagcgcctatatcggtgaaattttccgcgcgggcatccaaagcgtcgacagaggccaaggcgaggcctgccgcgcactgggcatgagctatgccaagtccatggcccttgtcgtggttccacaagggattcgccgggtcctacctgcactcgtcaaccagttcatcgccatcgtcaaagactcctccctcgtctacttcctgggactgctggttactgaacgtgaactcttccgagtaggccaggacgccgcagtactttccggaaacctctcccccttggtcatggcgggcatcttctacctcatcatcacggtcccactgacccatctggtcaactacttcgacagccgcttcaggaccggccgccgccgtccttccgcccccaccagcggactaaacgaagtcaaggaactcgacgcggcctcgccgctgatcaccgggagcaacacgtga

SEQ ID NO: 1317 - DNA, 681 bp, Shewanella baltica OS185
atgatagacgcaattaatacctcgctgtttagcccgattggcgaagatggcatgataggcatactgctgatattaaatggtttgaaagtgacgttaatcgtcactttcttcgccatgttattaggcgcagtgttaggcattggcaccacctttatgaagatgtcgtctaagtggtatatccgcttccccgccaatctttatgtcggtgtcatccgtggcacgcctgtggttgtgcagttagtgatcctttactttatcgtgctttcagccttagatgtcgataagatcaccgccgctattatcgcttttggtctcaatagcggcgcgtatatttctgagataatccgcgcggggattcaagccgttgataaaggtcaaaccgaagcggcccgttcactcggtttatcccaagcgatgaccatgaagtcgattattctgccccaagcgattaagaatattctgcccgcactcggaaatgaatttatcgtgctcctcaaagaaaccgccgtcattggctttatcggtggcgtcgaccttatgcgcgccggtgaaatcatccgtagccgcaccttcgaggacagtgtgccgttatttacctgcgcactcatctacctattcctgacctacagcttcacatttgtgctgtcgaaatttgaaaagaggttgaaacaaagtgattaa

SEQ ID NO: 1318 - DNA, 660 bp, Bacillus cereus cytotoxis NVH 391-98
atgaatctagatttttcggcaataacgccatcgataccatatatattaaaaggactagaagttacattaaaaattgtagctgtttcagctttaattggttttatattagggacactattagctctttgtaagattgctagaattcgagttttaaatgttgcagcggatctatatacatccatatttcgtggaacaccacttgttttgcaattaatgattatatattttggtgtaccacaaatgattggatatgatattccagcttttttagccgcagtcattgcatttagcttaaattcaggtgcatatatgtctgaggtcattcgcgccgggattcaagcgattgataaagggcagaccgaagcagcgatagcgctaggtgtaccgtatgggaaaatgatgagacatattatattaccacaagcattaaaaaatatattacctgcgcttgtgaatgaatttgcaacactgacgaaggaatcggctgtagtaacagtaattggtgcaacagatttaatgcgtcgcgcttacattgtgggtggtgaaacatttaagtatcttgaaccattactttttgttgggcttgtttattatattttagtgattgtacttacagtagttgggaaagcaattgaagggagaatgaagaaaagtgattaa

SEQ ID NO: 1319 - DNA, 708 bp, Campylobacter hominis ATCC BAA-381
ttgtatttcaaaattttcaaatttttattttttatagccattgttttgatagcgatttattatacttatccgacagatattacggatgcacagataaaaaattattgtaaaagttacggcattacgatgattcttacgattggcggaacaagtataggtatttttttgggttttattttggcgtttttaaaatttgcaaattttaaaattttaaattttataatcgatgaatatattgatatcattcgtggaactccgattgtaattcaacttatgatttttgtttttgttatttttgcaagttggacgaacaatattgcggctgcggtttttgcactcggtttaaacagctcggcttatgtagctgaaatagtgcgaagcggtataaacagtatagataaaggtcaaatggaagctgcgcgtgcgatgggtttgaattatacaacttcgatgagaaagattgtttttccgcaagctataaaaaatatcctacccgctttggcgaacgaatttataagcctttttaaagaaacttcagttgttggaatggtggcaattaccgatcttacgtttttttcaaaaagtttgcaggcgacgttatatacggttcagccgatacttttcgctgctgttatttattatgtgagtgtaaaattttttacgcttttggtaaaattacttgaaaaaaggctgaacagaaatgattga

SEQ ID NO: 1320 - DNA, 681 bp, Shewanella baltica OS195; identical to SEQ ID NO: 1317

SEQ ID NO: 1321 - DNA, 708 bp, Clostridium phytofermentans ISDg
ttgagtattcagataaaaatggaagagttttatcagcggtttgtatcgaattttatagaagataaccgttatatgtacctcgtaaggggattaattacaacattagtaattacattttttgctgtaatgattggtgcattacttggttttatcatagcgataattcgttctacttattcaaaaactggtaagttaagagtattaaactttttatgtaatatctatattacagtaattcgtggtacaccggtagttgtacaattattgattatttattttgttatatttggttcagttaacataaataaaatatttgtagcggtgttagcatttggacttaactccggtgcgtatgtgtcagaaattgttcgttctggtattatgtcagtggatgaaggacagttcgaagcaggtagaagtcttggatttaattataatcagactatgcgattgattattttacctcaggcaattaagaatatcttacctgcactcggtaatgagtttatcgttttgttaaaggaaacttctgtttgtggttttatagcattagaagatttaacgaaagctggagatattattcgtggtcgtacttatgacgcttttatgccactcatagcagtcgcattaatttatttgacattagttattatctttacgaaactagttaattatttggagaggaggttgagaaacagtgaccactga

SEQ ID NO: 1322 - DNA, 681 bp, Shewanella baltica OS223
atgatagacgcaattaacagctcgctgttcagcccaattggcgaagacggcatgataggtatactgctgatattaaatggtttgaaggtgacgttaatcgtcactttcttcgccatgttattaggcgcagtgttaggcattggcaccacttttatgaagatgtcgtctaagtggtatatccgcttccccgccaatctttatgtcggtgttatccgtggcacgccagtggttgtacagttagtgatcctttacttcatcgtgctttcagccttagatgtcgataaaatcaccgccgccatcatcgcctttggtctcaatagcggcgcgtatatctctgagattatccgcgcaggcattcaagccgtcgacaaaggtcaaaccgaagcggcacgttcactcggtttatcccaagcgatgaccatgaagtcgattattttgccccaagcgatcaagaatattctgcccgcactcggaaatgaatttatcgtgctcctcaaggaaaccgccgttattggctttatcggtggcgtcgaccttatgcgcgccggtgaaatcatccgtagccgtaccttcgaggacagtgtgccgttatttacctgtgcccttatttacctattcctgacctacagcttcacgtttgtgctgtcgaaatttgaaaagaggttgaagcaaagtgattaa

SEQ ID NO: 1323 - DNA, 777 bp, Catenulispora acidiphila DSM 44928
atgatcgcgatcggctgcacggctggcttcgccgcggtggtcggcgtcttggtggtcacctcgcccgggtggccgcgcttccgtgagtcgttcctgtcctggtcggtcttccgctcctcgatgcccgacatcctgcgcggcttctggctgaacatccagattttcatggtcgccgagccgatcatcctgatcctgggcctcggcgtggcgctgatccgcaccaccaagtccccggggctgttgcccttccgcctgaccgcgaccctgtacgccgacgtcttccgcggcgtcccgaccctgctgctaatcctggtcgtcggtttcggtattccggcgctccagctcagcgggacgcccaaggaccctgtggtgctcggggtggtcgcgttgacgctgtcgtacgtcgcctacgtctctgaagtcttccgtgccggtctggactcggtccatccgtcgcagcgcgctgcggccacggcactgggcttgtcggagcggcagacgttgcggttcgtggttcttccgcaggcgatccgcaacgtcgtgccgccgttgttgaacgacttctcggcgctgcagaaggacacggctctggtttcgacgctcggcgtggtcgaatccttgcgacaggctcagatccacgagtcgctgacgttcaactacacgccctacgtcggcgcggcgctgctgttcatcgcggtcaccgtgccgctggcacgctacaccgaccgcctggcacggcgcgccgccgcacggcagcaggcagggggagcccgatga

SEQ ID NO: 1324 - DNA, 1728 bp, Rhodoferax ferrireducens T118
atgcactatgatgcgtgcactgatgtcgataaatgcatttttatgcttctaacccgaggagaacagaacgtgagcacccccagccgtgtcgaataccaaatcaccccgtcccagtacaaacactggaaactggagttcaatggcccagtggccacattaaaagccgactttgacgaaaacgccggcctgcgccccggctacaaactcaagctcaacagctacgacctgggcgtggacattgaactcaacgatgccatcagccgcatccgctttgaacaccctgaagtgcgcaccgtggtggtcacctcggcccgcgaccgggtgttttgctccggtgccaatatcttcatgctcggcgtcagcagccacgcctggaaggtgaatttctgcaaattcaccaacgagacccgcaacgggctggaagactcttcggcccacagcggcctgaagtttcttgctgccgtcaatggtgcctgtgccggaggtggctacgagctggccctggcctgcgacgaaatcattttggtggacgaccgctccagcgcggtgagcctgcctgaggtgcctctgctgggcgtgttgcccggcactggtggcctgacccgcatcaccgacaaacgccatgtgcgccatgacctggctgacctgttctgcaccagcgccgaaggtgtgcgcggcgacaaggccgtggcctggcgtctggtggatgcggtggccaaacccgccgtgtttgcccagaaagtgcaagaacgcgccctggcactggccgcccagagcgaccgcccggcggatgccaagggcgtggccctgacgccgttagagcgcagcatcgaggccgatgcgctgcgttacacacatgtcaccgtcgagattgaccgtgccaagcgcaccgccaccttcaccgtcaaggcaccgactggcgtgcagccaagcgacatcgccggcatcgaagccgctggtgccgcctggtacccgctggccatggcgcgtgagctggaagacgccatcctgaatatgcgcaccaacgaaaccgaaatcggcacctggctgatcaagaccgaaggtgaagcgaaagccgtgctggcaatggatgctaccttgctggcgcacaaaaaccactggctggtgcgcgaaacccttggcctgctgcgccgcaccttcagtcgcctggacgtgtcctcgcgcagcctgtttgcgctgattgaagcgggctcctgctttgccggtaccctgctggagctggccttggcctgtgaccgcagctaccagttggtgttgcccaatgacgaagccagcacaccgcgcatcacggtgaccgagaccaactttggcttgtaccccatggccacgacccagagccgcctgggccgccgtttctacgacgagcagtccgcgctggactcggtacgcgccaggatcggtgaagcgctggatgccgatgccgccttcgcactcggtttggtgacctccaaccccgacgacatcgactgggccgacgaggtgcgcattgccattgaagagcgcgtgtccatgtcgcctgattcgctgaccggcctggaagccaacctgcgtttcaacggccaggagaacatgagcacccgcatttttggccgcctgaccgcctggcagaactggatcttccagcgccccaacgccgtgggagaaaaaggtgcgctcaaggtttatggcaagggtgacaaggcggcttttgactggaatcgggtctga

SEQ ID NO: 1325 - DNA, 1671 bp, Burkholderia xenovorans LB400
atgtccacagcagaaaccgccgtcgcgccggtcgactaccgcaccgatccctcgcagtacaagcattggaagctgagcttcaacggtcccgtcgcgacactcggcatcgatatcgccgaggacggcggtatccgtgacggctacaagctgaagctgaattcctacgatctcggcgtcgacatcgaactgcacgacgcaatacagcgcatccgcttcgagcatccggaagtcagaaccgtggtgctgacgagcctgaaggatcgcgtgttctgctcgggcgcgaacatcttcatgctcggtctttccacccatgcgtggaaggtcaacttctgcaagttcaccaacgaaacgcgcaatggcctggaagattcatcgcgccattcgggtctgaagtttctcgcggcggtcaacggcgcctgcgcgggcggcggctacgaactcgcgctcgcctgcgacgagatctatctggtggatgaccgttcgtcgtcggtatcgctgccggaagtgccgctgctcggcgtgttgccgggcaccggcggcctgacgcgcgtgaccgacaagcgcaaggtgcgtcacgatcgcgccgacatcttctgcacggtggtggaaggcgtgcgcggcgagcgcgcaaaggcatggcgcctcgtggatgaagtcgtgaagccgaaccagttcgaccaggcgatccaggcgcgcgcgctcgaactcgccgcgcagagcgatcgtcccgcgcacgcgcaaggcgtgccgctcacgcggatcgaacgcaccgatcgcgaagacggcctcacttataaaacgctcgacgtgacgatcgatcgtgcgaagcgcattgcaacgttcacggccaaggctccgcaaaccgaaccgcccgcgagtatcgacgccatcgtcgcagccggcgcgaactggtggccgttgaaattcgcccgcgaattcgacgacgcgatcctgtccatgcgcaccaacgagcttgcggtcggcacgtgggtcttcaggaccgaaggcgacgcccgccatctgctcgccgcggacgcctcgctgatgcagcacaaagaccactggttcgtgcgcgagacgatcggcctgttgcgccgcacgctggcgcgtatcgacgtctcgtcgcgttcgctgttcgcgctgatcgagccaggctcgtgctttgccggcaccttcgcggaactcgcgttcgccgccgaccgcacttatatggcggcgctgccggccaatgaagacgaagagccggccatcacgctttcggaggtcaacttcggcctctatccgatggttacgcatcaatcacgtctggcccggcgtttctatgaagaaacggaaccgctcgatgccgtgcgctcccggatcggccaggcgatcaagccggtcgaagccgaacgcctcggcctcgtcacggcgtcccccgacgacattgactgggccgacgaaatccgcattgcgctcgaagaacgcgcggccatgtcgccggatgccttgaccggactcgaagcgaatctgcgcttcaacggtccggaaacaatggagacgcgcattttcggccgtcttaccgcgtggcagaactggatcttcaaccggccgaacgcagtgggcgagaagggcgcgctcaaggtgtacggcaagggcagcaaggcgcaattcgacgtctcgcgcgtgtga

SEQ ID NO: 1326 - DNA, 1659 bp, Polaromonas JS666
gtgaacattgacactcgcgttgactatcaaaccaaccccggtcgctataaacactgggcactgaagtttgaagggcccgtcgccacgctgacggctgactttgacgaaaacgcaggcctgcgacctggctacaagctcaagctcaacagctacgaccttggcgttgatattgagctcaatgatgcgatcaaccgcattcgcttcgagcatccggaagtccgcacggtggtggtgaccagtgccaaggagaaggtcttctgctctggcgccaacattttcatgctgggtgtcagcagccactcctggaaggtgaacttctgcaaattcaccaacgaaacccgcaacggcctggaagactcctccaaatacagcggcctgaagttcctggccgccgtcaatggcgcatgtgccggtggtggctatgaactggcgctggcctgcgacgaaatcatcttggtggatgaccgctccagcgcggtgagcctgcccgaggtgccgctgctgggcgtgctgcccggcaccggcggcctgacacgcgtcaccgacaagaagcatgtgcgccacgacctggccgatctgttctgtaccagcgtcgaaggcgtgcgcggccagaaggccaaggactggcgcctggtggacgacatcgccaagccgcaggtctttgcccagaaggtgcgcgagcgggcgcttgaattggccgccaccagcgaccggccggccgatggcaaaggtgtcatgctgtcaccggtggcgtgcgtgctcgaggcagatgcactgcgctacccgaatgtgacggtcgaaattgaccgcgccaagcgtaccgccacctggaccgtcaagggccccacgggtgcccagcccaccgacgtggccggcatcgaggccgcgggcgcagcctggtacccgttgcagatggcgcgcgaactggaagatgccatcctgcaaatgcgcaccaacgagctggacattggcacctggttgatcgagacccagggcgatccggctgcggtgctggcaatggacgccaccttgctggcccatcagaaccactggctggtgcgtgaaacgattggtttgctgcgccgcacgttcagccgtctggatgtgtcgtcgcgcagcctgtttgcgctgatcgagccaggttcctgctttgccggtaccttcctggagctggccctggcctgcgaccgcagctaccacctggcgctgcccgacgacgagtctggtgcgccgaagatcaccgtgggcgaggtcaacttcagcctgtacccgatggtgacggaacagagccgcctgggccgccgtttctacaacgagcaacccgcgctggacgctgtgcgcgccagcatgggccagccactcgatgccgacgccgcgttcgccctcggcctggtcacgtccaacccggacgacatcgactggaccgacgaagtacgtattgccgtcgaagagcgcgtgtcgatgtcgcccgatgccctcaccggcatggaggccaacctgcgcttcaacggccctgaaaacatgttcacccgtgtcttcgggcgactcaccgcctggcagaactggatcttccaacgccccaacgccgtcggcgaaaagggcgccctgaaggtctatggcaaaggcgacaaggcccagttcgactggaaccgcgtctag

SEQ ID NO: 1327 - DNA, 1659 bp, Polaromonas naphthalenivorans CJ2
atgaccatcgcctcccgcgtcgagtaccagaccgacccttcccaatacaagcactggaagctcagcttcaatggccccgtcgccacgctggcggtggacatcgacgaaaacgccggcttgcgccccggctacaagctcaagctcaacagctacgacctcggggtcgatattgaactgaacgacgccatcagccgcatccgtttcgagcacccggaagtgcgcaccgtggtggtgaccagcgccaaagaaaaagtgttctgctccggcgccaacatcttcatgctgggcgtgagcagccactcctggaaagtgaacttctgcaagttcaccaacgaaacccgcaacggcttggaagactcgtcccgctacagcggcctgaagttcctcgctgcggtcaacggcgcttgcgccggcggcggttacgagctggcactggcctgcgacgagatcatcctgattgatgaccgctccagcgccgtcagcctgcccgaagtgcctttgctcggcgtgctgcccggcaccggcggcctgacccgcgtgaccgacaagcgccatgttcgccacgacctggccgacctgttctgcaccagcgtcgaaggcgttcgcggccagaaggccaaggactggcgcctggtcgatgacattgccaaggcggtcgatttttcgcagaaggtgcagacccgcgccctggcgctggccgagcagagcgaccggcccgccgacggcaagggcgtggtgttcaagccgctcaatcgcacggtcgaagccgatgcgctgcgctattcaaatgtgacggtcgagatcgaccgcgccaagcgcaccgccacctggacggtcaaggcgcccacgggtgcgcaaccctcaagcatcgccggcattgaagcgctgggcgccgactggttcccgctggtgatggcgcgcgaactggaggacgccatcctgatgatgcgcaccaacgagctggaaatcggcacctggctgatcaagaccgaaggcgatgcggctgccgtgctggccatggacgacgtgctgctggcgaaccagaagcactggctggtgcgcgagaccatcggcctgctgcgccgcacgctgagccgcctggacctgtcctcgcgcagcctgttcgcgctgatcgagccgggttcgtgctttgccggcacctacctggaactcgccctggcctgcgaccgcagctaccaccttgccctgcccgacgacgaggaccgtgcgcccaaaatcaccgtggccgagaccaattttggcctctacccgatggtgactgaccagagccgcctgggccgccgtttttatgacgaagcaccggcgctcgaagccgtgcgcgccaaggcgggccagccgctggatgccgacgccgcgtttgcgattggcctggtcacgtccaatccggacgacatcgactggactgacgaggtgcgcattgccatcgaggaacgcgtgtccatgtcgcccgatgcactgaccggcatggaagcgaatttgcgcttcaacggcaccgagaacatgttcacccgcatttttggccgcctgaccgcctggcagaactggattttccagcgcccgaacgccgtcggagaaaaaggcgcgctcaaggtctatggcaagggcgacaagtcccagtttgactggaaccgcgtctaa

SEQ ID NO: 1328 - DNA, 1683 bp, Verminephrobacter eiseniae EF01-2
atgaccgaccacccaccgcccgtcgctgcgcgcatcgactaccgcacggaccccgggcaatatcgccactggaagctggccgtcgatgcgccggtggcccgtctgtcgctggccatcgccgaggatggcggcatacgcccgggataccagctcaagctcaacagctacgacctgggcgtggacatcgaactgcatgacgcgctcaaccgcatccgcttcgagcacccgcaggtgcgctcggtcatcatcaccagcgccagggagcgcatcttctgctcgggcgcgaacatcttcatgctgggccgctccagccacgcctggaaggtcaatttctgcaagttcacgaacgaaacgcgcaacggcatggaggactcgtcccggtactccggcatcaaattcgtggccgccgtgaatggcacctgcgccggcgggggttatgaactggcactggcctgcgacgcgatcgtgctggtcgacgaccggtcctgcgccgtctcgctgcccgaagtgcccctgctgggcgtgctgccgggcaccggcggtctgacccggttgaccgacaaacgccatgtgcgccatgacctggcggacattttttgcaccagcgtcgagggcgttcgcggtcagcgcgcgctcgactggcgtttggtcgaccagattgccaagccggcgcaatttgccgcagcggtcgacgcgtgcgcggcccggttgggcgccggcagcatgcgcccgtccgatgcccggggcgtccggggcatcgccctgacaccgctggagcgcgaagaaagcgccgacagcctgcgctacgcgcatgtcagcgtcgccatcgaccgcaggcgcggctgcgccacgctgtccatacaggcgccgaccggcgcgcagcccgcagacatcgcgtccatcgaggccgcaggcgcggcatggtggccgctggccatggcgcgcgaactcgacgatgccatcttgcacctgcgcaccaacgagttggacatcggcacctggctgctcaagacccaaggcgatgccgccgccgtgctggccagcgacgccaccctgctggcgcaccaggagcactggctggtgcgcgagaccatcggcctgctgcgccgcaccctggcccgcctggatgtgtctgcgcgcagcctgttcgcgctgatcgagcccggctgcgcctgcgctggctcgctggcggaactggcctttgccgccgaccgcatctacatgctggcgctgccgggcgacgcgcagcgcgcgccccggctcacgctcgacgaattcaactttggcctgctgccgatggtcaacgaccaaagccgcctgcagcgccgcttccatgccgaggccgcgcccctgcaagcggcccgcgcggcgctgggccagccgctggatgccgacgcggcccaggccctggggctggtcagcgcagcgccggacgacatcgactgggacgacgagttgcgtatcgccatcgaagagcgcgccgccatgtccgccgacgcgctgaccgggctggaagccaacctgcgctttgccggccaggaaaacatgaacacccgcatcttcggccggctcacggcctggcagaactggattttcaaccgccccaatgcggtgggggaaaaaggtgcgctcaaggtttacggcaccggccagaaagccgttttcgatcccgatcgcgtctag

SEQ ID NO: 1329 - DNA, 1689 bp, Bradyrhizobium BTAi1
atggctggcgcaccgcggaagctcgcaaacggaaaagcgttcatcgatttccagacggaaccgtcgcgctaccgccactggaagctgtcggtccaaggcgagaccgcgacgctcgcgatggatgtcgacgagaatgccgggctgttcgagggctatcagctcaagctgaactcctacgatctcggcgtcgacatcgagcttgccgacgcgttgatgcggctccgcttcgagcatcccaacgtcaaggtcgtgctgctgcgctcggccaaagaccgcgtgttctgcgcgggcgccaacatccgcatgctggccggttcggaacatccgcacaaggtcaacttctgcaagttcaccaatgagacgcgcaacgcgatggaggatgcgagccaatattccggccagcgcttcgtcacggtggtgaacggcacggccgccggcggcggctacgagctggcgctggcgaccgaccacatcatgatggtcgatgatggctccaccgcggtgtcgctgcccgaagtgccgttgctcgccgtgctgccgggcaccggaggcctgacgcgcgttgtcgacaagcggatggtgcgccgcgaccacgccgacgtgttctgcaccatcgaagaggggatcaaggggcgccgcgccgtgcaatggcgcctgatcgacgaactggtgcctccgtcgaagctcgaagagcgtgtcaaggcgacggcgtccgatctggcgaccaagtcgccgcgcagcggtcccgccgagggcgtgaagctcacgcagctcgatcgcaaattccgcgccgacggcatcgactacggcttcgtccggctcgacatcgaggcggcgcagcggctcgccaccatcacggtgcgtgtggccgaggcggcgtcagccaagtccgccgcggagatcgtggcgctcggagctgcgttctggccgttgcaatgcgcccgcgagctcgacgacgccattcttcacttgcgcaacaatgcctatgagatcggaacggtcatcttcaagaccgagggcgatcccgaggtcgcccgcgcctatgatgatctgctcgaagcgcatcgcgacaattggttcgtgcacgagatccgccattactggaagcgcgtcctgaagcgcatcgatgtgacctcgcggaccctggtggcgctgatcgagcccggctcctgcttcgtcggcacgctcgccgagctcgctttcgccgctgaccgcagctacatgctgctcggccagttccagggcgacaatcgcccggcagcgacgatcgagctgacgcgcgccaatttcggcgcctatccgatgtcgcatggcctcacccgcttgcagtcgcgcttcctggccacgcccgacaagccggcgcagctcgaagccaaaatcgcaacggcgctggacgccgacgaggccgaggcgctggggctcgtcaccttcgcattggacgacatcgactgggcggacgaggtgcgcgtgttcctcgaagagcgcgcgagcttctcgcccgatgcgatgaccggtctcgaagccaatctgcgcttcgccgggcccgagacgatggagtccaagatcttcgcgcggctcaccgcctggcagaactggatcttccagcggcctaatgcggtcggcgaggagggcgcgctggcgcgctacggcaccgggcaacgcccgacctacgatctgaggcgcgtctga

SEQ ID NO: 1330 - DNA, 1671 bp, Delftia acidovorans SPH-1
atgcacccgtccagccccactgtcgattaccgcaccgagcccgcccagtaccgccactggtcgttcaccgtcgagggcgccatcgcccgcatgcagctgaacatcgccgaggacggcggcatacggcccggctacaagctcaagctcaacagctacgacctgggcgtggacatcgagctgcacgacgcgctcaatcgcatccgcttcgagcatccgcaggtgcgcaccgtcatcgtcaccagcgggcgcgaccgcatcttctgctcgggcgccaacatcttcatgctgggcgtgtccagccatgcctggaaggtgaacttctgcaagttcacgaacgagacgcgcaacggcatcgaggacagttcgcgccactcgggcctgaagttcctggccgccgtcaacggggcctgcgcgggcggcggctacgagctggccctggcctgcgacgacatcgtgctgatcgatgaccgctcctcctccgtctccctgcccgaggtgccgctgctgggcgtgctgcccggcacgggcggcctcacgcgcgtgaccgacaagcgccatgtgcgccatgacctggccgacatcttctgcaccagcgtggaaggcgtgcgcggccagcgcgccgtggactggcgcctggtcgatgccgtggccaagcccgcgcagttcgaggccgtggtggcccagcgcgcgcagcgcctggccgagggcagcacgcgccccgccaatgcgcagggcatcacgctcacgcgcctggaacgcgaagccacggacgacgcgctgcactaccgccatgtcagcgtgcagatcgaccgcgcgcgccgcagcgccacgctgaccgtgaaggcgcccacgcttgggcaaggcccgcagccggccaccatcgaagccatcgagcaggccggcgacgcctggtggccgctggccatgggccgcgagctggacgacgccatcctgcacctgcgcaccaatgagctggacgtgggcacctggctgctcaagaccgaaggcgatgccgccgccgtgctggccgcagacgcagccctgctggcccaccaggaccactggctggcgcgcgagacgctgggcctgctgcgccgcagctttgcgcggctggatgtgtcctcgcgcacgctgttcgcgctgatcgagcccggctcctgcttcgtgggcatgctggccgagctggccttcgcggccgaccgcgcctacatgctggtgctgcccgatgacaccgagcgcgccccgcgcatccagctggacgagttcaatttcggcctcctgcccctggtcaacgaccagtcgcgcctgcagcgccgcttctacgaggaggccgcgccgctggaggccgcgcgcgccgccacgggccgcgcgctggacggcgaccaggccctggccctggggctggtcacggccgcgcccgacgacatcgactgggacgacgagatccgcatcgccatggaagagcgcgccgccatgtcgcccgatgcgctcacgggcctggaggccaacctgcgctttgccagccgcgagaacatggtcacgcgcatcttcgggcgcctgtcggcctggcagaactggatcttcaaccgccccaatgccgtgggcgacaagggcgctctcaagctctacggcacgggccagaaggccggcttcgacttcaaccgcgtctga

SEQ ID NO: 1331 - DNA, 1683 bp, Burkholderia phymatum STM815
atgtccgcagtcatgtccccggcacacgccgccgccgcgcgcgtcgactaccgcacggatcccgcgcactacaagcactggaagctctcgttcgacggcgccgttgcgacgctcggcatcgatatcgccgaagacggcggcatccgtgacggctacaagctgaagctcaattcatacgacctcggcgtcgacatcgaacttcacgatgcacttcagcgcatccgcttcgagcatcccgaagtgcgcacggtcgtcgtcacgagtctgaaggatcgtgtgttctgctcgggtgcaaacatcttcatgctgggtctgtcgtcgcatgcatggaaggtcaacttctgcaaattcacgaacgagactcgcaacggcatcgaggactcgtcgcttcactcgggcctgaagtttcttgcagccgtaaatggttcatgtgcaggcggcggatatgaactggcgctcgcctgcgacgaaatctatctggtcgacgaccgctcgtcgtcggtggcgctgccggaagtgccgctactcggtgtgctgcctggcacgggcggcctcacgcgcgtcacggacaagcgcaaggtgcggcacgatcgcgccgacatattctgcacggtggtcgaaggcattcgcggcacgcgtgcgaaagaatggcgtcttgtcgatgaagtcgtaaagccgaacgggttcgaacaggcgatcgctgcgcgcgcgctggaactcgctgcgctaagcgaccgaccggcgaatgcacgaggcgtgacgctgacgcgcattgaacgcatggatcgcgaagacggcatcacgtatgcgacgctcgacgtgacgatcgaccgcgcgaagcgcacggccacgttcacggccaaagcgccgtcgacggcgcaacctttggatatcgatgccgtcgtcgcgatgggcgcgagctggtggccgctgcaatttgcgcgcgaactcgacgacgcgatcctgtcgatgcgcaccaacgaactcgatgtcggcacgtggattctaaagacgcaaggcgacgcgcgtggcgtgctcgccgccgacgccacgctgctgcagcacaaggaccactggttcgtgcgcgaaacgatcggtctgctgcgccgcacgctcgcgcgcatcgacgtctcgtcgcgttcgctgtttgccctgatcgagccgggctcgtgtttcgcgggtacgctcgccgagttcgcgtttgccgccgaccgcacttacatggccgcgctgcccgcgaacgaagatgaagagcccgcgatcacgctgtcggaggtcaatttcggtctctatccgatggtcacgcatcagtcgcggcttgcgcggcgcttctacgaagagacggagccactcgacgccgcgcgcgcgaaaaccggccagccagtgaaagcggcggaagcggagcggctcggcctcgtgacggcgtcgctggacgatatcgattgggccgatgagattcgcatcgccctcgaggaacgcgcggcgatgtcgccggatgcgctgacgggcatggaagcgaatttgcgtttcaatggccgcgagacgatggagacgcgtatcttcgggcggctgacggcctggcagaactggattttcaaccggccgaatgcggtgggcgagaagggcgcgctcaaggtgtacggcaagggcagcaaggcgcaattcgacgtctcgcgtgtctga

SEQ ID NO: 1332 - DNA, 1671 bp, Burkholderia phytofirmans PsJN
atgtccacagcagaaaccgccgtcgcgccggttgactaccgcactgaaccctcccagtacaagcactggaagctgagcttcaacggtcccgtcgcgacgctcggcatcgatatcgccgaggacggcggcattcgtgacggctacaagctcaagctgaattcgtacgacctcggcgtcgacatcgaactgcacgacgcggtacagcgcatccgcttcgagcatcccgaagtgaaaaccgtggtgctgacgagcctgaaagaccgcgtgttctgctcgggcgccaacattttcatgctgggtctctcgacgcatgcgtggaaggtcaacttctgcaagttcaccaacgaaacgcgcaacggtctggaagattcgtcgcgtcattcgggactgaagtttctggctgccgtgaacggtgcgtgcgccggtggcggttatgagctcgctctggcctgtgacgagatctatctggtggacgaccgttcgtcatcggtgtcgctgccggaagtgccgctgctcggcgtgctgccgggcaccggcggcctcacgcgcgtcaccgacaaacgcaaggtgcggcacgatcgcgccgatatcttctgcacggtggtcgagggcgtacgcggcgagcgcgcgaaagcatggcgtctcgtggatgaagtcgtgaagccgaatcagttcgaccaggcgatccaggcacgcgcgctcgaactcgccgagcaaagcgatcgtcccgctgacgcacaaggtgttgtgctcacgcgtatcgaacgcacggatcgcgaagaaggcctcacttataaaacgctcgacgtcacgatcgatcgtgcaaaacgtatcgcgacgttcactgccaaggcgccgcagagcgaaccgcccacgaatatcgatgagatcgtcgcagccggcgtgaactggtggccgttgcaattcgcccgcgaactcgacgacgcgatcctttgcatgcgcaccaacgaactggcggtcggcacatgggtcttcaagaccgaaggcgacgcccggaatctgctcgccgcggacgcctcgcttatgcaacacaaagatcactggttcgtgcgcgagaccatcggcctgttgcgccgcacgctggcgcgcatcgacgtctcgtcgcgttcgctgttcgcgctgatcgagccgggctcgtgcttcgccggcactttcgcggaactcgcgttcgccgccgaccgcacgtatatggcggcgctgccgagcaacgaagaggaagagccggccatcacgctgtccgaagtcaacttcggcctttatccgatggtcacgcatcagtcgcgtctcggtcgccgtttctatgaggaagcggagccgctcgatgctgtgcgctccctgatcggtcagccgatcaagccagtcgaagccgaacgcctcggtctcgtgaccgcatcgcccgacgacatcgactgggccgacgaaatccgaatcgcgctcgaagaacgcgccgcgatgtcgccggatgcattgaccggactcgaagcgaacctgcgcttcaacggtccggaaacaatggagacgcgcattttcggccgtctcaccgcgtggcagaactggattttcaaccggccgaacgcagtgggcgagaagggcgcgctcaaggtgtacggcaagggcagcaaggcgcaattcgacgtctcgcgtgtttga

SEQ ID NO: 1333 - DNA, 1677 bp, Variovorax paradoxus S110
atgaccgagaccacgacccttcaggcgcctctgcgcgtcgactaccgcatcgaacccgcgcaatacaggcactggaagctcagcttcgaaggcccggtggcgcgcctggtgctcgacatcgcggaagacggcggcatccgccccggctacaagctcaagctcaacagctacgacctgggcgtggacatcgaactgaacgacgcgctcaaccgcgtgcgcttcgagcaccctgaagtgcgcagcgtgatcgtcaccagcggcaaggaccgcatcttctgctcgggcgccaacatcttcatgctgggcgtgtcgagccatgcctggaaggtgaacttctgcaagttcaccaacgagacgcgcaacggcatcgaggattcgtcgaagcattcgggcctgaagttcatcgcggccgtgaacggcgcctgcgccggcggcggctacgagctggcgctggcctgcgacgagatcctgctggtggacgaccgctcttcctcggtctcgctgcccgaggtgccgctgctcggcgtgctgcccggcaccggcggcctgacccgcgtgaccgacaagcgccatgtgcgccatgacctcgccgacatcttctgcaccagcgtcgaaggcgtgcgcggccagcgcgcggtcgactggcgcctggtcgatgccgtggccaagcccgcgcagtttgccgccgccgtgcaggagcgtgccgcgcagctggccgccgcgagcgaccgcccggccagcggcaagggcgtggcgctgacccggctcgagcgcaccgacagcgccgacggcatcgcctattcgaacgtcgacgtgaagatcgaccgcagcaagcgcaccgccacgatcaccgtcaaggcacccaccggcacgcagccggccgacattgccgccatcgaggctgcgggcgccgcctggtggccgctggccgtgtgccgcgagctcgacgacgccatcctcaacctgcgcaccaacgagctcgacatcggcacctggctgctcaagaccgaaggcgacgcggccgccgtgctcgcatcggacgccctgatgctggcccacaaggaccactggctggtgcgcgagaccatcggcgcgctgcgccgcacgctggcgcggctggacgtgtcgtcgcgcagcctgttcgcgctggtcgaagccggctcgtgctttgccggcacgctggccgagctggcctttgcggccgaccgcagctacatgctcgcgctgcccgacgatgccgcgcgcgcaccgaagctcgtgctcaacgaattcaacttcggcttcttcccgatggtgaacgaccagagccgcctgcagcgccgcttctacgaagaggccgcgccgctggacgccgcccgcgccgcggccggcaagccgctcgatgccgacgaagcactgaagctcggcctcgtcaccgccgcgcccgacgacatcgactgggacgacgagatccgcatcgccgtcgaggagcgcgccgccatgtcgcccgatgcgctcaccggcctcgaagccaacctgcgcttcgccagcaaagagaacatggccacccgcatcttcggccggctcaccgcctggcagaactggatcttcaaccgccccaacgccgtcggcgaaaagggcgcgctcaaggtctacggcaccggccagaaagccggcttcgacttgaaccgcgtctga

SEQ ID NO: 1334 - DNA, 930 bp, Jannaschia CCS1
atgactgagcccaccgccccccgctcgttccaggagattatcctgcgccttcaggcgtattgggcgtcgaagggctgtgcggtcctgcaaccctatgacatggaggtcggggcgggcacgtttcaccccgcaacgaccctgcggtccctgggcacgcggccctggacggcggcctatgtgcagccgtcgcgccgcccgaccgatgggcgatatggcgacagcccgaaccggtggcagcactattatcagtatcaagtcatcatcaagccgtccccgcccgatctgcaggagctgtacctcggcagcttgcgcgccatcgggatcgacatggatctgcatgacatccggtttgtggaagacgactgggaaagcccgaccctcggcgcctggggcctggggtgggaggtatggtgcgacggcatggaagtctcgcaattcacctacttccagcaggtcggcggccacgattgtcatcctgtctcaggcgagctgacctatgggttggagcgtctggcgatgtatgtgctggattgtgacgacggcaacgagatgccgttcaacgatcccgatgctccgatcccgctgacctacggcgatgtcttccgcgaggccgaggcgcaatatgcgcgctggaacttcgacgtggcagacaccgacattctgtttcagcacttcaaggatgcagaggcagaatgcgcccgcatccttgaccaacccgacaccgacccaaagaccgggcggcggatcgtcatggcactgcccgcctatgatcaggcgattaaggccagccacgtcttcaaccttctggacgcgcgtggcgtgatttccgtgaccgagcgccaggcctatatcggccgtgtccgcacgctgaccaaaaaatgcgccgatgcgttcgtgcagacggccgctggcggggcagaggtggcgtga

SEQ ID NO: 1335 - DNA, 951 bp, Ruegeria sp. TM1040
atgacccagaccacagccccgcgttcgtttcaggagatcatcctgcgtttgcagacctattgggcctccaagggctgcgccatcctgcaaccttacgacatggaagtgggtgcgggcacgtttcatccggcgaccaccctgcgctcactgggctccaagccatgggccgcggcctatgtgcaaccgtcgcgtcgccccacggacgggcgctatggggaaaaccccaaccgattgcagcattactaccagtatcaggtgctgatcaaaccgagcccgccggatctgcaggagctctatcttggctcgctcgaggcgatcggcgtcgacatggatctccatgacatccgctttgtcgaggatgactgggaaagcccgaccctcggcgcctgggggctgggctgggaagtctggtgcgatggcatggaagtctcgcagttcacctatttccagcaggttggcggccatgactgtcacccggtttcgggcgagctgacctatggtctggaacgtctggcgatgtatatcctcggcgtggatcatgtcatggacatgccgttcaacgatccgcaatcgccgcagcccttgagctatggcgacatcttcaagcagaccgaagaagaatatgcgcgctggaactttgacgtggccaacaccgaggtgctgttgcgccactttgaggaggccgagaccgaatgcgccgcgatcctcgcgcaagagcataccgaccccaagaccggcaagcgcatcatcatggcgcatcccgcctatgatcagtgcatcaaggccagccatgtgttcaacctcttggacgcgcgcggcgtgatctccgtgacggaacgtcaggcctatatcggccgtgtccgcgcactggcaaagcaatgcgccgatgcctttgtgctgaccgaggcgggaggtcacaccgaagagaccgcaggcgaaacagccgcctga

SEQ ID NO: 1336 - DNA, 924 bp, Rhodobacter sphaeroides 2 4 1
atgaccggcaaacccgttcccccccgcagctttcaggaaatcatcctgcgcctgatgacctactggggcgcgaaaggatgtgccgtcctgcaaccctacgacatggaagtcggcgcgggaaccttccatccggcgacgacgctccgctcgctcggcgcccgtccctgggctgcggcctatgttcagccctcgcgccgcccgaccgacggccgctacggcgagaacccgaaccgcctccagcattattaccagtatcaagtcctcatcaaaccctcgccgccggatctgcagaagctctatctcggctcgctcgaggcgatcgggatcgacatggatctccacgacatccgcttcgtcgaggacgactgggagagcccgacgctcggcgcctggggcctcggctgggaagtctggtgcgacgggatggaagtcagccagttcacctacttccagcaggtgggcgggcacgactgcaggcccgtctcgggcgagctcacctacgggctcgagcggctggccatgtatgtgctgggcatcgaccatgtcatggacatgcccttcaacgatccctgtggtcccacgccgctcacctatggcgatgtcttccgccagaccgagcaggaatattcgcgctggaacttcgatcaggccgacaccgacatgcttctgcagcatttcaaggatgccgaggccgaatgcgaacgcatccttgccgcgcccgagaccgacaaggccggccgtcgcatcgtcatggcccatcccgcctacgatcagtgcatcaaggccagccacctcttcaacctgctcgacgcccgcggcgtgatctcggtgaccgagcggcaggcctatatcggccgcgtccgcgcgctcgccaagaaatgcgccgacgccttcgtcaccaccgaggcgggggcggctgcgtga

SEQ ID NO: 1337 - DNA, 951 bp, Paracoccus denitrificans PD1222
atgaccagcccaaaggacaatcagacggcgaaacccgtctgctttcaggacgtgatcctgcgcctgcaatcctattgggccgcgcagggctgtgcggtgctgcaaccctatgacatggaggtcggcgccggcaccttccacccggcgaccacgctgcgcagccttggggcccggccctgggccgcggcctatgtccagccctcgcgccgtccgaccgacggccgctatggcgagaacccgaaccgcttgcagcattactaccagtatcaggtcatcatcaaaccctcgcccccgaacctgcaagagctttacctgggcagtcttgcggccatcggcctcgacccgatgatccacgacgtgcgcttcgtcgaggacgactgggaaagcccgacgctgggcgcctggggcctggggtgggaggtctggtgcgacggcatggaggtcagccagttcacctatttccagcaggtcggcgggcatgactgccgcccggtctcgggcgagctgacctatggcctggagcgtctggcgatgtatgtgctgggggtcgagcatgtgatggacatgcccttcaacccgcccggcagcccgatcccgctgagctatggcgacgtcttccgccaggccgagcgggaatattcccgctggaacttcgagcaggccgataccgggatgctgctgcagcacttcaaggatgccgaggcggaatgcgatcgcatcctgactgcggccgagacggacagcgccgggcggcgcatcccgatggcgcatccggcctatgaccaggcgatcaaggccagccacctgttcaacctgctggacgcgcgcggcgtgatctcggtcaccgaacgccaggcctatatcggccgcgtccgcgcgctggcgaaacgctgcgccgacctgttcgtcaccaccgaggccgccaccctgcaagcggaggacgcagcatga

SEQ ID NO: 1338 - DNA, 924 bp, Rhodobacter sphaeroides ATCC 17029
atgaccggcaaacccgttcccccccgcagctttcaggaaatcatcctgcgcctgatgacctactggggcgcgaaaggatgtgccgtcctgcaaccctacgacatggaagtcggcgcgggaaccttccatccggcgacgacgctgcgctcgctcggcgcccgtccctgggctgcggcctatgtgcagccctcgcgccgcccgaccgacggccgctacggcgagaacccgaaccgcctccagcattactaccagtatcaggtcctcatcaaaccctcgccgccggatctgcagaagctctatctcggctcgctcgaggcgatcgggatcgacatggatctccacgacatccgcttcgtcgaggacgactgggagagcccgacgctcggcgcctggggcctcggctgggaagtctggtgcgacgggatggaggtcagccagttcacctacttccagcaggtgggcgggcacgactgcaggcccgtctcgggcgaactcacctacgggctcgagcggctggccatgtatgtgctgggcatcgatcacgtcatggacatgcccttcaacgatccggatggccccacgccgctcacctatggcgatgtcttccgccagaccgagcaggaatattcgcgctggaacttcgatcaggccgacaccgacatgcttcttcagcatttccgggatgccgaggccgaatgcgagcgcatccttgccgcgcccgagaccgacaaggccggccgccgcatcgtcatggcccatcccgcctatgaccagtgcatcaaggccagccacctcttcaatctgctcgacgcccgcggcgtgatctcggtgaccgagcggcaggcctatatcgggcgggtgcgggcgctggccaagaaatgcgccgatgccttcgtcaccaccgaggcgggggcggctgcgtga

SEQ ID NO: 1339 - DNA, 924 bp, Rhodobacter sphaeroides ATCC 17025
atgaccggcaaacccgttcccccccgcagctttcaggagatcatcctgcgcctgatgacctattggggcggcaagggatgcgcagtgctgcaaccctacgacatggaggtgggggcgggcaccttccaccccgccaccacgctgcgctcgctgggcgcgcggccctgggccgccgcctatgtccagccctcgcgccgcccgaccgacggccgctatggcgagaaccccaaccgcctccagcactattaccagtatcaggtgctgatcaaaccctcgccgccggatctgcagcagctttatctcggctcgcttcaggcgatcgggatcgacatggagctgcacgacatccgcttcgtcgaggatgattgggaaagccccaccctcggcgcctggggcctgggatgggaggtctggtgcgacgggatggaggtcagccagttcacctatttccagcaggtcggcggccacgactgcaagccggtctcgggcgagctgacctacgggctggaacggctggcgatgtatgtgctgggcgtcgatcacgtcatggacatgccctacaacgatcccgacagcccgacgccgctgaagtatggtgacgtattccgccagaccgagcaggaatattcgcgctggaacttcgatcaggccgacaccgagatgctcttgcagcatttcaaggacgccgaggccgagtgcgagcgcatcctgtccgcgcccgagaccgacaaggcgggccgccggatcgtcatggcccatccggcttacgaccagtgcatcaaggccagccacctcttcaacctgctcgacgcccgcggcgtgatctcggtgaccgagcggcaggcctatatcggccgcgtccgcgcgctggcgaagaaatgcgccgatgccttcgtgaccaccgaagcgggggcggctgcgtga

SEQ ID NO: 1340 - DNA, 984 bp, Dinoroseobacter shibae DFL 12
ttgaccctgccggggctgttgcctattgagaacgcggctctgatcaaaggcatccccatggacaccccccgctcgttccaggaaatcattctacgcctgcaggcctactgggccgaccagggctgcgccgtgctgcaaccctatgacatggaggtgggtgcaggcaccttccacccggccaccaccctgcgcgcgctgggcagccgcccctgggccgccgcctatgtccagccctcgcgccgccccaccgatggccgctacggcgagaaccccaaccggctgcagcactactaccagtaccaggtcatcatcaaacccagcccccccgacctgcaggagctctatctcggctcgctccgtgccatcggcatcgacgccgccctccacgacatccgctttgtcgaggacgactgggaaagccccacgctcggcgcctggggcctgggatgggaggtctggtgcgacggcatggaagtctcgcaattcacctatttccagcaggtcggcggccatgactgccgcccggtctcgggggagctgacctatggtctcgaacggctggcgatgtatgtgctcggcgtcgatcacgtcatggacatgcccttcaacgcccccgacgcagccatcccgctgagctatggcgacgtcttccgccagaccgaggccgagtattcccgctggaacttcgaccaggccgacaccgcgaccctgctcaagcacttcgaggaggcggaggccgaatgcgccgccgccctcgcggccccgcaccaagacccgaaaaccggcaaacgcatcctcatggtccacccggcctatgaccagtgcatcaaggccagccacctgttcaacctgctggatgcgcgcggcgtgatctcggtcaccgaacgccaggcctatatcggccgggtccgcgcgctcgccaaggcctgcgccgatgccttcgtgcaaaccgaggccggcggctggacgcctgcgcccgcatga

SEQ ID NO: 1341 - DNA, 3012 bp, Polaromonas JS666
atgatgcgtgaaacacgttcgacctgcccctactgcggtgtaggctgcggcgtcatcattgaatcgcagggcgatcagatcacgggcgtgcggggcgacccggaccatcccgccaacttcggtcggctgtgcaccaaggggtcgaccctgcacctcactgccaccgcacctgtcacgcggcagacgcgcctgctgtatccgatgcggcgcgagcaccgccacgaggcggcgcaacgcgtgtcgtgggacaacgcgctggacttcgccagcgagagctttgcgcagatcatccgcgaccacggaccggatgccgtgggcttttatatttcgggccagttgctcaccgaggactactacgtcttcaacaagctggccaagggcctgattggcaccaacaacgtcgacaccaactcgcgcctgtgcatgagcagcgcagtggccggctacaagcagacactgggcgccgacgccccgcccgcctgctacgacgacgtgaatcacgcgcagtgcatcttcatcgtgggcagcaacacggcttacgcgcaccccatcctgtttcggcgcattgaagatgccaaggccaaaaacccgcagctcaagatcatcttctgcgacccgcgccgcaccgacacggccgagatcgccgacctgtacctgccccttcaacccggcaccgatgtctcgctgttcaacggcatgctgcacatcatgctctgggaaggctgggtcaaggcagactacattgcggcccacaccagcgggtttgaggcactcaaggccacggtacgcgactacacacccgacctggtcgccgaaacctgcggtatcaaaaaggaagacctgttcacggctgccaaactgtttgccacatcaccggccaccctgagcctgtactgccagggcctgaaccagtccagcagcggcaccgccaagaacgcggcgctcatcaacctgcacctggccacggcgcagatcggcaagccgggtgccggccccttctcgctcaccggccagcccaatgccatgggcggccgcgaggtcggcgggctggccaacctgctgagcgcccaccgcgacctggccaatgcggaccaccgcgcggaagtggccgcgctctggggcgtgcccagcgttcccgaagcgcccggcaagacagcggtcgagatgttccaggccgccgccgacggcgagatcaaggcgctgtggattgcctgcaccaacccggcccagtccatgcccgaccaggccaccgtgcgccgcgcgctggagcgggccgagttcgtcgtggtgcaggaagcctttgccaccaccagcagctgcgattacgccgacctgctgctgcccgccaccacctggggcgagaaaaccggcaccgtcaccaacagcgagcgccgcatcagccgtgtgcggccggccgtgcccgcacccggcgagacccggcacgactggtcgattgccgtggcctttgcgcagcggctggagaaactgcttggagcgcagagccctcaccccaaccctctcccaaagggagagggagtaatacaagagacacaagagacaagcaattcaccttcttcgctccctctccctctgggagagggccggggtgagggcgcgcgaacaggctcgctctttccttattcgctaagcgatgaagccgctggcgttgaaaccatctggaacgaacaccgcgagtccacccgcggccgcgacctcgacatcaccggcatgagctacgccatgctggaagaatcgccccagcaatggcccctgcgcgaaggggaaaccacgggcaaggttcgcctgtacgaagacgggatcttccccaccgccgacggcaaggcccgctttgtgaacaccgtctacaagccagtagccgagccgcgcgaatcccgctatccgttctcgctgaccaccggacgcctgcgcgaccactggcacggcatgagccgcaccggcacgttggggcggctgttcggccatgtggccgagcccgccatccagatgaacgcgcaggacatggcacggcgcctgctcaatgaaggcgacctggttcacgtcacctccaagcgcggctccatcgtggtaccggtgcagtccagcagcgaaattggcatgagccaggcttttgtcgccatgcattggggcgaggagtacctgagcggccggtccagcaccggcgcaccgctggcgggcgtcaacgccctcaccacgtcggcttactgccccacgtccaaacagcccgagctcaagcatgccgcggtcaagatcctcaaggccgagctgccctggtcgctgctggccatggcctggctgcccgaggacgacgcgctgggtgcgcgggaacagctcaagccgctgatggcggcgtttcccttctccagttgcgtgcccttttccaacaacaccccgctggcgcagagcagccgtgaacgcaccggcctgctgtttcgcgccgcggccgatgaagcaccgtccgccgaaacgctggccagcatagaacgcatcctgggcctggccggcagcgatgcgctgcgctatgccgacaaaaagaaaggccagcaccgcaccgtgcggctggttcgcaagggcgatcaggccgagctggccgggtttgtgctcgccggggacaccagcgcccaggcctggatcaaaaccctgctgcaggacgagttgcccgcgcaaacctacggccgcctgctgctgctgccaggcgccaaaccgcctgtcacggtgcagtcgcgcggcaagctggtctgtacctgcctgaacgtgaccgacacggccatcgccgatcacctgaccgcagtcagccacggtgggggcggcgccggctacctgggcaccgacgaggagcgcttggcctcgctgcaaggcgcgctgaaatgcggcaccaactgcggctcctgtgtacccgagctcaaacggctggtgcgctctgccagaagtacgcagcctccagggtcagggctcgaagggcgtacggtgatcccgatccggcagctcgcttaa

SEQ ID NO: 1342 - DNA, 2961 bp, Acidovorax avenae citrulli AAC00-1
atgcacaacaaagaaacccactccacctgcccctactgcggcaccggctgcggcgtcatcatcgaatccaccggcaaccggatcaccggcgtgcgcggcgaccccacccatcccgccaatttcggccgcctctgcaccaagggctccacgctgcacctcaccgccacgcagcccgtcgccctgcagacccgcctgctcacgccgctgcaccgcacccagcgcggccaggcgcccggccccatcggctgggatgccgcgctggacatggccgcggagaagttcgcggacatcgtgcaggcgcacggccccgatgcggtcgggttctacgtatcgggccagttgctcaccgaggactactacgtcttcaacaagctggccaaggggctgatcggcaccaacaacatcgacaccaattcccgcctgtgcatgagcagcgccgtcgcgggctacaaggccacgctgggcgcggacgcgccgccggcctgctatgaagacctggcgctggcgcagtgcctgttcatcacgggcagcaacacggcctgggcgcaccccatcctcatgcggcgcatcgaggacgcgcgggccgcgaacccgggcatgaagatcatcgtggccgacccgcgccgcaccgagacggcggcgatggccgacctgcacctgcccatcctgcccggcaccgacgtcatgctctgccacggcatgctgcacctcatgctctgggagggctgggtggacgccggctacatcgcggcgcacaccacgggcttcgaggcgctcaaggccaccgtgcgcgactgcacgcccgcgcgggtggccgaggtctgcggcgtcaccgaggcgcagctcgccacggccgcgcgctggttcgcgctcggcggcgccgatgcgcccgcgagcggcgccgggggccgcgccccgacactgagcctctactgccagggactcaaccagagcagcagcggcacggacaagaacgccgccctcgtcaatctccaccttgcctgcggccagatcggacgccccggcgcgggtcccttctcgctcaccggccagcccaatgccatgggcgggcgggaggtgggtgggctggccaacctgctctccgcccaccgcgacctggcgaaccccgcgcaccgcgccgaggtggccgcgctctggggcgtgcccgaggtgcccgccacgcccggcaggacggcggtggagatgttccaggccgccgccgacggggagatccgcgcgctgtggatcgcctgcaccaatcccgcgcagagcctgccggaccaggccacggtgcgccgcgctctggaacgcgcggagttcgtcgtggtgcaggaggccttttccacgaccgccacctgtgcctatgccgacctgctgctgcccgccaccacctggggcgagaaaacgggcaccgtcaccaacagcgagcgccgcatttcgcgggtgcggccggccgtgccggcgccggggcaggcccggcacgactgggcgatcgcggtggaattcgcgcgccggctgcaggaccggctgcgcccgcaaggcgccagcctgttcccctacgacacaggcggcgccgaggccggtgccgaggcgatctggaacgagcaccgcgagaccacgcgcggccgcgacctggacatcacgggcctgtcgtgggcactgatcgacatgcagggaccgcagcactggccgtttccggaaggggccgcgcagggccgcgcccgcctctacgaggacggggtcttccccacgccggacggccgcgcgcgcttcgccgccgctccctggaaacccgtcgccgagccgcgcagcgcccgctatccgttcagcctcaccaccggccgcctgcgcgaccagtggcacggcatgagccgcaccggcaccctgggccgcctcttcggccacacgcccgaaccctgcgtgcagttgcacccgcaggacatggagcgccgccggctcgccgaaggcgagctggtgcgggtggaaagccggcggggcgcggtcgtcgtgcccgtgcaggccagcaccgacgtggggctctcgcaggccttcatcgccatgcactggggcggtgaaatgctctgcggccacgccggcgcgcaggacggcatcgcagacggcacggacgcaccgccgcccgccctgggcgtgaacgccgtcacctcgccggccttctgcccggcatcgaagcagcccgagctcaagcatgcggccgtgcacatcgagcgggccgccctgccctggcggctctacggcatggcctggctgccggcggatgaagccctggccgtgcgcgcgcagctcgccggcctgctggccggcttccccttcgcggtctgcgtgccgttcggcaacaacgcgcccctgtcggagcctgcgcgcgagcgccacggggtgctcctgcgggccgccggcgccgctcccgcgcccgatgcgctgctggcacgcatcgaggccctgctcggcctgggcggcgccgacaccctccgctacgccgacgcccggcgcggccagcggcgggccatgcggctcgaagccgcgcccacggcggccggcgggcccggcatggagcccggcaccggcaccgccggcagccaggaactgcggctgggcgccctgctgctggccggagacaccagcgcggaggcctggctgcgcggactgttgcaggaagagcggcccgcgcagggctatggtcgccggctgctgtcgccgggcctgcaggccccggacagcgccacgcccgccccgccgcgcagccgccccgtgtgcagctgcatgaacgtgagcgatgtggcgatcgcagcacagctcgggcggtgccacggcggcgatgccgagcggctgggccagctgcaggcggcgctggggtgcggcacgcagtgcggctcctgcctgccggaactccgccggatggtgcggggcagcgtggccgtgccggccgcggagtcctccatataa

SEQ ID NO: 1343 - DNA, 2859 bp, Acidovorax sp. JS42
atgcaagaaacccgttccacctgcccctactgcggcgtaggctgcggcgtgatcatccagtccgacggcgacaccatcaccggcgtgcgcggcgacccccaccaccccgccaacttcggccgcctgtgcaccaagggaagcaccctgcacctcaccgccagccggcccatcacactgcagacccggctgctgcaaccccagctgcgcccgcagcgcggccaggcagcgcaccccatcgactgggacgcggctctcgacaccgcggcgcagcgcttcgccgccaccatcgaccgccacggccccgacgcggtgggcttctacctgagtggccagttgctcaccgaggactactacgtcttcaacaagctggccaagggcctgatcggcaccaacaacatcgacaccaactcgcgcctgtgcatgagcagcgccgtggccggctacaaggccacgctgggcgccgacgcgccgcccgcctgctacgacgacctgggccacgcgcagtgcctgttcatcgccggcagcaacacggcctgggcgcaccccatcgtgtttcgccgcatcgaggacgcgcgcgccgccaacccggccatgaagatcatcgtggccgatccgcgccgcaccgacactgcggccatggccgatctgttcctgcccctgctgccgggcagcgacgtgatgctgttcaacgccatgctgcacgtgatgctgcgcgagggctgggtggaccagggctacatcgcgcgccacaccagcggctttgccgatctgcaggccgtggtgcaggactgcacgcccgagcgcgctgctgccgtctgcggcctgccgccgcaggacattgccaccgcagcgcgctggttcgctggcgtggagagcatggcggagggtgggccacgccggcccacgctgagcctgtactgccagggcctgaaccagagcaccagcggcacggccaagaacgccgcgctgatccacctgcacctggcctgcgggcagatcggccaaccgggcgccggccccttcagcctgacgggccagcccaacgccatgggcggacgcgaggtgggggggctggccaacctgctgcccgcgcaccgcgacatggccaaccccgaccaccgcgccgaagtggcccggctgtggggcctggagtcggtgcccgcgcggcccggcaagaccgcggtggaaatgttccaggccgcggccgacggcgagatcaaggcgctgtggatcgcctgcaccaaccccgcgcagagcctgcccgaccagaccaccgtgcgccgcgccctgcagcgcgccgagtttgtggtggtgcaagaggccttcgccaccaccgccaccgcgcagtacgccgacttgctgctgcccgccaccacttggggcgaaaagaccggcaccgtcaccaacagcgagcgccgcatcagccgcgtgcgcgcggcagtggccgcacccggcggcgcgcggcacgactggcagatcgcgctggcgctggcgcagcggctggagaggcacctgcgccccggccagcccacgctgttcccctacaccggcgacacggcgcaggcctgcgccgaggccatttggaacgagcaccgcgagaccacgcgcgggcgcgacctggacatcaccggcctgacctgggccgcgctggaggccgacgggccgcagcagtggccctacccgagcggcgcccgcacgggccgcgcgcgcctgtatgcggacggcgtctttcccactcccgacgggcgtgcgcgcttcgtccccacggcctggcagcccctggccgagccgcccagcgcgcgctacccgttcagcctgaccacgggacgcctgcgcgaccagtggcacggcatgagccgcaccggcacgctggggcggctgttcggccacgcgtccgagcccgcgctgcagatgcacccgcaggacctgcagcgcctgcagctggccgctggcgacctggcgcatgtgaccagcgcgcgcggctccatcatcgcgcccgtgcaggccgacgacacactggcacccgggcaggccttcatggccatgcactggggcggcgaatacctgggcgggcgctccagcacgggccggccgctggcgggcgtgaacgcgctcaccacgccggccttctgccctggctccaaacagccggagctcaagcacgcggcggtgaaggtgctcaaggccgagttgccctggacgctgctggccatggcctggctgcccgaagatgaagccctggccgcgcgcgaggccctggccgcgctgatgcccgaactgcccttcgcccactgcgtgcccttcagcggcgccgcgccggcggcaggtcccgcgcgcacgggcgttctgctgcgcggtgccgcgcacgaggcgccgccaccggccctgctcgcgcgcatcgagcacctgctgcacctggacgggcctggcacgctgcgctacgccgaccgccgccgcgcccagcaccgcgccgcgcgcctgcagcgccaggccgacggccgcaccactttggacgcactgctgctggccggcaatggcagcgctggcggctggctgcgcacgctgctgcaggaagaactgcccgtgcagacctatggccggttgctgctgctgcccacccaacagccgcccgtggccgtagccgcacgcggcaagcgggtgtgcgtctgcctgaacgtgaccgataccgacatcaccgagcgcctgggccagtgccagggcagcccggccgagcgcttggcgcagttgcagggcgcgctgcgctgcggcacgcaatgcggctcctgcgtgcccgagctcaagcgcatggtgcaggcggcggtcgcgggcataggcaccactgcggtgcaggcagcgtga

SEQ ID NO: 1344 - DNA, 2868 bp, Polaromonas naphthalenivorans CJ2
atgactgaaacgcgatctacctgtccctattgcggcgtcggctgtggcgtgatcatcgaatcgcagggcgacgacatcaccggcgtcaggggcgatccggaccatccggccaacttcgggcggctgtgcaccaagggctcgaccctgcacctgaccgcatcaagcgtggtcacgcggcagacgcggctgctgtacccgatgcggcgcgagcaccgcagcgaagcgccccaacgcgcctcgtgggacagcgcgctggacttcgccagcgagagcttcgcgcaaatcatccgcgagcacggacccgacgccgttggtttttatatctcgggccagttgctgaccgaagactattacgtcttcaacaagctggccaaagggctgatcggcaccaacaacatcgacagcaactcgcgcctgtgcatgagcagcgcggtggccggctacaagcagacgcttggagccgacgcgccgccggcctgctacgacgacgtgaagcatgcgcagtgcctgttcatcgtcggcagcaacaccgcctatgcgcatccgatcctgttccggcgcattgaagacgccaagaccgccaacccggcgctgagcatcatttactgcgacccgcgccgcaccgacaccgccgaaatcgccgacctctacctgccgctgcagcccggcaccgatgtgatgctgttcaacggcatgctgcacatcatgctgtgggaaggctggacggacccggcctggatcgcggcgcacacccatgacttcgacgcgctgaaggccacggtgcgcgactgcacgcccgacttggtggcccagacttgcggcatcaggaaggaagacctgtttgccgccgcccggctgttcgccacctcggccgccacgctcagcctgtactgccagggcctgaaccagtcgagcagcggcacggccaagaatgccgcgctgatcaacctgcacctggcgaccgcgcaaatcggcaagcccggcgccggaccgttttccctgaccggccagccgaacgccatgggcgggcgcgaagtcggcggcatggccaacctgatgagcgggcaccgcgacctgtccaatcccgatcaccgcgccgaagtcgccgcgctctggggcgtgcccagcgtgcccgaaaagccgggcaagacggctgtcgagatgttccaggccgccgccgatggcgaaatcaaggcgctctggattgcctgcaccaacccggcgcagtcgatgcccgaccaggccctggtgcgccgcgcgctggagcgcgccgagctggtcatcgttcaggaagcctttgccaccacggcgacatgcgcctgggccgatctgctgctgcccgccaccacctggggcgaaaagaccggcaccgtgaccaacagcgaacgctgcatcagccgggtccggcccgccgtggcggcgcccggcgagacgcgccacgactggtcgattgcggcagcgtttgcccaaaggctcgaacggctgctgcccggacgcagtcccggcgccctgttcccctattcactgacagacccggcgcttggcgtcgaaaccatctggaacgagcaccgcgaatcaacgcgcggccgcgacctggacatcaccggcatgagctacgccatgctggagcaggcgccccggcaatggccgctgaaagaaggcgaaaccaccggcaaggcgcgcctctatgaagacggcattttccccacgcccgatggcaaggcgcgcttcgtcaacaccgtgtacaagccggtcgccgagccgcgcgagtcgcgctatccgttctcgctgaccaccggccgcctgcgcgaccagtggcacggcatgagccgcaccggcacgctgggccgcctgttcggccatgtggccgaaccgtccatccagatgaacgtgcaggacatggcgcgacgcctgctgaaggaaggcgagctggtgcatgtcacctccaagcgcggctccatcatcgtgccggtgcaggcttcgcccgaagtcgcggtcagccaggccttcatggcgatgcactggggcagcgaatacctgagcggccagtccagcatcggccagcccctggcaggtgtcaacgccctgaccacttcggcctactgccccagttccaagcaacccgaactcaagcatgcagccgtcaagatcttgaaggccgaactgccctggtcgctgctggccatggcctggttcgacgaaggcgatgctctggccgcccatgaacagctcaaggccctgctgacggcatttccctttgccagctgcgtgccgttttccaacaacaagcctttgacggatcgccagggtgagcgcaccggcttgctgtttcgcgcagcggcccatgaagcgcccggcgaagaaatcctggccctgctggagcggattttcggcctcaacggctcctacatcctgcgctatgccgaccgcaagaaaggccagcgccgcacgatacggctagcgcgcacccatgacaatgccgagctgaccggctttgtgctggccggagacaccagcgcccaggcctggatcaccactctgctcaaggacgagctgcccgcgcaggcctacggccggctgctgctgctgccgggcgccaagccaccggtggcggtccagtcgcgcggcaaggtggtgtgcagctgcctgaacgtcaccgacacggccatcgacgagcatctggcacttctggggcaggcggacaccgatgaagcccggctggcatccttgcagggcgccctgaaatgcggcaccagttgcggctcgtgcgttcccgagctgaagcgccggctgcgttcggccagcggcacggccatcgatacgccagcatcgccgcgcagcgtcatcccgatcaagcaagtggcttaa

SEQ ID NO: 1345 - DNA, 2790 bp, Methylibium petroleiphilum PM1
atgcgcgagacccgatcgacctgtccttactgcggcgtcggctgcggcgtgatcatcgagtcgcagggcgcgcagatcaccggcgtgcgcggcgatccggagcacccggcgaacttcggccgcctgtgcaccaagggcagcacgctgcatctcaccgcctcggccgccatcacgcagcagacgcgcctgctgcagccgctgcggcgcgccgcgcgcggccaggctgctcagccggtgggctgggacgccgcgctcgacgaggccgccgagcgcttcgcggcggtgatcgcgcagcacgggccggacgcagtgggcttctacctgtcgggccagttgctgaccgaggattactacgtcttcaacaagatcgccaagggcctgatcggcaccaacaacgtcgacaccaactcacgcctgtgcatgagcagcgcggtggccggctacaaggccacgctcggcgccgacgcgccgccggcctgctacgacgacctgaagcacgccagcacgatcttcatcgccggcagcaacaccgcctgggcccaccccatcctgttccgccggctcgaggacgcgcgcgccgccaacccggcgatgaagctgatcgtcgccgacccgcgccgcaccgagaccgccgaggtcgccgacctgcacctgccgctgctgcccggcaccgacgtggcactgttccacggcttgctgcatctgctgatgtgggagggcctgaccgacaccgcctacatcgccacccacaccaccggcttcgaggcgctgcgcgaccgggtgcgcgagttcacgcccaagcacgtggcccaggtctgcgggctcgacgagtccgccatcgtgcaggcggcgcgctggttcggccagaacacgccgacgctgagcctgtactgccagggcctgaaccagagctcgagcggcaccgacaagaacgccgcgctgatcaacctgcacctcgccaccgggcagatcggcaaacccggcgccggcccgttctcgctgaccggccagcccaatgcgatgggcgggcgcgaggtcggcggcctggccaacctgctgagcgcacaccgcgacctcgccaacccgcagcaccgcgccgaggtcgccgcgctgtggggcgtgccggacgtgcccgccgcaccaggcaagagtgcggtggagatgttccaggccgccgccgacggcgagatcaaggcgctgtggatcagctgcaccaaccccgcgcagtcgatgcccgaccagacgacggtgcgccgcgccctcgaacgctgcgagttcgtcgtgttgcaggaagccttcgccaccaccgccaccgcggcctatgccgacctgctgctgccggccacgacctggggcgagaaggacggcaccgtcaccaacagcgaacgccgcatcagccgcgtgcgcccggccgttgcggcgcccggcgaggcccgccacgattgggccgccgcggtcgacttcgcacgccggctcgaagcgaagctgccgcgccgcgccgcgaacggcggctcgctgttcccgtatgccggccccgagtcggtgtggaacgaacaccgcgagagcacgcgcggacgcgacctcgacatcaccggcctcagctacgcccgcctcgaccagggccctcagctgtggccctgcccgcaaggtcaggccgaaggccgcgcccggctctacgaggacggcgtgttcgccacccccgacggccgagcccgcttcgcggcgatggcctatcggccggtggcggagccgcgcgacgcgcgctacccggtctcgctgaccaccggccggctgcgcgatcactggcacggcatgagccgcaccggcacgctgggccggctgttcggccacgtcgcggagcccggcgtcgagatccatccgcgggagctggtgcgtcgcggctgggaggaaggcgcgctggtgcacgtgacctcgcgccgcggctcggtgatgctgccggtgcgggccagcgattcggtcgcgccggcgcaggccttcgtggcgatgcactggggcgaggaattcgtctccggcctgtcgccgtcgggcgtgcggctggccggcatcaacacgctgatgcccagcgcctactgtccgcagtcgaagcagcccgagctcaagcacgcggcggtgaagctgctgaaggccgagatgccctggcaactgctcgccgctgcctggctgcccgaggaccaggccctgctggcgcagcagcggctgcgcgacctgatgccctcgttctcctacgcgcactgcgtgcccttcgggcgcgagccgcatgcgcgcggcgtggtcggcgtgctgttccgggccgccgccgaggagccggcggccgacgaactgatggcgcagatcgagagcctgctcggcgtggcgggcccgcaggcgctgcgctatgccgaccccaagcgcggccagcgtcgtgcgatgcggctggtggccggcgacggcggcaacgcgaggctcgacgccttcgtgctcggcggcgacatccgcgcagaggcctggatcaaggcgctgctgaccgacgaactgccggcgcaggcctacggtcgcgcgctgctgcggccgggcgccgagccgccgggggcggtggtggcgcgcggcaggcaggtgtgctcgtgcttcaacgtcaccgagcccgagatcctggacgccctcacgcgctgcagcggaaccccggaggctcggctcgatcaactgcaaggcctgctgaagtgcggcacgaactgcggctcctgcattccggccctgcgcaccctcgttcgcggttcggtgcaggccgcctga

SEQ ID NO: 1346 - DNA, 2856 bp, Burkholderia mallei NCTC 10247
atgacggtcgacacgctcgcgcagcccatcgcgccctccacgcccggcgccgtgcgcgaaacgcgctcgacgtgctgctattgcggcgtcggctgcggcgtcgtgatcgaaacccggcgcgacgcgaacggccgcgacacgatcgtcggcgtgcgcggcgaccccgaccatccggcgaacttcggacgcctgtgctcaaaaggcagcacgctgcatctgacggccacgcccgaacgctacgcgcagacgcgcgcgacgcatccggagctgcgcgcatcgcgcgacgcgacgcgcacgcgcgtgtcgtgggacgacgcgctcgagcacgtcgcgcagcgcctcgcgcgcaccgtcgagcggcacggccccgactcggtcggcttctacatctccggccaactgctgaccgaggactactacgtcttcaacaagctcgcgaaggggctcgtcggcacgaacaatatcgattcgaactcgcggctctgcatgagctcggccgtcgtcggctacaagaagacgctcggcgccgacgcgccgccgtgcagctacgaggatctcgatcacgcgctcaccgtgctgatcgcgggcgcgaatcccgcgtacgcgcacccgatcctgtaccggcgcctcgaggcggcgcgcgcgcgcaatccgcagatgaaggtgatcgtcgccgatccgcgccgcaccgattcggcgagcgacgcgacgctgcatctcgcgctgcagcccggcaccgacacgatgctgttcaacgcgatgctgcacgtgctgatctgggacggcgcgctcgattccgcgttcatcgccgcgcacacgcacggcttcgacgcgctgcgcgacgcggtgcgcgacgcgacgccggccgcggccgcgcaggtatgcgggctgcgcgcggacgacatcgtgcaggccgcgcgctggttcggcgcggggccgtcgctgtcgctgtactgccaggggctcaatcaatcgtcgagcggcacggcgaagaacgtcgcgctgatcaacctgcatctcgcgaccggccagatcggcaagcccggcgcggggccgttctcgctgacgggccagccgaacgcgatgggcggccgcgaagtgggcggcatggcgacgctcgcgtccgcgcatcgcgatctcgccaacccggccgagcgcgcggaaatcgcgcgcctctggggcgtgcccgatctgccggcgaaaccgggcctgaccgcggtcgaaatgttcgagcggctcgccgagggcgcgctgaaggcaatctggatcgtctgcacgaaccccgcgcattcgatcccgagccaggcgctcgcgcgcgcggggctcgagcgcgcggaatttgtcgtgctccaggatgcatacgcgcacacgggcaccgcgccgtacgcggacgtgctgctgcccgcggcgacgtggggcgagaaggaaggcacggtgacgaactccgagcggcgcatctcgcgcgtgcgcgcggtgacgcagccgtacggcgacgcgcgcgccgactggcgcatcgcggcggatgtcggccaccggctcgaggcgcggctcgcgcccggccgcccgacgctctttccgtacgaagacgccgaagcgatatggaacgagcaccgcgcgacgacgctcggccgcgactgcgacatcggcgggctgtcgtggccgctcctcgcacgcgacggcccgcagcaatggccgtttccggcgggcgccacgcagggtctcgcgcgcctgtacaccgacgggcgctttccgagcgccgacggccgcgcgcgcttcgtgccgacgccgtatcagccggtcgccgaggccgtcgacgcgcgctaccgcttcgcgctcacgacgggccgcctgcgcgaccagtggcacggcggcagccgcacaggctcggtcgcgaagctgttcgcgcacgcgccgcagccgtgcgtcgagctcaatcccggcgattgcgcgcggctcgggctcggcgcgcacgatttcgtccatctgacctcgcggcgcggcagtgcgctcatgcccgcgcgcgccgacgacgcggtcgcgcccggccaggcgttcgcgccgatgcactggggcgacgaatacgtctcgggtgtcgcgggcaaccgcgcggcgatgggcatcaacgcgctgacgacgccggcgcgcgacccgcactcgcagcagcccgagctcaagcacgcggcgatcaagctgctgaaggccgatctgccgtggcgctggctgatcgccgcgcgcgtgccgccgggcgagttgctcgcgcgccagcgggccgcgcgcgcattcttcgcgcgctttccgtacgcgagctgcgtgccgttcggcaccgatgcgtacgcggggctcgcgtggcgcgccgccgcgtacgagcccgcgccggccgagctgcagcgcgagatcgaggcgctcttcgaactgcccgcgcaggcggccgacgtgatgagctacggcgacgcgcggcgcggcaccggccggcgcgtgcggatcgtcgacggcgcgctcgtcgcgttctccgtcgccggcgcggcgggcgcgaccgaggacagcgcagccgtgctgcgcgactatgtcgacaccggcgcgagcgtcggcgcgctcggccgcctgctgctgttcgccggccgcgtgccgctgcagacggcgcccgcgcgcggccgcacgatctgcaactgcgtcggcgtgagcgagcgcgagatcggtgcggtgctggcggccgacgcgccgtccgcggcgcccatcgagcggctcgcgaacttgcaagaacggctcaaatgcggtactcagtgtggttcctgcatacccgagctgcgccgcctgatcgccgaaaccgcgacggccgcggcccctccccctcgatga

SEQ ID NO: 1347 - DNA, 2856 bp, Burkholderia pseudomallei 668
atgacggtcgacacgctcgcgcagcccatcgcgccctccacgcccggcgccgtgcgcgaaacgcgctcgacgtgctgctattgcggcgtcggctgcggcgtcgtgatcgaaacccggcgcgacgcgaacggccgcgacacgatcgtcggcgtgcgcggcgaccccgaccatccggcgaacttcggacgcctgtgctcgaaaggcagcacgctgcatctgacggccacgcccgaacgctacgcgcagacgcgcgcgacgcatccggagctgcgcgcatcgcgcgacgcggcgcgcacgcgcgtgtcgtgggacgacgcgctcgagcacgtcgcgcagcgcctcgcgcgcaccgtcgagcgacacggccccgactcggtcggcttctacatctccggccaactgctgaccgaggactactacgtcttcaacaagctcgcaaaggggctcgtcggcacgaacaatatcgattcgaactcgcggctctgcatgagctcggccgtcgtcggctacaagaagacgctcggcgccgacgcgccgccgtgcagctacgaggatctcgatcacgcgctcaccgtgctgatcgcgggcgcgaatcccgcgtacgcgcacccgatcctgtaccggcggctcgaggcggcgcgcgcgcgcaatccgcagatgaaggtgatcgtcgccgatccgcgccgcaccgattcggcgagcgacgcgacgctgcatctcgcgctgcagcccggcaccgacacgatgctgttcaacgcgatgctgcacgtgctgatctgggacggcgcgctcgattccgcgttcatcgccgcgcacacgcacggcttcgacgcgctgcgcgacgcggtgcgcgacgcgacgccggccgcggccgcgcaggtatgcgggctgcgcgcggacgacatcgtgcaggccgcgcgctggttcggcgcggggccgtcgctgtcgctgtactgccaggggctcaatcaatcgtcgagcggcacggcgaagaacgtcgcgctgatcaacctgcatctcgcgaccggccagatcggcaagcccggcgcggggccgttctcgctgacgggccagccgaacgcgatgggcggccgcgaagtgggcggcatggcgacgctcgcatccgcgcatcgcgatctcgccaacccggccgagcgcgcggaaatcgcgcgcctctggggcgtgcccgatctgccggcgaaaccgggcctgaccgcggtcgaaatgttcgagcggctcgccgagggcacgctgaaggcaatctggatcgtctgcacgaaccccgcgcattcgatcccgagccaggcgctcgcgcgagcggggctcgagcgcgcggaatttgtcgtgctccaggatgcatacgcgcacacgggcaccgcgccgtacgcggacgtgctgctgcccgcggcgacgtggggcgagaaggaaggcacggtgacgaactccgagcggcgcatctcgcgcgtgcgcgcggcgacgcagccgtacggcgacgcgcgcgccgactggcgcatcgcggcggatgtcggccgccggctcgaggcgcggctcgcgcccggccgcccgacgctctttccgtacgaagacgccgaagcgatatggaacgagcaccgcgcgacgacgctcggccgcgactgcgacatcggcgggctgtcgtggccgctcctcgcacgcgacggcccgcagcaatggccgtttccggcgggcgccaggcagggtctcgcgcgcctgtacaccgacgggcgctttccgagcgccgacgggcgcgcgcgcttcgtgccgacgccgtatcagccggtcgccgaggccgtcgacgcgcgctaccgcttcgcgctcacgacgggccgcctgcgcgaccagtggcacggcggcagccgcacaggctcggtcgcgaagctgttcgcgcacgcgccgcagccgtgcgtcgagctcaatcccggcgattgcgcgcggctcgggctcggcgcgcacgatttcgtccatctgacctcgcggcgcggcagcgcgctcatgcccgcgcgcgccgacgacgcggtcgcgcccggccaggcgttcgcgccgatgcactggggcgacgaatacgtctcgggtgtcgcgggcaaccgcgcggcgatgggcatcaacgcgctgacgacgccggcgcgcgacccgcactcgcagcagcccgagctcaagcacgcggcgatcaagctgctgaaggccgatctgccgtggcgctggctgatcgccgcgcgcgtgccgccgggcgaactgctcgcgcgccagcgggccgcgcgcgcattcttcgcgcgctttccgtacgcgagctgcgtgccgttcggcaccgatgcgtacgcggggctcgcgtggcgcgccgccgcgtacgagcccgcgccggccgagctgcagcgcgagatcgaggcgctcttcgaactgcccgcgcaggcggccgacgtgatgagctacggcgacgcgcggcgcggcaccggccggcgcgtgcggatcgtcgacggcgcgctcgtcgcgttctccgtcgccggcgcggcgggcgcgaccgaggacagcgcagccgtgctgcgcgactatgtcgacaccggcgcgagcgtcggcgcgctcggccgcctgctgctgttcgccggccgcgtgccgctgcagacggcgcccgcgcgcggccgcacgatctgcaactgcgtcggcgtgagcgagcgcgagatcggcgcggtgctggcggccgacgcgccgtccgcggcgcccgtcgagcggctcgcgaacttgcaagaacggctcaaatgcggtactcagtgtggttcctgcatacccgagctgcgccgcctgatcgccgaaaccgcgacggccgcggcccctccccctcgatga

SEQ ID NO: 1348 - DNA, 2856 bp, Burkholderia pseudomallei 1106a
atgacggtcgacacgctcgcgcagcccatcgcgccctccacgcccggcgccgtgcgcgaaacgcgctcgacgtgctgctattgcggcgtcggctgcggcgtcgtgatcgaaacccggcgcgacgcgaacggccgcgacacgatcgtcggcgtgcgcggcgaccccgaccatccggcgaacttcggacgcctgtgctcgaaaggcagcacgctgcatctgacggccacgcccgaacgctacgcgcagacgcgcgcgacgcatccggagctgcgcgcatcgcgcgacgcggcgcgcacgcgcgtgtcgtgggacgacgcgctcgagcacgtcgcgcagcgcctcgcgcgcaccgtcgagcggcacggccccgactcggtcggcttctacatctccggccaactgctgaccgaggactactacgtcttcaacaagctcgcgaaggggctcgtcggcacgaacaatatcgattcgaactcgcggctctgcatgagctcggccgtcgtcggctacaagaagacgctcggcgccgacgcgccgccgtgcagctacgaggatctcgatcacgcgctcaccgtgctgatcgcgggcgcgaatcccgcgtacgcgcacccgatcctgtaccggcggctcgaggcggcgcgcgcgcgcaatccgcagatgaaggtgatcgtcgccgatccgcgccgcaccgattcggcgagcgacgcgacgctgcatctcgcgctgcagcccggcaccgacacgatgctgttcaacgcgatgctgcacgtgctgatctgggacggcgcgctcgattccgcgttcatcgccgcgcacacgcacggcttcgacgcgctgcgcgacgcggtgcgcgacgcgacgccggccgcggccgcgcaggtatgcgggctgcgcgcggacgacatcgtgcaggccgcgcgctggttcggcgcagggccgtcgctgtcgctgtactgccaggggctcaatcaatcgtcgagcggcacggcgaagaacgtcgcgctgatcaacctgcatctcgcgaccggccagatcggcaaacccggcgcggggccgttctcgctgacgggccagccgaacgcgatgggcggccgcgaagtgggcggcatggcgacgctcgcgtccgcgcatcgcgatctcgccaacccggccgagcgcgcggaaatcgcgcgcctctggggcgtgcccgatctgccggcgaaaccgggcctgaccgcggtcgaaatgttcgagcggctcgccgagggcgcgctgaaggcaatctggatcgtctgcacgaaccccgcgcattcgatcccgagccaggcgctcgcgcgcgcggggctcgagcgcgcggaatttgtcgtgctccaggatgcatacgcgcacacgggcaccgcgccgtacgcggacgtgctgctgcccgcggcgacgtggggcgagaaggaaggcacggtgacgaactccgagcggcgcatctcgcgcgtgcgcgcggcgacgcagccgtacggcgacgcgcgcgccgactggcgcatcgcggcggatgtcggccgccggctcgaggcgcggctcgcgcccggccgcccgacgctctttccgtatgaagacgccgaagcgatatggaacgagcaccgcgcgacgacgctcggccgcgactgcgacatcggcgggctgtcgtggccgctcctcgcacgcgacggcccgcagcaatggccgtttccggcgggcgccacgcagggtctcgcgcgcctgtacaccgacgggcgctttccgagcgccgacgggcgcgcgcgcttcgtgccgacgccgtatcagccggtcgccgaggccgtcgacgcgcgctaccgcttcgcgctcacgacgggccgcctgcgcgaccagtggcacggcggcagccgcacaggctcggtcgcgaagctgttcgcgcacgcgccgcagccgtgcgtcgagctcaatcccggcgattgcgcgcggctcgggctcggcgcgcacgatttcgtccatctgacctcgcggcgcggcagcgcgctcatgcccgcgcgcgccgacgacgcggtcgcgcccggccaggcgttcgcgccgatgcattggggcgacgaatacgtctcgggtgtcgcgggcaaccgcgcggcgatgggcatcaacgcgctgacgacgccggcgcgcgacccgcactcgcagcagcccgagctcaagcacgcggcgatcaagctgctgaaggccgatctgccgtggcgctggctgatcgccgcgcgcgtgccgccgggcgagttgctcgcgcgccagcgggccgcgcgcgcattcttcgcgcgctttccgtacgcgagctgcgtgccgttcggcaccgatgcgtacgcggggctcgcgtggcgcgccgccgcgtacgagcccgcgccggccgagctgcagcgcgagatcgaggcgctcttcgaactgcccgcacaggcggccgacgtgatgagctacggcgacgcgcggcgcggcaccggccggcgcgtgcggatcgtcgacggcgcgctcgtcgcgttctccgtcgccggcgcggcgggcgcgaccgaggacagcgcagccgtgctgcgcgactatgtcgacaccggcgcgagcgtcggcgcgctcggccgcctgctgctgttcgccggccgcgtgccgctgcagacggcgcccgcgcgcggccgcacgatctgcaactgcgtcggcgtgagcgagcgcgagatcggcgcggtgctggcggccgacgcgccgtccgcggcgcccgtcgagcggctcgcgaacttgcaagaacggctcaaatgcggtactcagtgtggttcctgcatacccgagctgcgccgcctgatcgccgaaaccgcgacggccgcggcccctccccctcgatga

SEQ ID NO: 1349 - DNA, 2841 bp, Polynucleobacter necessarius asymbioticus QLW P1DMWA 1
atggctgaagttaagagcacctgttgctattgcggtgttggctgtggcgtcattattgaaaccgcagaaagtaacggaaagatcgaggtaaccggggttcgcggcgaccccgatcatcctgcaaactttggcagactctgcagtaaaggctccacccttcatctcactgcaaacccaagccttcagatgcaggctcggctgggttcaccagcaatccgcaaggcaagaggcgaagatccggtagatatttcttggcccgaggcaattcaaactgttgcccaaaaatttgccgacatcattcaagagcatggttcagaatctgttggcatttatgtgtctggtcaattactgaccgaagactattacatctttaataagttaatgaagggcctaattggctctaacaatattgataccaactcacgcctatgtatgtctagtgcggtagctggctacaagcaaactttgggaatggatgccccaccctgttgctatgaagatattgattctgcatccactatttttattacgggatcaaataccgcttttgctcatccgattttatatagacgtcttgaggatgcccgtaaaaataatccggatctcaaagttattgttgttgatcccagaaaaaccgataccgccaaagaggctgatctctacctacagatacaacctggtactgatgttgccctctatcacgggatgctttacatcatgctctgggagaaatggattaatgagtcttatatcaactcatatacggcagattttgatgcgctgcgtgatttggttagagatttcacgcctaaggcagtaagtcagatctgtggcattaacgaaaaagacttgttccaagcagcgcaatggtttgcaacttctcccgcaactctatcgatgtactgccagggattaaatcaatcagcatcaggtacagccaagaatgctgctttagtaaatctacacttggccaccggtcaaatagggaaagctggtgctggtccattctctttgactggacaacccaatgccatgggtggccgggaagttggaggtttagccaatctactatccgcacaccgtgatcttgctaacccagaacatcgtgcagaagttgcaaacctgtggggggtggattcagttcccgaaaagccaggtcttagtgccattcccatgtttgaggcattgcgtactgaaaaactcaaagcaatatggattgtctgtacaaaccctgcacaatcaatgcctgatctcaatgcagttcacgagggattaagcaaggcagaatttgttgtggtgcaggaagcttatgcgcacacggccactaccttatatgcagacgtattattgcccgccactacctgggcagaaaaagtgggaacagttactaattcagagcgaagaatttccaaagtaaatcccgcaattgatccctatgcgtctgctaaacatgattggcagatcgctcttgaaattggattagctcttgaagcgctattaccaggcaatagaaaagaaggaacatccactctatttccttacgccggacctgaggatatttggaatgagcatcgtgagagtacagccggtcgcgatctcgatattactggtttaagctacaaaatccttgaggagcgtgggcctcaacagtggccaatgccagtaggttcagattcgggaaagaaacgtctctatgaagatggaatattcccaactaaagataagaaagcacactttatcgctgcgccttataaggcaactgcagaatcagtggatgcacgatatccatttgccttaaatactgggcgcctcagagatcaatggcacggtatgagtagaactggaaccattggaacgctttatgggcactcacctgagccttgtgtagaactatcacctaaagatgccggcaggatgaatctagaaaatggtgatttagttcatgtcactagtcgcagaggtagtgagatcttcccaatcaaagtctcagacgatatcgcctcctcgcaagcctttattgccatgcactggggttctgaatttatttcaggcgctgctggtaaaacaccgggccgcggagtcaacggccttacttgcaacatgatcgaccccgtatccggtcagcccgaactgaaacattcagccgtcaagattttgcccgctaatcttccctggcatttagtagctttcggcttatttcctaaagaagaagtattttctgttcaaaacagtttgcgcagcatcctgcctcatttcgattctgcccaatgtgttctatttggtagagagcaggatggtggcctcattggagtttcattcaaggccgctcaccacgatgacccgctagaagaatcagaatctcttgccgcgcaagctttaaagcaagtgatgcagaaattcaagctagatgaagcatctggagaacctgtaatgcgctatattgataagcgcaggggcgtagttcgacttgttcgcgctcaagagaaggttctatctgccatgcttaccggccctattggcagcctagcaagtactgcctggttaagagagtacctagaaagcggtttagatgcaaaagcgcttggtcggtctttgttgatgcctgtcagcaaaccccctgtagaaattaaacccaaaggtaaggccatttgtaattgctttaatgtatctgcagacacaatgaagcaatgcttaagcaagatgcctgcaggaacctcccccgatgatgctatgagctcacttcaatcagaaacgcaatgtggaactaattgtggatcctgcaagcccgaagtcaagcaaattattgtcagctttctcaagaaagtggaagtagcggcataa

SEQ ID NO: 1350 - DNA, 2622 bp, Dinoroseobacter shibae DFL 12
atgacggaccagagcgtctgcaccacctgcccctattgcggcgtcggctgcggggtgcttgcaagtccagacgggaccattgccggcgatctggcacacccggccaatctggggcggctctgctcaaagggctcggccctcggcgagaccctagatctcgagggtcgtcttctcgcgccgcagatcggcaaccggcgcgcgggctgggatgaggcgctcgatctggtggccaatcggttccgggccgcggcggagacccatggcccagacagcgtggctttctacgtctccggccagctgcttacggaggattattacgtcgccaacaagctgatcaaggggttcatcggaacggctaatatcgacacgaactcgcggctctgcatggcctcttccgtggccggtcacaagcgcgccttcgggaccgacaccgtgccgggacaatacactgatttcgagaccgcggagcttgtggtactagtgggctcaaacctcgcctggtgtcacccggtgctcttccaacggttgcaggccgcgaaggccgtgcgcccggagctgaaggtcgtggtgatcgatccccgccgcaccgccacatcacagcttgccgatctgcacctgggcctgcgcccggatggggacgcggtcctgttcaacctgctgctgaccgagcttgtgcgacgtgatctcgtggaccgtcgctacgtggccgaggcagtgtccgggttcgatgccgccgtggccgaggccgaacgcgcggaagctgcacagaccggcctcgattctttcgagttagcgcagttcctcgacctgtggtgccgtaccgagaaggtcgtcaccctctactcccaaggcgtcaaccagtccgcctgcggcacggacaaggtcaacgcgatcctcaactgccaccttgcgaccgggcgcatcgggcgccccggcatgggcccgttttccatgaccggacagcccaacgccatgggaggccgcgaagtgggcgggctggccaacatgctgacctgtcatctcgatctcgaaaacgccgcgcaccgggacgccgtgcagcagatgtggtccgctccgaccatggccgacaaaccgggcctgaaggcggtggagcttttcgacgcttgcgcgcggggagagatcaaggcgctctggatcatgtccaccaacccggtcgtttccttgcccgatgccgatgcggtcgccgccgcgatccgagccgtccccttcactgtgatgaccgatatcatggccgacacggatacgggccgctgcgtcgatgttctgctgcccgccaccggctggggcgaaaaatccggcaccgtcaccaattccgaacgctgcatctcacggcaacgcaggttcctgcccacccccggcgaggcccgcgccgactggaacatcctcgccgatgtcggacgccgcatgggctggcccgaggcgttcgactaccgctccgaggccgaggtgttccgcgaattcgcacgcctgtcgaccttgggccacacctttggcaaggatttcgacatctccgggctcgcagacctaaccgatgccgagtatgatgccttgcctcccaccgtttggccggtgccgaccgaggggcctagcgggggtaggttctttgcagatggcgggttctatcatcccgatggcaaggctaagatgctgccgatcgctgccccggcctctgaggccccaaacaccgcacgcccggttcgattgaacaccgggcgggtgcgcgatcagtggcacacaatgacgcgcaccggcaaggcgccgcgcctcggggcgcatatggccgaaccctacctggaaattcatcccggtgatgccgccgcggcgggcctgtcggatgccgacctcgccaaggtttcctccgcccacggtagtgccatcttgcgggtcatgatcaccgatcgcagccaacagggcagcgtcttcgtcccgatgcattggaccgatatcgtctccagcaccgggcggatcaacgcggtcgtggccccgaccacagacccggtctcgggccagccggcctccaagggcactgccgtagcgctcgaacaggtcgcggcgcactggtacggctttgcggtcagcaccgcgaccatgaccccgacccgaccttatgccgccatcgcccgcactcggaccggaacacgcgccgaggttgccgatttcaagctccccgataactgggaagccgaagcccgcaaaatccttagcctgcccggcggcagcgccagcgtgatcgaggattccgcccgcggcacggcccgcgtcgcgattcacgaaaaaggcacgctgacagggttgttcttcgcggcggccaccccggtggcgctgtcgcggagccacgtggtcgcgctgatcggtacggcggccgatccgattcaggctcttgccggggttcccgccgccgaccgtcccgatccgggtgccatggtctgcgcgtgtttcgacgtgggggccaacagccttcgccgcgccatcgacggcggggccaccacgctgcacgcgcttggggtctgcacgcgcgcgggcaccaattgcggctcctgccgtccggaactggaggcgattctgaccgccgcgacagccatgaaattggccgcagaatga

SEQ ID NO: 1351 - DNA, 2865 bp, Delftia acidovorans SPH-1
atgcaagaaacccgatccacctgcccctattgcggcgtaggctgcggcgtcctcatcgaaagcgatggtgcgcgcatcacgggcgtgcgcggcgatccggcgcaccccgccaaccacggccgcctgtgcaccaagggcagcaccctgcacctgacggcctcgcccgccctggcacagcagacgcggcggctgcagcccgcgctgcgtgccacgcgcggcgcggcgccccaggatgtgggctgggatgccgcactggacctggccgccggcaggctggcctccatcgtgcaggagcacggccccgacgccgtgggcctgtatgtgagcggccagttgctgaccgaggactactacgtcttcaacaagctggccaagggcctgatcggcaccaacaacatcgacaccaattcgcgcctgtgcatgagcagcgccgtggccggctacaagctcacgctgggcgccgacgcgccaccggcctgctacgaggatgtggaccatgcggactgccttttcatcgcgggcagcaacgcggcctgggcgcatcccgtgctcacgcggcgcatcgagcaggcgcgtgccgcgcggccgcagatgaagatcatcgtggccgacccgcgccgcaccgacacggccggcatggccgacctcttcctgccgctgcgcccgggcagcgacaccctgctgttccacggcatgctgcacatcatggaactggaaggctggctggaccaggcctacatcgcacgccacaccagcggctttgccgacctgcaggccctggtgcgggaggccacgcccgagcgcgtgggcgagctctgcggcctgccccggcacgatctgttccaggccgcgcaatggtttgcgctgggcggggatgcacgcggcggcgccgcccgtggcgccacgctgagcctgtactgccagggcctgaaccagagcagcaacggcacggccaagaacgccgcgctgatcggcctgcacctggccacgggccagatcgggcgcgcgggcgcggggccgttctcgctcacgggccagcccaatgccatgggcgggcgcgaggtgggcgggctggccaatctgctgtcggcccaccgcgacctggccaaccccgtccaccgcgccgaagtggccgcactgtggggcgtggacgccgtgccgcaccgccccggcaagaccgccgtggagatgttcgaggccgccgccgagggcgagatccgcgcgctttggatagcctgcaccaaccctgcgcaaagcatgcccgaccaggccctggtgcggcgcgcgctgcagcgggccgaattcgtcatcgtgcaggaggcctttgccaccaccgccacctgcgcctacgccgacctgctgctgcccgccaccacctggggcgagaagctcggcacggtgaccaacagcgaaaggcgcatctcgcgcgtgcgccccgccgtggccgcacccggcgccgcgcgccatgactggcgcattgccgtggactgcgcgcggcgcatggaggcacggctgcgcccgggccggcccagcctctttccctacgacaccgaagacgccgctgccggcgcccaggccatctggaacgagcaccgcgagagcacgcgcgggcgtgacctggacatcaccggcctgtcctgggatctgctggacgcgcaaggcccccagcaatggccgctgcccgaaggcgcagcccagggccgcgcacggctctacgaagacggccgctttcccacgcccgatggccgcgcacgctttgccctgctgccctggcagccgctggccgagccgcccgatgcgcactatcccttcagcctgaccacaggccggctgcgcgaccagtggcacggcatgagccgcacgggccagctgggccgcttgttcggccatgcggccgagccctgcctgcaaatgcacccgcgggacatggccgagcgcggcctgcgcgcgggcgacctggtgcagatgagcagccggcgcggcgccctgctggtgccggtgcagcccgatgacacgctgacgccctcccagctcttcatggccatgcactggggaggcgagtacctgggcggcacctcaatgggcggcacttcaatgggcggcgtcaatgccctgaccacaccggccttgtgccccggctccaagcagcccgaactcaagcacacggccgtgaagctgcaaaaggccgaactgccctggaccctgctggccatggcctggctgcccgaggaccgggtgctggccgtgcgcgagcagttgtccgccctcatgccgcacttcggctttgccagctgcgtgcccttcggcaatgccgtcccgctgcaggacgccgcccgggcccggcacggcgtgctgctgcgcgccgccgcgcatgaggcgccgggcgaggccgtcctcgcacggatcgaatccctgctgggcctggatgccgccgacaccctgcgctacaccgaccgccgccgccagcacagccgcgcgctgcggctggaccgccacagcctgtccaccacggtcgaggccctgctgctggcgggcgacacgcgcgcgggcagctggctgtccaccctgctgcaggaccagatgccggcacaggactatggccgcctgctgctcatgccctcgggttcggcgccgctggccatccagccgcgtgcgcgccaggtctgtacctgcttcgatgtggacgagaccgccatcgcaggcgcgcttgcgcgctgcgagggcagcgacgacgcgcgcctggccgcgctgcagggccggttgcgctgcggcaccaattgcggctcctgcctgcccgagctcaagcgtctggtgcgccacatccccctggcgaagagccaggagaccgctgaaagaggcgattga

SEQ ID NO: 1352 - DNA, 2859 bp, Diaphorobacter TPSY uid29975
atgcaagaaaaccgttccacctgcccctactgcggcgtaggctgcggcgtgatcatccagtccgacggcgacaccatcaccggcgtgcgcggcgacccccaccaccccgccaacttcggccgcctgtgcaccaagggcagcaccctgcacctcaccgccagccggcccgtcacactgcagacccggctgctgcaaccccagctgcgcccgcagcgcggccaggcagcgcaccccatcgactgggacgcggctctcaacaccgcggcgcagcgcttcgccgccaccatcgaccgccacggccccgacgcggtgggcttctatctgagcggccagttgctcaccgaggactactacgtcttcaacaagctggccaagggcctgatcggcaccaacaacatcgacaccaattcgcgcctgtgcatgagcagcgccgtggccggctacaaggccacgctgggcgccgacgcgccgcccgcctgctacgacgacctggcccacgcgcagtgcctgttcatcgccggcagcaacacggcctgggcgcaccccatcgtgtttcgccgcatcgaggacgcgcgcgccgccaacccggccatgaagatcatcgtggccgatccgcgccgcaccgacaccgcggccatggccgatctgttcctgcccctgctgccgggcagcgacgtgatgctgttcaacgccatgctgcacgtgatgctgcgcgagggctgggtggaccagggctacatcgcgcggcacaccagcggcttcgccgatctgcaggccgtggtgcaggactgcacgcccgagcgcgccgctgccgtctgcggcctgccgccgcaggacattgccaccgcagcgcgctggttcgccggcgtggagggcatagcggagggtgggccacgccggcccacgctgagcctgtactgccagggcctcaaccagagcaccagcggcacggccaagaacgccgcgctgatccacctgcacctggcctgcgggcagatcggccaaccgggcgccggccccttcagcctgacgggccagcccaacgccatgggcggacgcgaggtggggggcctggccaacctgctgcccgcgcaccgcgacatggccaaccccgaccaccgcgccgaagtggcccggctgtggggcgtggagtcggtgcccgcgcggtccggcaagacggcggtggagatgttccaggccgcggccgacggcgagatcaaggcgctgtggatcgcctgcaccaaccccgcgcagagcctgcccgaccagaccaccgtgcgccgcgccctgcagcgcgccgagtttgtggtggtgcaagaggccttcgccaccaccgccaccgcgcagtacgccgacctgctgctgcccgccaccacctggggcgagaagaccggcaccgtcaccaacagcgagcgccgcatcagccgcgtgcgcgcggcagtggccgcacccggcggtgcgcggcacgactggcagatcgcgctggcgctggcgcagcggctggagaggcacctgcgccccggccagcccacgctgttcccctacaccggcgacacggcgcaggcctgcgccgaggccatctggaacgaacaccgcgagaccacgcgcgggcgcgacctggacatcaccggcctgacctgggccgcgctagaggccgacgggccgcagcagtggccctacccgagcggcgcccgcgcgggccgcgcgcgcctgtatgcggacggcgtctttcccactcccgacgggcgtgcgcgcttcgtccccgcggcctggcagcccctgtccgagccgcccagcgcgcgctacccgttcagcctgaccacgggacgcctgcgcgaccagtggcacggcatgagccgcaccggcacgctggggcagctgttcggccacgcgtccgagcccgcactgcagatgcacccgcaggacctgccgcgcctgcagctggccgctggcgacctggcgcatgtgaccagcgcgcgcggctccatcatcgcgcccgtgcaggccgacgacacactggcacccgggcaggttttcatggccatgcactggggcggcgaatacctgggcggacgctccagcatgggccggccgctggcgggcgtgaacgcgctcaccacgccggccttctgccctggctccaaacagccggagctcaagcacgcggcggtgaaggtgctcaaggccgagctgccctggacgctgctggccatggcctggctgcccgaagatgaagccctggccgcgcgcgaggccctggccgcgctgatgcccgaactacccttcgcccactgcgtgcccttcagcggcgccgcgccggcggcaggtcccgcgcgcacgggcgttctgctgcgcggcgccgcgcacgaggcgccgccaccagccctgctcgcgcgcatcgagcacctgctgcacctggacgggcctggcacgctgcgctacgccgaccgccgccgcgcccagcaccgggccgcgcgtctgcagcgccaagccgacggccgcaccactttggacgcactgctgctggccggcaatggcagcgctggcggctggctgcgcaccctgctgcaggaagaactgcccgtgcagacctatggccggttgctgctgctgcccacccaacagccgcccgtggccgtgcccgcacgcggcaagcgggtgtgcgtctgcctgaacgtgaccgataccgacatcaccgagcgcctgggccagtgccagggcagcccggccgagcgcctggcgcagttgcagggcgcgctgcgctgcggcacgcaatgcggctcctgcgtacccgagctcaagcgcatggtgcaggcggcggtcgcgggcataggcaccactgcggtgcaggcagcgtga

SEQ ID NO: 1353 - DNA, 2796 bp, Variovorax paradoxus S110
atggctgagactcgctccacctgcccctattgcggcgtcggctgcggcgtcgtcatcgaatccgatggcgcccagatcaccggcgtgcgcggcgaccccgatcaccccgcgaatttcgggcgcctgtgcaccaagggctcgacgctgcacctcacggcgacagccacggtgacgcggcagacgcggctgctgcagccgatgcggcgcgccgagcgcggcgccacgcccgaagccatcggctgggacggcgcgctcgacatggcgacggacaagttcgcccaggtcattcgcgaccacggccccgacgccgtgggcttctatgtctcgggccagctgctcacggaggactactacgtcttcaacaagctcgccaaaggcctcatcggcaccaacaacatcgacaccaactcgcgcctgtgcatgagcagcgcggtggccggctacaagcagacgctgggcgccgatgcgccgcccgcctgctacgacgacctcaagcatgcgcaatgccttttcatcgtgggcagcaacgccgcgtgggcgcatccgatcctgttccggcgtatcgaggatgcgaaggccgcgaacccggggctcaagatcatcgtggccgatccgcgccgcaccgacacggtcgagatcgccgacctgttcctgccgatccagccaggcaccgacgtcatgctgttcaacggcatgctgcacctgatgctgtgggaaggctggaccgacaacggctacatcgccgcccacaccagcggcttcgatgcattgaagaccacggtgcgcgaatgcacgcccgacaaggtggcgcagatctgcggcatctcgaaagaagacctgctcgccgcggcgcgcctgttcgcgacctcgccggccacgctgagcctctattgccagggcctcaaccagtcgtcgagcggcaccgccaagaacgcggcgctgatcaacctgcacctggccaccggccagatcggcaagcccggcgccggcccgttctcgctcacgggccagcccaatgcgatgggcgggcgcgaagtgggcggcctggccaacctcttgagcgcgcaccgcgacctggccaatcccgcgcaccgggccgaagtggcggcgctgtggaatgtgccctcggtgcccgaaaagcccggcaagaccgcggtcgagatgttccaggccgcggccgacggcgagatccgcgcgctgtggatcgcctgcaccaaccctgcccagtcgatgcccgaccaggccacggtgcgccgcgccctcgagcgcgccgagttcgtggtggtgcaggaagccttttcgaccaccgccacctgcgccttcgccgacctgctgctgcccgcaaccacctggggcgagaaggaaggcaccgtgaccaacagcgagcgccgcatctcgcgcgtgcgccccgcggtggcggcgcccggcgaggcacggcacgactggtcgattgccgtggacttcgcgcgccggctcgaacagcggctcggcgccacgcccacgctgtttccctacgagaccgccgagtcggtctggaacgagcaccgcgaatccacgcgcggccgcgacctcgacatcaccggcatgagctacgcgatgctcgacagcgcgggaccgcagcaatggccgctgaaggaaggcgaggccaccggccgcgcacgcctctacgaagacggcatcttccccacgccggacggccgcgcgcgctttgtcgacaccgtctacaagccggtggccgaggcgcgcgaggcgcgctatccgttctcgctcaacacggggcgcctgcgtgaccagtggcacggcatgagccgcaccggcaccgtcggccgcctgttcggccacgtggccgagccgctcgtgcagatgaatgcgcaggacatggcgcgccgccagctgaaggacggcgacctcgtgcacctgacctccaagcgcggctcgatcctgatgcctgtgcaggccagcgccgagatcggcctgagccaggccttcgtcgccatgcactggggcgaggaatacctgagcggctgctcgtcgaccggcacgccgctcgcgggcatcaatgcgctgaccacctcggcctactgccccacctcgaagcagcccgagctcaagcacacgccggtcaagatcctcaaggccgagctgccctggtcgctcctggccatggcctggctgccgcccgacgcggcgctggccgcgcaccaggcgctcaagccgatgatggcgatgtttccgtttgccacctgcgtgccgttctcgggcaacacgccgggcgaggaacgcagcggcatcctgttccgcgccgccgcgcacgatgcgccggccgacgaaaccatcgaccgcatcgaaggcctgctcggcctgcgcggcagcgatgccctgcgctacgccgaccgccggcgcggccagcgccgcgtggcgcggctggtgcggcgcgccgacggcaacgccggcctcgaagccttcctgctgggcggcgacaccagcgccgaggcctggatcggcaccctgctgcgcgaggagattccggcgcagagctacggccggctgctgctgtcgccgggcgcgcgcgcgccggtggcggtgcagtcgcgcggacatccggtctgcacctgcttcaacgtgaccgacctggcgatccaggccgaactgggccgctgcaccggcacgcccgacgagcgcctggccgcgctgcagggtgcgctcaaatgcggcaccaactgcggctcctgcctgcccgagctcaagcgcatggtgcgcgcaacgcccgccgagaccgtggccgagggtgcataa

SEQ ID NO: 1354 - DNA, 405 bp, Brucella suis 1330
atgatcgtcggaattggaagcgatctcattgatattcgccgggtcgaaaaaacgctggaacggcacggcagccgttttcgggaccgggtttttaccgaaatcgagcagaggaagtcggaggggcgcaagcagcgcgccgcgtcctatgcaaagcgtttcgcggcgaaggaagcctgcgccaaggctcttggcacaggcattgcagagggcgttttctggcgtgatatgggcgtggtgaatacgccttccggcaagccgaccatgcatcttaccggcggtgcggcaaagcagcttcaaaagcttcttccagccggaaccaatgctgcaatacatctgacaattaccgatgattttcctttggcgcaggcattcgtcattatcgaagccttgccagttttagaataa

SEQ ID NO: 1355 - DNA, 402 bp, Mesorhizobium BNC1
atgatcgtcggaatcggcagtgacctcatcgatatccgccgtgtcgagaaagcgcttgagcggcatggcgagcgcttcactcatcgcgttttcacagaggtcgagcgcgtcaaatccgatcggaggcgcatgcgcgccgcttcttatgcgaagcgttttgcagccaaggaggcttgcgccaaggcgctagggacgggactggctcaaggcgtattctggcgcgatatgggcgtggtgaatttgccgggcggcaagcctaccatgcatttgacgggcggggcggccgagcggctgaatgcattgattccggcaggtcaccggccgcttatccatctcaccattacagatgattttcctcttgcccaggcattcgtcattatcgaggcagtgtccgtagaatag

SEQ ID NO: 1356 - DNA, 402 bp, Bartonella bacilliformis KC583
atgatcattggtcttggtaatgatatgatagacataagacgaattgaaaaaatattaattcgtcatagtagtcgttttattcaacgcatttttacagatattgaacaaaataaatctgaaaattttccaaaacgttcttatgcttatgctaagagatttgctgctaaagaggcttgcgctaaagctttaggaacaggaattgcttatggtgttaattggagagatatagggatagttaattcaccatctggaaaaccaactataaagctaacaaatcatgcacaaatacagttagaaaagttattaccgtctaatcatgatgcttttattcatcttagtatgacagatgattttccttgggcacaggcatttgtgattatagaagcacttccacgtggataa

SEQ ID NO: 1357 - DNA, 405 bp, Brucella ovis
atgatcgtcggaattggaagcgatctcattgatattcgccgggtcgaaaaaacgctggaacggcacggcagccgttttcgggaccgggtttttaccgaaatcgagcagaggaagtcggaggggcgcaagcagcgcgccgcgtcctatgcaaagcgtttcgcggcgaaggaagcctgcgccaaggctcttggcacaggcattgcagagggcgttttctggcgtgatatgggcgtggtgaatacgccttccggcaagccgaccatgcatcttaccggcggtgcggcgaagcagcttcaaaagcttcttccagccggaaccaatgctgcaatacatctgacaattaccgatgattttcctttggcgcaggcattcgtcattatcgaagccttgccagttttagaataa

SEQ ID NO: 1358 - DNA, 420 bp, Sinorhizobium medicae WSM419
atgatcatcggcataggcagcgatctcatcgatatcagacgcatcgaaaattcgctccagcgcttcggcgagcgtttcgtaaaccggtgtttcaccgacatcgagatcgccaaatccgacggccgcaagaaccgcgcggcgtcctatgccaagcgcttcgccgccaaggaggcctgctccaaggcactcggcaccggcttagcgcagggcgtattctggaaagaaatgggggtcgtcaacctgcccggcgggaagccgacgatgcaactgaccggcggcgcggcagcgcgccttcgggaaatgttgccggtcggacaccgcgccgcgatccatctgacgatcaccgacgacttcccgcttgcgcaagctttcgtgattatcgaggcgctgccggttgcccccgccgagggaacggtttag

SEQ ID NO: 1359 - DNA, 477 bp, Ochrobactrum anthropi ATCC 49188
atgatcgtcggtataggcagcgatctcatcgatattcgtcgtgtcgaaagcgcgctggaacgacacggcgatcgctttcgcaacagggtttttaccgaggtcgagcagaaaaaatcggacgggcgcaagcagcgtgctgcatcttatgcaaagcgctttgcggcgaaggaagcctgtgcgaaggcgcttggaactggcatagctcagggcgttttctggcgggacatgggtgtggtcaatgccccttccggaaagcccaccatgcatttgaccggtggtgcggcgaagcagctgcagaaactcttgcccgccggaacacgcgccgccatacatctgacaattaccgatgattttcctctcgcgcaggcgttcgtgatcatcgaagccctgcctgagtgtctgaatcaaaatgcgtcaggccgcagcgagaatggtgattttcgagaaccggagcgcagtgtacttaaaggtacatga

SEQ ID NO: 1360 - DNA, 405 bp, Rhizobium leguminosarum bv  trifolii WSM2304
atgatcattggcattggcagcgatctgatcgacattcgccgcgtcgagaaatccatcgagcgcttcggcgaccgcttcacccatcgctgcttcaccgagatcgagcgcgcccgttccgaccgccgggcaaatcgcggcgcctcctatgccaagcgtttcgccgccaaggaggcttgctccaaggcgctcggcaccggcatagcccagggtgtcttctggaaggatatgggggtcgtcaacctgccgagcggcaagccgaccatggtcttgtcgggtgccgccgccctgatcctcgaatcgatgctgcctgcgggccacaggcccgccattcatttgacaataacggatgattatcccttggcacaggccttcgtgattatcgaggcgttgcccgagagcctctga

SEQ ID NO: 1361 - DNA, 405 bp, Rhizobium leguminosarum bv  trifolii WSM1325
atgatcatcggcattggcagcgatctgatcgacattcgccgtgtcgagaaatccatcgagcgcttcggcgagcgtttcacccatcgttgcttcaccgagatcgagcgcgcccgttccgacaagcgggcaaaccgtgccgcatcctatgccaagcgttttgccgccaaggaggcctgttccaaggcgctcggcaccggcatagcgcagggcgtcttctggaaggacatgggcgtcgtcaacctgccgagcggcaagccgaccatgcttttatcgggcggcgccgcgctgatcctcgaatcactgctgcccgtgggccacaggcccgccattcatttgacaataacggatgattatcccttggcgcaggccttcgtcattatcgaggcgttgcccgagagcctctga

SEQ ID NO: 1362 - DNA, 621 bp, Ralstonia eutropha JMP134
atgcccaagctcctttacctgagcgtgagtccgcgcgccgaaaattcctatagccggcaggccggcgctcgcatgatcgcgtggctggaacgccggcacgggccgctgaccgtgatcgatcgcgaccttgccgccgacccggtgcctcatatcgacggcgccatggcccgcgcaagcctgatgccggctgcggaccgcggtcccgccgagcatgctgcgctggcgttgtccgagacgctgattggtgaactggaggcggcagatatcgtgctgatctccacgccgatgcacaacttcacggtgccgtccgcgctcaaggcctggatcgaccatgtggtgcgatccaaccggacgtttcgcagtacgcctgccggcaaggtcggcctgctggcggaccgcccggtgctggccgtggtgtcctgcggcggaccgttccatgacgggccgggcagccagcgcgacatgatgacgccttacctgcagtatgtatttggctcggtcggcatcacgcaggtcgaagtggtgcgcatggagaatatggcgcgcggcgaggatttcgtcgcacgcggctttgagcggctcaatgcgtggacggggagcctggcaatccgggcagcctga

SEQ ID NO: 1363 - DNA, 615 bp, Burkholderia 383
atgaacaaccttcttttcgtcgatgccagtccgcatggcagtcgttcgctgggcgcgcgcatcgcgcgcgaagccatcgcgcagtggcaggcggcccacccccatgcacgggtcgtgtcgcgcagcctcggtcaacccgggttgccttcgatatcggccgactacgcgcatgcgctggtcgcgaggcagccggattccgatcccgcgctggcctgctccgaacaactgatcgcggaagtggagcacagcgacggcgtgttgatcagcacgccgatgcacaatttcacggtccccgccgcgctgaagttgtggatcgatttcgtgctgcgtatcggccgcacgttcgcggccacgccggaaggcaaggtaggcctgctggccgatcgtcccgtactcgtgctggtgcgctccggcggcatctgcaggggcgcagcggcacggcagcccgatttcctgacgccgtacctgaagcaggtgctggccgtcatcggcttttcgacggtcgatttcatctacctggaaggcgttgcgccggacgacgcagccatcgatgcggtgcgcggccagttggcccagtcggccctgctggctcgacgcgcgacggaaacggcttga

SEQ ID NO: 1364 - DNA, 621 bp, Cupriavidus metallidurans CH34 uid250
atgaccacattgctacacctgaacgtcagcccgcgcggcgagcgatcacacagccgccaggctgggtccgtcgtacgcgaacggctggccgcgcatcgcggaccgctgaccgtgatcgaacgcgatctcggtgccgagccgctgccgcccatcgacgcggcgttcacagacgcgaatcttgccgtggcggccggcggtgacgagcaggccccggcgctgatgctctccgagcgcctgattgccgaactcgagtctgcggacatggtgctgatcaccacgccgatccacaatttcacggtgccggccacgctcaagacgtggatcgacgtggtcgtgcggccggggcggaccttccggagcacgccgcaaggcaagcagggcctgctgcgagaccgcccggtgctggccgtggtggcctgcggcggcgcgtttcacgacgggcccggcagtcagcaggatttcttcacgccatacctgaagtacgtgctggggacgattggcctgtcgcgcgtcgaggttctgcgcatggagaacatgaatcgcggctccgacccggtggcgcgcagctttgaccaccttcgcgcctggtgcgaagccgccgtgcccgcgatggtggactga

SEQ ID NO: 1365 - DNA, 666 bp, Pseudomonas putida W619
atgacgtcgtcccaacagccacttgctcctttgcgcattcttcgcctggtcgccagccccaatgcagaggcttcggaaagtctgaaactgtcccagcagatcctatttgccttggccagtcaggccggcagaaggggtatccagttgaccgatttagacctcaacaccttggtcccagttgattcgccttacgcccaggcgttggccaatcagcgcgtagtcatagcaagcggtcagaagggtacgttgagccgttccgacgagttgatcgaccaactacaggcatgcgacgtactgctgattgccacgccgatgcacaactatagcgtgcccgccccactcaagatgtggatcgaccacgtggtacgcgtgggcaaaacgtttttgggcaccgccaaaggcaaagtcggaaatctgacggatcgtccggtttacgtcgcaatcgctagcgggggctatatcagcggcccacaggcccgtcaaccggactttctgcgcccctacctgtccgccgtccttgccaccatcggtctcactcaggtgcattacttcaccgttgagggtaccgccaaggggggggagtcactgaatactggaagggcaacagggtacggtgatgtgcaggcgtactttgttaggcatagccgtcgagtggatcaagtctaa

SEQ ID NO: 1366 - DNA, 627 bp, Ralstonia pickettii 12J
atgacaacactgctgcacgtgaccgtgagcccgcgcgacgatcgctcgcacagccggcgtggcgcaaagtgggtggtcgcacaattggcagaggccgttggtggcctgcgcgtcatcgagcgcgatctggcggccacgccgttgccgcatcccgatgccggttttgtcgaggccagcctcacgcccgatgccgaccgcaccgcagcgcaccgtgcagcgcttgcgctgtcggaaacgctgatcggcgaactgggagcagcggatgccgtgttgatttccacgccggtgcacaactacacggtgccttcggcgttgaaggcgtggatcgatctggtggtgcggcccgaacgcacgttccgccgcacgcccacgggcaaggtgggcatgctgaccgatcgctcggtgctggtggtatccgcttcaggcggccactttgacggcgcccacgcgcagaccgatttcctgatgccatatctgcgttatgtgtttgccacggtgggcatccatcaggtggaaggcatccgcttgcagaacactgcgcgcggtgctgattccgccatgcaggccttcgaaagtttccggcaggaactggctgcgcggatgttgctcatgccgctggtggcctga

SEQ ID NO: 1367 - DNA, 675 bp, Burkholderia phytofirmans PsJN
atgagaatcttgctgatcaatgccagcccgcatggtgaagcgagccacggctaccgtttcgccgacgaaatcgtcggcatgctgcacgggcacgccgcacccgccgcctcggccatcaccgtggtcgagcgcgacctggcggccgcgccgctgccgccgatcgcccgcgattacgcacgcgccgtcacgtcgcgcgcgccggatacggcgcatttcgatgtctccgagcaactgatcggtgaaatcgaaaccacggatgcgctcatcatcaacacgccgatgcacaacttcacggtcccggcagcgctcaagctgtggatcgattacacgctgcgcattcatcgcacgttcgcctcgacgccggagggcaaggttggactgatgcgcgaccggccgaccatcgtgatcgtcggttcgggcggtgtgcatagcggcgaacgcgcgcggcagacggatttcctgaccccgtatctgcgctacgcgctcggctcgatcggcattcacagcgtgcagtttcttcttttgcaggggctcgtgatgggcgaagcgactgtggccaaagcgctcgatgcggcgcgcgttcagcttaccggcgacgcagtgttcgtctcgcttgccgcgcaggcttcccgatgcgcgaggacggcggccggtagtactgcacggagcgcatag

SEQ ID NO: 1368 - DNA, 627 bp, Ralstonia pickettii 12D; identical to SEQ ID NO: 1366

SEQ ID NO: 1369 - DNA, 2598 bp, Enterobacter sp. 638
atgggtaaagctctcgtcatcgttgagtccccggcaaaagccaaaacgatcaataagtatctgggcaatgactacgtggttaagtccagcgttggtcatgtccgcgatttgccgaccagtggctcagccagtaaaaagagcgcagactctacctccaccaaaggggctaaaaagcctaaaaaggatgaacgtagtgcgctcgtcaaccgtatgggtgtcgatccatggcacgagtgggaagcacagtacgaagtgcttccaggtaaagaaaaagtcgtcaatgagctgaagcagctcgcagaaaaagctgaccacatttatctcgcaaccgaccttgaccgtgaaggggaagccattgcgtggcacctgcgggaaatcattggtggtgatgaaacacgttacagccgtgttgtctttaacgagataaccaagaatgcgattcgtcaggcgtttgaaaagccgggcgaactgaatattgaccgtgtaaatgcccagcaggcgcgtcgttttatggaccgcgttgtgggttatatggtctcaccactgctgtggaaaaagatcgcccgtggactttccgctggccgcgtacaatctgttgcggtgcgtttagttgtcgaacgtgaacgcgaaattaaagcgtttgtacccgaagagttctgggaaattgatgcgaacgtcaccacgcctgccggtgatgcgctgccgttgcaagtcactcacgaaaatgacaaaccgttccgtcctgttaatcgcgaccataccatggctgcggttgcgcaactggaaaaagcgcgttatcaggtcgttgagcgtgaagataaaccgaccagcagcaaacctggcgcaccattcatcacctccactttgcagcaggcggccagtactcgtctgggctttggtgtgaagaaaaccatgatgatggcgcagcgtttgtatgaagcgggctacatcacctatatgcgtactgactcgacgaatttgagccaggatgccgtcaccatggtgcgtgactacatcggtgaaaacttcggtaagaaatatttgccggaaagtgcgaaccagtacgcaagcaaagaaaattctcaggaagcgcacgaagcaattcgtccttctgatgtgtccgttgtttccgaatctctgaaagatatggaaaccgacgcacaaaagctttatcagctgatctggcgccagtttgttgcctgtcagatgaatcctgcgaaatatgattccaccacgctgaccgttggcgctggcgatttccgtcttaaagctcgtggtcgcatcttgcgcttcgacggctggacgaaagtaatgcctgcgctgcgcaaaggcgatgaagatcgtattttgccaccggtaaacaaaggcgatgagctttcgttgactgaactccttcctgctcagcactttaccaagccgcctgcacgttttagtgaagcctcgttggttaaagagcttgaaaaacgtgggattggtcgcccgtcgacctatgcgtcgatcatctcgaccattcaggatcgtggttacgtccgcgctgaaaaccgtcgtttttatgctgaaaaaatgggtgagattgtcacagatcgcctggaagctaatttccgcgagctgatgaattacgatttcaccgcgcagatggaagaccgtctggatcaggtggcgaaccatcaagctgaatggaaaaatgttctggatagtttcttcagtgattttaccgagcagctggcaaaagccgagaaagatccggaagaagggggcatgcagcctaaccagatggtgctgaccagcatcgactgcccaacctgcagccgtcagatggggattcgtaccgcgacgacgggcgtgttccttggttgttccggctatgctttaccgccaaaagagcgttgcaaaaccaccattaacctggtgccagagaacgaagttctcaacgttctggaaggtgatgacgccgaaaccaacgcgttgcgcgcgaaacgtcgttgccagaaatgtggcaccgcgatggacagctacctgatcgatccgaagcgtaaattgcatgtctgcggtaataacccaacgtgtgacgggtatgagatcgaagagggcgagttccgcatcaaaggctatgacggccctgtcgtggagtgcgagaagtgtggttctgaaatgcacctgagaatggggcgtttcgggaagtacatggcctgtactaacgaagaatgtaaaaacacgcgtaaaatcctgcgtaacggtgaagtggctcctccgaaggaagatccggtcccgctgccagaattgccgtgtgaaaagtctgatgcgtattttgttctgcgtgacggtgccgccggggtcttccttgctgcgaacaccttccctaaatcgcgcgaaacccgtgcgccgctggtggaagagttgtatcgtttccgcgatcgtttaccggaaaaactgcgttatttggccgacgcgccactgcaggatccggaagggaataaaaccgttgtccgctttagccgtaaaacgaagcagcaatatgtgtctgctgagaaagaaggtaaagcgaccggatggtcagcattctttattgacggaaagtgggttgaaggaaagaaataa

SEQ ID NO: 1370 - DNA, 2631 bp, Vibrio cholerae O395
atgggtaaatcactcgttatcgtcgagtcgccagccaaggctaaaaccatcaataagtaccttggtaaagactttatcgtgaaatccagtgtgggacacgtgcgtgatctgcctacagcagggcaaacggccacaccgaccggtaaagcggcggcagcatcgactaagaaagcatctactactgataaagagcagcaaaagcgtgaaaaagaacgcgcagcgctgatcaaaaagatgggtgtcgatccgtatcacggctggcaagccaattaccaaattctgcccggtaaagagaaagtggtggctgagctgcaaaagctcgcgaaagacgctgacagcgtttatctcgcaaccgacttggaccgcgagggagaagccatcgcttggcaccttcgtgagatcatcggtggcgatgaaaagcgatataaacgagtggtatttaacgaaatcaccaaaaacgccattcagcaggcttttaagcagcctggtgaactgaatatggatggcgtgaacgctcaacaagcacgccgtttcatggaccgcgtggtgggctttatggtctcgccactgctgtggaaaaaagtggcgcgaggcctttccgctggtcgtgtacagtctgtcgccgtgaaacttctggttgagcgtgaacgcgaaatcaaagcatttgttccggaagaattttgggacatcaatgccgataccttgaccgcagacaagcaagattttcgcctgttggtggcccaaaaagacggtttagctttcaagcctgtgaacgaaacggaagccttggcggcggttgctgcgctcaataaagcgcagtacgaagtgtgcaaacgcgaagacaaaccgaccaccagtaaaccgagtgcaccttttattacgtcaaccctgcagcaagccgcgagtactcgccttggttatggggtgaaaaagaccatgatgctcgctcagcgtttgtatgaagcgggttacatcacctatatgcgtaccgactcaaccaacttgagtgcggaagcggttgagaatctgcgtggctacatcaccaagcattacggtgaggcgtatttgccgagccagccaaatgtgtatggcagcaagcaaaatgcccaagaggcgcacgaagcgattcgtccttcggatgtgactgtcaccgccgacgatctggaaggaatggaagcggatgcacacaagctgtatgccctgatttggaatcagtttgtggcctgtcaaatgacacctgcgcaatacgattccacgacagtcagtgtaaaagcggcagagtacaccctgaaagcgaaaggtcgtatcctcaagtttgatggttggactcgcgtacagcgcccgttgggtaaaaacgaagatcagatcctgcctccggtgaagatcggtgatagcctaaagctcgtcagcctagatccgaaacagcactttaccaaaccgccagcgcgttacacggaagcggcattggtgaaagagttagaaaagcgtggtattggtcgcccatcgacgtatgcatcgatcatttccaccattcaagaccgcggttatgtgaaagtcgatcagcgccgtttcttcgcggaaaaaatgggcgaaattgtcaccgatcgtcttgatgagaattttgacgacttgatgaactacgactttaccgcgcgtatggaagagaaactcgaccaaatcgccgaaggtgaagtgaactggaccgcagtactggatgagttctttgctgatttcagtcgcgacctcgaaacggcggagcaagatgaaagcttaggtggcatgaagcctaatcacatcgtgatgaccaatattttgtgtccgacctgctcgcgtccgatggggatccgcacggcatcgacaggggtgtttttaggctgttctggctatgcattaccgccgaaagagcgctgcaaaaccaccatcaacttaggtgacgaagaaggggtgatcaacgttctcgaagaggatgtcgaaaccgcagcactgcgtgctaagaagcgttgcccaatttgtgaaacggcgatggatgcgtatctgattgacgataagcgtaagctgcatgtttgtggtaacaatccgaactgtgaaggctttatcgttgaagaaggcgagttcaaagtcaaaggctatgaaggcccaaccgtcgagtgtgataaatgtggctcagacatggtgctgaaaaatggccgctttggtaagtacatgggttgtaccaacgatgcttgtaaaaatacgcgtaagatcctgaaaaatggcgaagttgcgccaccgaaagaagagccagtgcatttccctgaactgccttgtgaaaattcggatgcgtattttgtgctgcgtgatggtgcatctggcttgttctttgcggcgagcaatttccctaaatcgcgtgaaacgcgcgcgcctttggtggaagagttgaaacgttttgctgagcgtttgccagaaaaataccagtatctgacttctgcacccgcacatgatcctgatggcttacctgctgtggtgcgcttctctcgtaaagagaaagagcattacgtgcgtaccgagacagagggtaaaccttccggttggatggcggtttaccaagagggtaaatggttggtcacggataaacgcaaaaacgcgaaataa

SEQ ID NO: 1371 - DNA, 2631 bp, Vibrio harveyi ATCC BAA-1116
atgggtaaatcgctcgttatagtggagtcaccagccaaggctaagacgataaataaatatcttggtaaagactttattgttaagtctagtgttggtcacgtgcgtgatctgcctacggccggtcaaagcactggtgagaaaaaagccgctgccatttctacaaaaggaatgagcccggaagagaaagcgcgtgtcaaaaaagaaaaagaccgcaaagcgctaatcaaaaaaatggggattaacccatatcatgactgggatgcgaattaccaaatccttccaggcaaagaaaaagtcgtaagcgaactgcaaaaattagccaaagacgctgattacgtttacctcgcaaccgatttggaccgcgagggggaagcaatcgcatggcaccttcgtgagatcatcggtggcgatgaagagcgatacaagcgcgtagtgtttaacgagatcactaagaatgctatccaacaagctttccagacacctggcgagctaaacatggacggtgttaacgcacagcaagcacgtcgattcatggaccgagtagtaggtttcatggtttctccattgctatggaagaaagttgcgcgtggtctttcagcaggtcgcgtacaatcagtagcggtgaagctattggttgagcgtgagcgtgaaatcaacgctttcattccagaagagttctgggatatcaacgcgaatacgcacaccaaagacaagaccgcattcaaattgcttgttgcacaaaaagatggcgttgcgtttaagccagtcaacgaggcagagaccaaagcagcgctttcggtactggaaaaagcgagctacgaagtttgtaagcgtgaagaccgcccaacaaagagtaagccttctgcaccgtacatcacttcaacactgcaacaagcggcaagcactcgtcttggctacggcgttaagaagacaatgatgctcgctcaacgtttgtatgaagcgggttacatcacctatatgcgtaccgactctaccaacttgagtgcggaagctgtagatgcggttcgtggattcatcggctctgagtatggtgacaagtatcttcctgctaaaccgctaacatacggtagcaaagagggcgcacaagaagcgcacgaagcgattcgtccttccgatgtttctgtgaaatcagaagatctacaaggtgttgatgcggacgcacacaaactttactcattgatctggaatcagttcgttgcttgtcaaatgacgccagcagaatacgattcaacaacaatcagtgtgaaagcggcagaatacacgctaaaagcgaaaggccgtatccttaagtttgacggttggactcgcgtacaacgcccaatgggtaaaaacgaagatacgattcttccagctgttcagctaggcgaaaagctagacttagagtcattagagcctaaacagcactttactaagccacctgcacgttttacagaagcggcattggttaaagagcttgagaagcgcggcattggccgtccttcaacttacgcttcaatcatctctacgatccaagatcgcggttacgtgaaagttgaacagcgtcgtttctatgcagaaaagatgggcgagatcgttactgaccgcctagatgacagctttaacgacctaatgaactacgacttcacggctcgtatggaacagaagcttgaccaaatcgcagaaggcgatgtgatgtggaaagatgttctagacaacttcttcacagacttcactggcgatcttgagaaagcggaacaggacgaaaacgaaggcggcatgaaactgaatcacattgtgatgacagatattgagtgtccaacttgtggtcgtccaatgggtattcgtactgcgtctaccggtgtgttccttggctgttctggttacgcattgccacctaaagagcgttgtaagacaacgattaacttaggtgacgaagatggcattatcaatgttctagaagaagatgtggaaactgcagcactgcgtgcgaagaagcgttgtcctatctgtgaaacagcgatggatgcatacctgatcgacgataagcgtaagatgcacgtttgtggtaacaacccgaactgtgaaggctacatcgttgaacacggcgagttcaaagtgaaaggctacgatggcccagttgttgagtgtgacaagtgtggttctgacatggtgcttaaaaacggtcgcttcggtaaatacatggactgtacgagtgagacgtgtaagaacactcgtaagattctgaagaatggcgaagttgcgccaccgaaggaagacccagttcatttccctgaactgccatgtgaaaactcggacgcttactttgttctgcgtgatggtgcttctggcctatttatggcagcaagcaacttccctaaatcacgtgaaactcgtgctccgttggtgtctgaactggctcgcttcgaagaacgtcttccggagaagtttaagtacctaacgacagcgccagcagcggatccagatggtcgccctgcagtggttcgctttagccgtaagagcaaagaaaactacgtgcgtactgaagacaatggcaaaccaagtggttggactgcgttgtttgttgacggtaagtgggaaatcacagataagcgcaaaaaagcaaaagcttaa

SEQ ID NO: 1372 - DNA, 2598 bp, Serratia proteamaculans 568
atgggtaaagctctcgtaatagttgagtccccggcaaaagccaaaactattaataaatatttaggtaatgactacgtggtgaagtccagcgtcggtcatatccgtgatttgccgaccagtggctcagccagcaaaaagagcgctgactcaaccgaagacaaagccaagaagaaagttaaaaaagatccaacgacggcgctggtaaatcgtatgggcgtcgatccctaccatggctggaaagcgcattacgaaatcctgccgggtaaagaaaaagttgttgccgagttaaagtcgttagcggaaaacgccgaccacatttatctcgcaaccgaccttgaccgcgaaggggaagccattgcctggcacctgcgggaagttatcggtggtgacgacaaacgctttagccgcgtggtgtttaacgaaattaccaagaacgcgatccaaaacgcgttcaaacagcccggcgaactgaatatcgaccgtgtcaacgcacagcaggcgcgtcgctttatggaccgcgtggtgggttacatggtctcgccactgctatggaaaaaaattgcccgtggcttgtccgctgggcgagtgcaatccgttgcggttcgactggtggtggagcgtgagcgcgacatcaaagccttcgtgccggaagaatactgggagttgcacgccgatctgttggcgaagggtgataccgcgctgcagatggaagtgacccatgcccacgacaaacccttcaaaccggttaaccgtgagcagactcacgccgcactcaacgtgctggaaaaagcccgttatacggtactggatcgcgaagacaagccgaccagcagcaagccgggcgcaccttatattacttctacgttgcagcaggcggccagtacccgtctgagctttggcgtgaagaaaaccatgatgatggctcagcgcctgtatgaagccggtcacatcacctatatgcgtaccgactccaccaacctgagccaggatgcgctcgagatggtgcgtggctacatcggtgacaacttcggcgacaagtacctgccgaaagcgccgaaccagtacagcagcaaagaaaactcgcaggaagcacacgaagccatccgtccgtcggatgtcaacgtgctggccgagcagttgaaagatatggaagcggatgcgcaaaaactgtatcagctgatttggcgccagtttgtggcctgtcagatgacaccggcgcagtacgactccaccacgctgtcggtgaaggccgctgattaccagctgcgcgccaaaggccgtacgctgcgtttcgatggctggaccaaagtgatgcctgctctgcgtaagggtgatgaagaccgcaccttgccgtatgttgaagtaggtagcgatctggaactgcagaaactgatcccaagccagcactttaccaaaccgccggcgcgttatagcgaagcgtcattggtaaaagagttggaaaaacggggtatcggccgtccttcaacctacgcttcgatcatttccaccattcaggatcgtggttatgtgcgagtcgaaagccgccgtttctacgctgagaaaatgggtgagatcgttaccgaccgcctggaagaaaacttccgcgagctgatgaactatgacttcaccgcacgcatggaaaacggtctggaccaggtagccaacaaccaggccgagtggaaagcggtgctggatgagttctttgccgagttcagcgaacagctggaaacggcggagaaagagccggaagaaggcggtatgcgcccgaatcagatggtgatgaccagtatcgattgcccaacctgcggtcgcaagatgggtatccgtactgccagcaccggcgttttcctgggttgctccggctatgcattgccgccgaaggaacgttgtaaaaccaccattaacctggtgccggaaacggaagtgctcaacattctcgaaggggatgacgcggaaaccaacgcgttgcgtgcccgccgtcgctgccagaaatgcggcacggcgatggacagctacctgatcgataaccagcgcaagctgcacgtgtgcggtaacaacccggcgtgtgacggctatgagattgaagagggtgagttccgcctgaaagggtacgacggccctgtggttgagtgcgataagtgtggttctgaaatgcacctgaaaatggggcgcttcggtaagtacatgggttgcaccaacgagagctgcaaaaatacccgtaagatcctgcgtaatggtgatgttgcaccgccgaaggaagatccggttccattgccggagctgccatgcgaaaagtcggacgcttactttgttctgcgtgacggcgctgccggtgtgttcctggcggccaataccttccctaaatcgcgcgaaacccgtgcgccgttggtggaagagttggcccgcttcaaggaccgtctgcctgaaaaactgcgttatctggcggatgcgccggtggccgatgcggaaggcaacaaaacgctggtgcgtttcagccgcaagaccaagcagcagtatgtctcggcagagaaagacggcaaagccactggttggtctgctttctacatcgatggcaaatgggttgaaggcaaaaaataa

SEQ ID NO: 1373 - DNA, 2616 bp, Yersinia pestis Angola
atgggtaaagctctcgtaatagttgagtccccggcaaaagccaaaactattaataaatacttagggaatgattacgtggttaagtccagcgtcggtcacattcgtgatttgccgaccagtggctcagccagtaaaaagagcgctaactcagctgaagaaaaagccaaaaaagacgataaacccaaaaagaaagtgaagaaagacgaaaaggttgccttagtcaaccgtatgggggtcgatccttatcatggctggaaagcgcagtatgaaattttgtctggcaaagagaaagtggttgccgagctgaaagcattagcagaaaacgcggatcatatctatctcgcaaccgaccttgatcgcgaaggtgaggctattgcctggcatttgcgggaagtgatcggtggggacgataaacgttttagccgcgttgtctttaacgaaatcaccaagaatgcgattcagcaggcgtttaatcagcctggtgaactgaacatcagccgtgtaaatgcacaacaagcccggcgttttatggatcgggttgttggctatatggtctctccactgttgtggaagaaaattgcccgtggcctgtcagctggccgtgtacagtcagttgctgtgcgccttgtggttgaacgtgaaaaagagattaaagcattcgttcctgaagaatattgggagctacatgcagatttagtggctaaaggtgacattccgattcaaatggaagtcactcatgcccatggcaagccatttaaaccggtaaatcgtgagcaaacacatgcagcgctgacgttactggaaaatgcccgttataaggtgttggatcgtgaagataaaccgaccagcagtaagcccagcgcacccttcattacctccaccttacagcaggcggcaagtacccgtctgagttttggtgtgaaaaaaaccatgatgatggcacagcgcctgtatgaagcgggtcatatcacctacatgcgtaccgactcgactaatttgagtcaggatgcattgacgatggtacgtggttatatcggcgataattttggtgataagtatctgcctgcaacgcctaaccaatacagcagcaaagagaattcgcaggaagcgcatgaggccatccgcccttcagatgtcaatgtgttagctgagcagttgaaagatatggaagcggatgcccagaggttgtaccaattgatttggcgtcagtttgtggcgtgccagatgcctccggccaagtatgactcgaccacactgacagtgcaggcgggggatttccaactgcgcgccaaaggccgcacattgcgctttgatggttggaccaaggttatgcctgcgctgcgtaaaggtgatgaagatcgcaccttgccggtgattgaagtgggcagtgatttagacttacaaaaactgattccgagccagcattttaccaagccaccggctcgttatagtgaagcatcattagtgaaagagctggaaaaacggggtattggccgtccatcgacttatgcctctattatttcgaccattcaagatcgtggctatgtgcgggtagaaaaccgtcgcttctacgcagagaaaatgggtgaaattgtgacagaccgcttggaagaaaacttccgcgagctgatgaattacgatttcacggcacgaatggaaagcggtttggatcaagtcgccaatgatcaggccgaatggaaagcggtgctggatggcttctttgctgaattcagcgagcagcttgaaaaggcagaaaaagatcctgaagaaggaggaatgcgcccgaatcagatggtgatgaccagcattgattgcccaacctgtggccgtcagatggggatccgtactgcgagtactggggtgttccttggctgttccggttatgcattgccgcctaaagagcgctgtaaaaccaccattaacttggtgccggacgctgagattttgaatattctggagggtgatgatgcggagactaacgcattacgtgcccgccgccgttgccagaaatgtggtactgcgatggatagctaccttatcgataatcaacgcaagttacatgtttgcgggaataacccagcgtgtgatggctatgaaatcgaagcaggtgagttccggataaaaggctatgaaggcccaattgttgagtgcgagaaatgtggttctgaaatgcacctgaaaatggggcgcttcggtaagtacatgggctgcaccaatgacgagtgtaagaatacccgcaagattctgcgtagcggtgaagttgcaccaccgaaagaagatccggtaccattgttagagttgccttgcgagaaatcagatgcttatttcgtcctacgagatggcgcagctggcgtgttcttggcagccaatacattccctaaatcgcgtgaaacccgtgcaccgctggtagaagaattggttcgctttaaagaccgtttgcctgagaagttgcgttatctggctgatgcccctgtggttgataaagagggtaataaaaccctggtccgtttcagccgtaaaacgaagcaacagtatgtttcatcagagaaagatggcaaagcaacaggctggtctgctttctatattgatggtaaatgggttgaggcaaagaaataa

SEQ ID NO: 1374 - DNA, 2598 bp, Salmonella enterica serovar Newport SL254
atgggtaaagctcttgtcatcgttgagtccccggcaaaagccaaaacgatcaacaagtatctgggtaatgactacgtggtgaaatccagcgtgggtcatatccgtgatttgccgaccagtggctcagcagctaaaaagagcgccgactctacctccaccaaaacggctaaaaagcccaaaaaggatgaacgtggcgctctcgtcaaccgtatgggggttgacccgtggcacaactgggatgcgcactatgaagtgctgcccggtaaagagaaggtcgtctctgaactgaaacagttggcggaaaaagccgaccacatctatctcgcaaccgaccttgaccgcgaaggggaagccattgcatggcacctgcgggaagtgatcggcggcgatgacgcgcgctacagccgcgtagtctttaacgaaataaccaaaaatgccattcgccaggcgtttgaacagccgggcgagctgaacattaacagggtcaacgcccagcaagcgcgccgctttatggaccgcgtggtaggctatatggtctcgccgctgctgtggaaaaagatcgcccgtggtttgtcggcaggtcgcgttcagtctgtcgcggtccgtctggtcgttgaacgcgagcgcgagattaaagcgtttgttccggaagagttctgggaaattgacgccaatacgacgacgccgtctggcgaggcgctaccgctacaggtcacgcatcagaacgacaagccattccggccggtaaatcgcgagcagacgcttgccgccgtcagcttgctggaaaaagcgcgctatagcgtactggagcgtgaagacaaaccgaccagcagcaaacctggcgcgccgtttatcacctccacgctacaacaggcggccagcacccggctgggctttggcgtgaagaaaaccatgatgatggcgcagcgtctgtatgaggcgggctacatcacctatatgcgtaccgactccaccaacctgagtcaggatgcggtcaacatggtgcgcggctatattggcgataatttcggcaagaaatacctgccggataacccgaaccagtacgccagcaaagaaaactctcaggaagcgcacgaagcgatccgtccttccgacgttgctgtcatggcggagtcgctgaaagacatggaggctgacgcgcagaagttgtatcagctaatttggcgtcagtttgtcgcctgtcagatgacgccagcacaatatgactccactacgcttaccgttggcgcaggcgaattccgtctgaaagcgcgtgggcgtattttgcgctttgacggctggacaaaagtgatgccggcgctgcgtaaaggcgatgaagatcgcacattgcctgccgtgaataagggcgatgcgctgacgctacttgaattgacgcctgctcagcactttactaaaccgccagcccgtttcagcgaggcttctctggttaaagaacttgagaagcgcggtattggtcgtccgtctacctatgcgtcgattatctcgaccattcaggatcgcggctatgttcgcgttgaaaaccgtcgcttctatgcggaaaaaatgggtgaaatcgtcaccgaccggctggaagaaaacttccgcgaattgatgaactacgattttaccgcgcagatggaagatagtctggatcaggttgcgaatcaccaggccgagtggaaagcggtactggataacttcttcagcgattttactcagcagctcgataaagccgagaaagatccggaagaaggggggatgcgtcctaaccagatggtgctgaccagcatcgactgtccaacctgtggccgtaaaatgggaattcgtactgccagtacgggggttttccttggttgttcaggttatgcgctttcgccgaaagagcgttgtaaaacgaccattaacctggtgccggaaaatgaagttctgaacgtgctggaaggcgacgacgccgaaaccaacgccctgcgcgccaagcgtcgctgtcagaagtgcggtacggcgatggacagctatctgatcgatccgaagcgtaaattacatgtgtgtggtaataacccgacctgtgacggctacgagattgaagaaggcgagttccgcatcaaagggtatgacggcccgatcgttgagtgtgagaaatgtggttccgaaatgcacctgaaaatggggcgttttggtaagtacatggcctgtacgaacgacgaatgtaaaaatacccgtaagatcttgcgtaacggcgaagttgcgccgccgaaggaagatcctgttccattgccggaactgccgtgtgaaaaatcggacgcgtactttatgctgcgcgatggcgccgcagggatattcctggcggccaatacgttcccgaaatcacgcgaaacgcgcgcgccattagtcgaggagctttaccggttccgcgatcgcctgccggaaaaactgcgttatctggcggatgcgccgcagcaggacccggaaggcaataaaaccgttgttcgctttagccgcaaaacaaaacagcagtacgttgcggcggaaaaagacgggaaggcgacgggatggtcagcgttcttcgtcgacggcaagtgggttgaaggcaagaaataa

SEQ ID NO: 1375 - DNA, 2598 bp, Salmonella enterica serovar Heidelberg SL476
atgggtaaagctcttgtcatcgttgagtccccggcaaaagccaaaacgatcaacaagtatctgggtaatgactacgtggtgaaatccagcgtgggtcatatccgtgatttgccgaccagtggctcagcagctaaaaagagcgccgactctacctccaccaaaacggctaaaaagcccaaaaaggatgaacgtggcgctctcgtcaaccgtatgggggttgacccgtggcacaactgggatgcgcactatgaagtgctgcccggtaaagagaaggtcgtctctgaactgaaacagttggcggaaaaagccgaccacatctatctcgcaaccgaccttgaccgcgaaggggaagccattgcatggcacctgcgggaagtgatcggcggcgatgacgcgcgctacagccgcgtagtctttaacgaaataaccaaaaatgccattcgccaggcgtttgaacagccgggcgagctgaacattaacagggtcaacgcccagcaagcgcgccgctttatggaccgcgtggtaggctatatggtctcgccgctgctgtggaaaaagatcgcccgtggtttgtcggcaggtcgcgttcagtctgtcgcggtccgtctggtcgttgaacgcgagcgcgagattaaagcgtttgttccggaagagttctgggaaattgacgccaatacgacgacgccgtctggcgaggcgctaccgctacaggtcacgcatcagaacgacaagccattccggccggtaaatcgcgagcagacgcttgccgccgtcagcttgctggaaaaagcgcgctatagcgtactggagcgtgaagacaaaccgaccagcagcaaacctggcgcgccgtttatcacctccacgctacaacaggcggccagcacccggctgggctttggcgtgaagaaaaccatgatgatggcgcagcgtctgtatgaggcgggctacatcacctatatgcgtaccgactccaccaacctgagtcaggatgcggtcaacatggtgcgcggctatattggcgataatttcggcaagaaatacctgccggataacccgaaccagtacgccagcaaagaaaactctcaggaagcgcacgaagcgatccgtccttccgacgttgctgtcatggcggagtcgctgaaagacatggaggctgacgcgcagaagttgtatcagctaatttggcgtcagtttgtcgcctgtcagatgacgccagcacaatatgactccactacgcttaccgttggcgcaggcgaattccgtctgaaagcgcgtgggcgtattttgcgctttgacggctggacaaaagtgatgccggcgctgcgtaaaggcgatgaagatcgcacattgcctgccgtgaataagggcgatgcgctgacgctacttgaattgacgcctgctcagcactttactaaaccgccagcccgtttcagcgaggcttctctggttaaagaacttgagaagcgcggtattggtcgtccgtctacctatgcgtcgattatctcgaccattcaggatcgcggctatgttcgcgttgaaaaccgtcgcttctatgcggaaaaaatgggtgaaatcgtcaccgaccggctggaagaaaacttccgcgaattgatgaactacgattttaccgcgcagatggaagatagtctggatcaggttgcgaatcaccaggccgagtggaaagcggtactggataacttcttcagcgattttactcagcagctcgataaagccgagaaagatccggaagaaggggggatgcgtcctaaccagatggtgctgaccagcatcgactgtccaacctgtggccgtaaaatgggaattcgtactgccagtacgggggttttccttggatgttcaggttatgcgctttcgccgaaagagcgttgtaaaacgaccattaacctggtgccggaaaatgaagttctgaacgtgctggaaggcgacgacgccgaaaccaacgccctgcgcgccaagcgtcgctgtcagaagtgcggtacggcgatggacagctatctgatcgatccgaagcgtaaattgcatgtgtgtggtaataacccgacctgtgacggctacgagattgaagaaggcgagttccgcatcaaagggtatgacggcccgatcgttgagtgtgagaaatgtggttccgaaatgcacctgaaaatggggcgttttggtaagtacatggcctgtactaacgacgaatgtaaaaatacccgtaagatcttgcgtaacggcgaagttgcgccgccgaaggaagatcctgttccattaccggaactgccgtgtgaaaaatcggacgcgtactttgtgctacgcgacggcgccgcagggatattcctggcggccaatacgttcccgaaatcacgcgaaacgcgcgcgccattagtcgaggagctttaccggttccgcgatcgcctgccggaaaaactgcgttatctggcggatgcgccgcagcaggacccggaaggtaataaaaccgttgttcgctttagccgcaaaacaaaacagcagtacgttgcggcggaaaaagacgggaaggcgacgggatggtcagcgttcttcgtcgacggcaagtgggttgaaggcaagaaataa

SEQ ID NO: 1376 - DNA, 2598 bp, Salmonella enterica serovar Schwarzengrund CVM19633
atgggtaaagctcttgtcatcgttgagtccccggcaaaagccaaaacgatcaacaagtatctgggtaatgactacgtggtgaaatccagcgtgggtcatatccgtgatttgccgaccagtggctcagcagctaaaaagagcgccgactctacctccaccaaaacggctaaaaagcccaaaaaggatgaacgtggcgctctcgtcaaccgtatgggggttgatccgtggcacaactgggatgcgcactatgaagtgctgcccggtaaagagaaggtcgtctctgaactgaaacagttggcggaaaaagccgaccacatctatctcgcaaccgaccttgaccgcgaaggggaagccattgcatggcacctgcgggaagtgatcggcggcgatgacgcgcgctacagtcgcgtagtctttaacgaaataaccaaaaatgccattcgccaggcgtttgaacagccgggcgagctgaacattaacagggtcaacgcccagcaagcgcgccgctttatggaccgcgtggtaggctatatggtctcgccgttgctgtggaaaaagatcgcccgtggtttgtcggcaggtcgcgttcagtctgtcgcggtccgtctggtcgttgagcgcgagcgcgagattaaagcgtttgttccggaagagttctgggaaattgacgctaatacgacgacgccgtctggcgaggcgctaccgctacaggtcacgcatcagaacgacaagccattccggccggtaaatcgcgagcagacgcttgccgccgtcagcttgctggaaaaagccagctatagcgtgctggagcgagaagacaagccgaccagcagcaagccaggcgcgccgtttatcacctccacgctacagcaggcggccagcacccggctgggctttggcgtgaagaaaaccatgatgatggcgcagcgtctgtatgaggcgggctacatcacctatatgcgtacagactccaccaacctgagtcaggatgcggtcaacatggtgcgcggttatattggcgataatttcggcaagaaatacctgccggataacccgaaccagtacgccagcaaagaaaactctcaggaagcgcacgaagcgatccgtccttccgacgttgctgtcatggcggagtcgctgaaagacatggaggctgacgcgcagaagttgtatcaactaatttggcgtcagtttgtcgcctgtcagatgacgccagcacaatatgactctactacgcttaccgttggcgcaggcgagttccgcctgaaagcgcgtgggcgtattttgcgctttgacggctggacaaaagtgatgccggcgctgcgtaaaggcgatgaagatcgcacattgcctgccgtgaataagggcgatgcgctgacgctacttgaattgacgcctgctcagcactttactaaaccgccagcccggtttagcgaggcttctctggttaaagagcttgagaagcgcggtattggtcgtccgtctacctatgcgtcgattatctcgaccattcaggatcgcggctatgttcgcgttgaaaaccgtcgtttctatgcggaaaaaatgggtgaaatcgtcaccgatcggctggaagaaaacttccgcgaattgatgaactacgattttaccgcgcagatggaagatagtctggatcaggttgcaaatcaccaggccgagtggaaagcggtactggataacttcttcagcgattttactcagcagctcgataaagccgagaaagatccggaagaaggggggatgcgccctaaccagatggtgctgaccagcatcgactgtccaacctgtggccgtaaaatgggaattcgtactgccagtacgggggttttccttggatgttcaggttatgcgctttcgccgaaagagcgttgtaaaacgaccattaacctggtgccggaaaatgaagttctgaacgtgctggaaggcgacgacgccgaaaccaacgccctgcgcgccaagcgtcgctgtcagaagtgtggtacggcgatggacagctatctgatcgatccgaagcgtaaattgcatgtgtgtggtaataacccgacctgtgacggctacgagattgaagaaggcgagttccgcatcaaagggtatgacggtccgatcgttgagtgtgagaaatgtggttccgaaatgcacctgaaaatggggcgttttggtaagtacatggcctgtactaacgacgaatgtaaaaacacccgtaagatcttgcgtaacggcgaagttgcgccgccgaaggaagatcctgttccattgccggaactgccgtgtgaaaaatcggacgcgtactttgtgctgcgcgatggcgccgcagggatattcctggcggccaacacgttcccgaaatcacgcgaaacgcgcgcgccattagtcgaggagctttaccggttccgcgatcgcctgccggaaaaactgcgttatctggcggatgcgccgcagcaggatccagaaggtaataaaaccgttgttcgctttagccgcaaaacaaaacagcagtacgttgcggcggaaaaagacgggaaggcgacgggatggtcagcgttcttcgtcgacggcaagtgggttgaaggcaagaaataa

SEQ ID NO: 1377 - DNA, 2598 bp, Salmonella enterica serovar Agona SL483
atgggtaaagctcttgtcatcgttgagtccccggcaaaagccaaaacgatcaacaagtatctgggtaatgactacgtggtgaaatccagcgtgggtcatatccgtgatttgccgaccagtggctcagcagctaaaaagagcgccgactctacctccaccaaaacggctaaaaagcccaaaaaggatgaacgtggcgctctcgtcaaccgtatgggggttgacccgtggcacaactgggatgcgcactatgaagtgctgcccggtaaagagaaggtcgtctctgaactgaaacagttggcggaaaaagccgaccacatctatctcgcaaccgaccttgaccgcgaaggggaagccattgcatggcacctgcgggaagtgatcggcggcgatgacgcgcgctacagtcgcgtagtctttaacgaaataaccaaaaatgccattcgccaggcgtttgaacagccgggcgagctgaatattaacagggtcaacgcccagcaagcgcgccgctttatggaccgcgtggtaggctatatggtctcgccgctgctgtggaaaaagatcgcccgtggtttgtcggcaggtcgcgttcagtctgtcgcggtccgtctggtcgttgaacgcgagcgcgagattaaagcgtttgttccggaagagttctgggaaattgacgccaatacgacgacgccgtctggcgaggcgctaccgctacaggtcacgcatcagaacgacaagccattccggccggtaaatcgcgagcagacgcttgccgccgtcagcttgctggaaaaagcgcgctatagcgtactggagcgtgaagacaaaccgaccagcagcaaacctggcgcgccgtttatcacctccacgctacaacaggcggccagcacccggctgggctttggcgtgaagaaaaccatgatgatggcgcagcgtctgtatgaggcgggttatatcacctatatgcgtaccgactccaccaacctgagtcaggatgcggtcaacatggtgcgcggttatattggcgataatttcggcaagaaatacctgccggataacccgaaccagtacgccagcaaagaaaactctcaggaagcgcatgaagcgatccgtccttccgacgttgctgtcatggcggagtcgctgaaagacatggaggctgacgcgcagaagttgtatcaactaatttggcgtcagtttgtcgcctgtcagatgacgccagcacaatatgactccactacgcttaccgttggcgcaggcgaattccgtctgaaagcgcgtgggcgtattttgcgctttgacggctggacaaaagtgatgccggcgctgcgtaaaggcgatgaagatcgcacattgcctgccgtgaataagggcgatgcgctgacgctacttgaattgacgcctgctcagcactttactaaaccgccagcccgttttagcgaggcttctctggttaaagagcttgagaagcgcggtattggtcgtccgtctacctatgcgtcgattatctcgaccattcaggatcgcggctatgttcgcgttgaaaaccgtcgcttctatgcggaaaaaatgggtgaaatcgtcaccgatcggctggaagaaaacttccgcgaattgatgaactacgattttaccgcgcagatggaagatagtctggatcaggttgcgaatcaccaggccgagtggaaagcggtactggataacttcttcagcgattttactcagcagctcgataaagccgagaaagatccggaagaaggggggatgcgtcctaaccagatggtgctgaccagcatcgactgtccaacctgtggccgtaaaatgggaattcgtactgccagtacgggagttttccttgggtgttcaggttatgcgctttcgccgaaagagcgttgtaaaacgaccattaacctggtgccggaaaatgaagttctgaacgtgctggaaggcgacgacgccgaaaccaacgccctgcgcgccaagcgtcgctgtcagaagtgcggtacggcgatggacagctatctgatcgatccgaagcgtaaattgcatgtgtgtggtaataacccgacctgtgacggctacgagattgaagaaggcgagttccgcatcaaagggtatgacggcccgatcgttgagtgtgagaaatgtggttccgaaatgcaccttaaaatggggcgttttggtaagtacatggcctgtactaacgacgaatgtaaaaatacccgtaagatcttgcgtaacggcgaagttgcgccgccgaaggaagatcctgttccattaccggaactgccgtgtgaaaaatcggacgcgtactttgtgctgcgcgatggcgccgcagggatattcctggcggccaatacgttcccgaaatcacgtgaaacgcgcgcgccattagtcgaggagctttaccggttccgcgatcgcctgccggaaaaactgcgttatctggcggatgcgccgcagcaggatccagaaggcaataaaaccgttgttcgctttagccgcaaaacaaaacagcagtacgttgcggcggaaaaagacgggaaggcgacgggatggtcagcgttcttcgtcgacggtaagtgggttgaaggcaagaaataa

SEQ ID NO: 1378 - DNA, 2598 bp, Salmonella enterica serovar Dublin CT 02021853
atgggtaaagctcttgtcatcgttgagtccccggcaaaagccaaaacgatcaacaagtatctgggtaatgactacgtggtgaaatccagcgtgggtcatatccgtgatttgccgaccagtggctcagcagctaaaaagagcgccgactctacctccaccaaaacggctaaaaagcccaaaaaggatgaacgtggcgctctcgtcaaccgtatgggggttgacccgtggcacaactgggatgcgcactatgaagtgctgcccggtaaagagaaggtcgtctctgaactgaaacagttggcggaaaaagccgaccacatctatctcgcaaccgaccttgaccgcgaaggggaagccattgcatggcacctgcgggaagtgatcggcggcgatgacgcgcgctacagtcgcgtagtctttaacgaaataaccaaaaatgccattcgccaggcgtttgaacagccgggcgagctgaacattaacagggtcaacgcccagcaagcgcgccgctttatggatcgcgtggtaggctatatggtctcgccgctgctgtggaaaaagatcgcccgtggtttgtcggcaggtcgcgttcagtctgtcgcggtccgtctggtcgttgaacgcgagcgcgagattaaagcgtttgttccggaagagttctgggaaattgacgctaatacgacgacgccgtctggcgaggcgctaccgctacaggtcacgcatcagaacgacaagccattccggccggtaaatcgcgagcagacgcttgctgcggtgagcctgctggaaaaagccagctatagcgtgctggagcgagaagacaagccgaccagcagcaagccaggcgcgccgtttatcacctccacgctacaacaggcggccagcacccggctgggctttggcgtgaagaaaaccatgatgatggcgcagcgtctgtatgaggcgggctacatcacctatatgcgtacagactccaccaacctgagtcaggatgcggtcaacatggtgcgcggctatattggcgataatttcggcaagaaatacctgccggataacccgaaccagtacgccagcaaagaaaactctcaggaagcgcacgaagcgatccgtccttccgacgttgcggtcatggcggagtcgctgaaagacatggaggctgacgcgcagaagttgtatcagctaatttggcgtcagtttgtcgcctgtcagatgacgccagcacaatatgactccactacgcttaccgttggtgcaggcgagttccgtctgaaagcgcgtgggcgtattttgcgctttgacggctggacaaaagtgatgccggcgctgcgtaaaggcgatgaagatcgcacattgcctgccgtgaataagggcgatgcgctgacgctacttgaattgacgcctgctcagcactttactaaaccgccagcccgtttcagcgaggcttctctggttaaagagcttgagaagcgcggtattggtcgtccgtctacctatgcgtcgattatctcgaccattcaggatcgcggctatgttcgcgttgaaaaccgtcgcttctatgcggaaaaaatgggtgaaatcgtcaccgatcggctggaagaaaacttccgcgaattgatgaactacgattttactgcgcagatggaagatagtctggatcaggttgcgaatcaccaggccgagtggaaagcggtactggataacttcttcagcgattttactcagcagctcgataaagccgagaaagatccggaagaaggggggatgcgtcctaaccagatggtgctgaccagcatcgactgtccaacctgtggccgtaaaatgggaattcgtactgccagtacgggcgttttccttggatgttcaggttatgcgctttcgccgaaagagcgttgtaaaacgaccattaacctggtgccggaaaatgaagttctgaacgtgctggaaggcgacgacgccgaaaccaacgccctgcgcgccaagcgtcgctgccagaagtgcggtacggcgatggacagctatctgatcgatccgaagcgtaaattgcatgtgtgtggtaataacccgacctgtgacggctacgagattgaagaaggcgagttccgcatcaaagggtatgacggcccgatcgttgagtgtgagaaatgtggttccgaaatgcaccttaaaatggggcgttttggtaagtacatggcctgtactaacgacgaatgtaaaaatacccgtaagatcttgcgtaacggcgaagttgcgccgccgaaggaagatcctgttccattaccggaactgccgtgtgaaaaatcggacgcgtactttgtgctgcgcgatggcgccgcagggatattcctggcggccaatacgttcccgaaatcacgcgaaacgcgcgcgccattagtcgaggagctttaccggttccgcgatcgcctgccggaaaaactgcggtatctggcggatgcgccgcagcaggatccggaaggtaataaaaccgttgttcgctttagccgcaaaacaaaacagcagtacgttgcggcggaaaaagacgggaaggcgacgggatggtcagcgttcttcgtcgacggcaagtgggttgaaggtaagaaataa

SEQ ID NO: 1379 - DNA, 2607 bp, Dickeya dadantii Ech703
atgggtaaagctctcgttatcgtcgagtccccggcaaaagccaaaacgattaataagtaccttggcaatgactacgtggtgaaatccagcgtcggccatgtgcgcgatttgccgaccagtggatctgccagtaagaagagtgctgaggccggcgaagaaaaagaaaagaagaaagcggcgaaaccggtgaaaaaggatgaaaagtccgcactggtgaatcgcatgggggtcgatccttatagtggctggaaagcgcactatgaaatcctacccggtaaggaaaaagtcgtctccgagctgaaagcgctggcgcagaatgccgatcatgtctatctcgcaaccgaccttgaccgcgagggagaggcgattgcctggcacttgcgggaaattattggcggcgatgataaacgcttcagccgtgtggtttttaacgaaatcaccaaaaatgccatccgtcaggcgttcgagcagccgggtgaattgaataccgcccgggtgaacgcgcagcaggcgcgtcggtttatggatcgcgtcgtcgggtatatggtttctccgctgctgtggaagaaaattgcccgcgggttgtccgccggtcgtgtacagtcggtggcggtgcgtctggtcgttgagcgtgaacgcgagatcaaagcgtttgtaccggaagagttctgggaactgcatgccgatctgctgacgggggatgtcgcgctgcaaatgcaggtgactcatcacaacgataaaccgttcaaaccggtgaatcaggcgcagacgcaggctgcggtaagcttgctggaaagagcgcgttacgtggttgtcgagcgggaagacaaaccgaccagcagtaagcccggcgcgcctttcattacctcgacgttacaacaggcagccagtacccgtctggggttcggcgtcaagaaaaccatgatgatggctcagcgtctgtatgaggcgggctacattacctatatgcgtaccgattccaccaacctcagccaggatgcgctgagtatggcgcgtgattatatcggtcatcaattcggcaagcgctatctgccggaaaccgccaatttatatgccagcaaggaaaactcccaggaagcgcacgaagcgatccgtccttccgatgtcactgtgctgtctgagcagctgggcgatatggaaaccgatgctcaaaagctgtaccagttgatctggcgtcagttcgtggcctgtcagatgacacctgcacagtatgattccaccacgctggtggtcggcgcgggtgactaccagctgcgcgccaggggtcgcacgttgcgttttgatggttggaccagagtgatgtcggcactacgcaagagcgacgaagaccgtaccttgcccgccatcgaagtcggccagtcgctggaattggaaaaattgttgccgagccagcattttaccaagccgcctgcacgctacagcgaagcatcgttggtgaaagaactggaaaaacgcggcatcggccggccgtccacctatgcggccattatttccacaatccaggatcgtggttatgtgcgggtggaaaaccgtcgtttttatgctgaaaaaatgggggaaatcgtcaccgaccggctggaggaaaacttccgcgagttgatgagctacgatttcaccgcgcgtatggaaaacagtttagatctggtcgccaacaaccaggccgaatggaaagcggtgctggatgagttttttgctgaattcagcaaccagttggaaaccgccgaactggagccggagtccggggggatgaagcctaaccagatggtgttgaccagcatcgactgcccgacttgcggccgcaaaatggggattcgtaccgccagtaccggtgtgtttttgggctgttccggctatgcgctgccgccgaaagagcgctgcaaaacgacgatcaacctgatacccgaagcagaagtgctgaacgtgctggaaggggatgaggcggaaaccaatgctctgctcgcacgccgccgctgctccaaatgtggaacggcgatggatagctatctgattgataatcagcgcaagctccatgtctgtggtaataacccgtcctgcgatggctatgaaattgaagcaggagaattccgtctgaaaggatacgacggcccgatcgtcgagtgtgagaaatgcggttctgaaatgcacctgaaaatggggcgtttcgggaagtatatggcctgtactaacgacggttgcggtaatacccgtaagattctgcgtaatggcgaagtggctccgcccaaagaagatccggtgccgctgccggagctgccgtgcgagaagtctgacgcatattttgtgttgcgcgacggcgcggcgggtgtgtttttggcggcgaatacgttcccgaaatcacgcgaaacccgggcgccgctggtggaagagctggttcgtttccatgatcggttgccggagaagttacgctatctggcggaggcgccggttagcgatccgcaaggaaacaaaacgctggtgcgttttagccgcaaaaccaagcagcaatatgtcgcctcggaaaaggatggcaaggcgacgggatggtcggccttttttgttgacggcaagtgggtggagaacgtgaagtaa

SEQ ID NO: 1380 - DNA, 2604 bp, Dickeya zeae Ech1591
atgggtaaagctctcgttatcgtcgagtccccggcaaaggccaaaacgattaataagtaccttggcaatgactacgtggtgaaatccagcgtagggcatgtccgcgacttgccgaccagcggttcgggttccgcgagcaagaaaagcgctgaagccaatggcgagaaagcgaaaaaagcggtcaagaaagatgagaggaccgcgctggttaaccgtatgggggttgatccttaccgcggttggcaagcccattatgagatcctgcccggcaaggaaaaagtggtttcggaactgaaaatgctggcgcaaaacgctgatcacgtctatctcgcaaccgaccttgaccgcgaaggggaagccattgcctggcacctgcgggaaattatcggtggggatgaaaaacgcttcagtcgcgtggtgttcaacgaaatcaccaagaatgcgattcgtcaggcgttcgagaatccgggcgagttgaacatcaaccgtgtcaacgctcagcaggcgcgccgtttcatggatcgcgtggtgggatacatggtatcgccattgctgtggaaaaagatcgcccgaggtttgtctgccgggcgtgttcagtcggttgcggtgcgcctggtggtggagcgcgagcgtgaaatcaaagcgtttgtgccggaggagtactgggagttacatgccgatctgctggcgaatgcagaaacggcgttgcagatgcaggtaacgcatcatcatggtaaacctttccggccggtgaatcaggcgcagacgcaagccgcggtcagcctgctggagaaagccagctatgtggtgaacgagcgggaagataagccgaccagcagcaaaccgggcgcgccgtttattacgtcgacattgcagcaagccgccagtacgcgtctcgggtttggggtgaaaaaaaccatgatgatggcgcagcgattgtatgaagccggccacatcacctatatgcgtaccgactcaactaacctgagtcaggatgcgctgtcgatggcacgtgattatattcagggcgagtttggtaaacgctacctgccggatgcgccgaatctctataccagcaaggaaaattcacaggaagcgcacgaagcgatccgtccttccgacgtcagcgtactggctgaccagctcaaagacatggaagccgatgcgcagaaactgtatcaactgatctggcgccagttcgtcgcgtgtcagatgacgccggcgcagtatgactccactacgctggtcgtgagtgcggcggattatcaactgcgcgccaaagggcgtaccctgcgctttgacggttggaccaaagtgatgcctgcgttgcgtaagagcgatgaagataggaccttgccggctgtggagataggacaatcgttatctctggaaaaattgtcgcccagccagcactttaccaagccgccggcccgttacagcgaagcgtcgctggtgaaagaactggaaaaacgcggtatcggccgtccttctacctatgccgccatcatctctacgattcaggatcgtggttatgtgcgggtggaaaatcgtcgtttttatgcggaaaaaatgggagaaatcgtcacggaccgtctggaggataacttccgcgagctgatgaactacgattttaccgctcgtatggaaaacagcctcgacctggtcgccaacagtcaggcggaatggaaagcggtactggatgagttcttcgccgagttcagccagcaactggaaaccgccgagcaggagccggacgaaggcgggatgaagccgaaccagatggtgctgaccagcattgattgtccgacttgtggtcgcaaaatggggattagaaccgccagtaccggtgtgttcctggggtgttccgggtatgcactgccgccgaaagagcgctgcaaaaccaccatcaacctgatcccggaagcggaagtgttgaacgtgctggaaggcgatgaggcggaaaccaacgcattgcgtgctcgtcggcgttgttcgaagtgcggtacggcgatggacagctatttgattgataaccagcgcaagctacatgtttgtggtaataacccatcttgcgacggctacgagatagaacaaggcgaattccggcttaagggttatgacggcccggtggtggaatgtgagaagtgcggttcggaaatgcacctgaaaatggggcgtttcggtaaatacatggcttgtaccagcgacagttgcggcaatacccgcaaaattctgcgtaatggtgacgtcgcgccgccgaaagaagacccggtgccgctgcctgaattgccgtgtgaaaaatccgatgcgtattttgtactgcgtgacggtgcggcgggggtattcctggctgccaacaccttcccgaaatcacgcgaaacccgtgcgccgttggtggaagagctggtgcgttttcgtgatcgcttaccggaaaaactgcgttatctggctgatgcgccggtcacggacccgcaaggcaataaaacgctggtacggtttagccgcaaaaccaaacagcagtacgtttcctcggaaaaagagggtaaagcgaccggatggtcggcgttctatgttgataataaatgggtagagactgcccgttga

SEQ ID NO: 1381 - DNA, 2601 bp, Pectobacterium carotovorum PC1
atgggtaaagctctcgttatcgtcgagtccccggcaaaagccaaaacgatcaataagtatttaggcaatgactacgtggtgaaatccagcgtcggtcatgtacgcgatttgccgacgagtggctcagtcagtaaaaagagcgcggactcaacgactaaagataaaacgaaaaagaaagtcaaaaaggatgaaaaatccgcgctggttaatcgtatgggcgtcgacccttaccatggctggcaagccaactacgaaatactgccgggtaaggagaaggttgtctccgaattaaaaacgctggcggaaaatgccgaccacatctatctcgcaaccgaccttgaccgcgaaggggaagccattgcctggcacctgcgggaaatcattggtggtgaagatgagcgtttcagtcgcgtggtgtttaacgaaatcacgaaaaatgccattaaacaggcgtttgaaaaaccagacacgttgaatattgaccgcgttaatgcacagcaggcacgtcggtttatggatcgcgtggtgggttacatggtatccccgctgctgtggaaaaaaatcgcccgtggcctgtccgccggacgcgtgcagtcggttgcggttcgcctgattgtcgatcgcgaacgcgagatcaaggcgtttgtgccggaagaatattgggaactgcacgccgatttactggcaggcagcgatattcaactgcaaatgcaggtaacgcaccacagcggcaagccgtttaaaccggttaataaagaacaaacacaggctgcggttagcctgcttgaaaacgcccgctatgtggttgccgatcgtgaagataaaccgaccagcagcaaaccgggcgcgccgttcattacctcaacgctgcaacaggccgccagtacacgccttggctttggcgtgaaaaaaaccatgatgatggcacagcgtctgtatgaagcgggctacatcacttacatgcgtactgactcaacgaacctcagtcaggatgccttgacgatggtgcgtggctatattggcgaagaattcggcaagcgttatctgcccgaatccgcgaatctttacagcagcaaagaaaactctcaggaagcgcacgaagcgattcgtccttccgatgttggcgtgctggccgacagcctgaaagatatggaaaccgatgcgcagaagttgtatcagttgatttggcgtcagttcgtcgcctgtcaaatgacgcctgcgcaatacgactccaccacgttaatcgtggaagcggccgattatcaactgcgtgcgaaaggccgtacgctgcgtttcgatggttggacgaaagtcatgcctgcgctgcgtaaaaatgatgaagaccgcacattgccaaccgtggcggtgggcgaagcgctgtcactgcagaaactgctgccaggacaacacttcactaaaccgcctgcgcgttacagcgatgcctcactggttaaagaactggaaaaacgcggtattggccgtccgtctacctacgcgtctattatttcaaccattcaggatcgcggctatgtccgagtggagaaccgccgtttctacgccgagaagatgggcgaaatcgttaccgatcgactggaagaaaacttccgcgaattgatgaattacgatttcaccgcgcggatggaaagccgtctcgatcaggttgccaataatcaggcggaatggaaagcggtgttggatgagttcttcaacgaattcagccagcagttggaaaaggcagagcaggatccggaagaaggcggcatgcgccccaatgcgatggtgttgaccagcattgactgtccgacgtgctctcgccaaatggggattcgtaccgccagtaccggggtgttcctaggctgttccggttatgcactgtcgccgaaagagcgctgcaaaaccacgatcaacctgataccggaaaacgaagtgctgaacgtgttggaaggcgatgatgctgaaaccaatgcgctgcgtgcccgtcgtcgctgtgaaaaatgtggtacggcgatggacagctacctgattgataatcagcgcaagctgcacgtttgcgggaataacccagcctgtgacgggtatgagatcgaaaccggcgaattccgcatcaaaggctatgatggcccgattgttgagtgcgaaaagtgtggttccgagatgcatctcaaaatgggacgcttcggtaaatacatggcgtgcaccagcgagacgtgctctaacacgcgtaagatcttgcgtaatggcgatgttgcgccaccgaaggaagatccggtgccgttgcctgagctgccttgcgagaagtccgatgcttatttcgtgttgcgtgacggtgcagcaggggtgttccttgccgctaatacgttcccgaaatctcgcgaaacgcgggcaccgctggtagaagaattagtgcgcttcaaggatcgtctgccagaaaaactgcgctatttggcggaagcgccagtggtcgataaagatggcaacaagacgcaggtgcgtttcagccgtaagaccaaacagcaatatgtctcgtcagaaaaagacggcaaggcaacgggctggtcagcgttctatatcgatggcaaatgggttgaaggcaagaagtaa

SEQ ID NO: 1382 - DNA, 966 bp, Escherichia coli BL21 (DE3)
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggcctgggtgccattcttgcggtgaagaagaggttgccgccattacgcgtgtttcgtaagccacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccagtctggtcgagatatttacaaagctcactgattacacctggggagtcatctttggggtcggtgcggcgacagtttgggtgagttatggcgtggcgcaaaaggttttattgcgtcggctggcctcaccgcagatcctgtttttgctgtacactttatgtacaatcgcgctcttccctctggcaaagcctggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 1383 - DNA, 921 bp, Haemophilus somnus 129PT
atgaaacagaaaccattactcgggtttatatttgcattgactactgcgatagcttggggatctttacctattgcattacaacaagttatgaatgctatgagtatgcaaactatcgtttggttcagatttatggttgctactgttgcattagctattttacttaaattagcgaacagattacctaaattatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatttttaaagaaaagttaggattacatcaaaaaattggtttagttattctaattattggacttatcttatttttcaatgagcgagcggagcaattatttgatattaacatctattctataggcgtatttttaagtatgtcggcatccttgatttgggtaacttacggactcgcacaaaaattacttttacgccgttttaactctcaacagattttattgatgatttatacagggtgtgcatttgtttttactccttttgttgagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttag

SEQ ID NO: 1384 - DNA, 966 bp, Enterobacter sp. 638
atgaaacagcaggcaggcatcggtattcttttggcactcactacggcggtgtgctggggagcgttgcccattgccatgaagcaggttctggaagtcatggaaccgcctacggtagtgttttatcgctttttaatggccagtattggccttggcgcgattctggcgataaaaggaaaacttccgccattgcggatttttcgtaaaccgcgttggctgattctcctggctatcgcaacggctggcctgttcggtaacttcattctgttcagttcttctctgcaatatttaagccccaccgcatcacaggtcattggtcagctttcgcctgtgggcatgatggttgccagcgtgtttatccttaaggagaagatgcgtgtcacgcagatagtgggtgcaagtatgttgttatgcggtctggtgatgtttttcaacaccagcctgatcgagatttttacccgcctgacggattacacctggggtgtgattttcggtgttggggcagcaacggtctgggtgacatatggtgtcgcgcaaaaggtgttattgcgcaggctcggctcaccgcagattctctttttattgtacactttgtgtacaatagcattattgccgttagcaaaaccgggtgttattacccagctcagcgactggcaactggcgtgtctcattttttgtgggcttaacacgctggtcggttatggcgcgctggccgaagcgatggcgcgctggcaagcagcacaagtgagtgcattaattacgctcacgccgctttttacgctgttattttcagatttattatcaatggcctggcccgatttcttcgtcaaaccgatgttaaacctcttgggatatctcggtgcgtttgtcgtggttgcgggcgcgatgtattccgccattggtcatcgtctttggggacgttggcgcaaaaatgaagcggttgtagttgtcccccgctcaggcgaatga

SEQ ID NO: 1385 - DNA, 987 bp, Yersinia pseudotuberculosis IP 31758
atggatacgaaacagcaggctggtttaggtatttttctggcactaaccactgccgtattctggggtgctttgccgattgcaatgaagcaagtacttgaggttatggagccgtttaccatcgtctggtatcgcttcatgatggcggcgattggcctggggattatcctggcttcacgtcgtcagcttccctctcttaaactttttcgccaacgtcgctggctagcattactgatcattgcgacctgtggcttgctggggaatttcatcttcttcagttcatcattacaatatctaagtccgacgacgtcccaggtcattgggcaactctcgccagtcgggatgatggttgccagtgttctggttctaaaagagcggatgcgtatcacccaagtgattggtgcgggtatgctgatttgtggtctattgttattttttaacaccagcctacatgaaatttttacccgcctgacggattatacccttggcgttgcattgggcgtctgtgcagcggtagtctgggtaagttatggtgttgcccagaaggtgctattaaggcgtatggcatcgcaacaaattctattattgctgtacactttatgtgcgattgcattgtttccactggcgaaacctgctgtcatttttcagcttagcgggtggcagtttgcctgtttactgttttgtggtgttaataccttggtaggctacggtgccttggctgaagctatggcacgctggcaggcagcgcaggtaagcgcactcatcacattgacgccattgtttaccttgtttttttcaattttattggcgctggcttggccagatatgtttgccgcaccgtccctcaaccttgtcgggtacgcaggtgcattcgtggtggtggcaggtgcaatgttttccgcaattggtcaccgttggtggccacgtcggacagaaataaacctggttgctttgcaaaagcagccggtgaatgatttacggagaaagtaa

SEQ ID NO: 1386 - DNA, 966 bp, Escherichia coli HS
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggcctgggtgccattcttgcggtgaagaagaggttgccgccattacgcgtgtttcgtaagccacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccagtctggtcgagatatttacaaagctcactgattacacctggggagtcatctttggggtcggtgcggcgacggtttgggtgagttatggcgtggcgcaaaaggttttattgcgtcggctggcctcaccgcagatcctgtttttgctgtacactttatgtacaatcgcgctcttccctctggcaaagcctggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 1387 - DNA, 966 bp, Escherichia coli E24377A
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggccttggtgccattcttgcggtgaagaagaggttgccgccattacgcgtgtttcgtaagccacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccagtctggtcgagatatttacaaagctcaccgattacacctggggagttatctttggggtcggtgcggcgacggtttgggtgagttatggcgtggcgcaaaaggttttattgcgtcggctggcctcaccgcagatcctgtttttactgtacactttatgtacaattgcgctcttccctctggcaaagcctggagtgatagcgcagcttagccactggcagctcgcatgtttaattttttgcggactgaatacattggtaggatatggcgccctggcggaagcgatggctcgctggcaggcagcgcaggtgagcgcgatcatcacgcttaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 1388 - DNA, 1005 bp, Serratia proteamaculans 568
atgcatcggcccgtcagcgctggcaaaggtaagatggaaacaaaacagcaggtcggaattggcatttctctggcggtgactacggcagtttgctggggcgcattgccgattgcgatgaaagaagtgctggtagtgatggatccgtttaccatcgtttggtatcgatttaccatggctgcacttgggttggggctgattttggccgtgcgcggcaagttgccgccggtgaccctgttccgtcaaccgcgctggttgttgattctggccatcgccaccgcaggcctgctggggaattttattttcttcagctcttcgctgcagtatctcagcccgacagcatcacaggtgatcggccagttatcgccggtcggcatgatgtttgccagtgtgctgattttaaaagagcggatgcgcatcactcaggtgattggcgcgctgatgctgatctgcgggttgctgttgtttttcaacgtcagcctgattgagattttcacccgcctgacagattacacccttggggtgctgctgggtgtgtgtgcggcaatggtctgggtcacttatggcgttgcgcagaaagtgttgctgcgtcgattagcctcgccgcaaattctggtaatgttgtacactttatgtgcagtggcgttatttcctctggccaggccggaggggattttccagctcagcggctggcaattagcctgtttgctgttctgtggtgccaacacgttgattggttatggtgcgctggctgaagcaatggcgcgctggcaggcggcacaggtgagtgcgttagttacgctgacaccgctgtttaccctgcttttttcagatttattggcgctggcctggccacacgtattcgccgccccgaccttaaatgtcgtcggctatgtcggtgctttcgtagtggtagcgggcgccatgttttccgcaattggtcaccgttggtggccgcgacgggcagaaccccgcctggttgctcctttgaagcagcccggtgaatga

SEQ ID NO: 1389 - DNA, 966 bp, Escherichia coli C ATCC 8739; identical to SEQ ID NO: 1386

SEQ ID NO: 1390 - DNA, 966 bp, Escherichia coli SMS 3 5
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggccttggtgccattcttgcggtgaagaagaggttgccgccattacgcgtgtttcgtaagccacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccagtctggtcgagatatttaccaagctcaccgattacacctggggagtaatctttggggtcggtgcggcgacggtgtgggtgagttatggcgtggcgcaaaaggttttattgcgtcggctggcctcaccgcagatcctgtttttactgtacactttatgtacaattgcgctcttccctctggcaaagcctggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 1391 - DNA, 966 bp, Shigella boydii CDC 3083 94
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggcctgggtgccattcttgcggtgaagaagaggttgccgccattacgcgtgtttcgtaagctacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccactctggtcgagatatttacaaagctcactgattacacctggggagtcatctttggggtcggtgcggcgacggtttgggtgagttatggcgtggcgcaaaaggttttattgcgtcggctggcctcaccgcagatcctgtttttgctgtacactttatgtacaattgcgctcttccctctggcaaagccaggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccaccattggtcatcgtatttggggcggattacgtaagcatacaacggtggtatcgcaaccccgcgcaggcgaatga

SEQ ID NO: 1392 - DNA, 966 bp, Salmonella enterica serovar Newport SL254
atgaagcagcaggcaggcattggcattcttttagcgctcactaccgcgatgtgctggggagcgttgccaatagcaatgaagcaagtgctggaggtgatggagccttcaaccattgtcttctaccgcttcttaatggccagtattggcctcggggcgatactggcagtaaaaagaaagctgccgccgctgcgtatttttcgtaagccgcgttggttggtgttattggcgatagcgacctgcggactgttcggtaatttcattttgttcagttcttccctgcaatatttaagcccaaccgcgtcgcaggttatcggccagctctcgccggttggcatgatggtcgccagcgtctttattctgaaagaaaagatgcgcggtacgcaggtgattggcgcgctgatgttattgagcgggctggtgatgttttttaacaccagtctgatcgagatttttacccgactgaccgactacacctggggcgttatttttggcgtaggcgcggcgatggtgtgggtgagctatggcgtggcgcaaaaagtattattgcgacgtctggcctcgcagcagatcctgtttttactgtacactttatgtacgatagcgctcttgccgctggcaaaaccgatggtgatagcgcaactgagcgactggcagctcgcctgtttgattttctgcgggctaaatacgctggtaggatatggcgccctggcggaagcgatggcgcgttggcaggcggcgcaggtgagcgcgataatcacgcttacaccgctatttaccctgctgttttcagatcttttatctatggcctggcccgatttcttcgccagaccgatgttaaaccttttaggttatctcggtgcgtttgtcgtggttgcgggcgcgatgtattccgccattggtcatcgtatttggggcggtttacgcaagcatgaaacggtggtttcgcaaccccgctcaggcgaatga

SEQ ID NO: 1393 - DNA, 966 bp, Salmonella enterica serovar Heidelberg SL476
atgaagcagcaggcaggcattggcattcttttagcgctcactaccgcgatgtgctggggagcgttgccaatagcaatgaagcaagtgctggaggtgatggagccttcaaccattgtcttctaccgcttcttaatggccagtattggcctcggggcgatactggcagtaaaaagaaagctgccgccgctgcgtatttttcgtaagccgcgctggttggtgttattggcgatagcgacctgcggactgttcggtaatttcattttgttcagttcttccctgcaatatttaagcccaaccgcgtcgcaggttatcggccagctctcgccggttggcatgatggtcgccagcgtctttattctgaaagaaaagatgcgcggtacgcaggtgattggcgcgctgatgttattgagcgggctggtgatgttttttaacaccagtctgatcgagatttttacccgactgaccgactacacctggggcgttatttttggcgtaggcgcggcgatggtgtgggtgagctatggcgtggcgcaaaaagtattattgcgacgtctggcctcgcagcagatcctgtttttactgtacactttatgtacgatagcgctcttgccgctggcaaaaccgatggtgatagcgcaactgagcgactggcagctcgcctgtttgattttctgcgggctaaatacgctggtaggatatggcgccctggcggaagcgatggcgcgttggcaggcggcgcaggtgagcgcgataatcacgcttacaccgctatttaccctgctgttttcagatcttttatctatggcctggcccgatttcttcgccagaccgatgttaaaccttttaggttatctcggtgcgtttgtcgtggttgcgggcgcgatgtattccgccattggtcatcgtatttggggcggtttacgcaagcatgaaacggtggtttcgcaaccccgctcaggcgaatga

SEQ ID NO: 1394 - DNA, 966 bp, Salmonella enterica serovar Schwarzengrund CVM19633
atgaagcagcaggcaggcattggcattcttttagcgctcactaccgcgatgtgctggggagcgttgccaatagcaatgaagcaagtgctggaggtgatggagccttcaaccattgtcttctaccgcttcttaatggccagtattggcctcggggcgatactggcagtaaaaagaaagctgccgccgctgcgtatttttcgtaagccgcgctggttggtgttattagcgatagcgacctgcggactgttcggtaatttcattttgttcagttcttccctgcaatatttaagcccaaccgcgtcgcaggttatcggccagctctcgccggttggcatgatggtcgccagcgtctttattctgaaagaaaagatgcgcggtacgcaggtgattggcgcgctgatgttattgagcgggctggtgatgttttttaacaccagtctgatcgagatttttacccgactgaccgactacacctggggcgttatttttggcgtaggcgcggcgatggtgtgggtgagctatggcgtggcgcaaaaagtattattgcgacgtctggcctcgcagcagatcctgtttttactgtacactttatgtacgatagcgctcttgccgctggcaaaaccgatggtgatagcgcaactgagcgactggcagctcgcctgtttgattttctgcgggctaaatacgctggtaggatatggcgccctggcggaagcgatggcgcgttggcaggcggcgcaggtgagtgcgataatcacgcttacaccgctatttaccctgctgttttcagatcttttatctatggcctggcccgatttcttcgccagaccgatgttaaaccttttaggttatctcggtgcgtttgtcgtggttgcgggcgcgatgtattccgccattggtcatcgtatttggggcggtttacgcaagcatgaaacggtggtttcgcaaccccgctcaggcgaatga

SEQ ID NO: 1395 - DNA, 966 bp, Salmonella enterica serovar Agona SL483; identical to SEQ ID NO: 1393

SEQ ID NO: 1396 - DNA, 966 bp, Escherichia coli O157 H7 EC4115
atgaagcagcaggcaggcattggcattcttttggcgctcaccacagcaatttgctggggggcgttgccaattgcaatgaagcaggtgctggaggtgatggaacctccgacaatcgtgttttaccgtttcttgatggcgagtattggcctgggggccattcttgcggtgaagaagaggttgccgccattacgcgtgtttcgtaagccacgctggttgattttgttggcagtggcgaccgccgggctgtttgggaacttcatcctgttcagctcatccttgaaatccctgagtccgaccgcttcgcaggtgattgggcaactctcgccagttggcatgatggttgccagcgtatttatcctgaaagagaaaatgcgcagcactcaggttgtaggggcattgatgctcctgagcggcctggtgatgttttttaacaccagtctggtcgagatatttacaaagctaaccgattacacctggggagttatctttggggtcggtgctgcgacggtttgggtgagttatggcgtggcgcaaaaggttttattgcgtcggctggcctcaccgcagatcctgtttttactgtacactttatgtacaattgcgctcttccctctggcaaagcctggagtgatagcgcagcttagccactggcagctcgcatgtttaattttttgcggactgaataccttggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 1397 - DNA, 921 bp, Dickeya dadantii Ech703
atgaaacagaatgctggcatcggattgagcctggcattgaccactgctgtatgctggggcgcattgccaatagcgatgaagcaagttttggccaacatggagccctataccgtagtttggtatcgtttcgtgattgcgtccgttggtctgtggctgtttcttcgtgccaaaggtaatttgccgactgttaggttgtttaatcatcagcgttggtggattttgctgtttatcgctactggaggactgttgggaaacttcatgctgttcagctcatcgctgcgctacttgagcccaacaacttcacaggttatcggtcagttatctcctgtcggaatgatgattgccagtgtttttattctgaaagagaggatgcgtctaaatcaggtcatcggtgtaatcatcttaatttctggcctggtgatgttttttaactccagtttggttgaaatacttactcggcttactgattatactttgggcgtattactgggtatggcggctgccacagtctgggtatcttatggtgtggctcaaaaagtgttgcttcgacggttatcgtcgcaacaattgttgtttctgttatatgcgctatgcgctctctgtattactccgctggcaaagccgtgggcaatttttcaattaagcaactggcaactggtttgtttgttgttttgcggaatcaatacgctggtcggatatggtgcgctggctgaagctatggcacgttggcaggctgctcaggtaagtgccattattacccttaccccactatttaccttatttttctcagatattctggcgcttgtctggccttctgtttttgcgtcacttgagctgaatccgcttggttatataggggcgtttgttgttgtagctggggccatgttttcggctattgggcaccgtattatcgggcggtaa

SEQ ID NO: 1398 - DNA, 945 bp, Dickeya zeae Ech1591
atgaaacagaatgctggcatcgggttttgtctggcgctgaccaccgccatatgctggggggcgctgccaatcgcgatgaaacaggttctggtagcgatggagccttataccatcgtctggtatcgctttttgattgcgtccgccgggttgggcatttttttgtacagcaaaggtgcgttgccaaagccacagatgttcgatcaccagcgttggtggattctgttgctggtagcgaccggtggattattaggtaatttcgtgctgttcagctcttcgttacaatatcttagtcctacggcgtcacaggtaatcgggcagttgtcgacggtggggctgatggttgccagtgtcgttattctcaaagagaagatgcgactgaatcaggtaatcggtgccgtagtactcatctgtgggttattgatgtttttcaatagcagcctggtagagctttttactcgtttgacggattacaccttcgggattttgctgggtgtggcggcatccaccgtatgggtggcttatggcgtagcacaaaaggtattgttgcgccgactcacctcacaacaattactgtttctgttatacacgctttgcgtgttgtttattacgccgctggctaaacctgaggtcgtgtttcaactgaccggctggcagttggcctgtttgctgttttgcggtgcgaatacgctggttggctacggcgcattggcggaagcgatggcccgctggcaagctgcgcaggtgagtaccattattacgctgacgccgttgtttacgctgttcttctctgatttgctgtcattagcctggccatcgctatttgctgcaccatcgctgaatttattgggatatgccgggtcctttatagtcgtagcgggggcgatgtttgctgcgattggacatcgattaatcgcagcaaaacgcagcaaatatccacaggtatga

SEQ ID NO: 1399 - DNA, 963 bp, Pectobacterium carotovorum PC1
atgaatactaaacaacagacggggatcggtctttgtctggcgctgactacggctgtttgctggggggcgctgccgatagccatgaaacaggttctggtggttatggagccttatacgattgtttggtatcgctttattattgcttctattggactcggcattattctgtcatcccgtaagaatttaccgccaatgcgagtttttcggcatcgccgctggtgggttctgttgctgattgcaacggcggggttattaggaaattttgttttctttagctcgtctctgcaatatctgagtccgactgcgtctcaggtcatcggacagctttctcctgttggtatgatgttcgccagcgtacttatcctaaaggaaaagatgcgtggcacgcaggtcattggtgcgatcatgctgatctgtggcctgattctgttctttaataccagcctgattgagatatttacccgactgacggactacacactgggcgtactgctgggtgtttgcgcctcggcggtatgggtatcctatggtgtggcgcagaaggtgttattacggcgtctgacgtcgcagcagattctgtttctgctgtatgttctgtgtgttgtctttatcacgccttttgccaagcctgaagttattttccagcttagtgggtggcaacttatctgcctgctgttctgcggcgcgaatacattgattgggtatggcgcactagcggaggcgatggctcgctggcaggcatcgcaggttagcgcggtcattacgttaacaccgctatttacgctgttgttttccgatctcctggcgttaggatggccgactttttttgctgcgccagtactaaattgggtcggctatgtaggggcctttgttgttgttgcgggtgccatgttttctgctatcggacaccgtttcctccctggaaagaaagagcctgtgccaccattgatggtgaaaaagtaa

SEQ ID NO: 1400 - DNA, 1128 bp, Escherichia coli BL21 (DE3)
atgcaaagcgttaccccaacatcgcaatacctgaaggcgctcaatgaaggcagccatcaacccgacgacgttcaaaaagaggccgtcagccgcctggaaattatttatcaagaactcatcaatagcaggccaccagcccccaggacgagtgggctaatggcgcgggtcggtaagctgtggggtaaacgcgaagacacaaagcatacgccagtgcgtggcttatatatgtggggcggtgtaggacgcgggaaaacctggctgatggaccttttctatcaaagcctgccgggagagcggaaacagcgcctgcactttcaccgttttatgctgcgggtgcacgaagagctaactgccttacaggggcagaccgatccgctggaaattattgccgatcgctttaaagccgaaactgacgtgctctgttttgacgaattttttgtttctgatattaccgacgccatgctacttggcggtctgatgaaagccctgttcacccgcggtattaccctggttgcgacgtcaaatattccgccggacgaactttatcgaaatggcctgcaacgtgcgcgttttctgcctgcaatcgatgccattaaacagcattgtgatgtaatgaacgtggacgctggtgttgattatcgactgcgtacactcactcaggcgcatctgtggctttcgccactcaacgatgaaacccgggcgcagatggataaactatggttggcgctggcgggggcgaaacgagaaaattcaccgacgttagaaatcaaccatcggccattggcgacaatgggcgtcgagaaccagacgctggcggtctcttttactacgctgtgcgtcgacgcccgcagtcagcatgactatattgcgctctcacgtctctttcatacggtcatgttgtttgatgtaccagttatgacgcggttgatggagagcgaagcgcggcgctttattgcgctggtggatgagttttacgagcgccatgtcaaattagtggtgagtgcagaagtgccgctgtatgcaatttatcagggcgagcggctgaaatttgagttccagcgttgcctgtcacgtctgcaagagatgcaaagcgaagagtatctgaagcgcgagcatttagcaggttaa

SEQ ID NO: 1401 - DNA, 1116 bp, Colwellia psychrerythraea 34H
atgataaagctctctcctatagataagtataaacaagatttaaccagagatgattttctctttgatgcagcacaagaaaatgcggttattcacttacaacgtttatatgacgacttacaaagcaagccattagctgtttctggttttaaaaaagtacttaaccgttggaaaaaagtttataaaaaacaagagcaggagcctatcaaaggattatatttttggggaggtgtaggtcgggggaaaacatatttagttgataccttttttgagagcctacctttcaataataaaatgcgtgtgcactttcatcgttttatgcacagagtgcatcaagaactcaaaagtctgtctggacaatccgatccgctaaaaattattgctaagaaatttgcagatgaaacacaaattatctgctttgatgagttctttgtttctgatattaccgatgccatgattttaggcacattatttgaagagttatttgcgcataatgtcacgttagtagcgacatctaatattatccctgatgagttgtatcgcaatggtttgcaacgtgagcgctttttaccggctataaaacttatcaataagcatactctcattgttaatgtagatagtggtgttgattatcgtctaagaaccttagagcaagcggaaatctttcattatccacttgatgcccaagcagatgaaaatttaaagcactactttaagcaactctctacagatgaaggtaaatcagggcaatccattgagattcataaccgtccattaaaaactgttttagtgagtgatggcgtggtgtactttgacttctcagtactttgtgaaagtgcacgtagccaaggtgattatatggaaattagtcaactttatcacacggtattaatggctaatgttaaagaaatgggccctgatagcgatgacacaactcgccgctttattgcgttagttgatgaattctatgaacgtaatgtgaagttgattatgtcggcagagctgcctttagatgatttgtatagcggtggtcgtttagcctttgaatttaagcgttgcctaagtcgtttacaagagatgcaatctcatgactaccttgccagtgaacaccttccatag

SEQ ID NO: 1402 - DNA, 1182 bp, Saccharophagus degradans 2-40
atgcttacttggcgctttaaagtaccggctttatttggtttgtacgtggtagttggcaatatggatttacacgatagtcccctagttagatacgaaaaagatttactgcagcccggttttagtcgcgacccagcgcaggcgatggctgttgagcatcttcaatccttttacgagcgattattggccgcccataacaaggttgagcctcgttctttggttgcatcggtaaaatccttatttgttaaaccaaaaaatgagccggttaagggcctttatatgtggggcggtgtagggcgcggtaaaacctaccttatggatgtgttttacgatgcgttgccattcgagcaaaaaatgcgcacccactttcatagatttatgcgacgcgtacatgcagagctaaccaaaaacaaaggcaagcaagacccgctaaagctggtggcagacactattgccagtgaagcgaaggttatctgctttgatgagttctttgtggtcgatattaccgatgcaatgatattggggaatttgctgcaggagctgtttgctcgcggagtgtcgctggtggctacatctaatatagagccagacggcttgtataaagatggcttgcagcgggtgcgctttttgccggcaattgagcagctaaagaagtatgtggaagttgttaatgttgatgggggggtagattaccgcttgcgcgccttagagcaggctgcactttactatacgccgcttagcgacagcgcggatgagcagatgagcgcttgttttgaacgcttagtgcccgaccccttatcggtacggcgcgatgtgcacattgaggttggtggtcgcaaaattagagcgaaatgcgcggcagacgatgtggcgtggtttgacttcgatgctatttgcgatgggccgcgctcgcaaaacgattatatcgacctggcgtgtgagcatcacgcggtacttgtgtctggtgtgccggagttgggcgcgcgcaacgacgataaggctcgccgctttatttacttggtagatgagttctacgacaggaatgtgaaattaatactctctgccgaactgccaatagagaagctttacggtgcagggcgcctggagtttgaatttcagcgcactgtaagcagggtgttagagatgcaaagccatgaatacctatcgcgagcgcataaggcttaa

SEQ ID NO: 1403 - DNA, 1176 bp, Chromohalobacter salexigens DSM 3043
atgagtgccaccatgccaccgtcccggggcgcgtcgacgcccctggagaaataccgtcaggatctgcagcgcgacgactttcaatacgaccccggtcaggaagaagcggtcaagcacctgcagcgcctctacgatgagttgatgcaggcgccacgtcagtctccgagtgcgcccgcgtcatcgagcggcggtctcaagtccaaggtcgccaagctgttcggcaagccgtcggcgccttccccgttcgaagagccgccggcagtgctggggttgtacttctggggcggcgtgggacgcggcaagacgtatctggtcgacaccttctacgaaacgctgccgttcgccgacaagatgcgcacgcacttccatcgcttcatgcagcgcgtgcacaacgagctgacgcactacaagggcgagaagaacccgctgacgttgatcgcggccaaattcgcctcggaggcacgcgtcatctgtctcgacgagttcttcgtcaaggacatcaccgatgcgatgatcctggccaacctgctggaggccctgttcgcgcagggggtcgtgctggtcaccacatcgaacatcgtgcccgacgatctctacaaggacggccttcagcgggcacggttcatcccggccatcgacctgctcaagcgtcattgcgaggtcgtcaacgtcgattcgggagtcgattaccgcctgcgtgccctggagcaggtcaagatcttctatcatccgctgggcgacgaagccgagcacgcgctggagaaaagctttcgcgccatcgccggtgccgggggagagcccgatgccgacatccacgtcaaccatcgcgtcctgcccgcgcgccgcttgcacgaggatgtggtctggttcgagttccgtaccctgtgcgacgggccgcgaagccagaacgactacatcgagctgtcgcgcgagttccataccgtcttgctctccaacgtgccgcagatgagcgctcactcggaagaccaggcgcgtcgcttcatcaatctggtcgatgagttctacgaccgcggggtcaagctgttgctttctgctgcggtggccatcgagtcgctgtatacgcacggccagctggagttcgagttcgagcgcacgctgtcgcgtctccaggagatgcagtccaaggagtatctggcgttgccgcacaagccgtga

SEQ ID NO: 1404 - DNA, 1134 bp, Marinobacter aquaeolei VT8
atgactgcagctacgtcctccgataccgttgcgaacctgaccccttgggagcgttaccaaaaggatcttgaacgcccggattttcacaaggaccccgcccaggtagatgcagttcaacgcttgcaggcactgtacgataaattggtggctgctgaaaacgagcgcaacaaagggttggccaaactgcgccgcaaactcaagaagggccgggaagagccggttaaaggtctgtatttctggggcggcgttggccggggtaaaacctatctgatggacaccttttttgagtcgctgccattcgagcgcaagatgcgggtgcacttccaccgttttatgcagcgcgttcacaacgaattgaaagctttgaaaggggagaaaaacccccttgagatggtggctaaaaagtttgcggacgagacccgtgtcatctgtttcgacgagttctttgtttccgacattggcgatgccatgatccttgccacgctgatggatgggctttttggtcgtggtgttaccttggtgtgtacgtccaatatcgtccccgatggcctttataaagatggcctccagcgcgcgcggttcctgcctgccatcgagctggtaaagaagtacaccgatgtggtgaatgtggatggcggcgtggactatcgcctgcgtaccctggagcaggcagagctttatcactgtccgctggatgatgaggcggatatcagcttgcggaacagtttcgacgccctggccgtcgaagcggcgaagcacagtaaaaccatggaaatcaacggccgcaagattcccgcccaggcccacgcagacgatgtggtctggtttgacttcaaagacgtgtgtgacggcccccgaagccagaacgattacatcgaaatggcgcgccagttccacgccattatcgtcagcaatgtaccggtgcttggcggcgacaaggacgaccaggcgcgccgttttatcaacatgatcgatgagttctacgaccgcaacgtcaaggtcattatctccgctgcagcgcccatcaccgagctctattcgggcgggcgcctgagctttgaattcgagcgcacggaatcccggttgctggagatgcaatcccaagagtatctcgaagcgccccacaaaccataa

SEQ ID NO: 1405 - DNA, 1125 bp, Enterobacter sp. 638
atgcaaagcctgtctccaacatcgcgttaccaacaagccctggatgagggcactcaccagccagatgatgtgcagcgtgacgcggtaaatcgcctgaattctatctatcaaaaattgatgaccgaaccgactgaaacggcgcaaaccagcgggctgaaagccgcgtttgggcgactgttagggaaaaaatatccacagacggttcccccggttcgcggcttatatatgtggggtggtgtggggcggggcaaaacctggctaatggatatgttttatcaaagcctgccgggcacgcggaagcagcgtttgcacttccaccgctttatgctgcgcgtacatgaagagctcacggcgctgcaaggccacgccgatccgctggagattgtcgccgaccgttttaaagcggaaaccgacgtcctgtgctttgatgaattttttgtctccgatatcaccgacgccatgctgcttggcggcctgatgaaagcccttttcgcgcgtggtattacgctggtagcgacatcgaatattccgccagacgacctgtatcgtaacggtctgcaacgcgcacgtttcatgcctgcaatcgatgcgattaaagaacattgtgacatcatgaatgtggatgcgggtgtggattatcgtctgcgcacgctgactcaggcgcacctctggctgtctcctttaaacgagcagacacaaagccaaatggacaaactgtggctggcgctcgcgggcgctaagcgtgataaatcgcctgaactggaaattaatcatcggccattacagacgcttggggtcgaaaatcaaaccctggccgtgtctttcgcgacgctgtgcgtggatgcccgcagccagcatgattacattgcgctctcgcgtctgttccacaccgtgatgctgttggatgttccggtgatgacgccgctgatggagagtgaagcacgccgttttattgcgctggtggatgagttttacgagcgccacgtcaagctggtggtcagcgcggaaatgccgttatatgaaatttatcagggcgagcggctgaaatttgaattccagcgctgtttgtcacgcttgcaggaaatgcaaagcgaagagtatttgaagcgtgctcatatgccctaa

SEQ ID NO: 1406 - DNA, 1104 bp, Vibrio cholerae O395
atgactccgaagcagcgatacgaaaaagatttacaacgcactgatttttatagtgatgaagcacaggcacgtgccgtcgatgccttagataatttgtatcaccaatggctaaattacctcaatcagccagtggtacgaccttctgtatggcaaaagctcatcggtaagaagccaacagtgacgcaaccgccacaaggtctctatatgtggggaggtgtcggacgcggtaaaacctatcttatggatactttttttgaagccttgccgacagaaaagaagcttagggttcattttcatcgctttatgtatcgggtgcacgatgaattacgcactttatcagacgtcagtgatccgcttgaaattgtggctgatcgcttttgtgctgaggcaaacattatctgttttgatgagtttttcgtctcggatattaccgatgcgatgatccttggaactctgttcgaggccttatttagacgcggtatcgtattggtagccacttcgaatattgcccccaaggatttgtaccgcaatgggttacagcgagcccgattcctacctgcaattgcgttggtggaaatgcattgtcagatcctaaatgtagatagtggtgtcgattatcgtttgagaaccttacagcaagcggaaatttatcattaccctttagacagtaaagcgaccgataacctacagcgttacttccagcagttgatcagctcagagcagactccagagacgcagatcgacgtgaatcaccgaatgattacggttgaagcggcaggagacggagtattgtatgcgacctttgctcagttatgccaaacggcacgtagccaaaatgactatattgagctgtcgaaaatttatcacaccgtgctgctggcggatgtcaaacagatgaacaaaagtagcgatgatgccgcgaggcgctttattgcgctggtggatgagttttatgagcgacatgtaaagttaattatttctgctgaagtgccccttaccgatctgtataccgatggtttgttagaatttgaatttaaacgctgccaatcacgcttaattgaaatgcaaagtcatgattacttagcgaaggagcacttgggctga

SEQ ID NO: 1407 - DNA, 1101 bp, Marinomonas MWYL1
atgacacccattacacgttacaagcaagatttgactagaacagactttaattatgatccagctcaagaagaagcagtggaagcgcttcaggatttatttgaccgtttgattgcgaaccaagcagataaatccaccaatggtttcttggggcgcttcttgaaaaagaaagctccgactgttgagcagggattgtatttttggggtggagtaggtcgaggtaagacctatttaatggataccttctttgattgtttgcctactgaaaagaaaatgcgcctccattttcatcgctttatgcaaatggttcaccaagaacttcgtaagctgcatgacgttaaaaatccactggaaattgttggtaaggagatttcgtctaaagcaaaggtgctgtgttttgatgagttttttgtgacggacatcactgatgctatgattttagccggcttacttgaggtgttgtttgaaaatggcacgactttagtggcgacctccaacattgagccagacggtttgtataaaaacggtttgcagcgtgcgcgtttcttgccagcgattgatttggtgaaaaaatacaccaaagtaatgaatgttgatggtggcgtggattatcgcttaagaacgcttaaacaggccaagctttaccattacccacttagcaaagaagcggatgatgagttaaataatcgttttatgagtttgatctctgatgcttcgcatgttgtagagggcggggcggtagaaatagaaggtcgaaacattccgctattaagaagttgcgaggggatggcttggtttgatattaaagctttgtgtgatggtccaagaagtcaaattgattatattgaaattgcccgtctttacagcacagtcatcatttcaaatttgccacaaatggatgcttcgcgagacgatttagcgcgccgctttattaaccttgtggatgaattttacgatcgccacgtcaaggtgattttttcggcagaagtggctattccggaaatttataaaggtacacgtttagcctttgaatacgatcgtacagtaagtcgattgttagaaatgcaatcagaagagtatttgtctttagagcaccgcccttaa

SEQ ID NO: 1408 - DNA, 1128 bp, Yersinia pseudotuberculosis IP 31758
atgcaacagagttcacctataacgctttatcagcaggcacttgatgccggcggctatcaacctgatgatgtgcagcggcgtgctgtagcacggctagagacaatttatcaggcgctaaatcagtaccaaaatgtccctgcggccagtgcaagtttacgcaaccgcctgggccgtttatttgggaagccagctcgacgaccacccgtaagccccgttcaggggttatatatgtggggcggtgtggggcgggggaaaacctggctgatggacctgtttttccacagtttgccgggtgagcgcaaactccgcctccattttcatcgttttatgctgcgggtacatcaagaactgaccgagttacaagggcatgaaaatccattggaaattgttgctgatggtttcaaggcccagactgacgtactgtgttttgacgagttctttgtctcggatattaccgatgccatgttgttggcaacattattggaagcgctatttgccaggggcatcacactggtcgcgacgtctaatattccgccagataatctgtaccataacgggttacagcgcgggcgttttttacccgctatcgccttaattaagcaacattgtgaggtgatgaacgtggatgcgggtatcgattatcgtttgcggacattgactcaggctaatctttatctgaccccgttaaattcacagaccgaacaagcaatggcagcgattttcgttaaacttgcgggaaaagaggggggaaaggcaacggtgttggaggtgaatcaccggcctttgcctgcgatttgtgtggctgagggggtgctggcggttgatttccatacattgtgtgaagaagcgcgcagtcaactggattatatcgctttgtctaagcgctatcacacggtattgctccacaatgtccgttgcatggcggcccgcgatgagaacacggcacggcgttttctggccttggtagatgagttttatgaacgccgggtgaaactgattattgcggctgaagcctcaatgtttgagatttatagcggtgagcgccttaagtttgagtaccagcgttgtttatcgcgattacaagagatgcaaagcgaagagtacctttctttaccccatttaccttaa

SEQ ID NO: 1409 - DNA, 1104 bp, Vibrio harveyi ATCC BAA-1116
atgacaccattacaacgataccaacaagacatagcagagcatggattccagcgtgatgaagcccaatataacgctgtcgttgctttagataaactctaccatgcgattgcagaatttcagtctgcacctattccacagcttagcacttggcagaaacttctcggtaaaaagccagaaatgccagagccgccaaaagggttatatttttggggcggagtagggcgaggtaaaacctatttaatggatgcgttttttgatgctttgccgacggaaagaaagatgcgagtgcattttcaccgttttatgtatcgtgtgcacgatgagctcaaacgccttggagaagtggaaaatccgctctcgaaagtcgctgatttattcaaaaaagaggcggatattgtctgtttcgacgagttctttgtctcggatattaccgatgcgatgatcttggcgactttgctacaagagatgtttaagcgccaaatgattttggtcgcaacctcgaacattgagccagaaaacctgtaccgtaatggcttgcaacgagcccgttttttacctgcgataaatatgatcgttcagcgctgtgatgttctcaatgtcgacagtggggtggattaccgtttacgcactctacaacaagcggaaatctaccattacccgctggatgaacaagcctccgtcaaccttaataagtattaccaccaactgattggtgaaagaaaagttgcagcaaacagcattgaaattagccatcgcgaagtggcggtgattgaagctagtgatggcgtgctacatgcttcttttgagcaactatgccaaacgccccgtagtcagaatgactatattgaattatctcgtatctaccacacggtattgctggcagacgtaaagcagatggatcgtaagatagatgatgccgcgcgacgctttattgcgttggtggacgagttctacgagcgtaacgtcaaactgattatttctgcagaagtggcgatggaatccctttatacgcaagggcagttggaatttgagtttaaacgttgtctgtctcgattgaccgagatgcaaagccacgaatacctcgctagagagcatctggcgtaa

SEQ ID NO: 1410 - DNA, 1128 bp, Escherichia coli HS
atgcaaagcgttaccccaacatcgcaatacctgaaggcgctcaatgaaggcagccatcaacccgacgacgttcaaaaagaggccgtcagccgcctggaaattatttatcaagaactcatcaatagcaggccaccagcccccaggacgagtgggctaatggcgcgggtcggtaagctgtggggtaaacgcgaagacacaaagcatacgccagtgcgtggcttatatatgtggggcggtgtaggacgcgggaaaacctggctgatggaccttttctatcaaagcctgccgggagagcggaaacagcgcctgcactttcaccgttttatgctgcgggtgcacgaagagctaactgccttacaggggcagaccgatccgctggaaattattgccgatcgctttaaagccgaaactgacgtgctctgttttgacgaattttttgtttctgatattaccgacgccatgctacttggcggtctgatgaaagccctgttcacccgcggtattaccctggtagcgacgtcaaatattccgccggacgaactttatcgaaatggcctgcaacgtgcgcgttttctgcctgcaatcgatgccattaaacagcattgtgatgtaatgaacgtggacgctggtgttgattatcgactgcgtacactcactcaggcgcatctgtggctttcgccactcaacgatgaaacccgggcgcagatggataaactatggttggcgctggcgggggcgaaacgagaaaattcaccgacgttagaaatcaaccatcggccattggcgacaatgggcgtcgagaaccagacgctggcggtctcttttactacgctgtgcgtcgacgcccgcagtcagcatgactatattgcgctctcacgtctctttcatacggtcatgttgtttgatgtaccagttatgacgcggttgatggagagcgaagcgcggcgctttattgcgctggtggatgagttttacgagcgccatgtcaaattagtggtgagtgcagaagtgccgctgtatgcaatttatcagggcgagcggctgaaatttgagttccagcgttgcctgtcacgtctgcaagagatgcaaagcgaagagtatctgaagcgcgagcatttagcaggttaa

SEQ ID NO: 1411 - DNA, 1128 bp, Escherichia coli E24377A
atgcaaagcgttaccccaacatcgcaatacctgaaggcgctcaatgaaggcagccatcaacccgacgacgttcaaaaagaggccgtcagccgcctggaaattatttatcaagaactcatcaatagcaggccaccagcccccaggacgagtgggctaatggcgcgggtcggtaagctgtggggtaaacgcgaagacacaaagcatacgccagtgcgtggcttatatatgtggggcggtgtaggacgcgggaaaacctggctgatggaccttttctatcaaagcctgctgggagagcggaaacagcgcctgcactttcaccgttttatgctgcgggtgcacgaagagctaactgccttacaggggcagaccgatccgctggaaattattgccgatcgctttaaagccgaaactgacgtgctctgttttgacgaattttttgtttctgatattaccgacgccatgctacttggcggtctgatgaaagccctgttcgctcgcggaataacgttggtcgcaacgtcaaatattccgccggacgaactttatcgaaatggcttgcaacgtgcacgttttttgcctgcaatcgatgccattaaacagcattgtgatgtaatgaacgtggacgctggtgttgattatcgactgcgtacactcactcaggcgcatctgtggctttcgccactcaacgatgaaacccgggcgcagatggataaactatggttggcgctggcgggggcgaaacgagaaaattcaccgacgttagaaatcaaccatcggccattggcgacaatgggcgtcgagaaccagacgctggcggtctcttttactacgctgtgcgtcgacgcccgcagtcagcatgactatattgcgctctcacgtctctttcatacggtcatgttgtttgatgtaccagttatgacgcggttgatggagagcgaagcgcggcgctttattgcgctggtggatgagttttacgagcgccatgtcaaattagtggtgagtgcagaagtgccgctgtatgaaatttatcagggcgatcggctgaagtttgagttccagcgttgcctgtcacgtctgcaagagatgcaaagcgaagagtatctgaagcgcgagcatttggcgggttaa

SEQ ID NO: 1412 - DNA, 1131 bp, Serratia proteamaculans 568
atgcaggcacaatcaccgttatcacgctaccagcggctgcttgctgcgggagaataccaggccgatgaagtccagatggaggccgtgactcaactggatcatatctatcaggcattattgcagcagacgcccgttgtcagtgcgccggccgcgggcctgcgcggcaaactgaatcgttggctgggcaagagcagtgaaacgactcagcagcgtccggttcagggcttatatatgtggggcggcgtgggacgcggcaaaacctggctgatggacatgttcttccatagcctgccgggggagcgcaagctgcggctgcattttcaccgttttatgctgcgggtgcacgaagagctgaccgaactgcaggggcaggaaaacccacttgaaatcatcgcggatggtttcaaggcacagaccgatgtgctgtgtttcgacgagttctttgtttccgatattaccgacgccatgttgttggcaacgttgttgcaggcgctgtttgcccgtggcattacgctggtggcgacctccaatatcccgccgaacgatttgtaccgcaacggcctgcagcgggcgcgtttcctgccggcgatcgatctgattaacgaattctgtgacgtgatgaacgttgacgccggcattgattatcgcctgcgtactttgactcaggcgcatttgtacctgacgccgcttgatgaacagacccggctgaccatggaccggatgtttgtgaagctggccggcaagccaggagaggcggcaccggtattacagatcaatcatcggccgttgcaggcgatcaacgcggtagacggcgtgctggcggtcgattttcacacgttgtgcgaagaggcgcgtagccaattggactatattgcgctgtcgcgcctgtatcacagcgtgatcctgtataatgtgcgggtgatggggccgctgaaggaaaataccgcgcgccgcttcctggcattggtcgatgaattttacgaacgtcacgtcaaactggtgatcgctgccgaagcgtcgatgttcgatatttaccagggtgagcggttgaagttcgagtaccagcgttgtctgtcgcggctgcaagaaatgcagagtgaagagtatctgaagttgccgcatctgccgtga

SEQ ID NO: 1413 - DNA, 1128 bp, Yersinia pestis Angola
atgcaacagagttcacctataacgctttatcagcaggcacttgatgccggcggctatcaacctgatgatgtgcagcggcgtgctgtagcacggctagagacaatttatcaggcgctaaatcagtaccaaaatgtccctgcggccagtgcaagtttacgcaaccgcctgggccgtttatttgggaagccagctcgacgaccacccgtaagccccgttcaggggttatatatgtggggcggtgtggggcgggggaaaacctggctgatggacctgtttttccacagtttgccgggtgagcgcaaactccgcctccattttcatcgttttatgctgcgggtacatcaagaactgaccgagttacaagggcatgaaaatccattggaaattgttgctgatggtttcaaggcccagactgacgtactgtgttttgacgagttctttgtctcggatattaccgatgccatgttgttggcaacattattggaagcgctatttgccaggggcatcacactggtcgcgacgtctaatattccgccagataatctgtaccataacgggttacagcgcgggcgttttttacccgctatcgccttaattaagcaacattgtgaggtgatgaacgtggatgcgggtatcgattatcgtttgcggacattgactcaggctaatctttatctgaccccgttaaattcacagaccgaacaagcaatggcagcgattttcgttaaacttgcggggaaagaagggggaaaggcaacggtgttggaggtgaatcaccggcctttgcctgcgatttgtgtggctgagggggtgctggcggttgatttccatacattgtgtgaagaagcgcgcagtcaactggattatatcgctttgtctaagcgctatcacacggtattgctccacaatgtccgttgcatggcggcccgcgatgagaacacggcacggcgttttctggccttggtagatgagttttatgaacgccgggtgaaactgattattgcggctgaagcctcaatgtttgagatttatagcggtgagcgccttaagtttgagtaccagcgttgtttatcgcgattacaagagatgcaaagcgaagagtacctttctttaccccatttaccttaa

SEQ ID NO: 1414 - DNA, 1128 bp, Escherichia coli C ATCC 8739; identical to SEQ ID NO: 1410

SEQ ID NO: 1415 - DNA, 1128 bp, Escherichia coli SMS 3 5
atgcaaagcgttaccccaacatcgcaatacctgaaggcgctcaatgaaggcagccatcaacccgacgacgttcaaaaagaggccgtcagccgcctggaaattatttatcaggaactcatcaatagcacgcctccagcccctaggacgagtgggctaatggcgcgggtcggtaagctgtggagtaaacgcgaagacacaaagcatacgccagtgcgtggcttatatatgtggggcggtgtaggacgcgggaaaacctggctgatggaccttttctatcaaagcctgccgggagagcggaaacagcgtctgcactttcaccgttttatgctgcgggtgcacgaagagctgaccgaattacaaggccaaagcgatccgctggaaattattgccgatcgctttaaagcagaaactgacgtgctctgttttgacgaattttttgtttctgatattaccgatgccatgctacttggcggtctgatgaaagccctgttcgcccgaggtattaccctggtagcgacgtcaaatattccgccggacgaactttatcgaaatggcctacaacgtgcgcgttttttgcctgcaatcgatgccattaaacagcattgtgatgtaatgaacgtggacgctggtgttgattatcgactgcgtacactcactcaggcgcatctgtggctttcgcccctcaacgatgaaacccgggcgcaaatggataaactatggttggcgctggcgggggcgaaacgagaaaattcaccgacattagaaatcaaccatcggccattggcgacaatgggcgtcgagaaccagacgctggcggtctcttttactacgctgtgcgtcgacgcccgcagtcagcatgactatattgcgctctcacgcctctttcacacggtcatgttgtttgatgtaccagttatgacgcggttgatggagagcgaagcgcggcgctttattgcgctggtggatgagttttacgagcgccatgtcaaattagtggtgagtgcagaagtgccgctatatgacatttatcagggcgagcggctgaaatttgagttccagcgttgcctgtcacgtctgcaagagatgcaaagcgaagagtatctgaagcgcgagcatttagcgggttaa

SEQ ID NO: 1416 - DNA, 1128 bp, Shigella boydii CDC 3083 94
atgcaaagcgttaccccaacatcgcaatacctgaaggcgctcaatgaaggcagccatcaacccgacgacgttcaaaaagaggccgtcagccgcctggaaattatttatcaagaactcatcaatagcaggccaccagcccccaggacgagtgggctaatggcgcgggtcggtaagctgtggggtaaacgcgaagacacaaagcatacgccagtgcgtggcttatatatgtggggcggtgtaggacgcgggaaaacctggctgatggaccttttctatcaaagcctgccgggagagcggaaacagcgcctgcactttcaccgttttatgctgcgggtgcacgaagagctaactgccttacaggggcagaccgatccgctggaaattattgccgatcgctttaaagccgaaactgacgtgctctgttttgacgaattttttgtttctgatattaccgacgccatgctacttggcggtctgatgaaagccctgttcgcccgcggtattaccctggtagcgacgtcaaatattccgccggacgaactttatcgaaatggcttgcaacgtgcgcgttttctgcctgcaatcgatgccattaaacagcattgtgatgtaatgaacgtggacgctggtgttgattatcgactgcgtacactcactcaggcgcatctgtggctttcgccactccacgatgaaacccgggcacaaatggataaactatggttggcgctggcgggagcgaaacgcgaaaattcaccgacgttagaaatcaaccatcgaccgctggcgacaatgggcgctgagaatcagacgcttgctgtctcttttaccaccttgtgtgtcgatgcccgcagccagcatgactatattgcgctctcacgcctctttcatacggtcatgttgtttgatgtaccagttatgacgcggttgatggagagcgaagcgcggcgctttattgcgctggtggatgagttttacgagcgccatgtcaaattagtggtgagtgcagaagtgccgctgtatgaaatttatcagggcgatcggctgaagtttgagttccagcgttgcctgtcacgtctgcaagagatgcaaagcgaagagtatctgaagcgcgagcatttggcgggttaa

SEQ ID NO: 1417 - DNA, 1125 bp, Salmonella enterica serovar Newport SL254
atgcaaagcttttcccctacatcgcgttatctccaggcactcaacgaaggcacccatcagcctgacgacgtacagaaagaggcggtcgaccgtctggaaaccctttatcaggcgctcaccgcgaaaaaatcgtcggctacgccacccggcggactgatagcgcgactggggaaattattaggcaaaaacgaaccggacgcgcaaataccggttcgcgggctgtatatgtgggggggcgtgggtcgcggcaaaacctggctcatggatctcttctaccacagcctgccgggtgagcgaaaattacgcctgcattttcatcggtttatgctgcgcgtgcatgaagaacttaccgcgctacagggacagatcgatccgttagacattattgccgatcggtttaaaaccgagacggacgtactgtgtttcgatgagtttttcgtcaccgatattaccgacgccatgctgctgggcggtttaatgaaagcgctgtttgcacgcggcattacgctggtcgcgacctccaatattccgccggatgaactctaccgcaacggtttgcaacgcgcccgcttcctgccggctatcgatgccattaaacagcactgcgacattatgaatgtggacgccggcgtcgattaccggctgcggacgctgacgcaggcccatttatggctaacgccgcttaatgatgaaacccggcggcaaatggataaactgtggctggcgttagcgggggccgcgcgcgagcacgctccgacgctggaaatcaatcatcgctctttatccaccctgggcgttgaaaaccaaacgctagcggtctctttcgctacgctgtgcgtcgaggcccgcagccagcatgattacattgcgctctcaaggttatttcacacggttctgctgtttgacgtgccggtcatgacgccgctgatggagaacgaagcgcgccgctttattgcgctggtggatgagttttacgagcgccacgttaagctggtggtcagcgccgccgcaccgttatatgaaatttatcagggggaacggctcaagtttgaatttcagcgctgtctgtcacgcctgcaagagatgcagagtgcggagtacctcaagcgggagcatatgccgtaa

SEQ ID NO: 1418 - DNA, 1125 bp, Salmonella enterica serovar Heidelberg SL476
atgcaaagcctttcccctacatcgcgttatctccaggcactcaacgaaggcacccatcagcctgacgacgtacagaaagaggcggtcaaccgtctggaaaccctttatcaggcgctcaccgcgaaaaaatcgtcggctacgccacccggcggtctgatagcgcgactggggaaattattaggcaaaaacgaaccggacgcgcaaataccggttcgcgggctgtatatgtgggggggcgtggggcgcggcaaaacctggctcatggatctcttctaccacagcctgccgggcgagcgaaaactacgcctgcattttcatcggtttatgctgcgcgtgcatgaagagcttaccgcgttacagggacagatcgatccgttagacattattgccgatcggtttaaaaccgagacggacgtactgtgtttcgatgagtttttcgtcaccgatattaccgacgccatgctgctgggcggtttaatgaaagcgctgtttgcacgcggcattacgctggtcgcgacctccaatattccgccggatgaactctaccgcaacggtttgcaacgcgcccgcttcctgccggctattgatgccattaaacagcactgcgacattatgaatgtggacgccggcgttgattaccgactgcggacgctgacgcaggcccatttatggctaacgccgcttaatgatgaaacccggcggcaaatggataaactgtggctggcgttagcgggggccgcgcgcgagcacgctccgacgctggaaatcaatcatcgccctttatccaccctgggcgttgaaaaccaaacgctagcggtctctttcgctacgctgtgcgtcgaggcccgcagccagcatgattacattgcgctctcaaggttatttcacacggttctgctgtttgacgtgccggtcatgacgccgctgatggagaacgaagcgcgccgctttattgcgctggtggatgagttttacgagcgccacgttaagctggtggtcagcgccgccgcaccgttatatgaaatttatcagggggaacggctcaagtttgaatttcagcgctgtctgtcacgcctgcaagagatgcagagtgcggagtacctcaagcgggagcatatgccgtaa

SEQ ID NO: 1419 - DNA, 1125 bp, Salmonella enterica serovar Schwarzengrund CVM19633
atgcaaagcctttcccctacatcgcgttatctccaggcaatcaacgaaggcacccatcagcctgacgacgtacagaaagaggcggtcgaccgtctggaaaccctttatcaggcgctcaccgcgaaaaaatcgtcggctacgccacccggcggtctgatagcgcgactggggaaattattaggcaaaaacgaaccggacgcgcaaataccggttcgcgggctgtatatgtgggggggcgtgggtcgcggcaaaacatggctcatggatctcttctaccacagcctgccgggcgagcgaaaactacgtctgcattttcatcggtttatgctgcgcgtgcatgaagaacttaccgcgttacagggacagatcgatccgttagacattattgccgatcggtttaaaaccgagacggacgtactgtgtttcgatgagtttttcgtcaccgatattaccgacgccatgctgctgggcggtttaatgaaggcgctgtttgcacgcggcattacgctggtcgcgacctccaatattccgccggatgaactctaccgcaacggtttgcaacgcgcccgcttcctgccggctatcgatgccattaaacagcactgcgacattatgaatgtggacgccggcgtcgattaccgactgcggacgctgacgcaggcccatttatggctaacgccgcttaatgatgaaacccggcggcaaatggataaactgtggctggcgttagcggggcgcgcgcgcgcgcgcgctccgacgctggaaatcaatcatcgccctttatccaccctgggcgttgaaaaccaaacgctagcggtctctttcgctacgctgtgcgtcgaggcccgcagccagcatgattacattgcgctctcaaggttatttcacacggttctgctgtttgacgtgccggtcatgacgccgctgatggagaacgaagcgcgccgctttattgcgctggtggatgagttttacgagcgccacgttaagctggtggtcagcgccgccgcgccgttatatgaaatttatcagggggagcggctcaagtttgaatttcagcgctgtctgtcacgcctgcaagagatgcagagtgcggagtacctcaagcgggagcatatgccgtaa

SEQ ID NO: 1420 - DNA, 1125 bp, Salmonella enterica serovar Agona SL483
atgcaaagcctttcccctacatcgcgttatctccaggcactcaacgaaggcacccatcagcctgacgacgtacagaaagaggcggtcgaccgtctggaaaccctttatcaggcgctcaccgcgaaaaaatcgtcggctacgccacccggcggtctgatagcgcgactggggaaattattaggcaaaaacgaaccggacgcgcaaataccggttcgcgggctgtatatgtgggggggcgtggggcgcggcaaaacctggctcatggatctcttctaccacagcctgccgggcgagcgaaaactacgtctgcattttcatcggtttatgctgcgcgtgcatgaagaacttaccgcgttacagggacagatcgatccgttagacattattgccgatcggtttaaaaccgagacggacgtactgtgtttcgatgagtttttcgtcaccgatattaccgacgccatgctgctgggcggtttaatgaaagcgctgtttgcacgcggcattacgctggtcgcgacctccaatattccgccggatgaactctaccgcaacggtttgcaacgcgcccgcttcctgccagctatcgatgccattaaacagcactgcgacattatgaatgtggacgccggcgtcgattaccggctgcggacgctgacgcaggcccatttatggctaacgccgcttaatgatgaaacccagcggcaaatggataaactgtggctggcgttagcgggggccgcacgagaacacgctccgacgctggaaatcaatcatcgccctttatccaccctgggcgttgaaaaccaaacgttagcggtctctttcgctacgctgtgcgtcgaggcccgcagccagcatgattacattgcgctctcaaggttatttcacacggttctgctgtttgacgtgccggtcatgacgctgctgatggagaacgaagcgcgccgctttattgcgctggtggatgagttttacgagcgccacgttaagctggtggtcagcgccgccgcaccgttatatgaaatttatcagggggaacggctcaagtttgaatttcagcgctgtctgtcgcgcctgcaagagatgcagagtgcggagtacctcaagcgggagcatatgccgtaa

SEQ ID NO: 1421 - DNA, 1125 bp, Salmonella enterica serovar Dublin CT 02021853
atgcaaagcctttcccctacatcgcgttatctccaggcactcaacgaaggcacccatcagcctgacgacgtacagaaagaggcggtcgaccgtctggaaaccctttatcaggcgctcaccgcgaaaaaatcgtcggctacgccacccggcggactgatagcgcgactggggaaattattaggcaaaaacgaaccggacgcgcaaataccggttcgcgggctgtatatgtgggggggcgtgggtcgcggcaaaacctggctcatggatctcttctaccacagcctgccgggtgagcgaaaattacgcctgcattttcatcggtttatgctgcgcgtgcatgaagaacttaccgcgctacagggacagatcgatccgttagacattattgccgatcggtttaaaaccgagacggacgtactgtgtttcgatgagtttttcgtcaccgatattaccgacgccatgctgctgggcggtttaatgaaagcgctgtttgcacgcggcattacgctggtcgcgacctccaatattccgccggatgaactctaccgcaacggtttgcaacgcgcccgcttcctgccggctatcgatgccattaaacagcactgcgacattatgaatgtggacgccggcgtcgattaccggctgcggacgctgacgcaggcccatttatggctaacgccgcttaatgatgaaacccggcggcaaatggataaactgtggctggcgttagcgggggccgcgcgcgagcacgctccgacgctggaaatcaatcatcgctctttatccaccctgggcgttgaaaaccaaacgctagcggtctctttcgctacgctgtgcgtcgaggcccgcagccagcatgattacattgcgctctcaaggttatttcacacggttctgctgtttgacgtgccggtcatgacgccgctgatggagaacgaagcgcgccgctttattgcgctggtggatgagttttacgagcgccacgttaagctggtggtcagcgccgccgcaccgttatatgaaatttatcagggggaacagctcaagtttgaatttcagcgctgtctgtcacgcctgcaagagatgcagagtgcggagtacctcaagcgggagcatatgccgtaa

SEQ ID NO: 1422 - DNA, 1107 bp, Aliivibrio salmonicida LFI1238
atgacaccattagaaaaataccagcttgaccttacgcaagatacatttcatcacgacagtgctcagcaacacgccgtggagtgtttggatgagttatatcatcgattattgcaaccaaaaacgacacccaaagcagaacgaaaatcttggttgtctgtatttaaaaaatcagaacctcagaccgtcgtgccagagaaaggattgtatttttggggaggagtggggagaggaaaaacgtatttagtcgatactttttacgatgccttgcctactgaacgtaaaatgcgagtgcacttccatcggtttatgcagcgagttcatgatgagcttggtgagcttcaacaacaagcggatccattgttgattgtggctgataaatttaaacaagaaaccgatattatctgttttgatgaattctttgtttctgatattaccgatgccatgatattagcgacattattagaggcgttatttgaacgaggtattgcccttgttgcgacatcaaatattgtccctcaggagttataccgaaatggattgcaaagggcgcgttttattcctgctattacgttgatcgaacaacactgccagatagttaatgtggacagtggcattgattatcgtttaaggacgttagagcaagctgaaatctatcatttccctctcgatagtttagctcaacaaaatatgttggattatttccatcagttaacgtcagaaacggaacatgaagagaaagaaatagaaattaatcatcggatattgtccgtgaatgccgaaggggatggggttgtgcattttgaattcacttctctatgtgaaagtgcgcgcagtcaacatgattacattgaattgtctcgtttgtatcatacggttcttctttctaacgtaaaggtcatgggagagctcaatgatgatgcggctcgtcgttttattgccatggttgatgagttttatgagcgaaacgtgaaattaatcatttcagcggaagtccaattagctgatttgtatcaaaatggacgattaacctttgaatttaaacgttgtcagtcaaggttgattgaaatgcaaagtcatgagtatctagcaaaagaacatttatcttag

SEQ ID NO: 1423 - DNA, 1128 bp, Escherichia coli O157 H7 EC4115
atgcaaagcgttactccaacatcgcaatacctgaaggcgctcaatgaaggcagccatcaacccgacgacgttcaaaaagaggccgtcagccgcttggaaattatttatcaggaactcatcaatagcacgccaccagcccccaggacgagtgggctaatggcgcgggtcggtaagctgtggggtaaacgggaagacacaaagcatacgccagtgcgtggcttatatatgtggggcggtgtaggacgcgggaaaacctggctgatggaccttttctatcaaagcctgccgggagagcggaaacagcgcctgcactttcaccgttttatgctgcgggtgcatgaagagctaactgccttacaggggcagaccgatccgctggaaattattgctgatcgttttaaagcagaaactgacgtgctctgttttgacgaattttttgtctctgatattaccgatgccatgctacttggcggcctgatgaaagccctgttcgcccgcggtattaccctggtagcgacgtcaaatattccgccggacgaactttatcgaaatggcttgcaacgtgcgcgttttctgcctgcaatcgatgccattaaacagcattgtgatgtaatgaacgtggacgctggtgttgattatcgtctgcgtacactcactcaggcgcatctgtggctttcgccactccacgatgaaacccgggcgcaaatggataaactatggttggcgctggcgggggggaaacgagaaaattcaccgacgttagaaatcaaccatcggccattagcgacaatgggcgtcgagaaccagacgctggcggtctcttttactacgctgtgcgtcgacgcccgcagtcagcatgactatattgcgctctcacgtctctttcatacggtcatgttgtttgatgtaccagttatgacgcggttgatggagagcgaagcgcggcgctttattgcgctggtggatgagttttacgagcgccatgtcaaattagtggtgagtgcagaagtgccgctgtatgaaatttatcagggcgatcggctgaagtttgagttccagcgttgcctgtcacgtctgcaagagatgcaaagcgaagagtatctgaagcgcgagcatttagcgggttaa

SEQ ID NO: 1424 - DNA, 1131 bp, Dickeya dadantii Ech703
atgcaaagaattacccctttatcactgtatcaacaggccctctcagcggaggagtatcagccggatgaggtgcagcggcagacgattatgcgactcgatgaaattcaccaggcgttgacggaacaggtatgggtgaacgttgagcctgctaccgggatgtggtcgcgttggcgctctttactgggaggaaaacacgagccgcatcgggaaccggtaacgggattgtacatgtggggcggtgtcgggcgtggaaagacctggttaatggatatgtttttccacagtttgccctcggagagaaaattacggctacattttcatcgcttcatgctacgggtgcatgaggagttgaatcagttgcaagggcaggaaaatccgctggaaaaagtcgccgatggctttaaggcgcaaacggacgttctctgctttgatgagttttttgtttctgatatcaccgatgccatgctactggccgagttattgaaagcgctgtttgaacgcggcatcgccctggtagcgacatcaaatattccgccggacgaactgtatcgcaatgggttacaacgctcgcgtttcctgccggcaatcgaattgataaagcaatattgcgaggtgaggaatgtcgatgccggcattgattaccggttgcgtacgttgactcaggcccacctttacctgacaccgttgaatgatgagaccgatgcagtcatgaggacgatgttcggccgattatccggccatgaatatcgtcaccctggaccggtgttggagatcaatcatcgcgctatgcctacgctaagtgctggcgatggcgtgttgtcgatcgattttccgacgctttgcctggaggcgcgtagccagaatgactatattgcactatctcgtctgtatcacacggtgttgttgcaccatgtcaccgtgatgggcgcaaaggaagaaaacgccgcccggcgttttctggcgttggttgacgaattttatgaacgtcgtgtgaaactggtgatttcagcggaaagtccgatgtttgagatttatcaggggcatcatctgaaatttgagtatcagcgctgtttgtcgcgtctgcaggaaatgcaaagcgaagagtatctgcgccaacctcatctgccttga

SEQ ID NO: 1425 - DNA, 1131 bp, Dickeya zeae Ech1591
atgcagagaacaacccctttggcactttaccagcaggctttggcggctcaaacctatcagccggatgaagtgcagcatcagacggttgtccgtttgaacgctattcatcaaacattgacggagcaggtgtggggaccatcggagagccgtgcaccggggctgatgtcgaaatggcgcagttggctggggcaaaaggaaacatcgtcgacgccggtgcaagggctgtacatgtggggcggtgtggggcgaggtaaaacctggttgatggacctgtttttccatagcctgccttcagaacgcaagcttcggttgcatttccatcggtttatgttgcgggttcatgaagaactaaaccagttgcaggggcaggaaaacccgttggaaaaggtggcggacggttttaaggcgcagaccgacattctgtgtttcgacgagtttttcgtctcggatattaccgatgcgatgttattggcggagctgctgcgggcgttgttctcgcgggggatcgcgctggtggcgacgtcgaatattccaccggacgagctgtatcgcaacgggttgcagcgcgcgcgtttcctgcctgccattgatttgatcaaacgttactgcgatgtgctgaacgtggatgccggcattgattaccggttgcgtaccctgacccaggcccacttgtacctgagcccaatcaatgctgataccgatgctgaaatgcaggcggtattccgccgtctgtctgggcgcgatgcggggcagccgggcccggtgctggaggtgaatcatcgtccgctggcgacgttgagcgctggcgacggcgtgctggcggtggattttgccacactgtgctttgaagcccgcagccagaatgattacatcgcgttatcgcggttatatcacaccgtattgttgcatcatgtgccggtgatggaggtaaaagatgagaacgcagctcgtcgttttctggcgctggtggatgaattttatgagcgcagggtgaagttgattatctcggcgcaggcgccgatgtttgatatttatcagggggagcacctgaaattcgagtatcaacggtgcctgtcgcgtctacaggagatgcaaagcgaagagtacctacgccagccgcatttgccatag

SEQ ID NO: 1426 - DNA, 1152 bp, Pectobacterium carotovorum PC1
atggctactccacagacaacacggcagcaaacaacacctttggcactttatcagcaggcgctttccgctggtgaatatcagccggatgaggtgcagcggcaaacggttgtgcgcctggaagcgatacatcaggcgctatgcgaacgtgctgctgatgacaatgcaggggcatccggccgcgtgggaaaatggcgtagctggcttgggctacgtgagaaacgtgaatctgcgccagtccaagggttgtatatgtggggcggcgtcggacgcggtaaaacctggctgatggatatgttttttcacagcttgcccgctgagcgcaaaatgcgcctgcattttcatcgttttatgctgcgcgtgcatgaagaacttaaccagtttcaggggcaggagaatccgctggaaaaagtggctgatgggttcaaagctgaaactgatgtgctgtgtttcgatgaattttttgtctctgacattaccgatgcgatgttgctggctgaactactgcgggcgctgtttgctcgtggcatcgcgctggtggcgacgtcgaatattccgccagacgatctctatcgcaatggattacaacgcgcccgttttcttcctgcgattgagctgattaaacagcactgtgaagtgcgtaatgtcgatgcaggtatcgattatcgtttgcgcacactgacacaggcacacctttatctgtctccgttgaatgaagataccgaggctacgatgcagcagatgtttacccgcctgacggggaaacgctggcagacgccagggccggtgctggagattaatcatcgcccgttggcgacactcggtgtgagtgagggcgtgctggcggttgatttccacacactgtgtactgaagcgcgcagccagaatgattacatcgcgctttcgcgtctctaccacacgatgctgctgcacaatgtgaccgtgatggaaacgaaggaagaaaacaccgctcgccgttttctggcgctggtggatgagtgctacgagcgtcgcatcaaattgattatttctgcccaagcatccatgtttgagatttatcagggagaacacctgaaatttgaatatcagcgctgtctgtcccgtttgcaggaaatgcagagcgaagagtacttacgacagccacatttggcataa

SEQ ID NO: 1427 - DNA, 981 bp, Yersinia pseudotuberculosis IP 31758
atgcatgagacatttcgcccgctggcaggggccagcaacccacacttgcagacattgctgccgcgcctggtcaggcggcatgtgcaactatcgccctattggcaacggctggaattaccggacggtgattttatcgatttagcttggagtgagaaccccgagttggcgcgcgagaagccccgagtggtactcttccacggtttggaagggaatttttacagcccttatgcccacggtttgctacgcgcctggcaagctgcaggctggctgggtgtggtgatgcattttcgcggttgcagtggtgaacccaatcgtaagtcgcgcatttatcactctggcgaaaccgaagatgcgaattttttcctacattggttacaagaaacctatggacaggtgcctaccgccgccgtaggcatatcattaggcggtaatatgctggcttgctacctggccaaaaaggggaagaatagcggattgcgcgctgcggtggtggtttcggcccccttaatgctcgaaccttgtgctgaccgtatggaccaaggtttctctcgggtctatcagcgctatttattgaatcagttaaagctgaacgcgacccgcaagctattacagtacccaaatagcctaccggtgaatttattccagttgaaaaaattgcgacgagttagagatttcgatgatgcaataacagcaaaaattcatggatttaatgatgcaggagattattatcgccgttgtagcgccctgccactgttaccgcaaatccgtgtcccgctgctgattattcatgccaaagacgatccgttcatgaccgccgaagtcattccgaatatcgagacactgccggacaatattgattatcagctcactgaacacggcggccacgtaggatttgtcggcggctcgttaaaacatccacaaatgtggctggaacagcgaattccagcctggctttccccctatttggagcagcagtcatga

SEQ ID NO: 1428 - DNA, 981 bp, Serratia proteamaculans 568
atgcatgaatcctttcgccctttgaccggggccagtaatccacacctgcaaacgctgctgccacggctggtgcgccgccgtgtgcagttgaaaccccactggcaacggctggaactgcccgacggtgactttgtcgatctcgcctggagcgaagatccggctcaggccagcggcaagccgcgagtggtgctgttccacggcctggaaggcaacttctacagcccctatgcccatggccaacttaatgcctggcgtgaaaagggctggctcggggtggtaatgcattttcgcggttgcagcggtgtgccgaaccgcaagcagcgcatctaccattccggtgaaacggaagatgcacgcttcttcctccagtggctgcgtgctacctacggagaagcccccaccgctgccgttggcgtttcgctcggcggcaacatgctggcctgttatctggcacaacagggcgccgacagcctgctgcaggcggcggtggtggtttctgcgccactgatgctggagccctgttcgtggcggatggaccaaggcttctcgcgggtctatcagcactacctgctcgggcagttgaaacaaaacgccacccgcaaactgctgcactatcctgatacgctgccgctcaaactgccgcagctcaaggcattgcgtcggatccgcgactttgatgatgccattacctcgcgcatccatggctttagcgacgccaccgattattaccgccgttgcagcgccctgccgttgttaccgtcgatccaaacgccgctgttgatcatccatgccaaggacgatccttttatgaccgacgaagtgatccccgaaaccgccacgctgccgcacaatattgaatatcaattgaccgagtttggcggtcacgtcggttttgtcggcggcacattgaaaaaaccccatatgtggctggaataccgtattccatcctggcttgccccttacctggaaacaaccaagtga

SEQ ID NO: 1429 - DNA, 981 bp, Yersinia pestis Angola
atgcatgagacatttcgcccgctggcaggggccagcaacccacacttgcagacattgctgccgcgcctggtcaggcggcatgtgcaactatcgccctattggcaacggctggaattaccggacggtgattttatcgatttagcttggagtgagaaccccgagttggcgcgcgagaagccccgagtggtgctcttccacggtttggaagggaatttttacagcccttatgcccacggtttgctacgcgcctggcaagctgcaggctggctgggtgtggtgatgcattttcgcggttgcagtggtgaacccaatcgtaagtcgcgcatttatcactctggcgaaaccgaagatgcgaattttttcctacattggttacaagaaacctatggacaggtgcctaccgccgccgtaggcatatcattaggcggtaatatgctggcttgctacctggccaaaaaggggaagaatagcggattgcgcgctgcggtggtggtttcggcccccttaatgctcgaaccttgtgctgaccgtatggaccaaggtttctctcgggtctatcagcgctatttattgaatcagttaaagctgaacgcgacccgcaagctattacagtacccaaatagcctaccggtgaatttattccagttgaaaaaattgcgacgagttagagatttcgatgatgcaataacagcaaaaattcatggatttaatgatgcaggagattattatcgccgttgtagcgccctgccactgttaccgcaaatccgtgtcccgctgctgattattcatgccaaagacgatccgttcatgaccgccgaggtcattccgaatatcgagacactgccggacaatattgattatcagctcactgaacacggcggtcacgtaggatttgtcggcggctcgttaaaacatccacaaatgtggctggaacagcgaattccagcctggctttccccctatttggagcagcagtcatga

SEQ ID NO: 1430 - DNA, 981 bp, Yersinia pseudotuberculosis YPIII
atgcatgagacatttcgcccgctggcaggggccagcaacccacacttgcagacattgctgccgcgcctggtcaggcggcatgtgcaactatcgccctattggcaacggctggaattaccggacggtgattttatcgatttagcttggagtgagaaccccgagttggcgcgcgagaagccccgagtggtactcttccacggtttggaagggaatttttacagcccttatgcccacggtttgctacgcgcctggcaagctgcaggctggctgggtgtggtgatgcattttcgcggttgcagtggtgaacccaatcgtaagtcgcgcatttatcactctggcgaaaccgaagatgcgaattttttcctacattggttacaagaaacctatggacaggtgcctaccgccgccgtaggcatatcattaggcggtaatatgctggcttgctacctggccaaaaaggggaagaatagcggattgcgcgctgcggtggtggtttcggcccccttaatgctcgaaccttgtgctgaccgtatggaccaaggtttctctcgggtctatcagcgctatttattgaatcagttaaagctgaacgcgacccgcaagctattacagtacccaaatagcctaccggtgaatttattccagttgaaaaaattgcgacgagttagagatttcgatgatgcaataacagcaaaaattcatggatttaatgatgcaggagattattatcgccgttgtagcgccctgccactgttaccgcaaatccgtgtcccgctgctgattattcatgccaaagacgatccgttcatgaccgccgaggtcattccgaatatcgagacactgccggacaatattgattatcagctcactgaacacggcggtcacgtaggatttgtcggcggctcgttaaaacatccacaaatgtggctggaacagcgaattccagcctggctttccccctatttggagcagcagtcatga

SEQ ID NO: 1431 - DNA, 993 bp, Dickeya dadantii Ech703
atgaatacttatccactacacaacagcgcttttcagccgttgggcgggatgcgcaacccacatctgcaaacactgctgccgcggttgtttcgccgacgccccagcctgacgcccgtctggcaaacgctggatacccccgacggcgacttcgtcgaactggcctggagcgaaccgccgcaacctgcggcgcataagccgcgcgtggtgctgttccacggcttggaggggaacttccgcagcccttatgcgcacggtttgatggccgcctgtcgggaacgcggttggctggcggtgatcatgcatttccgcggctgcagcggggtgcctaatcgccggacgcgcatctatcactccggcgaaaccggcgatgccgactatttcctgcaatggctggaaaaaacgctggggccggcgcccacggcggcgatcggcatttcgctcggcggcaatatgctggcctgcctgctgggccgtcagggggagcgctgttcgctcaacgccgccgccgtcgtctcggcgccgttgttgctggagccttgcagccgccgcatcgaacaggggttttcccgcatctatcaatcttatctggtcaattcgttgcgccagagcgcactgcgcaaactggcggcgtatcccggcaccattccggtatcgccgtcccgcatcaaacaggtacgcgggttgagggagttcgacgacctcatcaccgcccgtcttcacggctttcacgacgccgcggattattaccggcgttgcagcgccatgccgctgctgccgcagatccgtactccaaccctgatcatccaggcaaaggacgatccttttatgacgcctgaagtcattcccgatccctcgcagttaccgccctgcgtcgaataccaactgacagagcatggcgggcatgtcggctttgtcagcggatcatggcgccaccctgaaatgtggctggaacatcgcatccccgattggttcaccccttatctggagcaataa

SEQ ID NO: 1432 - DNA, 996 bp, Dickeya zeae Ech1591
atgaatcattcttcttatcgtaatacatgttttcagcccttgtcgggcgcgcacaacccacatgttcagacgctgctgccgcgcctgcttcgccgccgtccggctctgcaacccgtctggcaacggctaaccctgccggacggggattttgtcgatctcgcctggagtgaagcgccggcgcaggcggcgcacaagccgcgcgtggtattgttccacgggctggaaggcagctttcacagcccttacgcccacggcctgatggccgcctgtcggcaacgcggttggctggcggtggtgatgcattttcgcggctgtagcggacaacccaatctcctgccgcgcgcgtatcacgccggtgaaaccgaagacgcacgctacttcctgcattggttgcgccggaccttcggtgccgcacccaccgtcgcggtggggttttcgctgggcggcaacatgctggcttgtctgctggcgcaacaacaggaaagcctgttgaatgcggcggcggtggtctccgccccgttaatgctggagccctgtagtaatcggctggagcacggcttttcccgtttctaccagcgctacctgctgcactcgctgcgtcgcaacgccttgcacaaactgacgatgtaccctgattgcctgcccatttccgccggacagttgcgtcaggtgcgtcgtttacgacaatttgacgaattgatcaccgcacggctgcacggttttgccgacgcaaccgattattaccggcgcagcagcgccctgcccttgttgccgcgcatccgtcagccgttactgattatccatgctaaagacgatccgtttatgacgccggcggtgataccggagccgtcgcaattaccggccaatatcgactaccagttgacggagcacggcggtcacgtcggttttgtcggcggcacatggcaccaacctgagttgtggctggaacagcggctccccaactggttcaccccttatctggagcagatcgcatga

SEQ ID NO: 1433 - DNA, 1005 bp, Pectobacterium carotovorum PC1
atgtatgaccattttcatccgctgagcggcgcgcataacccgcatctgcaaacgctattgccgcgtctgattcgccgtcacgcgcagttttcgccagtctggcagccccttgagttaccggacggcgatttcgtcgatctggcgtggagcgaagcgcccgaacaggcgcggaacaaaccgcgcgtggtgctgttccacgggctggaaggcagctttcatagcccctacgcccacggcctgctgcatgcctgtaaacagcgcggctggctggccgtcgtcatgcattttcgtgggtgcagcggaaaacccaaccggatgaagcgtatttatcactccggcgaaaccagcgatgccagctatttcctgcgctggatgcaagagacgctgggcgatgcgcctaccgccgccatcggcgtgtccctcggtggcaatatgctggcctatctgctcgcgcagcaaggcgaatcctgttatctctctgctgccgtcattgtttccgcgccattgatgctcgaaccctgtagccgtcgcatggagcaaggcttctcccgcgtctatcagcactacctgctgcgactgctaaagcaaaatgccggccgcaagctggcagcctacccggacacgctgccgattcagttgccgcaactgaaacgcatccgccagttacgagagtttgatgacgtcattacgtcacgtattcacggcttccacgatgccgccgactactatcgacgctgtagcgccctgccgctgttgcctcagattcgcacaccgctgctcatcatccatgcgaaggacgatcctttcatgacgtcagaggtgattcccgatctgtcgcagttaccgtctaatattgaatatcagctaacagaacacggcgggcatgttggtttcgtcggtggaacgctgctgaaaccgaaaatgtggctggaacagcgcattcccaactggcttagcccatttttggaccacgccaccgactcccctttgactcaggaaccatag

SEQ ID NO: 1434 - DNA, 2406 bp, Bacillus anthracis Ames 0581
atgaaaaaacgtttagttatgatcggaaatggtatggctggcatacgttgtatggaagaaatattaaaacatgattgtgattcatatgagattactatttttggagatgaaccacacccaaactataatcgcattatgctctctcatgttttacaaggtaaaacaaatatacaagatatcattatgaatgaatacagttggtatgaagaaaacgaaataactttgtatacaaatgaaagagttcaaagtattgaccgagaagaaaaagttattatgacagaaaagaatcgtactcttacatatgacaagcttattattgcaacaggttctagtgcttttattttacctgttgaaggttccactcttcctggtgtaacaggttttcgaaccattgaagatacacagtttatgatggatactgctaaagaaaagaaaaaggccgttgtcattggtggtggattacttggtttagaagcagcacgaggtcttattgacttaggaatggacgtacatgttgttcatttaatgcctagcttaatggagcaacaactagatacgaaagccgcttctctactgcgtgaagatttagaagcacaaggcatgaagtttctcatggaaaagaaaactgtaaaaattcttggtacaaaccatgttgagggcattcaatttgaagatggtgaagttgtagattgtgatttaatcgtaatggctgtcggaatccgaccaaatacgcaaatagcaagagatgctggtttaattgtcaatcgcggcattgtagtcaatgactatatgctaacaaatgatgagtccatttatgcagttggcgaatgtgcagaacatgacggtatcgcatatggacttgttgcccctctttatgaacaaggtgcaatattagcgaaacatatatcgaatttacaaactgatggatattcgggcagtatcgtcggtacgcaattaaaagttgctggttgtgatttattctctgcaggccaaatttatgaagatgatcaaacgaaagcaatatccatctttaatgaatgcaaacgttcctataaaaaagtattaattcgtgacaataaagtcgtcggtatcgttttatatggtgacacagctgatggtacacgcctctttagcatgttaaagaaagaagaagatatacaagaatatacaccagcgtccattcttcacaaagctggtgaagaaagtgaacttgatgttgctacaatgagtgcggatgacacgatttgtggatgtaatggtgttacgaaaggaacaatcgttcatgccattttagaacaagagttaacgacttttgaagaagttaaaggctgtacgaaagccgcagggtcttgtggtaaatgtcgtccgcttgtagaacaagttttatctcatacactcggagatgcttttgatgcctcagcccagtctgctggtatgtgcggatgtacacctttatcacgtgatgaagtcgtagcggcaattcatgaaaaaggcttaaaatcaccaaaagaagtacgaaatgttcttggttttgtacatgaagatggctgttcaaaatgtcgtcctgctttgaactactatttacgtatggcgattccagaagaatatgaagatgataaagcctcccgtttcgttaatgaaagaatgaatggtaacatccagcacgatggtacattctctgttattccacgtatgtacggaggcgttacaacagcagatgatttaatgaaaattgctgaagttgcgaaaaagtatgatgttccacttgtgaaaattaccggtgcaagtcgaattggcttatacggtgttaagaaacaagatttacctaacgtatgggctgacttaaatatgacttctggatatgcgtattcaaaatctcttcgtaatgtaaaatcatgtgttggctctcgtttctgccgtttcggtacgaaagattcattaggacttggtatgctccttgaacaatcattagaaatggtagatacacctcataaaatgaagatgggtgtaacgggctgtccgcgtaactgtgcggaagtacttacgaaagattttggcgttgtttgtgtcgaaaatggataccaactttatattggtggaaatggtggtacagaagtacgtgaagctgattttgtaatgattgtccctactgaagatgatgttcttcacatcgctacagcttacatgcaatattatcgtgaaactggtatttacggagagcgtactgcctactggacagaacgattagacttcgatcacataaaagaaatactgcaagatgcaaatatggtcactaagttaaatgaacgtttccaaacggcccgtggcacatataaagaagcttggggacaagcactagaaacgaaatcattaaaagcgatgtatgaagtagaaactgtgaaataa

SEQ ID NO: 1435 - DNA, 2406 bp, Bacillus anthracis str Sterne; identical to SEQ ID NO: 1434

SEQ ID NO: 1436 - DNA, 2406 bp, Bacillus thuringiensis konkukian
atgaaaaaacgtttagttatgatcggaaatggtatggctggcatacgttgtatggaagaaatattaaaacatgattgtgattcatatgagattactatttttggagatgaaccacacccaaactataatcgcattatgctctctcatgttttacaaggtaaaacaaatatacaagatatcattatgaatgaatacagttggtatgaagaaaacgaaataactttgtatacaaatgaaagagttcaaagtattgaccgagaagaaaaagttattattacagaaaagaatcgtactcttacatatgacaagcttattattgcaacaggttctagtgcttttattttacctgttgaaggttccactcttcctggtgtaacaggttttcgaaccattgaagatacacagtttatgatggatactgctaaagaaaagaaaaaggccgttgtcattggtggtggattacttggtttagaagcagcacgaggtcttattgacttaggaatggacgtacatgttgttcatttaatgcctagcttaatggagcaacaactagatacgaaagccgcttctctactgcgtgaagatttagaagcacaaggcatgaagtttctcatggaaaagaaaactgtaaaaattcttggtacaaaccatgttgagggcattcaatttgaagatggtgaagttgtagattgtgatttaatcgtaatggctgtcggaatccgaccaaatacgcaaatagcaagagatgctggtttaattgtcaatcgcggcattgtagtcaatgactatatgctaacaaatgatgagtccatttatgcagttggtgaatgtgcagaacatgacggtatcgcatatggacttgttgcccctctttatgaacaaggtgcaatattagcgaaacatatatcgaatttacaaactgatggatattcgggcagtatcgtcggtacgcaattaaaagttgctggttgtgatttattctctgcaggccaaatttatgaagatgatcaaacgaaagcaatatccatctttaatgaatgcaaacgttcctataaaaaagtattaattcgtgacaataaagtcgtcggtatcgttttatatggtgacacagctgatggtacacgcctctttagcatgttaaagaaagaagaagatatacaagaatatacaccagcgtccattcttcacaaagctggtgaagaaagtgaacttgatgttgctacaatgagtgcggatgacacgatttgtggatgtaatggtgttacgaaaggaacaatcgttcatgccattttagaacaagagttaacgacttttgaagaagttaaaggctgtacgaaagccgcagggtcttgtggtaaatgtcgtccgcttgtagaacaagttttatctcatacactcggagatgcttttgatgcctcagcccagtctgctggtatgtgcggatgtacacctttatcacgtgatgaagtcgtagcggcaattcatgaaaaaggcttaaaatcaccaaaagaagtacgaaatgttcttggttttgtacatgaagatggctgttcgaaatgtcgtcctgctttgaactactatttacgtatggcgattccagaagaatatgaagatgataaagcctcccgtttcgttaatgaaagaatgaatggtaacatccagcacgatggtacattctctgttattccacgtatgtacggaggcgttacaacagcagatgatttaatgaaaattgctgaagttgcgaaaaagtataatgttccacttgtgaaaattaccggtgcaagtcgaattggcttatacggtgttaagaaacaagatttacctaacgtatgggctgacttaaatatgacttctggatatgcgtattcaaaatctcttcgtaatgtaaaatcatgtgttggctctcgtttctgccgtttcggtacgaaagattcattaggacttggtatgctccttgaacaatcattagaaatggtagatacacctcataaaatgaagatgggtgtaacgggctgtccgcgtaactgtgcggaagtacttacgaaagattttggcgttgtttgtgtcgaaaatggataccaactttatattggtggaaatggtggtacagaagtacgtgaagctgattttgtaatgattgtccctactgaagatgatgttcttcacatcgctacagcttacatgcaatattatcgtgaaactggtatttacggagagcgtactgcctactggacagaacgattaggcttcgatcacataaaagaaatactgcaagatgcaaatatggtcactaagttaaatgaacgtttccaaacggcccgtggcacatataaagaagcttggggacaagcactagaaacgaaatcattaaaagcgatgtatgaagtagaaactgtgaaataa

SEQ ID NO: 1437 - DNA, 2406 bp, Bacillus cereus ZK
atgaaaaaacgtttagttatgatcggaaatggtatggctggcatacgttgtatggaagaaatattaaaacatgattgtgattcatatgagattactatttttggagatgaaccacacccaaactataatcgcattatgctctctcatgttttacagggtaaaacaaatatacaaaatatcattatgaatgaatacagttggtatgaagaaaacgaaataactttgtatacaaatgaaagagttcaaagtattgaccgagaagaaaaagttattattacagaaaagaatcgtactcttacatatgacaagcttattattgcaacaggttctagtgcttttattttacctgttgaaggttccactcttcctggtgtaacaggttttcgaactattgaagatacacagtttatgatggatactgctaaagaaaagaaaaaggccgttgtcattggtggtggattacttggtttagaagcagcacgaggtcttattgacttaggaatggacgtacatgttgttcatttaatgcctagcttaatggagcaacaactagatacgaaagcagcttctctactgcgtgaagatttagaagcacaaggcatgaagtttcttatggaaaagaaaactgtaaaaattcttggtacaaaccatgttgagggcattcaatttgaagatggtgaagttgtagattgtgatttaatcgtaatggctgtcggaatccgaccaaatacgcaaatagcaagagatgctggtttaattgtcaatcgcggcattgtagtcaatgactatatgctaacaaatgatgagtccatttatgcagttggcgaatgtgcagaacatgacggtatcgcatatggacttgttgcccctctttatgaacaaggtgcaatattagcgaaacatatatcgaatttacaaactgatggatattcgggcagtatcgtcggtacgcaattaaaagttgctggttgtgatttattctctgcaggccaaatttatgaagatgatcaaacgaaagcaatatccatctttaatgaatgcaaacgttcctataaaaaagtattaattcgtgacaataaagtcgtcggtatcgttttatatggtgacacagctgatggtacacgcctctttagcatgttaaagaaagaagaagatatacaagaatatacaccagcgtccattcttcacaaagctggtgaagaaattgaacttgatgttgctacaatgagtgcggatgacacgatttgtggatgtaatggtgttacgaaaggaacaatcgttcatgccattttagaacaagagttaacgacttttgaagaagttaaaggctgtacgaaagccgcagggtcttgtggtaaatgtcgtccgcttgtagaacaagttttatctcatacactcggagatgcttttgatgcctcagcccagtctgctggtatgtgcggatgtacacctttatcacgtgatgaagtcgtagcggcaattcatgaaaaaggcttaaaatcaccaaaagaagtacgaaatgttcttggttttgtacatgaagatggctgttcgaaatgtcgtcctgctttgaactactatttacgtatggcgattccagaagaatatgaagatgataaagcctcccgtttcgttaatgaaagaatgaatggtaacatccagcacgatggtacattctctgttattccacgtatgtacggaggcgttacaacagcagatgatttaatgaaaattgctgaagttgcgaaaaagtatgatgttccacttgtgaaaattaccggtgcaagtcgaattggcttatacggtgttaagaaacaagatttacctaacgtatgggctgacttaaatatgacttctggatatgcgtattcaaaatctcttcgtaatgtaaaatcatgtgttggctctcgtttctgccgttttggtacgaaagattcattaggacttggtatgctccttgaacaatcattagaaatggtagatacacctcataaaatgaagatgggtgtaacgggctgtccgcgtaactgtgcggaagtacttacgaaagattttggcgttgtttgtgtcgaaaatggataccaactttatattggtggaaatggtggtacagaagtacgtgaagctgattttgtaatgattgtccctactgaagatgatgttcttcacatcgctacagcttacatgcaatattatcgtgaaactggtatttacggagagcgtactgcctactggacagaacgattaggcttcgatcacataaaagaaatactgcaagatgcaaatatggtcactaagttaaatgaacgtttccaaacggcccgtggcacatataaagaagcttggggacaagcactagaaacgaaatcattaaaagcgatgtatgaagtagaaactgtgaaataa

SEQ ID NO: 1438 - DNA, 2445 bp, Dechloromonas aromatica RCB
atgagtaaacctcgtctcgtcctgatcggcaatggcatggccggtgtccgcaccgtcgaagagctgctgaagatcaagcctgatcactacgacatcaccatcttcggcgctgagccgcacccgaactacaaccgcatcctgctttccccggtcctcgccggcgaaatgaccatctccgagatcgtcctcaacgaactcgagtggtacaaggaaaacaacatcaagctgcataccggcaagcagatcaagacgatcgatcgcgtcaagcgcaaggtcatcgctgaagacggcaccgaagaagaatacgaccgcctgctgatcgccaccggctcgacgcccttcatgctgccgattccgggcaacgatctgccgggtgtcattggataccgtgacattaaagacaccgacgagatgatcgaagccgccaagctgcacaagcacgcggtggttatcggtggcggcctgctcggtctggaagccgccaacggcctgaagcttcgcggtatggatgtgaccgtggtgcaccttggcccgtggctgctcgagcgtcagctcgacgaagtcgccggcaagatgttgcagaagtcgctggaagacaagggcctcaagttcctgctccagaaacagaccgaaatgctggtccagggcgagtctggccgcgttgccgccgtgcgcttcaaggacggcatgactatcccggccgacctcgtcgtgatggccgccggcatccgcccgaactatgcgctggctgagtcttccggtatctactgcaaccgcggcatcgtggtgaatgacaccatgcagacctacgacccgaaggtttatgccgttggcgagtgcgtgacgcaccgtggcattgcctatggcctggtcgccccgctgtttgaacaggccaaggtcgccgccaaccatctggctggctacggcattggccgttacaccggttcggtgacttcaaccaagctgaaagtcaccggcattgacctcttctcggccggcaactacatgggcggcgagggcaccgaggaaatcgtcctcaacgacccttacggcggcgtgtacaagaagctggtgctcaaggacaacaagctggtcggcggcgtcatgtacggcgatacggcagatggcccgtggtacttccagttgctgaaggacggccgcgacattcacgacatccgcgaccagctgattttcggccagtcgctggttggtgacgtcggccatgccggcaatagcaaagcggccgacatgcccgacagcgcagaggtctgcggctgtaacggcatcaccaagggcgtcatcgtccaggcgatcaaggccaaggggctcttcacgctggacgaggtgaagaagcacaccaaggcagcctcttcctgcggttcctgcgctggtctggtcgagcagattcttgcttcgaccatcggcggcgcctacacgcctgctgcttccgacaagaaaccggtctgtggctgtaccgagcagtcgcataaggcggtgcgtgaagccatcctgaaccagcacctgatcaccaaggaagccgtcttcgcggcgctggagtggaagacgccgaacggctgcgacaagtgccgcccggccgtcaattactacctgatttcgacctggccgcatgaagccaaggacgatccgcaatcgcgcttcatcaacgagcgttcacacgccaacatccagaaggacggtacctactcggtcgtgccgcgcatgtggggcggtctgaccaaccccaaggaactgcgcgccattgccgatgccgccgagaagtacaacgtgccgaccgtcaaggtgaccggcggccagcgtattgacctgctcggcgtcaagaaggaagacctgccggccatgtgggccgacctcaacgccgccggcatggtttccggccacgcctacggcaagtcgatccgcaccgtgaagacttgcgtcggcatggagcactgccgcttcggtacgcaactggcgatgtcgatgggcgtcaagctggaaaagatgctgttcgacatgtacgcaccgcataaggtcaagctggccgtctccggctgcccgcgtaactgtgccgaagccggcatcaaggacgtcggcatcatcggtgtcgattccggctacgagatctacatcgccggtaacggcggcatcaagaccgaagtcgcccagttcctgtgcaaggtgtcatcggacgaggacgtcatggaatattccggcgccttcctgcaactctaccgcctcgaaggctggtatctggagcgcacctgccactacctggagcgcgttggcatggactacatcaagggcaggattctcgaggatgaagagggtcgcaaggcgctctacgccgcgctgctcgactcgctgaaggatgccaaggacccgtgggccacctcccgcgagccggaagcgatcaagcagttcattcccatcatggttgaagcctga

SEQ ID NO: 1439 - DNA, 2466 bp, Acidovorax sp. JS42
atggtgaagcaatccaggctggtgatggtgggcaatggcatggcaggcgtgcgcgcgctggaagagctgctcaagatcgcgcccgacctctacgacatcacggtgttcggcgccgagccgcaccccaactacaaccgcatcctgctgtcgcccgtgctggcgggcgagcagacgctggaggagatcgtcctcaacgactggtcctggtatgcggaccaccacatcacgctgcacgcggggtgcaccgtgacccatgtggaccgcacgcggcgcaccgtgcatggcgtggcgcaggacgggcgcaccgtcgaggctccctacgaccggctgatcctcgccacgggctccaacccgttcatgctgcccattccgggccgtgagctgcccggcgtgctggcctaccgcgatatcgccgacacgcaggccatgatcgacgctgccgccagctacaagcacgccgtggtgatcggcggcggcctgctgggcctggaggcggccaacggcctcatgaagcgcggcatgcaggtcaccgtggtgcatgcgggcgagtggctcatggagcgccagcttgacgacgtggcgggcaagctgctgcagcagtcgctggccgagcgcggcatgcagttcctgatgcaggcgcagacgcaggaactggtggccggcggcgacggccgcgtggccgcggtgcgcttcaaggacggcagcgaggtgcccgcccagctcgtggtgatggccgtgggcatccgccccaacacggccctggccgagcagatgcacctgcacgtcaaccgcggcatcgtcgtcagcgacacgctgcagaccgtgaccgacccgcgcatctacgccgtgggcgaatgcgcggcgcaccgcggcatcgcctacgggctggtggcgccgctgttcgagcaaggcaaggtgctggccaaccacctggcggaatggggcatcgggcgctaccagggctcgctcacctccaccaagctcaaggtcacgggcatcgacctgttttccgccggcgacttccagggcggcgagggcacggaggaaatcgtgctcagcgacccgcatgccgagggtggcggtgtgtacaagaagctggtgctcaaggacgaccggctcgtgggcgcctgcctctatggcgacacggtggacggcagctggtacttcaagctgctgcgcgacggccgcagcgtggccgacatccgcgaccggctcatgttcggcgaatcgcacctgggcgacgcgggccatcagggccagaacaaggccgccgccatggccgacagcgacgaggtgtgcggctgcaacggcgtgaccaagggccagatctgcaaggccatcaaggacaagggcctgttcacgctggacgaggtgcgcaagcacaccaaggccagcgccagctgcggctcgtgcaccgggctggtggagcagatcctcatggccaccgcgggcggcgactattccgccacgcccaagaccaagcccgtgtgcgcctgcaccgaccacggccaccaggccgtgcgcgaagccatccgcacacaccggctgctgaccgtggacggcgtgtttcgcttcctggagtggaagacgcccaacggctgcgccacctgccgcccggccgtgaactactacctcatcagcacttggcccaaggaggcgcgggacgacccgcaaagccgcttcatcaacgagcgcagccacgccaacatccagaaggacggcacctacagcgtggtgccgcgcatgtggggcggcgagaccagtgccgccgaactgcgccgcatcgccgacgtggtggacaagtaccagatccccacggtgaaggtcacgggcggccagcgcatcgacctgctgggcgtgaaaaaggaagacctggtcaacgtctggcgcgacatcggcatgccctgcggccacgcctacgccaaggcactgcgcaccgtgaagacctgcgtgggcagcgagtggtgccgcatgggcacgcaggacagcacgcagctcggcaaggacctggagcacgccttcgtgggcatgtacgcgccgcacaaggtcaagttcgccgtcagcggctgcccgcgcaactgcgccgagagcggcatcaaggacgtggggatcatcggcgtggactcgggctgggagatgtacgtggccggcaacggcggcatcaagaccgaggtggcgcagttcttcaccaagctcaagaccgccgaggaggtgctggagtacacgggcgccttcatgcagctgtaccgcctggagggctggtacctggagcgcacggtgcatttcgtcgcccgcgtgggattggactacgtcaagcgccgcgtactccaagatgcccccggccgccaagcgctgtggcgcgagctgcaggacgcgctggcgggcgagcccgacccgtggttcgagttcgagccggcggcggtggaccggcgccagttcatcccgatcacgccgatccccgcatga

SEQ ID NO: 1440 - DNA, 2478 bp, Verminephrobacter eiseniae EF01-2
atgaaaaagcctcaactggtgctggtgggcaacggcatggccggtgtgcgcacgctggaagaactgctcaggatcgcccccgatcggtacgacatcacggtgttcggggccgagccgcacccgaactacaaccgtatcctgctgtcgccggtattggccggcgagcagagcatggaccagatcatcctcaacgactggtcctggtacgccgagcaccacatcacgctgcacagcggctgcacggtgaccgatgcagaccgcgcgcgccgcgtggtccgtgccagcgacgcggcgggcaaggtcatcagcgcccagtacgaccgcctcatcatcgccaccggctccacccccttcatgctgccgattcccggcaccgacctccagggcgtgctgacctaccgcgacatggccgacacccgggccatgatcgctgcggccgcaagctaccggcacgccgtcgtcatcggcggcggcctgctgggcctggaggccgccaacggcctgatgaagcgcggcatgcaggtcaccgtggtgcatgtggccgactggctgatggagcgccagctcgacgccgtggccggcaagatgctgcagcagtcgctgcaagagcgcggcatgcagtttctgctgggcgcgcagacgcaggcgctgctcggccatgccgacggcaacgggccagggcaagggcaaggggccgccccgagggtgcgcgccgtccgattcaaggacggcagcgaactgcccgccgacctggtggtgatggccgtcggcatccgccccaacaccgcgttggccgaaaggatgcgtctgcatgttcagcgcggcatcgtggtcagcgacacgctgcaaaccaccaccgacgcgcgcatctacgcggtgggcgaatgcgccgcccaccgcggcatcgcctacgggctggtggccccgctgttcgagcagggcaaggtgctggccaaccatctggccgaattcggcatcggccgctaccaaggctcgcagacctcgaccaagctcaaggtcaccggcatcgacctgttctcggccggcaactttcacgggggcgggcacagcgaagaaatcgtgctcagcgaccccggcgccggcgtgtacaagaaactcgtcatccaggacgacaaactcgtgggcgcctgcctgtatggcgacacggtagacggcaactggtacttcaagctgctgcgcgatggccgcagcgtggacgacatccgcgacaagctgatgttcggcgaatcccagttgggcgacaccggccaccagggccagcacaaggccgcagcgctgcaagacagcgacgaagtctgcggctgcaacggcgtgaccaagggccgcatctgcaaagccatccgggagcagggcctgttcaccctcgaagaggtgcgcaagcacaccaaggccagcgccagttgcggctcgtgcaccgggctggtcgagcagatcctgatgttcgccgccggcggcgactacagcgccacgcccaaaacccgcgccctgtgcggctgcaccgggcatggccaccaggccgtgcgcgatgccatccgcaccctgaagctgctcagcatccaggcggtcttcgagcacctgcaatggcgcacgcccaacggctgcgccagttgccgcccggccgtgaactactatctcgtcagcacctggcccaaggacgccagggacgacccgcaaagccgcgccatcaacgagcgcagccacgccaacatccagaaagacggcagctacagcgtcatcccgcgcatatggggcggcgagaccacggccgacgaactgcgccgcattgccgatgtcgccgacaaataccgtatcccgaccatcaagctcaccggcggccagcgcatcgacctgctgggcgtgaagaaggaagacctggtaggcgtctggaaagacctggccatgcccagcggccacgcctacgccaaggccctgcgcacggtcaagacctgcgtgggcagcgaatggtgccgcatgggcgtgcaagacagcacccgcctgggcaaggaactcgaacgcgcgatgtggcgcatgtatgccccgcacaaactcaaattcgccgtctcgggctgcccgcgcaactgcgccgaagccggcatcaaggacgtgggcatcatcggcgtggacagcggctgggagatgtacatcgccggcaacggcggcatcaagaccgaggtggcgcatttcttcaccaagctcaagaccgcccaggaggtgctggaatacaccggcgcgttctgcgagctctaccgccaggaaggctggtaccaggagcgcagcgtgcactacgtgggccgcgtgggcctggagcatgtgaaaaagcgcattctccaagacccggccgggcgcaaggcgctgtgggaacgactgcaatgtgcgctggccgatgagcccgacccctgggtcgagttcgacaaggcggcgctggacacacgccagtttgccgcgctgaacgcctga

SEQ ID NO: 1441 - DNA, 1341 bp, Geobacter sulfurreducens
gtgacggaaaacaagtatctgtatgtagaaacattcggatgtcagatgaatgtcaacgactccgaaaagatcgcgacgctcctgaaagatgaggggtatctccccaccgacgatccggaacgggccgacttggtcattctcaacacgtgcagcgtgagggccaaggccgagcagaaagtatacgggcaccttggccggttcaagggcgtccggagcaggaagaagggattcctgctcggcgtgggggggtgtgtggcacagcaggagggagagcgcctgctgcagaaggttccctggctcgatctggtcttcggcacccacaatctccacctgctgccggagattgtgcgggcggccgagcggggcgagcgccgggccgaggtggggttcatcgacaacgaaacccggctcgacctgttccccgagacaggtggagagggtggtgtcacccgctttgtgacggtgatgcagggttgtgacaatttttgttcctactgcattgtcccctatgtgagggggcgcgagataagtcgccgttcatccgacataattgacgaggtgcgaaagtccgttgcggagggtgtcaaggaagtgactcttctggggcagaatgtcaactcttatggtctcaagaccgagggagagttgtcgttcgccggactcatccgtcgcattgccgaggtggaggggcttgaacggatacgtttcaccacgtcacacccgaaggatatctcgcccgagctcatcgcctgcttcgccgaggtacccaagctgtgcggccacattcatctgccggcccagtcggggagcgatgcggtccttgcgcgcatgaaccggggatacacccgggccgggtacctcgaaaaggtggaggccctcagggcagcccggccgggtatccagttcacgggagacatgatcgtgggcttcccgggtgagacggaagaggacttccaggcaaccatctcgctcatggaggaagtgcgctacgccgatctcttttccttcatctactcgccgcgccctgaaacggccgcggccggtatccgggatacggtgagccggaaggagaagcagtcgcgcctcgaccggctccagacactccagcagcagatgaagcgcgagcgcaacatcagctttgtcggcacccgccagcttgtcctggtggagggggtgagcaagcgaggcgatcagctctacggtcgcatcgacggcaaccggatcgtcaacttcgcggccgaccagtcgctcatcggaaccatggcagaggtaaccatcacccaggactatcagaattcgctgctgggcgaaatcgtcaccgataaaggggacgcacggtaa

SEQ ID NO: 1442 - DNA, 1326 bp, Geobacter metallireducens GS-15
gtgaccggcgaaaaacttctgtatatcgaaacctttggttgccagatgaacgtgagcgattccgagaaggtggcgtcgctcctgaggggggaggggtactcccagactcccgattcatcggaggcggacctgattattgtgaacacctgcagcgtgcgggcaaaggccgagcacaaggtctacagctacctgggccgctttcggaagcttaagcgtgacagacggttgcttctgggcgtgggggggtgcgtggcgcagcaggagggggaacggctcctgaagcgggtgccgtggctcgatctcgtcttcggaacgcacaacctccatcttttgccggagatggtcagggccgcggagcagggagagcgcagggccgcggtggatttcatcgacaacgaggcaaggctcgacttgttcccgcaagccgacgaaggggggggcgtaacccgcttcgtgacggtcatgcaggggtgcgacaacttctgctcctactgcatcgtcccttacgtgcggggaagagagatcagccgccgttccgtcgagatcatcggagagattcgcagcgccgtggctggtggcgtgcgggaggtgacgcttctgggccagaatgtcaactcctacgggctgaagacgccgggtgagctgagttttgcggggctcctgcgggaaatttcggccatcgacggcctggagcggatccgcttcaccacctcccacccgaaggatatctcaccggagctcattgcctgcttcgccgagcttcccaagctctgcggacacatccatctgccggcccaggcggggagcgattcgattctggcacgcatgaacaggggctatacgcggcaggaatacctggaaaaggtggcagcgctcagggcggctcgcccggagatcctcataaccggggacatcatcgtcggcttccccggtgagacggaggccgattttctccagaccctctccctcatggaggaggtccgctataccgacatcttttcctttgcctattccccccgccccgagaccgccgccgcgtccctcggcgacaggattatgcgcaaggagaccacggagcgcctggaacgggttcaggggctccagcgggacatgaccattgagaggcatgccggctttgtcggcacctgccaggcggtcctcgtggaagggatgagcaagcggggagaccagctctacggccgcaccgacggcaacctgatcgtgaactttgccggcaatccctccctcgcaggttccctcgtcgacgtgcgcatcactcgcggctacccgaattcgctcctgggcgaactcgcagtttttcaataa

SEQ ID NO: 1443 - DNA, 1395 bp, Desulfovibrio desulfuricans G20
atgcatgaaagaactttccatataatgacctttggctgccagatgaacgtcaacgattccgactggctggcgcgtgccctggaagcccgcggctttacacaggttccggaacatgaggccgccatatacatcatcaacacctgttcagtccgcgacaaaccggaacagaaagtctattcactgctcggacgcatacgcagagaaacaaaaaacagacggaatgtgaccgtatgtgtgggcggctgcgtggcgcagcagataggcaaaggctttttcaagcggttcagtcaggtccggctggtattcggcaccgacggggcagccagcgcgccgcaggccatcgaacggctggtgcaggaaccgcacgcccgcatcagcctgctggatttttccgaagaatttcccgaacgcgatgcagggtgggaaaacggcgaagtacctgtctccgcgtatgtcaatattatgcaggggtgcaacaacttctgcgcatactgcattgtgccctacacccgcggcaggcagaaatcgcgcagttcggccgccgtgctggacgaatgcagaacgctggtcggcaacggagcgcgggaaatcaccctgctggggcagaacgttaattcctacgggcttgatccgcacggcgacgggacaacgtttgcccggctgctgcatgacgtggctgccatacccggtcttgaaaggctgcgtttcatgactccgcatcccaaagacatagccggtgaagtcattgaagccttcggagcgctgaaaaatctctgccccagagtacacctgccgctgcagtccggttctgacagagtgctcaaagccatgggccgcaaatacgacatggcccgctacatggacattgttacccgtctgaaagcggtccgccccgacattcagataaccagcgacctcatagtcggttttccgggcgaaacggaagcagattttgaacagacgctggaagccatgcgcaccgtgccctttgttcagagcttttcattcatctattccgacaggcccggcacacgggctgagatgctgcccggcaagctttcgcgcgaagaaaaaaccgcacggcttgtcaggctgcaggaagtgcagaatgaatacagtgaagcagcgctgcaggctatggtcggcaaaacagtcatggtgctgtttgaaagccccagccccaaaagtgcagccggttccggtacggacgcacagaatgcagcggaagaatcgggccggacggcatcctcatggcagggacgggacgagcacggctttatactgaacgtgcacctgcccgcacccgcagacctgtacggcaaaataatgcccgtcacagtgaccgccgcacgcaaacactcgctgacgggcgaacccgcgggggaatcatgctga

SEQ ID NO: 1444 - DNA, 1335 bp, Candidatus Koribacter versatilis Ellin345
gtgcctgtgagttccgacccaaaaaccttctatattgagacctttggctgccagatgaactttcacgactcagaaaaggtcgtgggaacgctcatttcccaaggctaccgtcaggtcgagacggaactggacgccggcctcatcctctacaacacctgctcgattcgagataaagcggagcagaaggtcttccatcgcctgagcgaattccggcagcttcaaaaggaaggcaagcgattcgcagtgctcggctgcgtggcgcagcaggaaggcgaaaagatcttcgagcgtgcgccgcacgtttctctggttgcgggttcagcctcgtaccgcaatttggcggagatgctggtgcagatcgagagcggcagccagcgcatcactggcctcgacgaccgcgagaccgaccagaccttcgagactgagttcactgcgcgcggcaacgcgcaccgcggatacatcacgatcatcgaaggctgcgacaagttctgcgcctactgcgtagtgccgtacacgcgcggcaaagagcgcagccgtagcgccgagagcgtgctgagagaagcgcgccagatggccgatgccggcttcacagatgtccaactgctcggccagaacgtgaactcctaccacgatcccagcggaacgatgacgttcgccgaactgctgacagcagttggcgagatcacgggaatcaaacgggttcgcttcactacttcgcacccacgcgacttcactcgcgacatcgttgaggcgatcgacaatcacccgacgctctgtgaccacgtgcatctgccggtgcagagcggttcgagcaaagtgctgcgcgagatgttccgcgagtacacccgcgaacagtatctcgaacgtatctcttggatgaaggcgacgaagaaccggaagctcagcattacaacggacgtcattgttggattccctggcgaaaccgagaccgaattcgaagagacgctggctctgcttgatcacgttcaatacgacggtgtgttctcgttcaagtattcgccgcgtcctaatactccggcgctgaagtacattgacaccgttcccgagcaggagaaatcgcgtcgattacagatcctgatggaacaccagcgtgagatccagcgtgctaattatcgcaagcacatcggcgagaccattgaagtaatggttgaagccgaaaatgcgacgcgcgcgcaatggattggccgaacctcacagaacaagacactgaattttacagtcccgcaaaccgtgcagcccgaaatcgggtcatatcatcaagtgctggtaacccaggcattccccaacagcctggtgggagaactcgtcggctaa

SEQ ID NO: 1445 - DNA, 1335 bp, Moorella thermoacetica ATCC 39073
gtggtaaaagcaagaaaaaccttcaagattataacctatggctgtcagatgaaccagagggacagcgaaatgatggccgatctccttcaagatgctggctatgaaccggtggcccgggaagaagaagccggcgtaatcatcctcgatacctgttgcgtccgggagaaggctgaaaataaggtttacggcaaactgggccagatcgagaagttaaagagtgccaacccggacctggtaattgctgtggccgggtgtatggtccagcagccgggggtcgccgagaaaatccgccagcaggcaccttatgtcgatctcctcctggggaccggtaacctccaggagctgccgcaactgatcgaggaaatcaaggccatgcaccggcccaggatagttgtcggcgagcaggaaggaccggtagtggaggatctcccccggcggcgggccaggggggcccaggcctttgtaaccataacctacggttgcaataacttttgcacctattgtattgtcccctatgtccgcgggcgggagagaagccgccggccggagaatataatcaaagaagtaaaagaactggttgaccagggagtaattgaagttaccctcctgggccagaatgtcaactcttatggccgcgacttgagagacgggatcaattttgccggcctgctggagcgtgttaatgctgttgaaggtttaaagcgtatacgttatgtaacttcccaccccagggattttacccccgaactggtaactactattagccggttggataaagtctgtgaacatgttcatctgcctgtgcaggccggcagtaaccggatcctggaactcatgcaccggggttataccagggaacactacctggaactggttgccgacctgcggcgccatatcccggggatcagcctgacgacggatctcattgttggttttcccggggagacagaagccgactttgaggataccctggacctggttgccagggtgcagttcgataatgcctttacctttatgtactcgccgcgacggggcacggaggctgccaccatgccgggtcagctgcccacggccatcaagaaggagcgcctgaagcggttgatggaactccagaacagcatcagcctggcgaagaatgaagccctggtaggccaggaagtggaagttctcgtggaaggccccagtaaaaccgatcccgaccagttgagcggccgtacccggaccaataagctaattattttccccggggatcaatccctgaccggccggctggtaagggtgcggttaacccgagcccagacttggttattaaaaggagaaatggttgatggctag

SEQ ID NO: 1446 - DNA, 1371 bp, Syntrophobacter fumaroxidans MPOB
atgatcactccgcttgccaagacggcccccgcgccgcgttacctgtacgttcgcaccttcggctgccagatgaacgaatacgacagtcagcgggccctccggctgctctgcgccgtagggtatcgtcccacttcggacattgccgacgccgacgtgatctttctcaacacgtgctccgtgcgcgacaaggccgagcagaaggtctactccttcctggggcgtctgcgccgcctgaaggcgcaccgtccatggctgaaaatcgttgtcgcgggatgcgtcgctcagcagttgggcgacggcctgctcaagcgtttcgaacacgtcgacctggtggttgggacccgcggaatcggctccatcgcctctttgctggaagaagtcgaacggtcgaaacggagggtcgcgcatttgcccgccgaagagctgcaggggttcacgacggataagtgcaggacggtggggaccggtgatgtggtcgctcaggtgaccatcatgcagggctgcaacaatttctgcacctattgcatcgtaccgcacgttcgagggcgcgaaaggagccgcgcgcccgacgacatcctgcgcgagatcgacttcctggcgtcccgcggcgccagggaagtgctgctgctgggacagaacgtgaattcctacggccgggggctgccggacccgatttcttttcccgatctgctgcgccgcatcgggaaggaaacatccatcaggcgggtccgcttcaccacgtcccaccccaaggacctcacggaagatctcatcgagtgtttcgccggcctgccctttctgtgcaaacacctgcatctgccctttcagtcgggttcggacggcatcctcaagctcatgcaccgcgggtacaccgcgcggcagtacctcgaaaagattgcccggctgcgggaggtgtgtcctgaaatcgcgctttcgacggacgtcatcgtggggttccccgcagagagtgaggaggactacctgcaaaccctgcggctcattgaagaggtccgtttcgactcgcttttctcattccgctactcggaccgtccgctcacgcgggcagccggttttcccgacaaggtgcccatggacgtcaaggtccgaaggctggcacggttgcagagcatccaggcagacattactttgcagaagaaccttgccgaaacagggactgtccgggaggtgctcgtagaaggtccgagcaaggcgtccaacgggcagatgaccggccggacccagcaaaacaggatcatcaacttccagtgccctgtcgatctcacgggtaaaatcgttcctgtccggattgtcgccgcctattcccattcgctcaaaggcgaactgttgtctcaaccggggaaagaaagttaa

SEQ ID NO: 1447 - DNA, 1431 bp, Desulfovibrio vulgaris DP4
atgccacggccagacaggcaccgcagcacagtcccccgcaacacactccgcgccagcgcgcaagccgacacgataccccccatgcacgaccgcacattccacatagagacgttcggctgccagatgaacgtcaacgactcggactggctcgcccgcgccctcatggagcgcggcttctcacccgcccccttcggtgaggcgagactgaccatcgtcaacacctgttccgtacgcgacaagcccgaacagaaggtctacagcctgttgggccgcatcaggcaagccaccggcaagaaacccgacgccttcgtcgcggtgggcggttgcgttgcacagcagataggttcgggctttttcagccgcttcccgcaagtgcggctcgtcttcggcaccgacggactcgccatggccccgcaagccctcgaccgccttgtcgaggaacccgacctcaaactctcgctgctcgacttttccgaggactacccggaacgcgacgcagtcctcgggcagggggccgtgcccgcgtcggtcttcgtcaatatcatgcaggggtgcgacaacttctgcgcctactgcatcgtgccctacacacgcggcaggcagaagtcgcgcgccacaggcaccatccttgacgaatgccgcgcccttctcgacaggggcgcgagagagataaccctgctgggccagaacgtgaactcgttcgggcaggatagccacggcgacggtaccacgttcgcgcaactgttgcacaaggtcgccgcactgccggggctggagcgcctgcgcttcgtcaccccgcaccccaaggacatcgcccccgaggtggtcgaagccttcggcacgctgcccaacctgtgcccccggctgcatctgccactacaggcagggtcggaccgcatcctcaagctcatgggacggcgctacgacatggcacggtacctgcgcatcgtggacgacctgcgtgccgcacgacccgacatcgtgctctccagcgacatcatcgtgggcttccccggtgagacggaagaggacttcatggagaccatgggcgcactcgagacggtgggctacgccgcctcgtactcgttctgctactccgacaggcccggcacacgcgccgagatgctgcccgacaagctgtcccgcgaggtcaaactcgaacggctcgaacggttgcagacacttcagaacagattgacggaacgatgcctgcaagacatggtaggaaagaaggtcgaggtactcctcgaagggatgagccgcaaaccgggcgacgaaggcgacagctggcagggccgcgacccctacggaaacctggtcaacgtcgcgctgccgcaagggtcggacgtgcgtggaaggttcttgcccgtcgtcgtcgcgcaggccaagaagcattcgctcctcgcggagcaggcaggtgcgccatggtag

SEQ ID NO: 1448 - DNA, 1323 bp, Geobacter uraniumreducens Rf4
gtgacaagagaaaaactgctgtacctcgaaactttcggctgccagatgaatgtcagtgattcggaaaaaatcgcagcgctgctgaaagggatcggttattttcccacccaggactcatctcaggctgatcttgtaattctcaatacctgcagtgtcagagcgaaagcggaagagaaggtctacaatcatcttgtccagtacaaggggctgaaacggaaaaaaccgggcatcattctcggggtaggcggctgtgttgcccaacaggagggtgagcggctgctggcaaatgtcccacatctggacatcgtattcggaacccacaatcttcacctgttgccggagctggtcagagcggcggagaagggggagcggcttgcggaagtcggttttatcgacaacgaaaccaggcttgatctctttcccgttgatgaacggacagacggggtctcccgcttcgtcaccgtcatgcaggggtgtgaaaatttctgctcctactgcatcgtcccttatgtgcgcggaagggagatcagccgccgctcggcagacatcctcggcgaggtcaggggaatggcgggaaatggagtcaaggaagtgaccctcctgggtcaaaatgtcaactcttacggtctcaaaagttccggcgagatgagctttatcgccctgttgcgagaggtgtcgctgatcccgggcatcgagcgcatccgctttaccacttcccatcccaaggatttttctcagccgctgatcgattgttttgccgaaatccccaaactatgcagacatattcatctgcctgcccagtcggggagcaacgcggtgctggcggcaatgaacagggggtatacccgcgaggaatacctcgggtcgattgcccgcctgaaggccgcatgtccttcgatccagataaccggcgacatcatcgtcggtttccccggcgaaacggaggaggatttccaggcaaccctgtcgctcatggaggaggtgaggtataccgatgtcttctccttcatctattcaaaacggccggaaacaaaggcggccggatatgcagacgaagtcggccaggatgaaaagcaggggcgtctcagccgcttgctggatcttcagcggcgcatcaccctggaaaccaacaagagctttgtcggcaccgttcagcaggtcctcatcgaaggggagagcaggcgggggggacagttttacggccggacttcggggaacagggttgttaacctcgcagcagatgtctccctggtaggaagcatcgtcaatgtcatgattacccgcggtgatcagaattcgttgcagggggagctctgccggtag

SEQ ID NO: 1449 - DNA, 1401 bp, Candidatus Desulfococcus oleovorans Hxd3
atgaagcggttttacatccataccatcggctgccagatgaacgtgtacgattcatcccagctgtcggccatccttaccgccatgggccaccgatccgtaaacgcacctgaacaggccgacctggtctttgtcaacacctgcaccattcgggccaaggccaaacagaaggccaccagctttgtgggccggctggccgccatgaagcgggcccggccggacatgatcgtcggcgtgggtggatgcctggcccaggaggagggccggcagttacttgacgctttcccctgcgtggatatcgtgttcggcacccatgccctgggccggctgcccggacatattcaggccgtggcgcaccagggcgaccgcatcgtggacgtggagatgaccgccgccatcgacgaatcggtgcatgcccttcaggggccggacagcagcggggtaaccggttttatcaccatcatgcgggggtgcgacaacttctgcacctactgtgtggttccctatgtgaggggccgggagaccagccgcgcgccggagcatattcttgatgagattcgggcccgtgtggccggcgggctgcgggagatcaccctgctgggccagaacgtgaacagctatggccaaaaagaggggctctgctcttttgccgaccttctggccagggtcaacgagattgacgggctgcaccgcattcggtttaccacctcccatcccaaggacctttcaccggaactggcagcggcctttacctcccttgacaaactgtgcagtcacgtgcacctgccggcccagtccggttccgatgctgttttaaagcgcatgaaccgacgctacacccggcaggcctatctggaaaaacttcactggctgagggaggcccaacccggcatggccctttccaccgatatcattgtggggtttcccggggagacggagcaggattttttacagaccctggacctgatcgaaaaggtccggtacgacagcatctttgccttcatgtattcagaccggcccctggcaccggcccgtgcgtttgacggcaaggtggatgaagcggaaaagcagcagcgcatttacgccctgctggaactgcagaaccggatcaccgctgaaaaaaacagggcgctggagggccgtgtcgaacaggtgctggtggagggcaaaagcaagtcctcgggcagaaacgacatcacggcggataccgtccagtggaccggccgcaccacctgcaaccgggtggccaatttcacggtgccccgggagcttgccagcggcaatgccgttggaccgggcgccatggtgcgcgtggagatcatgtccggcctggcccacagcctgtccggcattgccgtaggtgttgagaaaccgggagcaggaggagacgcgcatgctgcataa

SEQ ID NO: 1450 - DNA, 1314 bp, Sulfurihydrogenibium YO3AOP1
atgaagttttacataaaaacttttggatgtcagatgaatgtaaatgactcagaaaaaatggcaggtattttacaaactcttggatatacacctactgaaaattgggaagaagcagatgttatactcgtaaatacatgttcagtaagagaaaaaccagaccaaaaagttttatcagcacttggtgagtttaaaaaagtaaaaaaacataatccaaatgcagtcattggcgtttgcggttgcttagcacaaagggcaggatacgaaatttatcaaaaagcaccatttatagatatagtttttggaacgactaatatccaccatcttccaaatcttttagaagaagcaaaaagcggaaataaagctatagaaattttagaagaaatagacgagaacgaaaatcttttagaccagttcccaactgtaagagaaaataaatatacagcattcgttactgtaattagaggatgtgataaaaaatgtacttactgcatagttccaacaacaagaggtagagaaagaagtagaagaatcggcgatattctaagagaagttcaatacttagttgaagatggtgttaaagaaatccatttaataggtcaaaatgttactgcttacggaaaagattttggagatgtgaagttttgggagcttttaaaagctgtggcagaggttgatggagtagaaagaattagatttacaacagggcatccaagagatttagatgaagatactataaaagttatggcagacctgccgcaaatctgtgaagccttacatctaccaatccaggcaggttcagacagaatactgcaagcaatggatagaggatatactcaaaaagagtacctgcaaaaaatagagctgcttaaaaagtacattccaaatatagcattgtctactgatatcatagttggatttccgggagaaacttacgaagattacttagaaacagttaaagttataaaagaagtagagtatgaccaagtgtttgcatttaaatattcaccaagaccaggaactccagcagcagatttaccaatgacagagtcgccggaagagctttcaaaacgtttaaatgacttgataaatttacaaaaagatataacttttaaaaagaatcttgaatatcaagataaaatagttgaaatcttggtagaagagataaaccaagagaataagttggtaggcagaacaaggactaataaacttgtttatgcagaaggaagtccagagtatttaggaaaattagtaaatgtaaaaattgaaaaagtaaatagattttccttagaaggaagtataattggaggcgattaa

SEQ ID NO: 1451 - DNA, 1326 bp, Geobacter bemidjiensis Bem
gtgaaccaagcaaaaaagctgtacctggaaaccttcggttgccagatgaatgtaagtgattcagagaagatagttaccctgatgaaggggatgggataccagcagacgcaggacccggtcgatgccgacctggttttattgaacacctgcagcatcagggctaccgccgaacagcgggtctacgggcacttggggaagttcaagtcgatcaagaagacaaagccggggctcatcatcggcgttggcggctgcgtggcccagcaggagggggaaaagctcctcaagaaagcgcctttcgtaaaccttgtcttcggcacccataacctgcacctgctgcagggaatggtcgcggccgccgaggaagggaagcggagcagccagaccgactttctcgacgacgaaaagcggttcgatctcttcccgcactccgaggcggaagggggagtgacccggttcgtcaccgtgatgcagggatgcgataatttctgcgcctactgcatcgtcccgcacgtgcgcggccgcgagatcagcaggagcgccgccaaggtggtcgaagaggtacgggccctagccgattccggcgtcaccgaggtgacccttctgggacagaacgtgaactcttattgctccaagcagccgggggagccggatttcccggaccttttgcgcctggtggcgcaggtcgatggcatcgagcgtatccggttcaccacctcgcatcccaaggacatgtcgccaaggctcattgagtgcttcgccgatcttcccaagcttgccccccacattcaccttcccgcccagtcgggaagcgaccgggtgcttgagcggatgaaccgcggctacacggcgcagcaatacctggccaaggtggcggcgctcaaagaggcctgccccgcgatccagttcaccggcgacatgatcgtcggctttccaggcgaggacgaggcggcctttcaggacaccatggcattgatggagcaggtgcagtacgccgatctcttctccttcatctactcggcgcgcccgggaaccaaagccgccgagtatgcggacgatgcgacccgtgccgagaagcaggggcgcctggaaaggttgcaggcggcccagaagaagaccactttggctaggaaccggagcctggaggggacggtgcaaaaggtgctggtggagggtttgagcagcacaggcgactccctcttcggcaggaccggcggcaaccgcggcaccgtcatggcgggggacccctccctggccggacgggtgttggacgtgaagatagtggaagggttgcagaccctgctcaagggcgagatcgtccatgactga

SEQ ID NO: 1452 - DNA, 1437 bp, Desulfovibrio vulgaris  Miyazaki F
atgagcgaccgtacatttcatatcctgacctttggctgccagatgaacgtcaacgattccgactggctggccagagcccttgtggcgcgcggcttcaccgaagcccccctgggcaaggcccgcgtgaacatcgtcaacacctgctcggtgcgcgacaagccggagcagaaggtctacagcgtgctcgggcgcatccgccaggccacccgcaagctgcccgacgcctttgccgtggtgggtggctgcgtggcccagcagatcggctccgggttcttcacccgttttccgcaggtgcggctggtgttcggcggcgacggctcgtccatggctccacaggccatcgaacggctgtgcgccgagccgggcctgcgcctctcgctgctggacttttccgaggaataccccgagcgcgacgcccaactggacgccgggccggtgccgccttccgccttcgtgaacatcatgcagggctgcgacaacttctgcgcctactgcatcgtgccgtacacgcggggccgccagaagtcgcgcgcggcggacgcggtggtgcgcgaatgcgcggaactggtggagcgcggcgcgaaggaaatcaccctgctcggccagaacgtcaattcctacgggcaggacgcggaagccgcccgccaggcaacggtggcgggtgacggcaacgccgtgaccttcgccgagctgctgcaccgcgtggccgccctgcccgggctggcccggctgcgtttcgtcacgccgcaccccaaggacatcgcgccggaggtcatcgacgccttcggcacgctggacaacctgtgcccgcgcctgcacctgcctatgcaatcagggtcggaccgcatcctgaaggccatgggccgcaagtacgacatggcccggtacatggacatcgtgcaccggctgaaggcggcccgaccggacatccagctttccaccgacatcatcgtgggctttcccggcgagacggagcaggacttcgaggacaccctgtccgccatgcgggccgtgggctttgccgccagcttctcgttctgctattccgacaggccgggcacccgcgcggaaatgctgcccggcaagctggacgccgccgaaaaggccgcccgcctggcccgtctgcaggaatggcagaatgattatactgaacagtgcttgcggaacatggtagggttgcacacaatggtgctgctggacggcatgagccgcaaacccggcatggccaccccggaatcgcacgagggcgtgcatgacggcgccacgggcactcccggcggtgaaagctggcaggggcgcgacccatacggccaggcagtcaacgtggtgatgcccccccgtacggagggcggcccggaaggctggctgggccggatcgtgccggtgaccatcgtggaggccaagaagcattcgctgcgcggagtattgcgggcatga

SEQ ID NO: 1453 - DNA, 1365 bp, Desulfovibrio desulfuricans ATCC 27774
atgatcgaaaaatcttatcatatcattacgttcggctgccagatgaacgtgcacgactcccagtggctgggccgtgccctcacagctcgcgggtttgttgaagcttcacttgaagatgcgcaggtggtggttgtcaatacctgttccgtgcgtgaaaaaccggaacaaaaggtcatgagcgcccttggccgcatccgccacgttactggcggcaatcccgatgtgctggtaggggtcgcaggctgcgtggcgcagcaattgggtgaagggtttttcagcaaggaaagccaggtgcgcctggtggcgggcagcgacggcataagcggtgcgcctgcagcaatcgaacgcctgctggaagagccgaccctgcacttgtcattgctggatttcaccagccactatatcgaacgcgaggccggtccgggaacatccggatcctcctcaggcccggtggcctttgtcaacatcatgcaaggctgcgacaacttttgcgcgtattgcattgttccctttacccggggacgccagaaatcgcgctcggcagccgctatccttgatgaatgccgcgccgtgctcgagcggggcgcgcgcgagatcacactgctggggcagaatgtcaatgccttcggccaggataaaagcggcgatggaacaagctttgcacagcttttacgccaggtggccggtctgcccgggcttgagcgcctgcgctatgtcacccctcaccccaaggatatggggccggaagacgtagccgcttttgcggaattgccccagctatgcccccgtctgcaccttcccctgcaggccggatcagatgtggtactcaggagcatgcgccgccggtacgacagcgcggccttcttgcgccttgtggacgatctgcgcgccgcaaggccggacctcgccctgtccactgacctgattgtggcttttcccggtgaaacggaagaagactttcaggacacacttgccatgatgcgtgcctgcaacttcatgtccagcttttctttcatatattccgacaggcctggagccagagccgcgctttttccaggtaaaatcgctccggacgtggcccaggacaggctgcggcggcttcaggccctccaggacgacctgggagcacgctggctggcggcccgggttgaaaacagggacaagacaaccctgctcatggaaggcccaagccccaaaccgggcgaaagtgccgaaccaagctggcaggggcgtgacccgtacggagtaccggtgcatgtaccgttgcccgccggggctgatcacacaggttttctggtgcaaaccgtcattacagaggccaagaagcacagcctgctggccgtgcgcacgggggagccatggtag

SEQ ID NO: 1454 - DNA, 1335 bp, Desulfomicrobium baculatum DSM 4028
gtgaggtttcatatactgacttttggatgccagatgaatgtggcggacgccgactggttgacccaatctttggtctccagaggctggaccgaggcgggcgaatccgacgcccaggttttcgtggtcacgacgtgcagcgtgcgggaaaagcccgaacagaaagtgtattccctgctcggccggctgaagagctacgccgaccggagtccggatgttttcgtggccgtgggcggctgcgtggctcagcagatcggcgaggaattctggaaccgttttcctttcgttcgcctggttttcggcaccgacggaacggccatggtgccccaggctctggagcggctggccaacgaccctgcgctacggataagcctgcttgattttctggaccattatcccgaacgcgaacagcccgaaggcggtactgtccaggctcaggcctttgtgaacatcatgcaggggtgcgataatttttgcgcctactgcatcgtgcctttcaccaggggacggcagaaatcgcgcagctcggacgccgtggtggccgaatgcgaggccctggtgcgtcgtggcgcgcgcgaactgacccttttggggcagaacgtgaacagctacggccaggacaagcatggcgacggaacatcctttgcgtcgctcctggagcggatatccgccattcccggcctcatgcgcctcaaattcacgacatcgcatcccaaggacatcgccccggaggttgtgaccgcattcggcaaactgcccaatctttgcccgcagctgcatctgcccgtgcagtccgggtccgacgcagtcctgaaggccatggggcgcaaatacacacgggcgcgttacctggacacgatccgcgagctgcgccgggtttgcccgcaaattaccctgaccacggacatcattgtcggttttccgggcgagactcttcaggattttgaagatactctggaacttatgcgtgaagtgcggtacgaatccagcttctccttcaagtattcggaccggccgggggtgcgcgccgaaaagatggatttcaaggtgcccgaagaagagaagtcgcggcgtctcgcggtgctgcaggagatgcaggaccgaatcaccgtcgaggagttggccgcgcaggtggggtcgatggccgaagtgctggtcgaagggccgagcaagatgcaggacagtgagtatattttttggagaggccgtgacgggggcggacggattgtcaatttctcatcgcccataccttgcctgactggcagaatggttcgcgtgcgcatcgtggacgcgaagaaacactccctcgtgggagagattcgaggtgaaccgtggtag

SEQ ID NO: 1455 - DNA, 1326 bp, Geobacter M21
gtgaaccaagcaaaaaagctctacctggaaaccttcggttgccagatgaatgttagtgattccgagaagatagttaccctgatgaagggtatgggataccagcagacccaggacccggttgacgccgacctggttttattgaacacctgcagcatcagggctaccgccgagcagcgggtctacgggcacctggggaagttcaagtcgatcaagaagggaaagcccgggctcatcatcggcgtcggcggctgcgtggcccagcaggagggggaaaagctcctcaagaaagcaccattcgtaaaccttgtcttcggcacccataacctgcacctgctgcaggggatggtcgcggccgccgaacaaggtaaacggagcagccagaccgattttctcgacgacgagaaacggttcgacctgttcccgcatgccgaggcggaggggggagtgacccgcttcgtcaccgtcatgcagggatgcgataatttctgcgcctactgcatcgtgccgcacgtgcgcggccgcgagatcagcaggagcgccgtcaaggtggtcgaagaggtacgggccctggccgggggcggcgtcaccgaggtgacccttttggggcagaacgtgaactcttattgctccaagcagccgggggagccggatttccccgaccttttgcgcttggtggcgcaggtcgatggcatcgagcgtatccggttcaccacctcgcatccaaaagacatgtcgccgaggctcatagagtgcttcgccgatcttcccaagcttgccccccacatccaccttcccgcccagtcgggaagcgatcgtgtgcttgagcggatgaaccgcggctataccgcgcagcaatacctggccaaggtggcggcgctcaaagaggcctgccccgcgatccagttcaccggcgacatgatcgtcggctttcccggcgaggacgaggcggcctttcaggagaccatggccctgatggaggaggtgcggtacgccgacctcttctccttcatctactcggctcgcccggggacgaaagcggccgagtacgcggacgacgcgactcgtgccgagaagcaggggcgcctggaaaggctgcaggcggcccagaagaagaccaccctggccaggaaccggagcctggaggggacggtgcaaaaggtgctggtggaggggctgagcagcacaggcgactccctcttcggcaggaccggcggcaatcgcggcaccgtcatggcgggggacccctccctggcggggcgggtgttggacgtgaagatagtggaagggttgcagaccctgctcaagggcgagatcgtgcatgactga

SEQ ID NO: 1456 - DNA, 1338 bp, Desulfohalobium retbaense DSM 5692
atgcgatttcatataattacccacggttgccagatgaatgtctgtgattcggactggctccaccgggccctggtcgatctgggcggggaaccggctgatgaagaatcggccgaggtctttgtcgtcaatacctgcagtgtccgggaaaagccggaacaaaaggtctacagtttgttgggacgcctgcagggctattggcagcgcaatcccaatgtctttgtcgcggtcggcgggtgtgtggcccagcaggtggggacccgtttctggaaacggtttccccatgtgcggctggtctttggcaccgacggcatcgctatggtgccccaggcggtcgaccggttgcgcagcgatccccagctccggctttcgttgctggattttgaagagcactaccccgaacgcgagcaactctggcccgaggccgaagtgcccgcccaggcgtttgtgaatatcatgcagggttgcgacaattactgcgcctattgcatcgtgccgtatacccgggggcggcagaaatcccgcagcagtgcggccgtcctccaggagtgccgagaactggcccggcgcggggccagggagatcacgcttctgggacaaaacgtcaatagttatgggcaggatgcaaatggcgacggcacgtcctttgccgcgctgctggaacaggtctgcgccattcccggcatcgagcaggtccgtttcacgacctcgcaccccaaggatatcgcgcctgaagtcattgccgccttcggacgtttgccggaattgagcccgcatctgcatctgcccctgcaatccggatcggaccgcattctcaaggccatgcgccggcggtatacgcggcagcggtatctggacatcgtcacgggattacgtcaggcccggccggagatcaccctgaccaccgatctcattgtcggctttccaggtgagaccgaggccgattttgaacagaccctggagatgatgcgcgaggtcggttttgcctcgagcttttccttcaaatactcggatcgccctggtgtggctgcggagcagatggaggacaaggtccccgaggagatcaaatcccaccggctgcagcggttgcaatccctgcaggaggaactcaccggcgaggccctgcaggccgaagtcggccggcacgtgaccgtgctcctcagagaaccggggcgccaggacggaggcggcgtgatctggcgggggcgtgaccccggcgggcgcgtggtcaattgccgcacggaactggacagtgcgctgattggctcgtatgtcggggtacgggtgacagaggccaaaaaacattccctgtttggggaagtggagacaggcccatggtag

SEQ ID NO: 1457 - DNA, 366 bp, Brucella suis 1330
atggcaaccgtaaccgttaccatcgatggcaaagcttaccgcatggcttgcgacgaaggacaggaagagcaccttaccgggcttgccgaccgcttcgatcaatatgtggcccatctgaagaattcctttggcgagatcggcgatctgcgtctcaccgtcatggccgggatcatggtgatggacgaactggcggaaatgcaaaagcggatcacggggcttgaaaatgaggcggaaaccctgcgccggtcccgcgatgaggcattgagccgcgccgacagcaacgatgccgctctcacgggcatgttgtcggatgtcgcttcgcgcatcgaacaggtggcatcgcgcatagcgccgcgtaacggctga

SEQ ID NO: 1458 - DNA, 384 bp, Nitrobacter winogradskyi Nb-255
atgagccacgtcaacgtgaccatcaatagccgccagtaccggatggcttgcgaggatggccaggaagaccggctgctgaagctcgcgggcgatctggaaggccgtatcggccagttgcgcggcaagttcggagaaatcggggatcagcgtctcgaggtcatggcggctctggtgacatccgacgaactgatggatgcgcagcagcgcatccgcgctctggaggaagagctcaaggcgttgcgcgatgtgcgcgccgcggccgccgagcgcgcccgcgcgacgcagacggcggttgtcgccgcgctgaacatggcggcgcaccggatcgagaagaccacgcaggtactgaaccgcaccgtcggcggcggcatcgccatcgggtga

SEQ ID NO: 1459 - DNA, 411 bp, Rhodopseudomonas palustris HaA2
atgaatccgaaggacgcggccgcctccgccaatcatgtcagcgtcaccatcaacggccggcaataccggatggcctgcgagcccggccaggagccgcagctgctcggcctcgccgacaatctcgagagccggatccagagtctgcgtggccggttcggcgagatcggcgatgcgcggctcacggtgatggccgcgctgatgatggccgacgaactgctcgacgtgcacggccgcctcgccacgttgcagcaggaagtcgaggtgctgcgcgaggaccgcacgcaggcgctcgaccgcaccgtgacgaccaaccgtgccgtcgccgccgcgctgaattcggcggccgagcgcatcgaacgcaccacgcaggtgctgaaccgcaccatcggcggcggcatcgcgatcgggtag

SEQ ID NO: 1460 - DNA, 384 bp, Rhodopseudomonas palustris BisB18
atgagcgaggccaccagccacgtcaacgtcacgatcaacggccggcaataccggatggcctgcgaggagggccaggaggagcggctgatccggctcgccgacgacctcgcggcccgcatcgtgcatctgcgggaaaaattcggcgagatcggcgacgcccggctgatcgtgatggccgcgctgatggtctccgacgagttgctcgacacgcaaagccgcgtcaccgcgctggaacaggagcgcgacgcgctgcgccagggcggcgccgccgccaaagtggtcgagaccgcggtggtcgcggcgttgaattccgccgccgagcgaatcgagaagaccacgcaagtgctcaaccgcaccatcggcggcggcatcgcgatcggctga

SEQ ID NO: 1461 - DNA, 411 bp, Rhodopseudomonas palustris BisB5
atgaatccgaaagatgcggccgcctccgccaaccatgtcagcgtcaccatcaacggccggcaataccggatggcctgcgagccgggccaggagccgcagttacttgggcttgcggataatctcgaaagccggatccagagcctgcgcggccgcttcggcgagatcggcgacgcgcggctgacggtgatggccgcgctgatgatggccgacgaactgctcgacgcccacagccgcctcgcggcgcttcagcaggaagtcgacacgctgcgcgacgatcgcagccagtcgatcgaccgcacggtgacgaccaaccgcgccgtcgccgccgcgctgaactccgccgccgagcggatcgaacgcaccacccaggtgctcaaccgcaccatcggcggcggcatcgcgatcgggtag

SEQ ID NO: 1462 - DNA, 384 bp, Nitrobacter hamburgensis X14
atgagttacgtcaacgtcaccatcaacggccgccaataccgcatggcctgcgaggacggccaggaagaccgactgctgaaacttgcgggcgacctggaaagccggatcggcgagttgcgcggcaagttcggcgagatcggcgatcagcggcttgaggtgatggcggcgctgacggcctccgacgagttgatggatgcgcaccagcgcatccgcgcactcgaggacgaacttaacgcattgggcgacgtgcgcgctgcggccggcgagcacgcgcgcgccacgcaaacggccgtggccgccgcgctgaacatggcggcacagcggatcgagaagacgacgcagaccttgaaccgcaccgtcggcggcggcattgccatggggtga

SEQ ID NO: 1463 - DNA, 360 bp, Mesorhizobium BNC1
atggcccaagttacagtaacgatcgacggcaaggcatatcgtatggcttgtgaagagggccaggaagaacacctcgtggacctcgcgcaacggttcgaccgctatgtcgcccatctgaaggactcctttggcgagatcggcgatcagcgcgtcaccgttatggcgggcatcatggtcatggacgagctttctgagctgcagaggcggatgcgcggcctcgaaagcgagattgcgacgttgcgaaagacgcgcgacgatgcactgcttaaggcagaccaaaatgatgctgcgctgacgggtgccctcgctcaaatcgccgagcgcatcgaggcagttgctgcaaagctggcaggctcgtaa

SEQ ID NO: 1464 - DNA, 426 bp, Maricaulis maris MCS10
atgtctcgcgtgacggtcaaactcaatggtcgcgatttcaccattggctgtgaagaagggcaggaagcctatctgcgggagctcgccggcagtctcgacaagcgtgtcagcgagatatccggccaggtcgggcaaattggcgatctgagactgttgctgatggcctcgctgatcctggtggatgatctcaaggaatctgatcgcaagatcgcggaactggaaggccaggtgcagcgtttgcgtcacgagaaccacggcgccgcaagcttgcaggccgaggcgagggggcagctgactgagcatctcgcccggctggccgacagaatggaaaacttcgccgcgacgcttgaggcagatgatgccgaccctcagggcggtgaccggacatctgcgcctgatgcctcgctcgcggaagctggtgcttga

SEQ ID NO: 1465 - DNA, 384 bp, Bartonella bacilliformis KC583
atggaaactatttcagtcaccattgatggtaaagtgtatcgtatggcttgtgataaagggcaagaagactatcttacaaaacttgctgcgcaattagatcaatatatcacacatttaaaaaataattttggggaaattggcgatcaccgtttatcggttatggccggtattatgattctcgatgaaagagaagaaattaagcaagagtaccaaaaattacaggaaagctacgcaactcttttacaacaaagtcaggaacaagaccatcacattatccaaattatacaggaaacaaccaagcgcattgaaaaactaactcaagaattacgcaaagatgcacatcctcttaatttacagcaagagagcgagccaacagatcgttaa

SEQ ID NO: 1466 - DNA, 384 bp, Bradyrhizobium BTAi1
atgagccacatcaacgtcaccatcaacggccgccaatatcgcatggcctgcgaggagggccaggagctcaggctgctgaagctcgccgagagcctcgaatcccgcatcaccaatctgcgcggcaagttcggcgagatcggtgacgccaggctcaccgtgatggcggcgctcacggtgtgcgacgaactgatcgacgccaatcagcgcgtgcagatgctggagcaggagctcgaaggcctgcgcaatgtgcgcaaccagtccgccgaccgcgcccgcgcgacgcaggttgccgtggccaaggcgctgaacgccgccgccgagcgcatcgagcgcaccacgcaggtgctgaaccgcacgatcggcggtggcgtggcgatcgggtag

SEQ ID NO: 1467 - DNA, 366 bp, Brucella ovis; identical to SEQ ID NO: 1457

SEQ ID NO: 1468 - DNA, 378 bp, Sinorhizobium medicae WSM419
atggcgcaggtgacggtgacgatcgacggcaaggcctaccgtatggcctgcgaggaagggcaggaggatcatctcagcgacctcgctacccggttcgatcaatatgtagggcatttgaaggcccagttcggcgagatcggtgacctcaggctcaccgtcatggcaggtataatggtcatggacgagctgagcgaggtcaatcgccggctgaagagcatcgaggccgaagtggacgacctgaagagaggccgcgataccgcgctttcggatcagacgagaagcgaggaggcgcttgccttcgcgcttggagaggtgacggcgcagattcaggatatcgccgccaaactcaacgggcggccaattcccccggcaaattga

SEQ ID NO: 1469 - DNA, 324 bp, Ochrobactrum anthropi ATCC 49188
atggcctgcgacgaaggacaggaagaacacctgtccgggcttgccgaccgtttcgatcaatatgtcacgcatctcaaaacgtccttcggggagataggcgatctgcgcctgaccgtcatggccgggatcatggtgatggacgaaatggccgagatgcagaaacgtatcaacggtctggaaagcgaagttgaaacgctgcgccgtgcacgtgatgaagcgcttggtcgcgctgatagcaacgatgctgccttgacaggcatgctgtcggatgtggcgtcgcgcatcgagcaggtggcttcgcgcatcgcaccacggaacagctga

SEQ ID NO: 1470 - DNA, 360 bp, Parvibaculum lavamentivorans DS-1
atgggacaggtcaaggtctccattaatgatcgatcctactccgtcgcctgcggcgatggcgaggaagcccatgtgcgggaactggcaagccacataaaccggcatgtcgtcagcctggctcaggaagtcgggcaggtgggcgacgcccggctcctgctgatggcggggctgcttgtcgcggatgaactgtcggacgcccttcaaaagacaaagcttctcgaacaggaaatcgagagcctgtccggcacacgtgcctccgcgcaggagcggacgcgggaggctgaggaatcgctcgccgaagtgctggatactgccgcccgccgcatcgaggatctggccaaacgcatcgaggccgcgtga

SEQ ID NO: 1471 - DNA, 372 bp, Methylobacterium extorquens PA1
atgccgcacgtcaacgtcaccatcgcgggcaagagctaccggatggcctgcggccccggcgaggaagaccatctcgcggctttggccaagagcttcgacgaccgtgtcaccgagatgcgcggcaccttcggcgagatcggcgacatgcgcctgcacgtcatggcctcgctgacgctggccgacgaattgctcgaagcccgccgccgcatcgccgacctggagcagcacgcggcccagggcgcggccgatcacgcgcggctcgcgagcggtgtcggcatcgccgccgagcgcatcgaccggctggcgcgggcgctgtctggccagccgggcggcgcgcccggcggcaagggcgaggccgagcgcggcggctga

SEQ ID NO: 1472 - DNA, 372 bp, Methylobacterium radiotolerans JCM 2831
ttgccgcagatcaacgtgaccatcgacggccgtagctaccgcatggcctgcggcgagggcgaggaggcgcatctgacgggcctcgccgccaccctggacgggcgcatcgccgagatgcgcaagagcttcggcgagatcggcgacatgcgcctgcaggtcatggcggcgctgaccatcgccgacgagctcgcggagctgcggtcgcggatcgcgacgctggaaggcaacgtcgcggaactgcgcgccgccgccgagaccgcggagcgggggcggacggaagatgccgagcgcgcggcgttcgggatcggtcgggcggccgagcatatcgggcggctcgccgacgccctcggcgcgtcggcgccgcgggcctga

SEQ ID NO: 1473 - DNA, 441 bp, Beijerinckia indica ATCC 9039
atggcgcaagtgtcggtaacaatcgctggccgagtctatcgaattgcctgcggcgagggggaagaaacccatttgcgaggcttggcccgtcaggtcgacgacaagatcgaccagttacgcggtacattcggcgaaatcggcgaccaacgcctgacggtcatggcggcgatcacactcgctgacgaattgctcgaggcgcaacgcaaactggccgatcttgcggccgaacatgccctcgccgaagcacgggtcgcggcgcaaacgcgtggcgaggcggaatggaccgatcatctggcccattcgctcaacggccttgccgaacggatcgagcgcgtggcgacaaagctcaatgccgccgaacgtcccgacggcgcggccacgaacgaagcccttccccgagccagcacaaccagtcccgaggccgtgcgccaaccgggctga

SEQ ID NO: 1474 - DNA, 372 bp, Methylobacterium populi BJ001
atgccgcacgtcaacgtcaccatcgcgggcaagagctaccggatggcctgcggccccggcgaggaggaccatctcgcggccctggccaagagcttcgacgaccgcgtcaccgagatgcgcggcaccttcggcgagatcggcgacatgcgcctgcacgtcatggcctcgctgacgctcgccgacgagctgcacgaggcccgccgccgtatcgccgagctggagcggaacgcggcccacggcgccgccgaacaggcgcggctcgccggcggcgtcggcatcgccgccgagcgcatcgaccgcctcgcccgcgccctgtcggggcagcctgtcgggtcttccagcggcaagggcgaggccgagcgcggcggctga

SEQ ID NO: 1475 - DNA, 411 bp, Rhodopseudomonas palustris TIE 1
atgagctcgagcgactccgctggatccgccaaccacgtcagcgtcaccatcaacggccggcaataccggatggcctgcgagcccggccaggagccgcagctgctcgggctcgctgaaaatctcgagacacggatccagagcctgcgcggccggttcggcgagatcggcgacgcgcggctgactgtgatggcggcgctgatgatggccgacgaactcctcgacgcccacggccgcatcgcctcgctgcagcaggaggtcgatgccctgcgcaacgaccgcgccgctgcgctcgatcgcacggtctcgaccaaccgcgccgtcgccgctgcactcaacagcgccgccgaacgcatcgaacgcaccacccaagtgctcaaccgcaccatcggcggcggcatcgcgatcgggtag

SEQ ID NO: 1476 - DNA, 384 bp, Methylobacterium sp. 4-46
atgcctcaggtgacggtgagcatcgccggcaagacctaccgcatggcctgcggcgagggcgaggagcgccacctcgaggagctggcgcggggcttcgacgcgcggatcggcgagatgcgcaaggccttcggcgagatcggcgacatgcgcctgcacgtcatggcggcgctgatggtctcggacgaactcgccgagacgcgccgccgggtcgaggcgctggagcgcgagaccgccgccctgcgcgaggccgccgccgccgccggcagcgagcgcgaggccgtggagggccgcatcgccgaggggatcggccgggccgccgagcggatcgaggccgcggtgcgccggctcgtgcccggcccgcagccgggcgcggccgagccgtaa

SEQ ID NO: 1477 - DNA, 378 bp, Rhizobium leguminosarum bv  trifolii WSM2304
atggcgcaagtgacggtaacgatcgacggcaaagcctatcgcatggcctgcgaggaagggcaggaagatcacctgaccgatctcgccacccgtttcgaccgctatgtcggccatctcaaggggcagttcggggaaatcggcgacctcaggattacggtcatggccggtatcatgatcatggacgagattgccgagctgacgcgccgcgtcaccgggctggaatccgaactcgaatccttgcgcggcaaccgcgacacggtgcttgcggctaccgcccgcaccgaggagaatctcgcggcggcgctcagcgaggtttcatcccgcattcgcggcatcaccgacaagctgaacggccggccggcccccgaactcaattga

SEQ ID NO: 1478 - DNA, 375 bp, Methylocella silvestris BL2
atggcccaggtcgccatgcagatcgccggacgcgtttatcgcgtcgcttgcgacgagggcgaggagcctcatctcgaaggcctcgcgcggctggtcgacggcaagatcgccggcatgcgggataaatttggcgagatgggcgaccagcgcctgaccatcatggcggcggtgacgcttgccgatgaattgcatgaatcgcagcgccgcgtcagcgaactcgaagcgcggctggcggaagtgcaggagaacgccgccgacgccctcagcggccgcgaggcgtggatcgacagggtgacggaggccgtcggcgaggccagcgcccgcatcgagcgcgcggcgcaggacatgagcggggccagccgcggcgaggactaa

SEQ ID NO: 1479 - DNA, 372 bp, Methylobacterium chloromethanicum CM4
atgccgcacgtcaacgtcaccatcgcgggcaagagctaccggatggcctgcggccccggcgaggaagaccatctcgcggctttggccaagagcttcgacgaccgtgtcaccgagatgcgcggcaccttcggcgagatcggcgacatgcgcctgcacgtcatggcctcgctgacgctggccgacgaactgctcgaagcgcgccgccgcatcgccgacctggagcagcacgcggcccagggcgcggccgatcaggcacggctcgcgagcggtgtcggcatcgccgccgagcggatcgaccggctggcgcgggcgctgtctggccagccgggcggcgctcccggcggcaagggcgaggccgagcgcggcggctga

SEQ ID NO: 1480 - DNA, 372 bp, Methylobacterium nodulans ORS 2060
atgcctcaggtgacggtgagcattgccgggaagacctaccgcatggcctgcggcgaaggcgaggagggccatctcgaagagctggcgcgcggcttcgacgcccgcatcggcgagatgcgcaaggccttcggcgagatcggcgacatgcgccttcacgtgatggcagcgctcaccgtctcggacgagctcgccgagatgcgccgtcgggtcgaggcgctggagcgcgagaccgcgtccctgcgcgaggccgcggcggcggccgccgccgagcgggaggcggcggaggggcgcatcgccgaaggcatcggccgggcggccgagcgcatcgaggcggcagtgcgccgcctcgccccggggccggccgaagcgtag

SEQ ID NO: 1481 - DNA, 366 bp, Agrobacterium vitis S4
atggcacaagtcacggtcaccatcgatggaaaagcctatcgcatggcctgcgaggaagggcaggaaaaccacctgaccgatctggccagccagttcgaccgttatgtcagccatctcaaaagccagtttggcgaaatcggcgacctgcgcgtcaccgtgatggcgggcatcatggtgatggacgaattgtccgagttgaaacgccggattgccgccgccgaagccacctccgctggcgccattggccgcgaagacgacatcctcgccgccatcatggaattgacggaacgcctcaacggcctgacccgcaaactgaccgaaaagccacaggctgcggccagcccgacggaaaaccagcaccactga

SEQ ID NO: 1482 - DNA, 378 bp, Rhizobium leguminosarum bv  trifolii WSM1325
atggcgcaggtgacggtaacgatcgacggcaaggcctatcgcatggcctgcgaggaagggcaggaggatcacctgaccgatctcgccacccgtttcgaccgctatgtcggccatctcaaggatcagttcggcgaaatcggcgatctgaggatcaccgtcatggccggcatcatgatcacggacgagattgccgagttgacgcgccgcgtcgccggattggagtccgagctcgagacgctgcgcggcaatcgcgatacggtgcttgcagccaccgcccggaccgaggaaaatcttgccgcagcgctgagcgaagtgtcgagccgcatccgcggcatcaccgacaagctgaatggccggtccgcccccgaactcaattga

SEQ ID NO: 1483 - DNA, 1947 bp, Sphingopyxis alaskensis RB2256
atgcccgacctcatcggcgccttttcgaccctggggttcgaggcgcacccgctgggcaacggtgcagatgcaaccgacgtcggtgccgaaacgagccgcgagctgctgcgcgcggtcgcggtatcgggctttgcgatgatgaacatcatgctgctgtcggtgtcgatctggtcgggtgcggcgggtgcgacgcgcgacctgttccactggctgtccgccgcgatcgcgctgccgacgatcacctatgccggacgcccgtttttccgctcggcatggcgcgcgctgcggcacgggggcaccaatatggacgttccgatcagcatcggcgtcgcgctcgtctgtgctatgagcctttacgagacggcgtcgagcggcccgcatgcctatttcgatggcgcggtgatgctgctcttctttctgctcaccggccgctggctcgacagcgtgatgcgcgaccgcgcgcggggcggagtcgcggcgctgctgcgcaacatggggacgggcgcgatggtgatcggggtcgacggggacagccgatgggtcgatgcgacggcgctcgaaccggggatggagatgctggtggcggcgggcgaacggctggccgccgacggggtggttgtggcgggcgaaagtcggttcgacctgtcgctactgaccggagagagcgcgccggttgcggcgcaagtcgatgatcgcgtccatgccggcacgctcaatctcgacgcgccgatccgcgtgcgcgtcactgccgcgggagccgacaccgcgatcgcggacatcgcgcggcttatgggcgaggcggcgcagggcaagtcgcgccatgtccgtatcgccgaccgtgccgcgcgcttctatgcccccgcggtccacgcgctcgctctgctcgctttcgccgggtggatgatcgcgggggcgggctggcatcaaagcctgctggtcgccgcggcggtgctcatcatcacctgcccctgcgcgctgggcctcgccgtcccggcggcgcagatcgtcgcggcgggcgaattgatgcgcgcaggcgtgctcgtgaaggacggatcggcacttgaacggctggccgaggtcgacctcgcgctcgtcgacaagaccgggacgctgacgcttgggcgtcccgaagcgatggggctcgaccggctggacgcggaggtgcgctcgctgacccttgcgcttgcgcgggcgagccgccacccgctgagcgcggcgttgacgcgcgagcttcaggcaggcggtgtccgggccgctcgggtggaggcgatccgcgaaacgccgggcgtcgggatcgaggcgcgctggcgcggccgggtcgtgacgctggggcgaccgcagggcagcgatcttggcaacgcgcttgccaccgaactggccgtcgacggtcgcccggtcgcgacgatcacctttgccgaccctttgcgccctgacgccgccgaggcggtcgatgccctggagcgggacggcgtcgcagcgatgatattgtcgggcgaccgcgccgaagccgtcgcgccggttgcccgcgacctgcgcctgacggcgcagacggggatgagcccgcaggacaagctggccgcgatcgcgcggcaggcggcacgggggcgcaaggtgctgatgatcggcgacgggctcaacgacggtccggcgctcgcggcgggccatgcttcgatggcgccggggtcggcgagcgatgtcggcaagaatgccgccgattgcatcttcctcggcgacaggatgatgcccgtggtgcaggcgctccgtatggcgcggcggacgcaggcggtggtgcggcagaactttctgctcgcgatcggctataatgtcgtcgcggtgccgctcgccttcatggggctggtcacgccgctcgtcgcggcgatcgccatgtcgggatcgtcgctgatcgtcgtcggcaatgcgctgcggctgaaaagggcaatccggtga

SEQ ID NO: 1484 - DNA, 2430 bp, Rhodospirillum rubrum ATCC 11170
atggacggactctccgagacacggccggcggactcggcggacggggggacggcgtgcaggcactgcggcttgcccgttccggccaacggtccggcgggagcggagttttgctgcgtcggctgccggggcgcctatgggctgatccgcgacagcgggcttgaccagtattaccaacggcgctgtcttgatcccgatacgccgccgccccgtcccgaggatctgggacccatcgatttttccgcccatatcctgcgtcagccgacggcggatggcggcgaggaggcggttctccatttgatggtcgagggcatccactgcgccgcttgcgtctggctgatcgaaaccctgttggggcgccagcccggcgtatcccaggcccggctcaatatgaccacccggcgtctcaccttgcgctttcgtccggccaaaggggaaaccgccgccgatcttggcgccaataccctgctcgccccggtggcgcgcgtcggctatcggctggtgccctatgatccggcgctgcttgatcaggaaacccggcgcaccgagaaagccctggttcaggcgatggcggtggccggtttcgccagcgccaatgtcatgctgctgtcggtttcggtctgggccggggtcgatatggggccgcgaacccgcgacctcatgcactggatttcggcactgatcgccgttcccgccgtgatctacgccgtgcgccccttcgcccattccgccttcgccgcgctgcgcgccggccgggcgagcatggatatgcccattaccctggccgtcaccctggccaccggcgtcagcctgtgggaaaccgccaatggcggcgcccacgcctatttcgacgcggcggtaacgctgctgttcttcctgttgatcggccgctttcttgatcaccgggcgcgtggccgcgcccgctcgacggccgagcacctgctggccctgggcgccaccgccgtcaccgtgctgcgcgacgacggaacattggagcatcgcccgccccggcaggtgaccccgggggcgaccgtgctggtggccacgggcgagcgcatcggcgttgatggcacggtcagccagggctgctccgatgtcgataccagcctgctgaccggcgagaccctgcccgagccggtgcatccgggcagcgcggtcttcgccggcaccctcaatctgaccggaccgctgcgcctgagcgccggcgcggttggcgagggaacgctgctggccgagatcgtgcgcatgatggaggtcgccgaacaggggcgggcgcgctatgtggcgatcgccgaccgggtggcgcgcgcctatgttcccgtcgtccacgccctggctttggccagtttcctcggctggctcacgctgatgggcgcgccctggcagcaagccctgatggtggcggcggccgtgttgatcgtgacctgtccctgcgccctggccctggcggtgccggtggttcaggtggtggcgaccggccggctgttgcgccagggcattctggtgaaatcgcccaccgccctggaacgtctgaccggcgtcgaccacgtggttttcgacaagaccggaaccctgaccctggggcgccccgatctgcggccggccgatccggcgcgcgccgatgcctggagcgccgaggatctcgccgccgccgcccaactggccgctgccagccaccatcccctggcccgcgccctggctttggccgcgcccgaggccaagcccgccgccctggcccgcgaatggccggggcagggcatgagcctgcctttggccgagggcgaggcgcgactgggacgcgccgtcttctgcggccttgaggacaccccggccgaggatggcggcgggccggagctgtggttcacccgtccgggccatgcgccggtgcgctttggctttatcgaccggccgcgcccagacgcggccgaggtggtggcggcgttgcgcgcccagggcatcggcgtggaattgctgtcgggggaccggccggcggtggccgccgccctcgccgcgcggatcgggctgaacgactggcgggcgggttgctcccccgccgacaaggtggcgcggttggccgaactggcggcggcgggcaagaccgtgctgatggtcggcgacggcctgaacgacgccccggccctggcggccgcccatgtctcgctgtcgccggcctcggcggtggatgtgacgcagaccgccgccgatgtggttttccagggcgagcgtctgaccccggtgatcgaggcgctgggcgtcgcccgccgcgccgaccggctggtccgccagaatttcgtcttgtccttcgcctataatatcgtgacggtgcctttggcgatctgtggtctggtaacgccgctgatcgccgcggtggcgatgagcagttcctcggtggtcgttatcctcaacgccctgcgcctgtcgcgtcgccgttaa

SEQ ID NO: 1485 - DNA, 2214 bp, Rhodobacter sphaeroides 2 4 1
atgtcgctggccgagcgcatcgacctgccgtcctccgaggcgcccggcggtgcctcggcctgtcccgcctgccttgccgcaccttccgccgaacggctggccgccatggccgggcccgccggcgggcggctcgtcctgtcgctgcctaccgcccattgcgccgcctgcatgaccaccgtcgagggcggtctcgagaagctcgcgggcgtgcgctcggcgcgggtgaacctcacgctgcgccgggtctcggtcgatgccgagcccgaggtgacggcggcccagctggtcgaggcgctgtcgcggctgggctacgaggcccacgagctcgatgccgggatgctgtcggccaccgagaccgaccggcaggggcgcgacctcctgatgcgcctcggcgtggccggcttctcgatgatgaacgtgatgctgctgtcggtggccgtctggtcgggcgccgaggccgcgacgcgcgatctctttcactggatctcggccgccatcgccctgccgaccgtggtcttcgcgggccagcccttcttccgcaacgcctggacggcgctccgcgccgggcggctcgggatggatgtgccgatctcgctcgccatcatcctcgcctcgtcgatctcgctcttcgagaccttccattccggccaccacgcctatttcgacgcggcggtgatgctgaccttcttcctgctcgcgggccgctatctcgaccaccgcacccgcgccgtcgcccgttcggcagccgaggaactggcggcgctggaagtgccgcgcgccatgctcctgcgcgatggcgaggaagtgacggtgccgattgccgagcttgccgcgggcgatctggtgcgcgtgcggcctggagggcggatgccggtcgacggtgtggtggccgaaggcttctccgagctcgaccgctcgctcctcaccggcgagagcctgccggtgccggccggccccgaaaccgtggtctcggcgggtgaggtgaacctcaccggcccgctcacggtgcgggtgacggcggccgggcgcgacagctcgctgcatcggatggccgatctcgtggcggtcgccgaaagcgccaagacccgctacacgtccctcgcggaacgcgcctcgcggctctactcgccgctggtccatatcctctccttcaccgccttcggggtctggatgtggatcacgaagggcgacgtgcgcacctcgatcaacatctcggccgccgtgctcatcatcacctgcccctgcgccctggggctcgccgtgcccgccgtggtgacggcggcgagcgggcggctcttccgcaaggggctgctcatcaaggacggcaccgcgctggaacgtctcgccgaggtggatacggtcgtcttcgacaagaccggcacgctgacgctgggcacgcccgagcccaccaatctcgcgacgcttcccccggcggatctgacgctggcggcggcgctggccgcgtcctcggcgcatcctctggccatggcgctcgcgctcgccgcaagggggcagggggtgcagcccgcggccgtcaccgacctgcgcgaagtgccgggcttcggcatcgagggccggctcgagggccgcaccgtccggctcggccgcgccgaatgggtgggtgctgcgcccgagcccgtgaccgcgacctacctctcgaccggagcggccacgcgcgccatcaccttctccgaccggctgcgtcccggcgcggaagaggccgtgcgggcgctggcggggcagggcaagcggatcctcctcctttcgggcgataccgaaggcgccgtggccgagctcgcagggcggctcggcatcggcgagtggcgctcgggccagcttccggccgagaaggcgcagcgggtggccgacctcactgccgaggggcggcgcgtgctgatggtgggcgatgggctgaacgacactgcggcgctggccgcggcccatgtgtcgatctcgcctgcttccgcgctcgatgcggcgcgggtggcgtccgacatcgtgcttctgggcaaggacatggcgcccatcgccgatgccgcgcgcatctcggtgaaggccaccaagcgcatccgcgagaactttgccatttcggccgcctacaacgtggtggcggtgcctctcgcgctggtgggccttgcgaccccgctggcggcggcgctcgccatgtcgctgtcctcgatcagcgtctcgctcaacgcgctgcgggtgaagtga

SEQ ID NO: 1486 - DNA, 2214 bp, Rhodobacter sphaeroides ATCC 17029
atgtcgctggccgagcgcatcgacctgccgtcctccgaggcgcccggcggtgcctcggcctgtcccgcctgccttgccgcaccttccgccgaacggctggccgccatggccgggcccgccggcgggcggctcgtcctgtcgctgcccactgcccattgcgcggcctgcatgaccaccgtcgagggcgggctggagaaaatcgccggcgtgcgctcggcgcgggtgaatctcacgctgcgccgggtctcggtcgatgccgagcccgaagtgacggcggcccagctggtcgaggcgctgtcgcggctgggctatgaggcgcacgagctcgatgccgggatgctctcggccaccgagaccgaccggcaggggcgcgacctcctgatgcgcctcggcgtggccggcttctcgatgatgaacgtgatgctgctgtcggtggccgtctggtcgggcgccgaggccgcgacgcgcgatctctttcactggatctcggccgccatcgccctgccgaccgtggtcttcgcgggccagcccttcttccgcaacgcctggacggcgctccgcgccgggcggctcgggatggatgtgccgatctcgctcgccatcatcctcgcctcgtcgatctcgctcttcgagaccttccattccggccatcacgcctatttcgacgcggcggtgatgctgaccttcttcctgctcgcgggccgctatctcgaccaccgcacccgcgccgtcgcccgttcggccgccgaggaactggcggcgctcgaagtgccgcgcgccacgctcctgcgcgacggcgaggaagtgacggtgccgatctccgagcttgccgcgggcgatctggtgcgcgtgcggccgggggggcggatgccggtcgacggtgtggtggccgaaggctactccgagctcgaccgctcgcttctcaccggcgagagtctgccggtgccggccggccccgaaaccgtggtctcggcgggcgaggtgaacctcaccggcccgctcacggtgcgggtgacggcggccgggcgcgacagctcgctgcaccggatggccgatctcgtggcggtcgccgaaagcgccaagacccgctacacgtccctcgcggaacgcgcctcgcggctctactcgccgctggtccatatcctctccttcaccgccttcggggtctggatgtggatcacgaagggcgacgtgcgcacctcgatcaacatctcggccgccgtgctcatcatcacctgcccctgcgccctggggctcgccgtgcccgccgtggtgacggcggcgagcgggcggctcttccgcaagggcctgctcatcaaggacggcaccgcgctggaacgtctcgccgaggtggatacggtcgtcttcgacaagaccggcacgctgacgctgggcacgcccgagcccaccaatctcgcgacgcttcccccggcggatctggcgctggcggcggcgctggccgcgtcctcggcgcatcctctggccgtggcgctcgcactcgccgcaagggggcagggggtgcggcccgcggccgtcaccgacctgcgcgaagtgccgggcttcggcatcgagggccggctcgagggccgcaccgtccggctcggccgcgccgaatgggtgggtgctgcgcccgagcccgtgaccgcgacctacctctcgaccggagcggccacgcgcgccatcaccttctccgaccggctgcgtcccggcgccgaagaggccgtgcgggcgctggcggggcagggcaagcggatcctcctcctttcgggcgataccgaaggcgccgtggccgagctcgcagggcggctcggcatcggcgagtggcgctcgggccagcttccggccgagaaggcgcagcgggtggccgaccttaccgccgaggggcggcgcgtgctgatggtgggcgacgggttgaacgacactgcggcgctggccgcggcccatgtgtcgatctcgcccgcctccgcgctcgatgcggcgcgggtggcgtccgacattgtccttctgggcaaggacatggcgcccatcgccgatgccgcgcgcatctcggtgaaggccaccaagcgcatccgcgagaactttgccatctcggccgcctacaacgtggtggcggtgcctctcgcgctggtgggccttgcgacgccgctggcggcggcgctcgccatgtcgctgtcctcgatcagcgtctcgctcaacgcgctgcgggtgaagtga

SEQ ID NO: 1487 - DNA, 2274 bp, Sinorhizobium medicae WSM419
atgagctgctgcgccgttggtgcggcaaccatggttgccgaaggaaggcaggcgtcgcccgcgtccgaggaactttggcttgcgagccgggccctcggaggcgggttgcgccagacggagctaagcgtccccggcgcatattgcggcgcctgcatcgccacgatcgaaggagcgctgcgcaccaagcccgaagtcgaacgcgcccgcgtcaacctctcctcccgtcgcgtttcaatcgtctggaaagaggaggtcggcggtcgtcggaccgatccttgtgatttcttgcatgccatcgccgagcgtggatatcagacacacctcttttcgcccggcggggaggaaggcgacgacctgctgaagcagttgatcctcgcggtcgccgtttccggcttcgccgcgaccaatattatgctgctctccgtgtcagtctggtccggggcagatgcggccacccgcgatctctttcattggatctcggcgcttatcgccggaccggcgctgatctatgctggccgctttttctacaagtcggcatggaacgccgttcgccacgggcgaaccaacatggatgtgccgatcgcgctcgccgtcagcctttcctatggcatgtcgctccacgagacgatcggtcatggcgaacatgcctggttcgatgcatccgtgaccttgctgtttttcctgctgatcggcagaacgcttgatcacatgatgaggggccgtgcacgaacggcgatcagcggtctcgcacgcctgtcgccacgcggggccaccgtcgttcatccggatggctcgcgcgagtaccgcgccgtcgacgagatcaagccaggtgaacgcctgatcgtcgctgctggcgagcgtatccccgtcgatggacgggtggtgtacgggacgagcgatatcgatcggtccgtggtcaacggcgagagctcgccggcggtggtcgccacaggggatacggttcaggccggcacgctcaaccttacgggtccgctgacgctggaggcgaccgccgcggcgcgcgattcgttcatcgccgaaatcatcggaatgatggaggctgccgagggggggagggcgcgctaccgacgtatcgccgaccgcgccgctcgcttttattcgcccgccgtccatctgctggcgcttctgaccttcgtcggctggatgctggtggagggagatgtccgccatgccctgctgatcgcggtggcggtgctcatcatcacatgcccctgcgcactcggtcttgccgttccggtcgtccaggtcgttgcagccggtcggctattccagggcggggtgatggtcaaggatggctcggcaatggagcgtctcgccgagatcgacatggtgctcctcgataagaccggcacgctgaccatcggcagaccgcggctcgtgaatgcgcacgagatcgcaccttgtcggctcgcgaaggcggcggctatcgcgttgcattcgcgccatccgatcgcagtagcgattcagaattcggcacgggcagtctcgccgcttgccggcggcatccgggaaattcccggcgcgggcatcgaagtgaaaaccgaggacggcgtctaccggctcgggagccgcaattttgcggtcggcaatccgggctctgacggcggacaatcgcaggcaatcctgtcgttggattttcgcgagcttgcctgctttcggttcgaggaccggccgcgcccggcttcgcgcgaatcgatcgaagcccttgcccgactggacattgcgaccggaatcctgtccggcgatcgggaacccgtggtggcggccctcgccggcagcttggggatttcgaattggcatggcgacctctcgccacgcgaaaaggtcaaggcatgcgacgctgccgccgaggcaggtcacaaggcactggtagtgggggacggcataaacgacgcgcccgttctgcgtgcagcgcatgtttccatggctccggcgactgccgccgatgtcggacgccaggccgccgacttcgtcttcatgcatgagccgctttcggcagttcccttcgccatcgagacttcgcgacatgccggccgacttatccggcagaacttcgcgctcgccatcggctacaacgtcatcgccgtaccaatcgcaattcttggttacgcgactccgctcattgccgctgtagcgatgtccacctcgtcgctagtggtagtcttcaatgctctgagactgaagcgaacccttgctgccggtaaggtcgcgaaagcagccgcattgatccaatcaggggcggtgacctcatga

SEQ ID NO: 1488 - DNA, 2259 bp, Ochrobactrum anthropi ATCC 49188
atgagctgctgcgtcgagaatgcacagatagcgaccgttgttcaggccgtctcggtagatgaaatgcaggtcgcaagccgtgcgcttggagacggctttcgccagctcgacctgtcggttcccggtgttcattgcggcctgtgcatcaagaatatcgaggagacgctcggcaagatcgcgggcgttgtctatgtccgcgtcaacctgacggcgcgccgcgtcaccgtgcgctggaaagatggcgagacgccgccagatgtggtcgatccgctgcgcaggctcggttatgaagcccatatcttcgatatggcgcaggacaaggatccgaccttcacgcggctcctgatcgcacttggcgtcgcggcctttgcttcgagcaatgtcatgcttttatcggtcgcggtctggtcgggcgcggatgccgcgacacgcgacatgtttcactggatttccggccttatcgccctgccgacgctgatctattcgggtcgcattttctatgtttccgcctggaatgcgctgcgcgcacggcgcgtcaacatggatgtgccgattgcactcgcaatcacgcttgccttcggcatgagcgtttatgagacgatgaaccatggccagcacgcctatttcgacgcatcggtgacactgctgttcttcctgctgatcggccgcacgctcgattacatgatgcgcgcccgtgcccgttccgccgtgcgcggtctggcgcagctcggcagccgcggcgcggtggtgatcggcgagaacgacgaacgcaattacctgccggtcaacgaaatccgccccggaatgcgcatcattcttgccgctggcgaacgcgtccccgttgatgccaaggtggaggaaggccgttcggaacttgattgtgccattgcatcgggtgaaagcgatgcggtcccggtcggtcccggctcggatattcgcgcgggcacgctcaatctctccacgccgcttgtcatccgcgctacggcggaagccaaggattccttccttgctgaaatggtgcgactgatggatgtcgccgaaggcggccgcgcttattatcgtcgtcttgccgaccgtgcttccgaactctacgtgccgatggtccataccatcgcctttgcggccttcgtcggctggatgatctacaccggtggcgactggtatcgctcgatctatatcgcgatctgcaccctcatcatcacctgcccttgcgcgctcgcccttgcagtgccgattgtgcaggtggttgcggcccgtcgcctgttcgaaaacggcatcatgatcaaggacggctccgccatggaacggatggccgagatcgacactgccattttcgacaagaccggcacattgaccctcggtcagccgagactgattaatgccgatgcgattgatccccacaatctggagatcgctgcggagctgtcgctttattcgcgccatcctttgtcgcgcgcacttgcgctgttctcgggcgcaaaaccgatgactgcctttacccgtatcgaggaagtgccgggcgcaggcatcgaagcggaactgaacggctccatctatcggcttggcaagcgggactgggcggatggtaccgctgtcatgcctcatgcagatggcccagaaacctgtctttccattgatggcaagctggttcagaccttccgctttgaagatcagccgcgcgaggacgctgccggagccatcgccacactgaagcgcaacggcctgaagcttggcatcatttccggcgacaggctgcctgccgtcgagaggcttgcaggttatctcggcgtcgacaattttcaggctcaggtactgcctgccgacaagtcggagctggtgcagaagctgtcgagagaaggcagcaaggttttgatggtcggcgacggattgaacgatgctccggcccttgtcgccgcccatgtttccatggccccggcgacggcagccgacattggccgcaatgcagcggatttcgtctttctgcgcgaaagcctgtcggcagtaccgcttgcctttgccgtctcgaaggaagcgggccggttgatcagtcagaattttgcgctttccatcggctataatatcatagccgtgccgattgcgatttttggctatgtcaccccgctggtggctgcgctttcgatgtcgctatcgtccatcgtggtggtcagcaacgcattgcggttgcgggccggaaaacaaaagcaacagacgcagaagaccatcgcgcctgttgctatcatcaaggaagcgcacaaatga

SEQ ID NO: 1489 - DNA, 2232 bp, Xanthobacter autotrophicus Py2
atggctgaggcgatcgactattccgttttcgtcgcgcggtccgaggacggcctcgcccagatgagcctcgccgtggacggcatcgactgcgccgcctgcatcgccgagatcgaggacggggtaaaggcgctgcctggcgtggtgcgcgcgcgcctcaattattccacccaccgcctcaccgtcgcctggcgcgaggagacctcaccggaccgggtggtgagccagctggaagccctgggctatcgcgcccaccccttcgccggccgagccgaggagagcgaggctcgccacgcccgctggctgctgcgctgcctgggcgtcgccggcttcgcggccatgaacatcatgctgctgtcggtgtcggtgtggtcgggcaatgtcaccgacatcacgccggagacgcgggacttcttccattgggtctcggcgctcatcgcgttgccggcggccgcctatgccggccagcccttcttccagagcgcgttccgggcggtgcgctcgggccggctcaacatggacgtgcccatcaccatcggcgtcaccctggcgctgggcatgagcgtgctggagacggcgctgagccagccccacgcctatttcgacagcgccatcatgctgctgttcttccttttggccgggcgctacctcgaccacgaggcgcgccggcgcacccgcgccacggccggcaacatcgccgccctgcggggcgagatggcccatcgcctcggcaccgacggcgtgccggtgctggtgccggtgcaggcactgcagccgggcgacaccatcctcgtcgcgcccggtgagcgggtggcggcggatggcgtcatcgcttccggccagtccagcatcgacgaaagcctcgtcaccggcgagaccctgccgcgcgccctgaaggcgggggatgcggtctacgccggcagcctcaacggcgagggcgcgttgcacctgacggttaccgccggcggcgagaacacgctggtggacgatgtgcagcgcctgctggatggcgcgctggccgagaagggcgcctatgtgcgcctcgccgaccgggtggcgcggctctacgcccccatggtgcatctgacggcgctggtctccgccatcggctggctcctcgccggagcggacctgcatcatgcggtgatgatcgcggtggccgtgctcatcatcacctgtccctgcgcgctggccctcgccgtgcccgcggtgcaggtgacggccaccggccggctgttccgcgccggccttctcatcaatgccggcgacatgctggagcgtctcgccgccgtggacacggtggtgttcgacaagaccggcaccctgacgctgccggagcccgcccttgccctgccgcgcggggcggaccgggcgctggtgggccttgccgggcggctggccctgtcgagccgccacccgctggcccgggccctcgccccgcgcgcggacgggccggccatcgagggcgtgaccgaggtgagcgggcagggcgtggaggcgctggtggacggcgcggtcgtgcgcctcggcagcctcgccttctgcggcgcggcgccgcccgccgatctgccggccggcgcctccctcatcgccctgcgtcgtggcggccagaccctggtcatgggtgtcgaacaggccctgcggccggacgcgccggaggtggtggcggcgctgaaggcgcgcggcctcgacgtgcgcatcctctccggcgaccgggaggccgccgtgacccccgtggcgcaggcgctgggcatcgcccattgggacgcaggcctcaagcccgccgacaagatcgccgcccttgatcacctgaaggcggaaggccggcgcgtgctgatggtgggcgatggcctcaacgatgctccggcgctggccgccgccacggtttccctctcccccgccaccggcgcggcggtaacgcaggcccatgcggacgcggtgttcctcggccgccgcctcgcgccggtgatggcggcggtggacggggcgggggtcgcggcgcggctgatgcggcagaacctcgccatcgccgtgctctacaatgtgatcgcggtgccgctggccatcgccggctttgtgacgccgctggtggcagcgcttgccatgtccggctcttccatactcgtgaccgtcaacgccttgcgcgcggcgcggccggggcgcaaggatgaggcgaccgacgccgcggcccctgccggcggcgatgcccgcacattggaagaggcggccgcgtga

SEQ ID NO: 1490 - DNA, 2190 bp, Dinoroseobacter shibae DFL 12
atgtcggatctgagcgcgcatagcctcggcccctcggccaactccgcctgcccggcctgcgcggccgcgccgctggccgagcagctgagcaagcgccccgtgcgcgggggcatcgtgctcagcctgccggggatccattgcgcgtcctgtatctcgggggtcgagcgcctgctggacgcaacccccggcgtggtcggggcccgggtcaacctgacccgcaaacgggttctgatcgacgccgaggaagggatcacccccgaagcgctcgcgcagcttctgaccgacaaggggttcgaggcctacgagcttgatcccggccaactcggcaatgccgaggccgaccgtccggcccgtgacctgctgatgcggctggcggtgtccggctttgccatgatgaacatcatgctgctgtcggtggcggtctggtccggcgccgaggccgcgacccgggacatgttccactggatctccgccgccatcgcgatcccgaccatcgggttctgcgcccagccgttcttttccaattcctggcgcgcgctgaaggccgggcggctcaacatggatgtgccgatctcgctggcgatcctgctggcggtgggcatgtcgctctacgagaccgccaattccggcgcgcacgcctatttcgacgcggcggtctcgctgaccttcttcctgctcgcggggcgctatctcgatttccgcacccgcgcctcggcccgctcggccgcgcaggagcttgccgcgctggaagtgccccgggcgatcaagctggtgggcggcaccgaggtgaagaccgtggtggccgatctggcggtgggcgacctgatccgggtgacacccggctcccgcgtgcccgccgatggcctggtcgtggacggggtgtccgagctggaccggtcgcttctgaccggagagagcctgccggttcacgcggcgcccgacaccccggtgtcggcgggcgagatgaacctgaccggggtgctgaccctgcgggtgacggcggcggggcaggacagctccctgcaccggatggcggaactcgtggccgtggccgagaacgcccggtcgaaatacacctccctcgcggacaaggcggcggggctctatgcgcccggcgtgcatatcctggcggcgctgaccgggctgggctggatgctctattccatggatctgcgcctgtcgctcaacatcgccagtgcggttctgatcatcacctgcccctgcgcgttgggcctcgcggtgcccgcggtggtcacggcggcctccgggcgtctgttccggcgcgggctgctgatcaagagcggcacggcgctggagcgtctggccgaggtcgacgaggtcgtgttcgacaagaccggcaccctgaccctgggccagccgattctggagaatgccgaccggatcgcggcccgggacctcgcggttgcccgggcgctcgcgcaggggtccgcgcacccgctggcgcgggcgattgccgccaccgacgcaggtggggccagcgcagaggtcaccgagttgcgcgaagtgcccggctacggggtcgagggtcgttggcaggatcagccggtgcgcctcgggcgggccgactgggtcggggctgcgcagggggacgtgaccgcgacctggctccggatcgggcaggcggcgccggtggccttcgagttcaaggatgccctgcgccccggcgcggcggaggccgtggcggccctgcaggcgcgcgggctgaaggtcagcctgctgtccggggatgcgcccggggccgtggcgcgggtcgcccgggagctcggcatcaccgactaccgcgccgagtgccgccccgaggaaaaggccgcccatgtcaccgcccgcggcgaggccgggtacaaggtgctgatggtgggcgacgggctgaacgacaccgccgccctggccgcggcccatgcgtcggtctcgccggccagcgcgctggacgcggcccgggtcgcgtcggacatcgtgctgctgggccaggacctgtcgccgctggccgacatgctgcagaccgcgcgcaagtccaccaagctgatccgcgagaatttcaccatctcgaccgtctacaacgtggtggccgtgccgctggccatcgcggggctcgccacgcccctgatcgcggcgctggccatgtcggtctcatccatcactgtcagtctgaacgcattgcgtgtacgctga

SEQ ID NO: 1491 - DNA, 2199 bp, Rhodopseudomonas palustris TIE 1
atgctgcagacgcgggatttctctcactacgtcaaagacgtcgacggccggatcgcgcatctcgacctcgcggtggaaggcgttcactgcgccagctgcatggccaagatcgagcgcggcctgcaatcgattccggatgtgacgctcgcccgcgtcaatctcaccgatcgtcgccttgcggtggagtggaacaagggcagcacgctggagcccggccagttcatcgatcgcctcgccgagctcggctacaaggcctatccgtatgagccggtgcgggccgaggtcgaagaggccgaacgcaccaagttcctgctccgctgcctcggcgtcgccgtgttcgccacgatgaacgtgatgatgctgtcggtgccggtgtggtacggcggcgatctcagtcccgaggctcgcgacttcttccattggttgtcggcgctggtcgctctgccctgtgccgcctatgcggggcagccgttcttccagtcggcgttccgcgcgctgaaggccaagagcgtgaacatggatgtgccgatcacgatcggcatcacgctggcgctcggcatgtcgctggtcgagaccatcaatcacgccgagcacgcttacttcgacgccgctgtgatgctgatcgcgttcctgctggcgggccgcttcctcgatcagaagatgcggcagaagacccgcgcggttgcgggtaacctcgcagcactgaaggccgagaccgccaccaagttcgtcgggcccgacgaaatcagcgaagtgccgatcgccgcagtgcgtgccggcgacatcgtgctgctgcgccccggcgaacgctgcgcggtcgacggcacggtgatcgagggccgctccgagatcgaccagagcctgatcaccggcgagacgctgtatgtgccggccgaacgcggcacccaggtttatgccggcacgctcaacatctccggtaccctgcgcgtccgcgtcgctgcggccgcagagggcacgctgctgtccgagatcacccggctgctcgaccacgcgctgcaggcgcgttcgcgctacgtccggctcgcggaccgcgcctcccagctctatgcgccggtggtgcacgcgaccgcgctgctgacgatcatcggctgggtcctggccggtgcgagctggcacgatgcgatcgtgatcggcattgcggttctgatcatcacctgtccctgcgcgctcggcctcgcgattcctgcggtgcagaccgtcgcctccggcgcgatgttccgcgccggcgtgctgctcaatgcgggcgacgcgatcgagcgcgccgcttcggtcgacaccatcgtgttcgacaagaccggtacgctgacgctgcccgagctcgacgtcgtcaacgccgccggcatcccgctcgaggtgttcgacctcgccggccggctcgccctcgccagccatcatccggtcgccgctgcggtggcgcgtgccgcgcacgccaagtcgccgctgccgaatgtggtcgaagaaccgggccgcggcgttcggacggtgttcggcggccaagaattacgcctcggcagcccggcgttctgcggcgccgatgccgaagccaatcagatcctcagcgaagaccccgaagtgtccgtggtggcgttcagccgcggcgagcagagggtggtattcgcggtccgccagttgctgcggcccgacgccgccaagacgatcgacgccctgaccaatcgcggcattgcggtcgagctcttgtccggcgatcgcgagccggcggttcgccacgcggcggctgcgcttggtgtatccgcctggcgcgccagcgtgacgccggccgagaagattgctcacatcgaggcgctgaagaagcagggccgcatcgtgatgatggtcggcgacggtatgaacgacgcaccgtcgctcgccgcggcgcatgtctcgatgtcgccgatcagcgccacgcatctcagccaggccaccgccgatctggtgttcctcggcaaggagcttgcgccggtgctggccgcggtcgattattcgcggaaagcgatggcggtgatgcgggagaatctcggtcttgccatcggctataacgtactggcggtgccgatcgcgatcgccggctatgccacaccgctgatcgcggcgctggcgatgtccggatcgtcgctgctggtgatgctgaacgcgatgcgggcgcgccgcgtccgccggggagccgcgtcgtggaagtaa

SEQ ID NO: 1492 - DNA, 2277 bp, Methylobacterium sp. 4-46
atgtgctgcaccgatgcggcgctcgcctacgtggaggcgcacgccgcctggagcgcggcgaacacccggtcctcgctgccgcgggactacgcggccttcctggccgaggagccggacggggcaagccgcgccgtcttcgcggtcgagggcgtgcgctgcgcggcctgcctcggcacgatcgagggcgggatcggcctgctcccgggcgtccgggccgcgcgcctgaacgtcaccgaccggcgcctctcggtgacctgggcgcccggcgcgccggccgagatcggggaggtgctcgccgcgctcacccgcctgggctatcgcggccacccgttcgacccgcaccggcgcggcgacgcggtggcggcgcgcgagaccgagcggctgatccgcgccctcgcggtggcgggtttcgcgtccatgaacgtgatgctgctggcggtctcggtctgggccggcaacgtctccgacatgacgcccgagaaccgcgacctcttccactggatccaggcgctggtggcgctgccggcggcggcctatgcggggcggcccttctacgagggcgcgctgcgcggcctgcgcgccggccgcatcacgatggacttcccgatcaccctcggggtcgtgctgaccctcgcgatgtcggtggtcgagacggcgatgagcgcgccgcacgcctatttcgacggcgccatcatgctgctgttcttcctcctgatcgggcgggtgctcgatcaggtgatgcgccgccgcaccctggcgctcgccgagaacctcgcggcgttgcgcgccgagacggccgcccgggtcggggcggatggggcggtgcgcgacgtgccggtggccgatctctcccccggcgacacggtgctggtgcggcccggcgagcgggtgcccgtcgacggcgtcgtggcgcagggccggtcggaactcgaccgcagcctcgtcacgggcgagaccgctccggtgacggccgggccgggggacatggtccatgccggctccctcaacgccagcggggcgctcaccgtgcgggtcacggccgcgacgcggggcaccctgctcgaccaggtcgaggcgctgatgcgccgggcgctggaggcgaagtcccgcgccctggtcctcgccgaccgggcgacgcgcctctacatgccggtggtccacgcggccgcgctcctcaccctcgcgggctggctggccgcgggggccgggttccacgcggccctcctcaccgccgtggcggtgctgatcgtcacctgcccctgcgccctcggcctcgccatcccggccgtgcaggtcgtcgccgccggggcgctgttccgcgagggcgtcctcctcaacagcggcgaggcgctggagcgcttcgcggcgatcgacacggtcgccttcgacaagaccggcaccctgaccctgccggagccggtcctggccgggcgctacgagtccgaggccctggccctcgccgcgcggctcgccctgtcgagccggcacccgatggcggccgccctggcgacggcggtgccggaggcccgggcgctgcccgatgccgaggaggccgccgggctcggcgtgcgggccgtggtcgaggggcgcctcgtgcggctcggcgcgccgcgcttctgcgaggcggaggccgaggcggagcgggccctcgcgcaggatcccggctcttcggcgatctgcctcaaggacggcgacgctccgccggtcgtgttccgggtgcgccaagccctgcgccccgacgcggagcgggtgctcggcagcctgcgggcggaggggtaccgggtgctgatcctctctggcgaccggccggaggcggtggccgccgcggccggcgccctcggcgtcgccgagtgggagggcgggctcgcgccgcaggacaagatccgccgcatcgaggccctcggcgcgcagggccgccgggtgctgatggtcggcgacgggctcaacgacgcgcccgccctcgcggccgcccacgcctcgctctccccggtcaccgcggcgcatgtcagccaggcggcggccgacgcgctcttcctcggccgcgacctcgcgccggtcctggcggtgctgcggatcggccgggcggcgcggcggctcatgctggagaacctgtgggtctcggccgcctacaacgtcgcggcgatcccgctcgccgccgcgggcctgctcacgccgctcatcgccgccctcgccatgtccggctcgtccgtcatcgtcacgctcaacgccctgcgggcgcgccggacgccccgccggccggagattgctcagccatga

SEQ ID NO: 1493 - DNA, 2250 bp, Methylocella silvestris BL2
atgaccgaggcgctcgatctttccgcttttgtgcagcgcctcgaggaaggcggctgccggatcgaattcgccgtcgagggcgtcaaggacgccgccgcgatccatgcgatcgaacatgcgctccgccctctgcccggactgacgagggcgcgggtcaatttttccgaacagcgccttctcgtcgaatggacggacggcctcgaaccggcgttaatcgtcgagcgggtccgcgcgctcggccatcgcatctatcctttctcgccgcgtctgcgcgaggaggatttcgaggccgcgcaggcgcgctggctgctgcgctgcctcgccgtcgcggctttcgcggcgatgaacatcatgctgctgtcgatctcggtctgggccggcaatgtcagcgacatcacgccggaaacgcgcgatttcttccattgggtctcggcgctcgtcgtgctgcccgccgcggctttcgccgggcagcccttctttcgcagcgcgatccgggcgctcagccggcgctcgctcaatatggacgtgccaatctcgctcggcgtgctgctcgctttggcgatttccgtattcgaaaccttgcgacacgccgagcacgcctatttcgacagcgccatcatgctgctcgtcttcctccttgccggccgctatctcgatcaggcgatgcggcgcaagacgcgctcctacgcggccaatctgtccgccctgcgcgcgccgaccgcctcgcgcatcgacgccgacggaactgtcgcgctcgtgccggcggcggcgctgcggccgggcgaaatcgtcctgctccgccccggcgaacgcgcgccggtcgacgggatcatcgtcgagggcagatccgagatcgaccagagcctcgtcaccggcgagaccgcgccggtcgccgtcggcgccggtcatgaggtctatgccggctcgctgaatttcggcggcgctctcagcattcgcgtcaagacagccggcgcggggacctttctcgacgagatcgaacggctgctcgatggcgcgattcagcagaaaagcgcctatgtccgcctagccgaccgggcagcccgtctctatgcgccggtggtccattcgatggccgcgctgaccgtgatcttctggctcgtcgccggcgcttccgtccatgacgcgatcatcgcggcgatcgcggttttgatcatcacctgcccctgcgctctcgctcttgccgttccggcggtgcaggtcgtcgccgccggcgcgctttttcgcgcgaaaatcatactcagcgccggcgacgccatcgaacgcttcgccgacgtcgacatggttgtgtttgacaagaccggcacgctgaccctgccggagctgggcgtcgaagccgacgacgatgcgccgtccggccttgtcgaacgcgcggcccgccttgcgctcgcctcgcatcatcccctcgccgtcgcgctcgcgcgcctgtcgcgggagcagacgcctgtcgcggatgcgcaggagcttttgggctccggcgtgcgggcgatgatcgacggagcggaggcgcgccttggctcgcccggtttttgcggccttgaggccgaggcggcgcgtctgcgagaaactcatcccggcgcctcgctgatcgcctttcggcacggcggccaagcgacgatttttcgcatccggcagaagctgcgcgcggacgccgcgagcgtcgtcgcggcgttgcgccgacgcggactcgaaatcgtcatcctgtcgggagacgccgccccagccgtgcgatcctgcgcgcaggcgcttggggtggccgattggcgcgcggatatgcggccgggcgagaaactcgcgtttctggccgaactcaagaaaaacgggcgcaagccgctgatggtcggcgacggcatgaatgacgccccggcgctcgccgcggcccatgcctcattatcgccgatcaccgcctcgggccttgctcaggcagcggcggacgcgctgttcctcggcgatctgctcgcgcccgtggatgcggcgctcgatatctcgcgccgcgcaaaaagcctgatgcggcagaatctcgcctttgcggtgatttataatatggtcgccgtgccgctcgccgtggctggactggcgacgccgctcattgcggctgcggcgatgtccgggtcctcgatcgtcgtcaccctcaattcgctgcgggcgaggggcgccgcaagacccgtctcgccgggcgccgcctccgccgcggcgcgcggcgcaagccgtctcaatgaggcaaggccatga

SEQ ID NO: 1494 - DNA, 2364 bp, Agrobacterium vitis S4
atgagctgctgcgcggcgggctcggaagcggccctcgacctggaacgctcaggggcgctgctgccatcctcggaggaaatccggctggcaagccgggatctgggcgaggggttgacccaggtggatttcagcgtacccggcgtctattgcggcgcctgcatcaccaaaatcgagacggccttgaagcgtctgcctgctgtcgagcgcgcccgcgtcaacctctccactcggcgcgtcggcgtggtctggcggacaagggttgcagaggaagggccgttcatcgaccgggaagcaggcccatttacgcacgatagcgggttcgatccggcggagcttgcgcgcgccattgcgtctaccggctatagctgccacctgttcacgcctcaggatctggcctccgatctgctcttgaaacaattgatccgggccgtcgccgttaccggctttgccgccaccaatatcatgctgctgtctgtctccgtctggtccggtgcggatgcatcgacgcgggatctgttccactggatttcggcactgattgccgccccggccctgatctatggtgggcggttcttctatcaatcggcctggacggcacttcggcaccggcgcaccaatatggatgtgccgattgccatcggcatctcgctttcttatttctcgtcgctgtgggaaaccattcatcacggcgaacacgcctatttcgatgcgacggcgtcgctactgttcttcctgctgatcggccgggcgctggaccatatgatgcgcgaccgcgcccgttcggcgatcagcggtctggcgcggctcaatccacgcggtgccactgttgtcggcgcagacggtagccgggaataccggctggtggatgatatcaaggtgggtgaacatgtcgccatttccgcgggcgagcgtatcgcgcttgatggcaccgtcatcgccgggaccagcgatctcgacgtctccatcgtcaatggtgaaagtgcgccgcaaaccgtggggcctggtgacgccgtgcaggcaggaacactgagcctcacaggatcgctgaccgtcaaggcgacggcacaggcacgcgattccttcctgtcggaaatcatccggctgatggaggcggcggagggtggcaaggcgcattaccgccgcatagccgaccgcgcctcgcagctctatgcgcctgtcgtccatctgctggctctcacctctttcatcgtctgggggctttatgacggcgactggaaacatgccctgatggtggcgattgccgtgctgatcattacctgcccttgcgcattgggtctggccgtgccggtcgtgcaggtggtagcagccggaaagctgttccagcgcggcatcatggtcaaggacggctcggccatggagcgcctggccaaggtggatgccgtcgcgttcgacaagacaggcacgctgacgcttggccgccccatgcccgtcgatatcaacaaggccagccccggcatgatctccatcgccgccgggcttgctgctcattcccgtcatccgctgtcacagtccctgtggcgcagcgcctcatccaattacgcagccggggcaatccgcaatttctccggtgtgacggaaattccgggtagcggcgttgaggccgacgcggcggaagggcgctaccggcttggaaaccgccgctttgcactcggctcaggcgagggtgaggccgatggtccggctctgtcggaagtcattctttcgctgaatggttacagtctcggctgtttccgcttcgaagacagccttcgccctagtgcagcggaggttattgccgggctacaggccgagggcatgagggtcacgatcctttcgggagacaggacgccggtggtgaaagcgctcgctgcacggcttggcgtcgacgcggcagaggccgaactctcgccatccggcaaggcaaagttttgcgcgtcagcggacgaggccgggcagcatctgttgatggtaggcgatggcattaatgacgcgccagcgctatcggctgcctatgtctccatggcaccagccacggcagccgatgtcgggcgccaggccgccgactttgtcttcatgcatgagggattggatgccgtgccctttgccataaacgtctcccgccgggcagggcagttgatccgcgagaatttcgtgctggcaatcggctataacgtgctggccgtgccggtcgctctgctgggctatgccacaccgctgattgccgccgtcgccatgtcgacctcctcgatcatcgtggtggccaatgcgttgcggctgaacgggttgggcggatttacccgcaaggccgacgctcatgcccttcaacccgcatcgaaccgcaaaccgctgggaatagccgcatga

SEQ ID NO: 1495 - DNA, 2286 bp, Rhizobium leguminosarum bv  trifolii WSM1325
atgacctgctgtaccatggacgcggaaagcgtgcttgccctcagcacgacatcattcagtgccgaagaggtccgtcttgccagtcagccgctcggcgagggattgcgtcagctggacctgagtgttcccgacgttcactgcggtggctgcatttcggccatagaaagggcgctgctgacacttcccttcgtcaagacggcgcgcgtcaatctcacggctcgaagggtgacctgcgtctaccaggaggagatcgagacgcatgccgccgatccgtccgagatcctcgcagcgatcaactcggccggatatcgcgcgcatctcttcacgccttcagctcccgagaacgacaagaccagaaatcagcttctcctcgcgatcggcgtttccggttttgcggccgccaacatcatgttgctctccgtatcggtctggtcgggtgcagatgccgcgacgcgcgatatgtttcattggatctcggcgatgatagcagcgcccgcgctggtttatgcggggcgcttcttcttcaaatcggcctggaatgcgctgcggcacgggcgcaccaacatggacgttccgatctcactcgccgtgtcgctctcctatgccgtttccttgtgggagaccgtccatcacggcgagcatgcgtggttcgacgcttcggtctcgctgctcttcttcctgctgatcggcagaaccctcgatcatatcatgcgggaaaaggctcgggcagcgatcaacggactggcacggctggccccgcgcggagcattgctgatcaatccggacgggtcgcgacgctacattgcggtagaagagatcgcggcgggggatgaaatctcgatagccgcaggcgaacgggttcccgtcgatggcatagtcgtcagcggagaaagcgacctggacctctccatcgtcaccggcgagagcagccccgtcgccgtcgccagcgacagcgaagtgagttccggggcgatgaatctgaccggctcgctcgtgttgcgggcgacgagaattgccaagatttcacttctctcggagatcattggcctcatggaagccgccgagggcggaagagctcgctatcgcaggatcgccgatcgcgctgcgacactctattcgccggtcgtgcatctgctggcgttggtctccttccttgcctggggcttcctgggcggagactggaaacaggccatgctggtcgccgtagcggtcctgatcatcacctgcccatgcgcattgggtcttgccgtgcccgtggtccaggtcgtcgccgcgggggagcttttccggaagggcatcatggtgaaggacggctcagcactcgaaagactggctgagaccgacaccgtggcctttgacaagacgggcactttgacgatgggcagttcgcgccttgtcagagtggatgccatggacgagagcgccactgcaatcgccggtggattggcagcgcattcacggcatcctctttctcgggctctggtgcgggacaccgaaactgcccccatctccttcgacagggtcacggaaatccccggcgggggactggaagccaggaacggagcggatatctatcgcttgggcaacgcggcgtttgcctgcggaaccagcttcgtgccccgcaccgccgacagtccgttctcggaagtggtcctgtcgaagaatggcgtcgatcttgcccgcttcttcttcgatgacacgcttcatccgggtgcgtgcgaggccatcgaccggctcgatgcagccggccttgaaacgctgatcttgtcgggcgacaggcagaccgtcgtcgacaatacggcgcatgccctgggtatcgacagggctttgggctctctgacgccgaaacagaaggtcgaggaatgccagaggctgaatggcgaaggtcgtcgcgtgctcatggttggcgacgggatcaacgacgccccggcgcttgctgccgcgcatgtctcgatggcgcccgccacggcctccgatatcggcagacaggcggccgacctcgtcttcttcaacgatcgccttgacgctgttccggaagcgatcgccgttgcgcgacgatccgccagcctcatccggcagaacttcgctctcgccattggttacaacgttctggcggtgccgatcgccatcgccggattggcgacgccgctgatagcggcggtggcaatgtcgacatcttcgatcatcgtcgtgaccaacgcactgcggctgaacgccctcagcaagcgtccgggtatgcacactcgaggagggatcggcaggagtgcggaggtcaaagccgcatga

SEQ ID NO: 1496 - DNA, 708 bp, Methanosarcina barkeri fusaro
gtgacacaccagaaaagattatcaatcccaagaagctggaaggctgggaaaaaaggttataagtgggtctccaccactcgcccggggcctcacagtcaggcacgcagtcttccgctcggaatcataattcgcgatattctcaagcttgtagataatagcagggaaggtaagaggattctctcggaaggcaaagttcttgtagatggaatccccaggaaagacctcaggttcccggtagggctttttgatgtaattacacttcctctcgtaaatgaaacatacagaatgttccaggacgaaaagggacgtctggcccttcacaagctgaacgcaacaaacgttaacaaattgtgcaggattaacaacaagactaccctcaaaggaggaaaggtgcagcttaacctgaatgacgggaccaacattctgggttctaacgagtacagcacaaaggactctctgattctctcattgcctgacaagcagatagtaaagcacctgcagttcaaggtcggcaatctggcaatggtagtaggcggccagcattctggagaaatcggaaagattactgaaatcagggaagttaagagttccaggcacaatacagtcgcgatttcaggggaaaccgatttcgaaacaattgaagattacgttattgtaattggtgaggacaagcctgaaatccgactcggtggtgaggtaattgagtaa

SEQ ID NO: 1497 - DNA, 726 bp, Methanospirillum hungatei JF-1
atgggacatcacctcaagcgggttgtatcaccaaagtcatggggaattccacgaaagactgataagtttgtcacaaagacctccccgggcccgcataacaaaaatgcacttccgattgttgtctgggcacgtgaccagatgggcatcgtccggaacatgaaggaagcaaaacacgttcttcgtgagcgtgagattatcgtaaatggcagaccggtacggcacccggatatgggaatcggcatctttgacatcgtttccataccgaagagcgggaaacactaccgcatccttcgtgacaagaagggacgtcatgtaaccatcccgatcgatgaagatgcagcatcctcacgccttgtgaagatcaccaacaagaccatcgtaaaaggtggcagaattcagctgaatcttcgagacggatcaaatgttctgacagacaagcagtacaaatcaggtgattcaattgttctctccctgaaggaagggcagaagaacgagatcatcgatcacttcccattccagcccggtaatatggcaatgatcatcggtggaaaacactccggtgttgtcggcagaattattgagcatatcccggttccgggcagccttccaaaccgtgtcatcctgaaggatgaaagttctggtgagtcctttgaaaccattgacgagtatgtcgtcatggtcggccgggagtcacccgcaattgatcgctgggggattgaggaatga

SEQ ID NO: 1498 - DNA, 711 bp, Methanococcoides burtonii DSM 6242
gtggccactcatcaaaagaggatatctgtcccaaaaagctggcagatctcaaagaaatccaacaaatggataacatccacaaggcctggtcctcacaacagactccagagcatcccattagcagttatactcagggatatgctcggtgttgtcgataaccgcgcagaggcaaagagagtactctctgaaggcaatgtacttgttgacggagtagcaaggaaagaccttaggttccctgtaggtctgatggatattattaccatcccattgaacaacgtggaataccgcgtaatgctcgatggaaagagcagacttgtgttgaacaagcttgatggaacaggtgctgacaaattgtgccgcattgaaggtaagacctctatcaaagaaggtaagatccagatgcgtcttaacgatggtgtcaatatcattggttccaacaattacaataccaaggattcaataatcctgtccgttccagacaaaaaggtcgtcaaacacatcaaatatgaagtgggcaatcttgcaatgatcgttggtggaagccatgcaggcgaagttggatctatcaaagagatcaatacagtgaaaagttccaagaacaacacagttactatctccggtgagattgaattcgagaccatcgaagattatgtgttcgtgatcggtgaatcaaaaccagagatcttcataggtggtgaaactgttgagtaa

SEQ ID NO: 1499 - DNA, 702 bp, Methanosaeta thermophila PT
gtgcacaggaaaagagtcacgatacccagaagctggctaataccaaggaagaccagcaagtggatagcaacgcccagacctggtccgcactcagctgaggagagtctgcctctgatggtcgttgtcagagatcttttaaagctggcagataacgcgcgcgaggtcaagaggatcctccacgagggcggggtgctggtggatgggactgtgagaagggatgcgaggtttcctgtgggactcttcgatgtcataacagttcccgctctcaacaaacagtacagaatggtcaagagcacgaaggggtactttgtgctcatagagatccagccagatacgccaagaaagcttgtcagggtagagaacaaaaccacccttaagggcaacaggatgcagctgaacctcagcgatggatcaaacataatcgcagagggtgatgtcgggactggcgattcgctgctgatctcgctgccagagaggagcatcgaggatatcataaagttcgaggtcgggaacctggcgatggtgaccggtggatcgcacacaggaatgacgggtcgcatcaaatccgtgcagattgtgagaagctcgatgccgaacagggtcacaatatctacggatgatggggatatagagacgatcatcgactacgtcttcgtgataggcagagatgcgcctgttattgagctggaggctggaatatga

SEQ ID NO: 1500 - DNA, 756 bp, Thermofilum pendens Hrk 5
gtgggcaggaaggttaaaggatccttgaggcaccttaggcgtagcgttgcaccgccgttctggcccataaagcgcaaagagtacgtgtggacagtaaagcctagcccgggtccccattccctgctcagctccatacccatagggatagtgttgcgcgatgtctttgggtatgcaaagacgatgaaggaggcgcgtagaatactggcctctagggtcatagaagtcgacggtagggttgtaacggactacaagtttcctgttggcttaatggacgttctacacataatcccggaggagaagtactatcgggtcgtacccgatcctgctagaaagctaaggttcgtagagatcaaacccgaggaggcgggctacaagctagcccagatacgcaggaagatgactgttaagaacggagacctacagttcacgttacacgatgggaggaacgtactaatcaggaagggtagcgaggcctactcgacggctatttcctacaagacatatgacgcgttgctgataaccattcccagacagagtatagtaagtcacgtaccgttcgaggtgggcaccctggctatcgtggtagatgggcggaacgtcggcttcatgggtagaattaacgcgattcagcaggtgttcaagagaagtcgcgccctcgtggagctcgaggatgccagcggtgcgaagtctaggactatactccagtatgttctcccagttgggaaagagaagccactagtaacggtgactgcgtaa

SEQ ID NO: 1501 - DNA, 717 bp, Pyrobaculum islandicum DSM 4184
atggtacatctacgtcgtacaactgcaccatactggtggcctataccgcggaagatcggaggagtatgggtagtaagatcttctccagggccccatagtcttgcctattcgttgccacttgcaataatcataagagacgtactaaaatatgctaagacaatgcgtgaagcaagatatataatatcgagaggatatgtaaaaatcgacggcgttattagaaaagactataagttcccagtgggtcttatggacgttgtagaaatcgtgccaacgggagaaatttacagagttgtgccagacgagaaaaagtattatgccctcattcctatttcttcagaagaggcaacgttgaaattgctaagggtagaggggaaaactgcagtaaaaggtggtaagttgcaactacatttccacgatggtagaaacttaatagtatctcaagacgtaggtcgtcatataaaaacctttgatactgtgctatacgatttacagaataaaaatataaaaatgcatataccatttaagctgggagcctatgctgtagtcacccgcggtggtaatgtaggcttctctggaaaattatatgaaattgtttggacactaaaaagaagacagtccgttgtcgcgttaaaaagaaatgaagaagtgagaagaacaattctagattacataatgataacaggatctgaagctcctgttataaaaatctctccttaa

SEQ ID NO: 1502 - DNA, 720 bp, Methanocorpusculum labreanum Z
atgacccgaaccaagagaatgactgcaccggatgcatggcagatcgccagaaaagaaagcaaatatgtcgtcagcacctcaagcggtccgcacgatggttcagctcttccaatcggcatctggctccgcgaccacatgcagtttgcattaaacaccaaagaagtcagaaagattctgcacgaccgtcaggttttactgaatggtcatatcgtaaccgatgaacacatcggaatcgatgtctttgatatcatcagcttcccgaaaatcgacaagcactacatgatccttgtcgatgagaagggacgccacaatgaatatgagatctccgcagatgcagccaaactccagctcgtaaaagttgcaaacaaaaccaccattaaaggcggcaagacacagatcaacttaaccagcggtgcaaacttcatcggtgaagaaaactgtaaaggcaaagattctctcgttatcggcatcgccggcgacgaccgtttcgcagtccagcagcacttcccgtatgcagtcggcaacatggcaatcatcatcggcggacagcacacaatgaagaccggaaaactcgtggagatccttgttcaggaatcatctctgccgaaccgtgtcatcattgaagatgccgacggaaacaagttcgagaccattgaagactatgtctacatgatcggaaccaccgagtccttcctcaaaacctggggtgttgacgcatga

SEQ ID NO: 1503 - DNA, 729 bp, Methanoculleus marisnigri JR1
atgtcaaagtatctcaagcggctggtagccccgggctcctggcacatcccgaagaaagtacagaaattcgtcatgaagaccgcccccggcccccacaacgccggcgctctgccggtcggggtctggctccgcgagcacatcggtcttgcacagaacgcgagcgaggtcaaaaagatcctgcaccagcgggacgtgctcgtcaacggacgggcctgcaaggactcgcggatgggcctcggtgtctttgatatcgtctcgatcccgaaactcgggaagcactaccggatccagctcgatgtgaagggcaacctggtcgcaatcgagatcccggcggagtccgcaaagacccggctctgcaagatccggaacaagaccacggtcaagggcggcaaggtgcagctgaacttcgcgttcggtgcaaacgtcctcgccgacaacacctacaaggcaaaggactccgtcgtcgtgaccctcgggacggacggcgaagaccggttcaggatcgtcgaccacttcccctacgcggaaggcaacgtggccatgatcgtcggcggaaagcactccggcaaggtcggcaggatcgtcgagatcatcaggacggcaagttccgtcccgaaccatgtcatcctcacggacgattcggccggcgagcggttcgagaccatcgaggagtacgtcttcatggtcggccgctccgcgatagcacccgaactggaggcctcggcatga

SEQ ID NO: 1504 - DNA, 714 bp, Pyrobaculum calidifontis JCM 11548
atggttcatcttagaaagtcgctggcgccatattggtggccaatacccagaaaagccggtggagtctgggccgtaaggccatcaacggggccacatagtttggaatactctcttccgttggcagttgtagtaagggatgtactgcgatatgcaaaaacgctacgcgaggcgaggtacataatttcgagagggtacataaaggtagacggggtcgtaagaaaagactataaattccccatagggctcatggacgtagttgaaatagtgccaactggcgagatttatagagtggtgccagacgaggccaagtactacgacttgaaacccataccgtccagcgaggcggctctaaagccgctacgtgtagaaggtaaaaccgccgtaagcggcggcagaattcagctacactttcacgacggccgcaacctgatactaccgcccgacgtaggccgccagataaagacctttgacactgtggtgtacgatttggaaaacaaggcgattaagactcatttgccgctgaggctgggccagctcgccgtagtaactcacggtggcaacataggatttgtgggccagttttttgaagtggtgtggacgcttaaaagacgtcaatccgttgtggctcttagaaaaggcgaggaggtaagaagaacgatcttagactacataatggtgattgggacagaagccccagtagtaaaaataagctaa

SEQ ID NO: 1505 - DNA, 735 bp, Methanococcus maripaludis C5
atggcaattaaaggacctagaaaacatcttaaaagattggctgctccagcaaattggcaacttcctagaaaagtaaaagcatttactgtaagaccatcacctggaccacactcaatggataaatccttacctttattgttagttgtaagagatgtattaaaatacgctgataacgcaagagaagctaaaaaaattatccaaacgggaaaaatcttaatcgatggattaaaaagaaaggaatacaaacaccctgctggattaatggatgttttatcaatccctgaaatggatgaaaactaccttgtattatttgacgaaagcggaagaatcagcttgaaaaaaactgacaaagcagatgcaaaattatgcaaaatcgtgaacaaaactgtcataaaaggcggtcacattcaattaaaccttcacgatggtagaaaccagattgtaaaagtttcagatgctacaaaagcagaagaagatgtttacaaaaccggagacagcgttttagtttcaattccagaacagtcaattgttggacatgttgcattcggcgaaggaaaattagcatacgtaactggcggtaaacacgttggagaatttgctaaaatcgttgaagtggaaaacagagcattgtactcagacattgtaactttagaaaacaaagacggcgagaaatttaaaaccgttaagccttacgtatttatcgtaggtcaagacgagccagtaatttcgatgtaa

SEQ ID NO: 1506 - DNA, 717 bp, Pyrobaculum arsenaticum DSM 13514
atggtccatcttcgtagatctctagctccttattggtggcctattcccagaaaagccggcggtgtatgggtcgtcaagccatcgccgggtcctcacagtttcgcctattcgctaccactagccatagttattagagatgtgttgagatacgccaagacgttgcgcgaggctaggtatatagtatcgaggggctacataaaggtggatggagttgtcagaaaagattacagatttcccgttggtctaatggatgtgattgagatagtgcccacaggagaggtgtatagagtagtcccagatcaggataggtattacaatctgttgccaataccttcaagcgaggcatcgcttaagttgttaagagtagagggtaaaactaccgtcaacggcgggaggttgcaactccattttcacgacgggaggaatttaataacatcgccagacatgggagcgaaaatcaagacctttgacacgatactttacgacctagaaaacaagaccataaagacgcatattcctatgaaactaggggtggtcgccgtggtgacacacggtagcaacgtaggattctctggcaaactctacgaaatagtgtggacgcttaagcggaggcaatccgttgtcgggcttaaaaagggtgaagaagtaagaaggacgattctggactacatcatggcagtgggcgaggagagccccgtgataaagataaccccctaa

SEQ ID NO: 1507 - DNA, 726 bp, Metallosphaera sedula DSM 5348
atgactcatattactagattagaggctccctggttcttaagagcgagtaaaaaggagtataaatggaccgttagagcctcgcctggtccccatccgttaggcaagagtatcccactaggtttacttctgagggattatctcgcgtttacttcttcgcttaaggaatctaagaagataatttcagacggtaaggtgctagtggatggaagagtaagacgtgattacaaatatcctgtaggtttgatggatgtgattgctattcctcatgctgacctatatttgagaatagttccagatcgtgctaggcttcttaaacctgtaaagatctcggaagaggaaagtaaattcaaactcgtgaggttgctgaacaaaacgctcgtgaaggggggtttacttcaatttaatctcgaagatgggaggaaccttttgataagcaaggagtccactgaaatgttcaagcttcctaccctgacaaccttaaagatatcaattccaaaccaggagatattaggtgtgtatgggtttaaggaaaatgtatatgttatggctgtaggtggaaagaacgcaggaatcataggtcaattaaagagaattcagacctctccttacaagaccaggcgttactccattgttgtaattagaagcccagacggttctgaatacgagactaaccttgaaaatgcaatggttataggagaggaaaaacctgaggtgaaggtggagtaa

SEQ ID NO: 1508 - DNA, 735 bp, Methanococcus vannielii SB
atggcaattaaaggacctagaaaacatcttaaaagattggctgctccagcaaattggcaacttcctagaaaagaaagaacatttactgtgagaccatcacctggaccacattcaatggacaaatccttgccgttattattaattgtaagagatactttaaaatgtgctgataatgcaagagaagctaaaaaaattatccaaatgggcaaaattttaattgacggcgtcaagagaaaagaatacaaacaccctgtaggattaatggatgttttatcaattcctgaacttaacgaaaattaccttgtattatttgacgaaaatggaagaatcagtttgaaaaagactgaaaaaaccggcgtaaaattgtgcaaaatcgtgaataaaactgttattaaaggtggccatatccagttgaaccttcacgatggtagaaaccaaattgtaaaagttgcaaatgctttaaaagcagaagaagacatttacaaaactggagatagcgttttagtttcattacctgaacaagcagttgtaggacatgttgaatttaacgaagggaagttagcatacatcactggcggtaaacacgtaggagaatttgctaaagtcgttgaagttgaaaaaagaacattgtactctgacatcgtaaccttagaaaataaggacggagaaaaattcaaaacaattaaaccttatgtgttcattgtaggtcaggatgaacccgtaatctcaatgtaa

SEQ ID NO: 1509 - DNA, 735 bp, Methanococcus aeolicus Nankai-3
atggcaaataaaggaccaaggaagcatttgaaaagactacccgctccaaaaaactggcaaatttcaagaaaaaccaataaatatactacaagaccatccgcaggacctcatgcaatggggagctccttgccgttattgttggttcttagagatttattaggttatgccgataatgcaagagaggcaaaaaaagttattaaaatgggtaaagtgttagttgatggagtaaaaagaaaagaccacagatacccgacaggtttaatggatgtaatatcattacctgatgcaaatgaaagctttttggtagtattggatgaaaaaggtagaattaaattaaataaaataaaagataacactaaaaagttatgtaaaattgaaaataaaactgttataaaaggcggacacattcagttaaaccttcacgatggtagaaatcaaatagtaaaacttgccgatgctacaaaagctgaggaagatatttataaaacaggagattgtgttattctctctattccagaacagagcatagtaggacatgttcagtttggtgaaggaaaattggcatacatcacaggcggtaaacacgtaggcgattttgcaaaaataataggtatagagaaaaaacaattatatcctgatataattacacttgaaacagaaaacggagagcagttcaaaaccattagagactatgttttcatagttggtgacgacaaacctgttatttcaatgtaa

SEQ ID NO: 1510 - DNA, 735 bp, Methanococcus maripaludis C7
atggcaattaaaggacctagaaaacatcttaaaagattggctgctccagcaaattggcaacttcctagaaaagtaaaagcatttactgtaagaccatcacctggaccacactcaatggataaatctttacctttattgttagttgtaagagacgtattaaaatacgctgacaacgcaagagaagctaaaaaaattatccaaacgggaaaaatcttaatcgatggattaaaaagaaaggaatacaaacaccctgctggattaatggatgttttatcaatccctgaaatggatgaaaactaccttgtattatttgacgaaagcggaagaatcagcttgaaaaaaactgacaaaaccgatgcaaaattatgcaaaatcgtgaacaaaactgttataaaaggcggtcacattcaattaaaccttcacgatggtagaaaccagattgtaaaagtttcagacgctacaaaagctgaagaagatgtttacaaaacaggagacagcgttttagtttcaattccagaacagtcaattgttggacatgttgcattcggcgaaggaaaattagcatacgtaactggcggtaaacacgttggagaatttgctaaaatcgttgaagtggaaaacagagcattgtactcagatattgtaactttagaaaacaaagatggcgagaaatttaaaaccgttaagccttacgtatttatcgtaggtcaagacgagccagtaatttcgatgtaa

SEQ ID NO: 1511 - DNA, 726 bp, Candidatus Methanoregula boonei 6A8
atgtcagatcatttaaagagactcaacgcgccggactcgtggcatatcacaaagaagaccacgaaatttgttgcaaagaccgcgccgggcccgcacaatgcaaatgccatgcccgttgcggtctggctcagggatcagcagggtcttgcccgcaccatgaaggaagtcaagcagatccttaagcagaaggatgttgttattaacggcagacctgttcgcgaccccaagatgggtatcggcatcttcgatgttatcgcccttccgcggatcggcaagtacttccgtgtactcagggatctcaagggccggcacaagaccgttgagatcgatgcggaagcagcccagaagcggctctgcaagatcgagaacaagacgattgttcccggtggaaaagtccagttaaacctcaggtacggggcaaacatcatcgccgacaatacctacaagtcaaacgactcggttgttatctcgctcaagcctgaggaccggtttaagattctcgagcactatccgttcgttgccggcaacatggcaacgattataggcggccggcactccggcaaggtggcgcggatcatcgagatcatcaagaccccggggagcgttcccaacaaggtgattctcgaggatgagaaaaccaaggagcggtttgacaccatcactccctatatctacatgatcggaaaagagaccgtttcaaaagccagctgggggcttgaccagtga

SEQ ID NO: 1512 - DNA, 714 bp, Caldivirga maquilingensis IC-167
atgacgcatttaaggagatcaacatcacctgaatggtggcctgtggagaggaagggggcgccgtggtcaattaaaccaagcccaggaccccacccggctaactcaagcatacccctcgcggtgcttcttagggatgtattccactacgctaagacccttagggaggctaggttaataataggtaaggggtatgttaaggttgatggtaaggtcaggagggattacaagtacccagtcggcttaatggatgttattgagttaacgccaataaacgagtactacaggattatacctgatccagttaacttcctaaggcctattaggattgataagtctgaggcaggcgtaaaggtgtgtaggattgaggataagaccatggttaaggcaggtaagattcagttaaacctacatgatgggaggaacataattgttgaccaggatgagggtaggaagtatgagacgcttgggagcgttgtggttaatcttgaggacggtaagttaatggattactacccaatgcagcctaaccaatacgtaatagccttcaacggtgttaacgtggggaggcacggtactttaattaattgggttaggtcgtttaggaagagggacgccatagccacggttaaggctaaggactctgagttcaggacggtattaaactacctactcgttatcggtaaggaatcaccagtggtgaaggtgactgagtga

SEQ ID NO: 1513 - DNA, 735 bp, Methanococcus maripaludis C6
atggcaattaaaggacctagaaaacatcttaaaagattggctgctccagcaaattggcaacttcctagaaaagtaaaagcatttactgtaagaccatcacctggaccacactcaatggataaatccttacctttattgttagttgtaagagacatattaaaatacgctgacaacgcaagagaagctaaaaaaattatccaaacgggaaaaatcttaatcgatggattaaaaagaaaggaatacaaacaccctgctggattaatggatgttttatcaatccctgaaatggatgaaaactaccttgtattatttgacgaaagcggaagaatcagcttgaaaaaaactgacaaaaccgatgcaaaattatgcaaaatcgtgaacaaaactgtcataaaaggcggtcacattcaattaaaccttcacgacggtagaaaccagattgtaaaagtttcagatgctacaaaagcagaagaagatgtttacaaaaccggagacagcgttttagtttcaattccagaacagtcaattgttggacatgttgcattcggcgaaggaaaattagcatacatcactggcggtaaacacgttggggaatttgctaaaatcgttgaagtggaaaacagagcattgtactcagacattgtaactttagaaaacaaagatggcgagaaatttaaaaccgttaagccttacgtatttatcgtaggtcaagacgagccagtaatttcgatgtaa

SEQ ID NO: 1514 - DNA, 717 bp, Nitrosopumilus maritimus SCM1
atggtaagtatttcaggtagtaaaaaactcaaacgtcaaatggcacctcaattctggggcattgccagaaaagacaagagatttgtaatcacaacaagaccaggaccacacaaaaaacatcatgcagttccaacagcagtgttcctaagagacatgttaaaaattgtaacaagtcttagagaagcaaagacttcaatctatactggaaaggtaaagattgacggtgttgttagaaaatcattacatcatgcaattggattaatggacgtagttgaactagaaaatgtttcagatatttatcgtcttgtcccaacagatggtaaattactaaaaccaatcaaaattaacgaatcagaaaaaacaaagaagcttgtaagagttacaagtaaaactacaattagtaaaggaaaaatgcaaattggattccatgatggacgttcaacaatttcagataccaaagtaagtgttggtgatgtgtgtttaatacaagtaccagatcaaaaaattcttgaagtaatcaaattagaatcaggtaatcacggattagtaacacgtggaattaacgcaggacaaatcggaaagattgaaagtattgaagaaggtacattcattcttccaaaaagagtcattctatctttaggagatagaaaaatcgaaattccagcagacatcattatgccaattggaaaagaggaaccagtaattcaattaaagtga

SEQ ID NO: 1515 - DNA, 717 bp, Thermoproteus neutrophilus V24Sta
atggtgcatctacgtcgtacaacctcgccctattggtggcctattccgcgaaaagccggaggcgtatgggctgtaagaccctcccctggcccgcactctcttgcctattctatccccttggcgctggttataagagacgtccttaggtacgccaagacgttaagagaggcgaggatgataatctccagggggtacataaaggtagacggcgttgtgagaagaaactacaaattcccagtgggtctcatggacgtagtagagatagtgcccacgggggagatctaccgcgtggtacccgacgagaggagctactacgcgttggtccccataacctcggaggaggctgacctcaagctactacgcgtcgaaggcaaaacggctgtgaagggaggccggctacaggtacacttccacgacggcagaaacctaataatgcctgccgaaacagcccgccagataaaaaccttcgactcggtgctctacgacctaaaggccaggacagtgagaagccacataccgatgcggctaggcgtctacgcggttgtgacacacggcggtaacgtggggttccacggccaactcagcgagatagtgtggaccttgaagaggagacagtcggtcgtcttgttgaaaaggggcgaagaggcgaagaggactatcctcgactacataatggcagttggggcagaggcccctgttataaagatatctccctag

SEQ ID NO: 1516 - DNA, 723 bp, Halorubrum lacusprofundi ATCC 49239
atgacgcgacatcagaagcgactggcagtaccgaactcctggccggtcgagcgaaagacgaacacgttcaccgtcaaggccggcgccggcccgcacggtgaggcgggcgttccgctcgtcgtcctgctgcgggacgtgctcggctacgtcgactcgacgaaggaggcgcgctacgcgctgaacaacgactcggtcctcgtcaacggggacgccatctcggacgagcagcgtccgatcgggatgttcgacatcctggcgttccccgagcgcggggagttcttccgcgtcttccccgacgagggcggtcggctcgcgctgacctccgtcgacgaggaagccgccggcagccggctcggaaagatcacgaacaagtccgtcgtccccggtggcgacgctcagctaacactccacgacgggacgaatgtcctcgtggacgccgacaccgagtacgacacgaaagactcgatcgtcgttgacaacgagtcgaaggatgtcgtcgcccacttcgagtacgaagagggcgccttggtcaccgccgtcgccggccaacacgccggccgcatcggcgaggtggccgacatcgacgtgacgctcggctccggctcgaacacggtcttcgtcggcgacgacgaggacggctacgagacggtcgaggagtacctcgtcgtcatcgacgagaacttcactggcgacgacgccgacgaggtggattcggatgagtga

SEQ ID NO: 1517 - DNA, 861 bp, Halorhabdus utahensis DSM 12940
atgagtaaccaccagaaacgactctcggtaccgaacagctggccgatcgagcgcaagaccgagaccttcaccgtaaaggccgacgccggcccccacggcgaggcgggcgtgcccctgctgatcgtccttcgggacgtgctggggtacgtcgacagccgcaaggaggcccgcttcgcgctcgatcaggaccaggtgctgatcaacggcgaccccgaaagcgacgagacccgcccggtggggatgttcgacatcctcgccttcacggagcgcgaggagttctaccgcgtgttccccggagagggcggtcgactcgcgctgacgccgatcgacgaggattcggcccagtcaaagctggggaagatcgtcggcaaacagttcgtccccggcggcgacctgcagctcacgctgcacgacggcgagacgctgctggtctccgaggacgcgccctacgagggcaacgactcggtcgtcgtcgagaacgacagcgaggagatcgtcgcccacttcgagtacgaggagggcgcactcgtaacggccgtcgacggtcagcacgccggcgagatcgggacgatcgaggagatccaggtcacgcccggcagcgccgagaacaacgtccgcatcgaccgcgaggacggctcgatcatcgagacgatcgaggagtacgtcgtcgttatcgacgagaacttcgtcgaggacgatgagggcgtggaagcggacgacgaggctgaggccgacgccgacgacgcggccgacgctgacgcagacgacgaagacgcggaagccgacgaggctgatgcagacgccgaggccgaggaagccgacggagacgacgacgaggctgacggaggtgacgacgaatga

SEQ ID NO: 1518 - DNA, 726 bp, Candidatus Methanosphaerula palustris E1 9c
atgtctgaacatctgaagagacttgtcgcaccccgtgcgtggcatatcgcaaagaagacgaatacattcatctcaaagaccgctcccggtccccacaatgggcaggcactcccgattggagtctggcttcgtgacaccatgggatttgcccagaccttaaaagaggtcaagcagatcttaaacgagcgctctgtcattgtcaatggcaggccatgcagggatccaaagatggggatcggtatcttcgatatcattgcgatcccaaagatgggaaaatattaccggattctgctcgccaagaacggcagactggtcgcaatttcgatcgaggcagaggacgcgaagagccggctctgcaaggttcaggacaagacgattgtctctggtggaaaaactcaggtgaacctgacctacggtgccaatgtactgacagaagaggcatgttcaccgaaggactcactggttctttcacttgagccggaacagcggtttacagtcctcgaccacttcccctacaaggagggaaatatggcgatggtgatcggtggtcggcactccggtaagatcgggaagattcagacgatcacgacagtgatggggtcaaccccgaacacggtcattctcgaagaggttgggactggaacccagttcgatacgatcgactcgtatatctatatggttggacgtgagacgccggtgatcgctgaatgggggattgaagagtga

SEQ ID NO: 1519 - DNA, 798 bp, Halomicrobium mukohataei DSM 12286
atgagtaaccatcagaaacgactatcggtcccgaagagttggccggtcgagcgcaagaccgagacgttcaccgtaaaggcagacgctggtccccacggcgaagcaggagtccccctcctgatcgtcctgcgggacgtgctgggctacgtggactcccgcaaggaagcccgctacgccctcaacaacgacagcgtcctgatcaacggaaaggccgtctccgacgaggaacgcccggtcgggatgttcgacatcctggcgttcgtcgagcgagacgagtactaccgcgtgttccccggcgagggcggtcggctggcgctgacccccatcgacgaggacagcgcacagtccaagctgggcaagatcgtcggcaagcgagcggtcagcggcgatcagatccagctgacgctgcacgacggccagacgctcctggtcgaggaagacaccgactacgacggtggcgactccatcgtcgtcgccaacgaggacagcgagtcgcagggcgactcggacagttcgagcggcgacgagccgcgagaaggcgagatcgtcgctcacttcgagtacgaagcgggcgcgctggtcaccgccgtcgacggcgcacacgccggcgagatcggtgagatcgacgagattcaggtcacgccggggagctcctcgaacaacgtgctcgtcgagcagaccgacggcgacggcttcgagaccgtcgaagagtacgtcgtcgtcatcgacgagaacttcgtcgatgaggacgccgaggacgcagcctcacaggaccccgagggaggtgacgacgaatga

SEQ ID NO: 1520 - DNA, 2412 bp, Moorella thermoacetica ATCC 39073
ttgcgagtcccgtataaatggctacagcaatacgtcgacgtcaccctgccgcctgcagagctggccgacaagctcaccatggccggcctggcggttgagggtgtcgaagacctcacccccggctttcagaaggtagtggccgggaaaataaaaaccatcaccccccatcccgatgccgaccacctggtcatctgcaacgtcgacgccggccgggaactccagctggtaacgggggctcccaacgtccatgagggccagatggtagccgtcgccctggaaggcgccaggttgccgggaggaagggagattcaccgggctaccttccgcggcgtggtctccgaaggaatgctttgttcggcccaggagcttggcctggatgtcagcctggtttccccggaagacagggaaggcatcatcaccctgccccccgatgcctccccgggagcggatgcggctgaagtcctgggcctcaaggacgtagtcctggttctggagttgacccccaaccgggccgactgcctgagcattttgggcgtcgcacgggaagtggcggctattaccggcgcccccatccacctgccggccactcttcccggcgaggacggcccggaaattaccggtctggcgacggtagaaattaccgccccggacctctgcgcccgctatgtggctcgcctggtccagggagtgcgcatcggcccctcaccggcctggctgcaggcctttttacgggccgcaggtatgcggccgatcaacaacgtggttgacataactaactttatcatgctggagatgggccagcccctccatgcctttgattacgacctcctggaaggacaccggataatcgtgcgccgggccgggccgggagaaaaaataacgaccctggatggagtggaacgggagctggatccggagatgctggtcatcgccgacgctgcgcggccggtagccgtagccggcgtcatgggagggctggcgacggaggttaccccggcaaccaccaatatcctgatcgaatccgcccattttgacggtgcttccatccgccgtacctcccgccgcctgggcttgcgctcggaggcctcgacccgttttgaacggggggtcaacctggagggcgcgccagctgcggccgaccgggcggcgcggttaatggccgaactggccgggggccgggtggcccctggccgcatcgactgctatgtaaaacggcgccagccggtcactattgagctgcggccggagcgggtaaactacctcctggggacggaactggcaccaacaaccatgaaggaactcctggagcgcctgcacctggaagtccggggtgaaggccccttccaggtgaccgtcccggcctaccggggcgacctgaccggggagattgacctggtggaagagatagcccgcctctatggctataaccgcatccccgtcaccctgccgggtaacctcacggccagggaaaaacaggccccggcccagcgctgggaagaggccggcagggaagcggcggcggccgccgggctggcggaggtcatcacctacagctttatcggtcccagggccctggatcaactgcggctgccggaggaccacccctggcgccgtacagtgaagatccagaatcctttaagggaagagcagagcatcatgcggccctccttgctgccgggcttattggaggtggccggccgaaacgccagccgccgggtgctgccggtggccatctatgaactggggcgggtatttataccggcagggtcccgccggcccggtgaaccactgcgcctggccgggctggtcatggggaccaccccgcggggatggaactggccggccggggagatggatttttattacctgaagggtatcctcgaaagtatattcagccggctccgggtaagggacgtttcctgggaagccagtaatgcctatcccttcctccatcccggccgggccgcgaccatcaaggccggtaccagggtcctgggctacctgggggaactgcacccggatgttctggcggccgtggagctgccggcaagggcctgcgcctttgaactggactgggaggctgccggggacctggcactgagggtgccccgctatgaacccctgccccgtttcccggccgtggaacgggacctggcggtggtggtgccggccacgaccccggcggcggccgtggccggggtaatcagggaggccgggggcgaactgctgcgggccatcgccctcttcgatgtctatgaaggcgccccggtgccggagggatgcaagagcctggcctattccctggtctatcagttgcccgaccggaccctgaccgatgccgaggtcaatgcagcccaggaaaggattcaaagggccctggaggaacgtctgggggccagtttgcgacagtag

SEQ ID NO: 1521 - DNA, 2403 bp, Candidatus Desulforudis audaxviator MP104C
gtgcgggtttcgatcaattggctgaaggaattcgtggatatcccagtgacctctgcggaactggccgaccgcctgaccctggccggagtggccgtcgaccggattgacaaaccgagtgcgggcgttacgggcgtggtcaccggcagggtggtggaggtgcggccgcaccccaacgccgaccggctcttgatcgctgcggtggacatcggcggggaaatcctgcagatcgtcacgggtgccgcgaacttcaaggtcggcgatgtggttccggtagccccggtgggggccaccctggccggtgacttggccatcaggcgggctaaattccgcggcgttgaatcctgggggatgatgtgcgcggccgacgaactgggcatcggtgacgaccacgaaggcattctgatcctcccctcggacaccccggtgggtgtggccgcgggccccatcctggggctggacgacgagatcctggaactggacttgacccccaaccggggtgactgcctgtcggtgctgggtgtggcccgggaagtcgccaccctgctgggcaagcccctaaaacgcagaaaaccggcctttccggaactggaccttcaggcgcagcgcatggtccgggtggacatcgaggacccccgcctctgcagccgctacgtggcccgggtgctagtcgacgtccgggtcgggccctcgccgctgtggatgcagacccggctgttcacggccggggtgagaccgatcagcaatattgtcgacgtcaccaattacgtgatgctggaactgggacagccccagcacgcctttgactacgacgcggtacacaacgcccacgtcatcgtgcgccgggcgcggcccggggagactctggtgaccctggacggcaacgagcggagtctggctccggacatgcttctgatcaccgacccccggacggtcatcggcgtcgccggcgttatgggcggcctggactccgaggtgaccgcggacaccaggcgggtccttctggagtcggcctgcttcaatccagtcagtatccggcggacttcccgagcgctcggtttgcgctcggaggcctcaatacgctttgaaaagggggtcgacccggaagggtgtctgaaggcggccgatcgggcactggaactcatgcagattatcggtgccggccacgccgcggcgggtgccgttgacgtctacccggacccctacacgccccgaacgctcattgtgcggcctgagcgcgtggaagagatactgggtctggctgtgccggctaaaaccatccgggacatcctggaacggctcgagtttgccccacgggaaaccggcgggaggtttctggtgcgtgttccgtcccaccggaccgacgtgttccgggaaatagacctgatcgaagaagtcgcccggatccacggctaccaccggatacccgacaccctgccgttcggcgtgactgtcccgggagtccggacgaaggctcaggtcttggagtccaggctcagggaactgctggtggcgtgcgggctgaccgaagttatcacgtacaccttcaccaaccggaaggttttcgaccgcctgcgcctgcccggtacctccccgctgcgccggacggtaccgttgcggaacccgcttaacgaggaccagacagagatgcgcaccctgctttatcccagcctgctcgacgtactggcccgaaactaccagcggcggaacaccaacgccgccctgttcgaaatcggccgggtttaccatccccgcgacaacgcgcccctgcccgaagaaggcctgcggctggccgcagcgctgatggggcgcactccggccggctggcgccgcaaggatgagcctttggactttttcttcctgaagggagttctggaaagcgtcgcccgggaaatcggccttgaaacgcttacctttacggcggagcaggatgaaccttcgtttcacccggggcggaccgcgcgcctccgggctggggaggcaaacctcggcatcatcggggaacttcatccggaggtacttgaggcgtacgacttgccaccgggtgtggtagtcaccgagattgacttggacctggtgctcgccgtggacaaaaagacacccacctttgtcccgctgccgcgcttcccgagcgtggaacgagacctggccctggtgatcagaaaagatatcccggctcgcgaggtgatggccttaatccgtaaggcgggaggggagttgctccgggaactgcgtctttttgacgtgtacgaaggccgtcagatccgggagggttaccgcaacctcggcttttccctcgttttccgggcggaggaccgtactttgacggatgaagaggtcggccggtacctggaggcaataatccggactctggaagacacgtatggcgcccagctccgagcatag

SEQ ID NO: 1522 - DNA, 2460 bp, Natranaerobius thermophilus JW NM WN LF
atgcaagtttcttataactggttgtgtgaatacttggatttagatatatcgccacaagaactggcagagaagcttaccaacggtggagttgaagttgagggcatagaacagttgaaccctgatcttgatgatatcgtagtaggtgaagtcaaggaagttactgaacatcccaatggagataaattatctgttacaaaagtagatgttggggatgctagtgattcctctgaattacaaatagtgtgtggtgctcctaacgtggcagttgggcaaaaggtgccggtagccctggtaggctcaatgcttccagatggtttcattattgaatcttgttcaatcagaggagaacgatcatatggaatgatttgttcctgtgaagagttagaacttctctcaccagaagaagaagagggaataatggttttggatgatgatgcccctattggtgaatcaatagtgacatacttggaattggatgatacgattctagaatttgatttaacaccaaaccgggctgattgtttagggatgctaggggtggctagagaggttgccgctttattagatattccctttcatgagccggaagtaactgattataagcagaataaaactttggatgaaattaatattaacatagaggattcgaatctaagtgagcgttatataggcatgcttattgaagatatcaatattgaaacatctcctatgtggcttcaacaaaaactcaggtcttatggcatcagacctattaataatctcgtagatattacaaattttattatgattgagtacggtcaaccattacatgcctttgattacgattggattaaagggaaaaatataagcgttagatctgctcaaaaagatgaacagataaaaactttagacgaaaaacagagaaccctgactccacaagatatagttattgccgatgaagaaagacctattgccatagctggagttatgggaggatatgatacggaagttagcttaaataccaatagaattctattggaggcggcatcttttaataatattagtgtacgtagaaccgccaatcgcttaaacttacgttcggaagcctctctacgctttgaaaaaggtgtggatccaaataatacattaaaagccgcttttagagcaattgatttgatagaacaacttgatgtaggaaaagtgaaaattggagctgctgacgaatatccacaaatcagagagtgtgtggaggttgaactacgaacttcacgagttagagctctaacgggtctggatatatctgatgatgagattaaagatatatttagacgtttagatttcgatatagacggagaaaaatcgcttagtaatacagactctgaacgaggacttaagttgactgttaaggttccaactagaaggaatgatatctctctagaagttgatttaattgaagagattgccagaatctatggttacgacaggattccgacttccatgcctcaaggtaagataactcagggccgaaagacccatagccaaaaagttgcggatatttcaagggaaacattgttaactgccggattctctgaaattatttcctatacttttatttcaccagatgatttcgataggataaaactgacagaagatgaccaattcagaacagcagtacctttagctaatccaatgactaaagaacaaagtataatgagaactaccatgataccatccatattaaagattttagagcataattcaaatcatggagaaaaagactttcaagtatttgagatcggaaaagtttattttcctaaagagttacctttaaaagaattaccaagagaacagactaatttgatttttggcggtatgggaaaactaactcctaaaacatggatggaacaaccaggggagatagatttctttcatttaaaaggtgtctttgaacttcttatagaaaggttaaatcttaatattagtgactttgattttatgccagaaaaacacccttctttccatcctaccaggactgccacaataaaataccgaggtgaaagagttggtctcatgggagaaattcatccagaactagcgtcagaattcaatctagataatgcggtgattgccgaacttaatttcgaaaaaattattgggtctgctaatctatttgacagttatcaaccgctacctaaatatccagctgtattacgagatctagctgtattagtacctgaagacacaccagaagaacatgtggctggaaagattgctgatacgggctctggcttaattgaaaacatccaattatttgatttataccaaggtgaccgaattccagagggtatgaaaagtttagcgtactctattagtttcagagatccagaaagcaccttgacagatgagtatgtagataatattttcgaagaaattgaacggcgattagaatctgaacttggtgccaagttgcgtaaatcttag

SEQ ID NO: 1523 - DNA, 2406 bp, Desulfitobacterium hafniense DCB 2
atgaaggtcagtttggaatggttacgggaatatgtagatatcgctcagactgctgaggatttagcggaaagcttaacccggggcgggattgaggtcggtggcgttgagtatctgaatcaagggctggaggcagtcgtggtcggcgaaatcacccgcatggaacatcatcctaatgcggataagctgtggatctgcgaagtgaacctgggagacaggtccacgaccatcgttacaggagctcagaatctgctggtcggggatcggattccggtggctttgccgggaaccacgctgcccaacggagttcatatcgaagtctcgaagctgcggggagtggaatcttcagggatgctctgttccactgaggagcttcatttggactccggcttaggggacccgcgcagtgaaggcggcattcttatcttagagaaggagactcccttaggggcaaccatggataccgttcttggcgaaggggattgcgtcctggatctggaactctatcccaaccgtcccgattgtttgggtatggtgaatgtggcgcgggaggttgcttctttgaccggggaagcactgcatctgcctgcatgggcggaggggtcccaaggcccggattacccaggggatcctaaggccaggattgttctggatgatccgggtctgtgccagcgctatgccggcttagtcgtagaagatgtcaacattgagccttctccggagtggatgcagaaacgtcttaaagcagcaggagtgcgcccgatcagcaatattgtggatattaccaactacattatgctggagatgggacagcctttgcatgcgtttgatcgggatgccatcgccggcgctgtccacgttcgccgggcccgtgctggagagaagctggtgacccttgatgatatagagcgggagcttgatccggaaatgctgctcattgctgatgacgagaaagcccttggtttggcaggggtcatgggtggcttaaacagtgaaatcaccgactccaccaaaaggatcttcgtggaatcggctcatttttccagtgtcagcattcgccgcaccagccgtcgtttgggactgcgctcagaggcatccaatcgttttgaaaaaggggttaatccacatggtgtagcggcgaccctgggccgtgtagctgagttggttatccagctgggagccggaaaaccggtagggtttgtcgaacaagcggggcagctcccagagcctgcggcggtttcccttactgtggaaaagaccaattcccttctgggaacggctcttactgaggaagagattaccggggttctcaaacgcttgcgttttccttatcaagaaaaggataggggatatgaagttcagattcctacctatcgttccgatattactattgaagaagatttaattgaagaagtggcccgtttgacaggctatgatcggattcccacgaccttgccccaaggagatcagactcagggacggagaactcctgagcaggaatttaagcgtacgctccgccatcttctggttggtttgggtctgaatgaggtcatgacctattccttcacccgccccgatgccgatcgccagtttggggatatggatcaggctattccgttgctgaatccgctgcgggaagagttaagtgtgatgcggactgctttgcttcctagcattatggagattgccgcccggaatatctcccgcaggaacctggatattcggctcttcgagatgggcagtatttataagagcaaggagcgccccttggtcaggcttcctcaagaggagctgcatttggccggggtgatctggggcaaatcctcccgccattggctgaccccggtaacggagtatgatttctatacagtgaaagggattctggaggaagtggctcgtgagtttggtctggagttcgactatcggctgcccaataatcaggagctcacccatccggggcgttccgcagatatctacctcaacggggtaaagatcggtctgatgggcgaaattcatcctgctttaggcaaagagtgggaactggaaagggccttgatttttgaactggctgtggctcccatgctggaggccggcaaccggaccattcgagctttctccataccgaagtttccggcgatgcagcgggatttggctgtagtggtaccgctggaggtctccgcccaggatgttatgaaacggattaaggagctgggaggaacgcttttggttcaggtgaatatcttcgatgtctataccggcaaacctattcccgaagatcgtaagagcctggcttttgcgctgaagtatcaagccttggatcgaactctgaaggacgaagaggtcaatgccttaaatcagcaagttcttgaagggattgaaaaggaatttggagctgcctggagaaaatag

SEQ ID NO: 1524 - DNA, 2400 bp, Halothermothrix orenii H 168
atgcgagtacctgttaactggcttaaatcatacatagattttcaatattccccacaggaactggcagataaattaacaatgcttggccttgaggttgaaggaattgaatatatgggggaaggccttgaaggaattattgtcggtgaaattaaaaaagtaaaacctcatcccaatgcagataaactggtaatttgtgaagtagataccggacaggagttattacagattataaccggtgctccaaatgtaaaagagggtataaaagtaccggtagctcccgtcggtgtaaccctacccggtggcctgaaaatcaaaaaagccagattgaggggagaaaactcctatggtatgatttgctcaattgacgagctcggcctaagtgaaaaaagggccagtggaattatgattcttgatgaagatgccgaagtgggtaccgatattattgattatctacatctggatgagtatgttctcaaactggatttaactcccaattatgccaggtgtctgggacttttagggattgcccgggagataaagtcggttctgggtaatgaaattaaaaaaccagatactgacctggttgagtctgaatctgagagtattgaaaactatatttctatagaggttgaagataaagatttatgtccccgttatactggccgggttattaaaaatataaaaatagggccttcaccacggtggatgcaggcccgtctccgggcggccggaatcaggcccattaacaatattgtagatatcaccaattacgtaatgctcgaatataaccagccactccatgcttttgattatgataagattgataagaaaataattgtcaggaggggtaaagaacaggaaaaactgattacccttgataataaagagcgtgaacttgatgaagaagtcctggtaattgccgataccgaaaaagccctgggtcttgccggggtcatgggtggagccaatagtgaagtttgtgatgatactactactgtatttcttgaatctgcctacttcaacccggtaaatatcaggaaaactgcaaaaaaattcgcccttcccagtgaggcttcccaccgttttgaaagggaggttgacattgagggtgtaattgctgccagtaaccgggctgcctatttaatgcaaaaatatgcaggtggtgaaattgttaggggcattgtagatgtttaccctgaacctcgtagattgcatgcaattaatctcgataccgggtatgtcaataaaattctcggtcttaatcttgataaaactgaaatagaagatatgttaactagactggaattcaaagtagaagaacgggattcaaaatctttaaaagtaatggtaccttccttccgcagtgatattgaaagggaagcagatttaattgaggaagtagcccggatgtatgggtataataatataccggtgaccaggccggagagtaaacagcgaggaaggaagacttataaacagcacctggaagatataacccgtaactatatgtctgccatggggttagatgaggttataactttcagtcttaccgggaaaaaggtttatgatgatctggatattcctgaagatagttccctgagaaactgggtcaaagtaaaaaatccactgaatgaagccttgagtattttaaggacctcattattacccagtattattgaagtcctctctaataatgcaaaacgacaggttgaaaccatgtctgtttatgaactgggtaagattttcaccaggattaaagagaaaaaacgaccagaggaaagggttgtgctggcaggaggctgtatgggtaaaaccgatgatccctggaaaactggagcccctgatttcttttacctgaaaggggttgttgtggattatctgcgggagctcggtcttgatgggcttgattttacaccttcaaaattacccttccttcaccctggacgaactgctgaaatatattaccgggataccaggataggcattatgggggaattaatgccagatattgcagatagatttaatctcaggtctggaacagccgtatttcagcttgattttgaaaccatagtagaagaagctgaccttgatagacaatatgaacaactacccaggtatccagctgttgaaagggatatggctgtagttgtagaaaatgaagtttttgccgggtctctcttgaaattgataagggaaaatggtgggaaattattgaagaaagctggcctgtttgacctttatcagggaaaacaaattccagaaggttataaaagtctggcctttaaacttgtattccaggcccatgacagaaccttaacagatgatgaagttaatgaagtgtttaactctattatggatcagcttaaagataaatttggggcagaaataagaggagtttag

SEQ ID NO: 1525 - DNA, 2415 bp, Desulfotomaculum acetoxidans DSM 771
gtgcttgtatcttataactggctaaaagagtatgttgacatagatatccctccgcaggaattggcagatcgcttgactctggccggtgttgccgtggagaaagtagagtatctgggggaagggatagaaaaagtttataccggtaaaatcctgaaaatagataaacatcccaatgccgataagctggttgtttgttctataactaccggaagtgaaaccttgcagatcgtgaccggtgccacaaatgtccgggaaggacatattgtacctgtctctgttgtgggagccagtctggcaggtggtttaaaaattaaaaaatcaaagctgcgcggtgttgagtcttatggcatgctttgttccggccaggaactgggcatggatgctaagttcctgcctccggaacaacaaaccggtgttatgattttaccggaagacactcctataggtgttgatgcaaaagaagtactgggtttaaatgatacaattttggagcttgacctgaccccaaacaggggagattgcctctcgatgattggtgtagcgcgtgaggtggctgctatgcttggctacacgctgcgtgtgcctcaaccggttgtgcaggaactgccggacgctattgcgggaaaagccagggtggacattgccgctccttctctgtgccggcgttatgcagcacgggttttggttaatgttaagattggttcatcgccggggtggatgcagcaaagactgagggcagccggagtgagaccaatcagcaatattgtggatgtgaccaactacgtcatgctggaattgggtcaacccatgcacgcatttgattatgacacattggagaatcaccatattattgtacgccgggctgcggccggtgagagtataatgactctggacggaagccagcgcaagctggaacaggatatgctggtgattgccgataccaccggggcgatagcagtagcaggagtgatggggggattgcgcaccgaggtgacaggtaatactgttgccgtattgctggaatcagcgcaatttaatcctattagtgtgcgccgtacctctaaggaactcggattgcgttcggaatcctcgctgcgctttgaaaaaggaattgacttggacggctgcctgcgcgcagctgatcgggcctgccagctgatgcaggaaatgggggctgctgatgtactggctggctctgttgacaattaccctgaggtgctgctggagaaaaccgtgctgctgcgtaccggacgggtgagccgcatattaggtgttgaagtgcctaaagaacaaattgttgctgttttaagcagtttggactttaacgtaagggataacggggatgaattattggttactgtgcccagtcatcgcaacgatgtaagcatagaagctgacttaatagaagaggtggccaggatgtacggctataaccggattcctgccactcttatgcagggtgacaataccagaggagctaaaacaccggttcagttgatagagaccaggctcaaagatacactggctgcctgtgggcttacagaagttataacctacagcttcgttaatccgcatgtgtttgatgccctgggtctggcagaggataatgacttgcgccgggcagtaaaggtgaaaaatcctctcagtgaagatcaatcggtcatgcgcaccacgctgctgcctaatttactggaagttttgcagcgcaattataaccgccgtgtacaaaacggggctgtttttgaaacaggcaggtgctttttgcccactgaccgtcaattgccggatgaaattccggtgcttggcgcggcagcaatgggaaaccaggcttctgcctggaataaaccagcggtgccaatggatttttattatcttaagggtgtgttagaggccatgtttgataccattgggctttccggtattgcttttgtgacgtcagaggctccaggctatcatccgggcaggacagcagttattcagcttgatggcaggcaaataggtgtactgggtgaggttcaccctgatgttctggagaattatgacttaccggagcgggtaacagcctgcgaaattaatttaactgaagtatttatgcttgccggtaagattaagaaataccaggctttgcctcgttatcccggtgtagacagggatttggcggtggttgtaaagcagtcattggcagttgaagctttgttccatgtaatccataataccggtggaaagctgttgcgctcggtgaagctctttgacgtttaccgtggcgggcaggttaaggaaggttaccagagcttggcttttgctcttaatttacaggcggaagatcataccttaaccgatgctgagataaatgagacaatggaaaatatccgcggtgcgctagagaaagaattgggagcggaactgcggggatag

SEQ ID NO: 1526 - DNA, 2412 bp, Alicyclobacillus acidocaldarius DSM 446
gtgagagcatcgtacaaatggctggccgaatatctcgatctcgcgggcctatcgccggctgaactcgcggatcgcctgacgagcgcggggcttgccgtggacgcggtcgatcccttgaatcgcggcgtggagggggtcgtgatcggcaagattctggaggtgcggccgcatccccaggcggatcggctgaaggtttgccgcgtggacgtgggcggccgacagctcgaaatcgtctgcggggcgccgaatgccgcgccggggctcgtggtgccggtcgcgctgcccggggcgaagctgccgggcggcgtggagatccggattgccgagtttcgcggcgtgtcctcgcacggcatgctgtgttcggcggacgagctcggaatcgagactcggtacctgcccaaacgggacgtggaggggctgttcgtccttccggaggacctgccgctcggcgaggacgtcgtcccgcatcttcacctggacgacgtcgtgctcgatctcgacctcacgcccaaccgaagcgattgcctgtccatccgcggcttggtgcacgagctttcggcgatcctccggcggccgcatcgattccctgcgtcggttccggcgcccgccgccgagggggaatccccgctccaggtgcgtctcgagacgccgcggtgcccgcgatacgaagcccaactcctggaaggcgtcgaggtccgggaaacgccgctctggatgaagatgcggcttttggccatgggcgtccgttctatcgatctcgtcgtcgacgtgacgaactacgtgatgctcgaatggggccagcctctgcacgcgtttgacgcggacgccatcgcccacgccaccatcgtcgtccgacaggcgagagagggcgagcgcctcgtgacgctcgacggccaggagcgcgcgctcacgcccgacatgatcgtcatcgcggacccggagaaggctatcgggctcgcgggcgtgatgggcggggagaacagcgaaatcggcccttcgacccggcgcattgcgcttgaatccgcccgcttcgacggcgcctccatccggagaacgggccaggccctctcgcttcgctcggaggcgcagcaacggttcgaaaaaggcgttgatccggcggccgtctcgagcgcgttgcaccgggcgaccgagctcctcgttcaactcgcgggatcgcgccccgtcggcgcgccacgccgcgtcccggcgcaggcagacgtgtcgaaaccgaccgtcatctccttctcaccgcgggcgtgtgctcggttcctcggcgtggacgtgcccgaggaagagatgcgcgcgtgcttcgagtccctcggctttgacgtcacgcaaggcgaaaacgagtggcgcgtggaagtgccgacgcggcgcccggatgtgcagttgccagccgatttgtacgaggaagtggctcggctctacgggtatgatcacatccccgccacgtccatgcggttgccggtggaagcgccggagtcgtcgggccagctcatgcttgtgcgcaaggtgaggcgcgcgctcgtcgattgggggcttcacgaggtgaggacgtacgcgctcacgtcgcccgaggccgaagcgccggtcgcgccgagcggggtgccggtgccgcttctgcggcccatgtccgacgaccgccgcaccttgcgccgccacctgttgccgagcctcgcggaggtggcgcggcacaacctcgcgcatcaggtgttgggcggtgcaatctttgaggtgggaaaagtgtttctggcggcctcctggccccaggaggcgttgccggaggagcgcgctgtcctcggcatgctgtggttcggcgagccggaaggcgatcccttcgagcgcccgcgccgctacgacttctacgatgcgaagggcgtgtgcgacgcgcttctcgcgcgcctcggcatccaggcgacttatcgagtcagccagcatgcgtatctccatcccggccgccaggcgtccattgaagtgaacggtgagcccgtcgggctcgtcggggaacttcatcccgacgtcggcgaggcctacgaggtcgagcgcgctgtgtacgcggagttcgatctcggccgcctgttatcgctcgcctcttcggaggtgcgcgtgctccccatcccgcgccatcccgcgagccgccgcgatctcgccgtcgtggtgccgcgcgaactcgagtcgcaggcgctggtcgatgcggcgtggcggacgcttggcgatcgcggcgatctgcgcttggtccgcgttttcgacgtgtacacgggcgtcggcgttccggaaggtcacaaaagcctggcggtcgcgctctggttccagcgcgacgagcgcacgctgacggacgccgagatcgacgaagcggtggaggcggtgctccgcgcttgggaggcggccttcggcgcgaagcttcgcgcgtaa

SEQ ID NO: 1527 - DNA, 1023 bp, Syntrophomonas wolfei Goettingen
atggcagttaagtaccttgattattacaaaatcctgggtgtggagcgcgatgccgacgccaaaaagataaaggcggcctaccgcaagctggcccgcaagtggcatccggatttgcattccggcaaaaagcgggaggaagccgaagaaaaaatcaaagaaattaatgaggcctatgaagtactcagtgacccggaaaaaaaggctctctatgaccgcctgggccccaactggaaaaacggcgagcgggtggattcctccggttttggggatggggttttctatcgcagcagtaatatagacccggaggacttgcagggtttcagcgagttcttttccagcctttttggcgcagagccgggccgccaaagccggagagcctcttaccgcagtgctccggtcagggggcaggacatagagagtactattgagttgagcctggaggaagcctaccacgggcttagcaagtccataaccctgtccacggccgccgcctgcccggaatgccagggcagcggctttgtgggccggggattttgccggcgctgcggcggtaccggtagtatttccgaggccaggaccctgcaggtaaggatacctcccggtgtccacgagggcagtagcatccgcctcaaaggccagggaggagaggggctgggcggagccgaacggggtgacctctatctccaggttcatatcctcccccatcctgtttttacgctgcggggccgggatttggaaacggaaatcactttgcggccggagcaggccgttctgggagaccgggttactgtggccactctggatcgccagctgacgcttaaagtcccgccgggaagccgcagcgggcagaaactacggctaaaaggcaagggcatgcccgcccgccagggggaaaacggagatctctatgcccggattaagattgacctcccccgcgacctgtcggaagaggaaaaggaactctatcgtcaactggcagagctgcgtgctccccgtcaggcggagaggggggtagccgaatga

SEQ ID NO: 1528 - DNA, 975 bp, Syntrophobacter fumaroxidans MPOB
atggcagtgaagtttagagactactacgaggtactgggggttccccgtacggcgacccaggaagaaatccagaggtcgtaccggaagcttgcgcggaaattccacccggatgtgaacaaggcgcgcgacgccgaggacaagttcaaggagatcaacgaggcctacgaggtcttgaaggatccggaaaagcgcaagaaatacgaccttctgggtgaaaactggaagaccggtcaggaattcaggccgccacccggctgggattaccaatacgatttcgggcgcgggggaggtcagggtgaattccagtggggaggatccggcgggttcagcgatttcttcgagatgctgttcggcggccagcgcggcggacgtgcgcgcggcggcgcgaggcgcggcggcgggccggtgtggagccaggcgggagccgaccaggaagccaccgtcaggatcagcctcgaggatgcgttccacggggccaccaagtccatcacgctgcaaatgcagagcctgactcccgatggtcaggtcgcggtgcaggagaagacctacgaggtcaagatcccggtcggaatcatgagcggccggaagatccgtctctccggccaggggggagaaggcatgggaggcgggccgcggggcgacctctacctcaagatcgagatcgagccccacgcggtttacaggctcaaggacagggacatttacgtggatcttccggttgcaccctgggaagccgtgctgggtgccgatgtgcagctcacaaccctgtccggccaggtgacgctcaagattcctccgggaactcaaagcggtcagaagctgcggttgaggggaaaggggatgccgaatcccaaggaaacggccggcgacctttacgtcgtggttcagataatggtcccgaaacacccttccagacgtgaacaggagcttttcgaagagctccgaaaagaatccgctttcaatccacggctctag

SEQ ID NO: 1529 - DNA, 1047 bp, Frankia EAN1pec
atgagcgccgggacgacgggacgcgcgagcccggacttctacgagctgctcggcgtgccgcgtgacgccgacaccgacgccatccagcgtgcgtaccgcaagctcgcccgcaggtaccacccggacatcaactccgacccgtccgccgaggagcggttcaaggacctctccgaggcgtacgacgtgctgtccgacccggacacccgtgcacgctacgaccggttcggccgcgatttccgccgggtgccggagggcgccgaacgctgggcggacgccccacggggcggcttcgggccaggtgccgggccgggcgccggcgccgacgggaccgccgggcgcggcgggggcttcggcttcgaggggttccagggcttcgacttcgaggacctgttcggcggggtccgcgggttcgcccgccggcgcggccgggtgggcccggtgcccggcgccgaccaggaggcggagatcgagatcctgctcgccgaggcctaccgcggcgcacggcggcggatcacgctgcccgggccgcgcggcctccgggaggtcgacgtggccgtcccggccggcgttcgtgacggccagcggctgcgcctcgccgggcagggtgggcgcggccgggacggcggaagccccggcgacctctacctcgtggtgcgcctggctcccgacccgcggttccgggtcgagggccgcgacgtccacaccgacctgccgctcgccccgtgggaagcagtcctgggaacggcggccgggctggacacaccggccggcgagcggatgacggtcaccgtcccgccggccacctccagcggccgccggctccgcctgcgcggccggggcctgccggcgcctggccgggacgcgtcccgggaggccacgggtggcagcgccggcgccgctggcggtggtggcggtcccggtggcgcggccggcgacctgtacgcgcacgcgcggatcatggtgccgcccaaccccgcggaacgggagaccgagctgttccgcgagctcgcccgggtctcgtccttcaaccccagggagcggtcatga

SEQ ID NO: 1530 - DNA, 945 bp, Geobacter lovleyi SZ
atgaacaactaccaggactactacaaaacactcggcgtcgagaaaaaagcaactcaggatgaaatccagcgggcgtatcgcaagctggctcgcaaataccatcctgacattaataaggaaagctccgctgaggaaaagttcaaacagctcaatgaagcctacgaggttctgggtgacccggaaaaaagagccaagtatgatcatctcggcagcggttgggatgggcaatttgccaatcagggttatcaggatggcgataatgtccaataccattactccaatgccgacccggggcagttcagtgacttcttccagaacctgttcggtggtggcggatggaacttcacggaggaaagcaattttcatggtggcggcgtcaggaggcgtcgggggcgcgaccatgaaaccgccatcaacatatcattggctgatgcctaccatggcgcaaagaagagcatcgaactagagcgggctgaactgggcagtgacggcaggccgaccagaaccaggcgcagctatgatatcaccatcccccaaggagtgactgatggctccttgatccgcctggctaaccaaggcgggagcgggagcggtggtggagatgcaggagacctgtttctgcgggtgaacatacttcccgatagtcgcttcacgctcaacggacacgaccttgccactaccgttgatatagctccctgggaggctgccctgggagggaaagtcttggtgcctactgtcgatgggcgcattaacctttccgtgcccgccggcacccaaagcggtcagagcctgcgggtgcgtggaaagggaatgccggtcgccccgggcaggttcggcgacctgctggtaaatgtccgcattgttgtgccacagcatctcacagccagggagcggcacctctttgaagaactggcaaaagaatcacgatttgagccgcgaaagtaa

SEQ ID NO: 1531 - DNA, 894 bp, Micrococcus luteus NCTC 2665
atggcggaggacctctacagcgtgctgggggtctcccggtcggcggatcagaaggagatccgccgcgcctaccgggagaaggcccgcaagttccacccggacgtcaacaaggccccgggggcggaggagaccttcaaacggatcagtgaagcccacgatgtgctgtcggacccggaaacccgctcacagtacgaccggttcggtgagaacttccggcagtacgccgccgcggacgcggctcgctcctccgagcagccgcgccgcagcggcggcacccgatacacgtggagcgggggcagcgcgcagagcgtgaactgggaggacctcttcgggggcggcttcggtggtttcgggggcggcttcggtggtttcggtcgcggcgccgaccgcaccgcggagctggagatcaccgtcgaggaggcctaccggggcgggcggcgcacggtgcaggtcgcgtccccgtacggcggcgcgcaggagtacaccatcgacatcccagcgggcgctgtcgacgggcagcggctgcggatcgcggacgccgacggacaggacggggacctgctgatcacgctgcgcgtgaaggacagtaagcggtaccggctcagcggcgcggacatcgaaacggaccttcccatctcaccgtgggaggcggcgctgggcgcggatgtcagcatgcccaccccgggcggcccggtcaccgtgcacgttccgcccggctcgtccacggacaggcggctccgcctgcgcgggcaggggatgccgcgcaggggacagccgggagacctgtatgcgcgggtgaaggtcgtcgttccccgcactctcagcaagaaggagagggagctgttcgaacagctccgcgacgaatcgtcgtttgatgccaggagaggatcatga

SEQ ID NO: 1532 - DNA, 975 bp, Catenulispora acidiphila DSM 44928
atggctcgcgactactacgaggtgctgggcgtgccgaagacggcggacgccgagcagatccagcaggccttccgcaagctggcccgccgccaccaccccgacgtgaacaaggacccggcggccgaggagcgcttcaaggagatcaacgaggcctaccaggtcctgtccgacccgaagacccgggcccgctacgaccggttcggcccggacttccgccagatccccgaggactacgacgagcaggtggcggccggccgcgccgcgcgcgccggcggtttccgcggcggcggaccggagggcggcgagtacgtcgacttcggcggcgccggggtccggttcgaggatttgttcggcgacatcttcggcgggcagggcgggccggccggccggggcggccagggtggtcggggcagtcggggcgggcgcggcggggtgcggatggccggcgcggaccagaccgcggagctggagctctccgtggaagaggcctatcgcggtggcaaacggaagatcacgatcggcggcgccggagggcgcgactacgacgtcacgatccccgccggcgtcgtcgacggccagcggatccggctggccgggcagggcggccgcggctacggcgacgccccggcgggcgacctctacctccagatccggatcgccccgcacccgcgcttccggctgtccggccgggacatcaccgtcgacctgccggtcagcccgtgggaggcggcgctcggcgcgacggtcccggtccccactcccggcggcacggccaaggtcgtcgtcccggcgggctcctcgaccgggcgcaagctgcggctgcgcggcgagggcatgcccaaccccaagggcccgcccggcgacctgtacgccgaggtcaggatcatggtgccggccacgccgaccgaccgggagcgcgagctgttcgaacagctcgccgcagcctcgtccttcgaccccaggaggcggtcatga

SEQ ID NO: 1533 - DNA, 975 bp, Nakamurella multipartita DSM 44233
atggcccaggacttttacgaggttctcggagtcaaccgcgatgccgatccggccgacatccagcgggcctaccgcaggctggcgcgccagcatcaccccgacgtcaacaagcactccggggccgaggagcggttcaaggacatcgccgaggcctacgacgtgctgtccgatcccgaactgcgtcgccgctacgacgccttcggcgaggacttccgacgcgtccctcccgacacagatccggccgcctggcgccaagcccggacgtacgccgacgccggtgcagggacgcgcggccgctggtcatcgggggcgggtccgtccggaggattcggagcgggcgacttcggcgacgtcgacattgaggacctgctcgggggaatcttcggcggccgggggcgaggcggtcggggccgggccggctggggaccgggcccggtcccgggctccgaccacgaggccgaggtggaggtgtcggtcgaggaggcctaccacggcacggagcgcagtgtgacgatcagtggccccgacggccctcgcacgctcgacgtcaccatcccggcgggcgtggtcgacggtcagcggatccggctgcgcggccagggcggatcgggcggcggttcggcggccgccggagacctctacctggtggtccggatcgccgaccacccgcgttaccgggtcgagggtcgcgacctgcacgcgctcctgccggtcgctccgtgggaggcggccctgggcgcttcggtctccgtcgacactcccggaggcgccgccacggtgaaggtcccggccggctcgtccagccaccgccgcttgcggctccagggccgcgggcttcccgacaggcgagggaagccggggaacttctacgccgaattgcagatccgcgtgcccaccaggctcaccgacgacgagcagcggctcttcgaggagctcgcgcgggtgtccagcttcgacgcgaggagcagacgatga

SEQ ID NO: 1534 - DNA, 933 bp, Syntrophomonas wolfei Goettingen
atgtataaactggcggctatcgtaggtccgacagcagttggcaaaaccaatatatccctggaagtagcccggcaaataaacggggagattatttcctgtgattccatgcagctttaccggggcatgaacatcggcaccgccaaggccagtaaggaagagcaaaatatagtagcacatcaccttattgatatagcagatccccatgaaaatttcacggttgcccgctatcaatccctggtaaaagaccttatctccaccatcaacgctcggggaaagattcccattctagtggggggcaccggactttactaccagtcagtggttgatgattatactttttttcctatggaagtccggcaaagcatacgcgacaaatggaacgctattattcaagaaaaaggattgcctcatgtctatcgcctattggagcagatagaccctgcttatgcccaaataatcagccccaatgaccagaaaagggtggtacgcgctttggaggtttatgagctcacgggaaaggctttctccaccttgcaggatagggcagagaacacatattatttggcggtggtgggattatacttggaaagaagagaattatatgccagaattgaaagacgggtcgatgaaatgataaagaaggggttgattgaggaggttgcagcgttgcgggaaaaagggatagacctttcgtataactctatgcaagccctggggtacaaacaggtattttatttcctggaaggttttattaatcgggaagagttgctaaatgaaataaaaagggaaacccggcgatatgccaaaaggcagttgacctggttcaaaaaagaccagcgtataaagtggtttaatgtaggcgattttagtgatgaggagcttttggttaaaaatatttgtacctttatggaaggacaattcggaatagtgtag

SEQ ID NO: 1535 - DNA, 852 bp, Desulfotomaculum reducens MI-1
gtgatttctgctgactccatgttagtttatcgtgacatggacattggaacggctaaacccacccttgaagagatggcaggcattccccaccatatgattgacattgttaaccctaatgaagaattcagtgtagccacgtatcaaagtagagtggaggaactcattaaccaaattattgatcgtggcaatttgcctctcctggtgggtggtacggggctttatattcgatctgtaattgatcactatgattttaccacagcaccgaaggatgatcggttgagagagtgtcttaagcgtgaagcagaacaagtgggggcggcagccatgcataaaaaattatctgaggttgatccacaatcagctgaacgcctgcaccccaatgacctgagacgggtcatccgggctttggaggtttattatcaaaccgggaaaacaattgcggaataccagtataaagatcaagtagagaagccgaaatataacttaaaaatgtttgggttaacgatggatcggcaattactataccaaaggattgaacagcgggtcgatctgatgatggcaagagggttgctgactgaggtaaaggaattggtggagcaatacaatggcctgggaactgcattacaagggctgggttataaagaaattatcggctacttaaagggagagtattctttgccggaggccgtagagattcttaaacgaaatactagacgttttgccaaacgccaacttacgtggtttcgagctgataatagaattttttggattgaaatggatcgttttgaaaataaaaaggctgttgcgaatgaaattatgaagcaaatggcaggagattttttaactttgtag

SEQ ID NO: 1536 - DNA, 918 bp, Thermotoga petrophila RKU-1
atgaagatagccatagtcggtgggcccactgctgttggaaagacagatatcatgatcgaagtctgtgaagagataggtgcggagatcatctcgatggactcgaggcagatctatcgctatatggacataggaacagccaagccaacatcggagcagagaagaagggttcctcatcacatgatagatatcatcgatcccgatgaatattacaacgctttcatgtacaggaaggattctctgagagcaatggaagacgttctcagacgtgggaagattcctgtttacgttggaggaacggggctgtacgcggatgcgctggttcggggtatattcgaaggagtgcctgccgatgaaaacataagaaaagaactcagagaactagagagaagagaacccgggattttgagaaaaatgctcgaagagttcgatcctgaagcggcgacgcgcattcatccaaacgatctcaagaggacgatcagagcccttgaagtttacatgaaaacgggaagaaggatctcggaacttcaaaaagaagcaaagggtgacgacaggtttttcataattgttttgactcgggaaaggtacgaactttacgagagaataaacaaaagagttgataagatgatagagatgggcctagtagatgaggtgaagagactcttggggatgggatattcgaaagatctcaattcgatgaaaacgataggatacagagaagtcattgactatctggaagggaagtacgattttgacaagatggttcatctcataaaacgaaacaccagacactttgccagaagacaaatcatatggttcaaaagatacaaagaagctgtgtggtacaatttaacgttcgaagatgtaggagaagtaaaggagaaactcaagaagctgatagttgaaaatttttcagtataa

SEQ ID NO: 1537 - DNA, 912 bp, Petrotoga mobilis SJ95
gtgaataaagttttagttatagcaggtcctacggctgtcggaaaaacagaaatatccattgagatagccagaagaattaatggtgaaataatttgtatggattcgagacaaatttatagccatcttataattggtaccgctacgcctgatgaagaaacaaaaaaattggtcccacatcacttgtatggttcagtagatccacggacccattttacagcttttgattataaaaaattggcagaaaaaaaaatcggtgaagtactaaatagaggaaatacaccagttttagtcggcgggacaggcctataccttgatgctctgaggaaaggttttttgaatgtaaaatccgactatggtttaaggacttatttaagaaaattagaaacaaataatcctggtgttttaagaaagattttggtagatttggatccacaaagagctcaaaagattcatccaaacgacttgaaaaggatcattagggccatagagatttatgttataacaggtataaaaatgggtgaaattgtaaaagaaaataggcaagacgaaaattcttttgattaccatataatagtactggatagagaaaggcaagaattgcacgaaaggattaacaaaagagttcatcaaatgatcgatgaaggtttgatagaagaggtgcgaaatctcttgtctttagggtattctacaactcttaacgctttaaacaccataggttataaagaagtggtacaatatttatatggaaaaattgattttaatgaaatggttcaccaaataaaagtaaatactcgtaactatgccagaagacagataatatactttcgtaagatagaaggtgcaaagtggatcaatttgagtaaaacaagtcaagaagaggtagtagatcaaatattaagtgaatttatttaa

SEQ ID NO: 1538 - DNA, 933 bp, Candidatus Desulforudis audaxviator MP104C
gtgaccgtgccgcccccgctggtcgtaatcaccggacccacggccacggggaaaaccgaagtcggcatcaatgtcgccctggcctgcggcggagagatcgtttcggccgattcgatgatggtctaccgggggatggatatcggcacggccaaaccgtccgcttccgagatgcggggtgtaccgcaccacctgatcgacgtcgtggacccggatgaggagttcaatgtggcgcggtaccagcaactggccggggaggcaatagtcggtattctcgggcggaaacgggttccgctgctggtcggcggcacgggcctttacatccggtcggtggtcgaagactaccggtttccggtacgggccgaccggcggcttagaaacagattgcaggaagcggccgagctttacgggtgtgcgcgcctgcaccgccatctggcggtggtcgaccccgttaccgcccgtcggctgcatccgaacgaccagcgccggatcatccgcgctctggaggtgtactaccagtcggggatccccttcagccgctatccggaccggcgggacagggcgccgaagtaccttccggtcatgttcgggctgaacatggaacggggccggctctaccggcggatcgaagaccgggtcgacgccatgatccgggcggggctggtgcgggaagtacagtccctgctggaaaagggttacggtcccgaactagtggcgatgaaggggttgggctacaaggaaatcgcggcccatctccgcgggagtctaacacttgaggaagcgatccatatactgaagagaaacacccgccggttcgccaaacgccagctgacctggttccggagagacgagcagattcgctggctggacgtggaggaatgcggcggcccggtgggagcggcccgagaaattgttggttctattgagcaggagtaa

SEQ ID NO: 1539 - DNA, 918 bp, Thermotoga RQ2
atgaagatagccatagtcggtggacccactgctgtcggaaagacagatatcatgatcgaagtgtgtgaagagataggtgcggagatcatctcgatggactcgaggcagatctatcgctacatggatataggaacagctaaaccaacaccggagcagagaaaaagggtacctcaccacatgatcgacatactggatcctgacgaatattacaacgcttttctttacaggaaagattcactgaaggcagtggaggccattctcaagcgtgggaagatacccgtatacgtgggtggaacggggctctatgcggatgctcttgtgaggggtatattcgagggagtgcccgcagatgagaacataagaaaggaattgagagaactcgaaagaagggaaccagggatcctgaggaaaatgctcgaagaattcgatccagaggcggcaacacgtattcatccgaacgaccttaaaagaaccatcagagcactcgaagtttatatgaagacgggaaggaggatatcagaacttcagaaggaaacaaaaggagacgacaggttcttcataatagtgctgacgagggaaaggtacgatctctacgacaggataaacagaagggtcgacagaatgatagagatgggtcttgtggacgaggtaaagagactcttgagtatgggctactcaaaagacctgaactcaatgaagacgataggatacaaagaagtgatcgaatacctggaaggaaagtacgacttcgaaaagatggttcatctcataaagagaaacacaaggcactttgcaagaagacagatcatatggttcaagaggtacgagaacgccatatggtacaatttaactttcgtgagcaaagaggagttgaagaagactttgaaggaactcatagtgaagaatttttcggtataa

SEQ ID NO: 1540 - DNA, 945 bp, Desulfitobacterium hafniense DCB 2
atgaaacccttgatcatcattgtaggacctacagccgtaggcaagacagctcttggggttgcccttgcccaagctctccagggtgagattatctccggggactccgttcaggtctatcgtaaactggatatcgggtcagccaagccaacgttggccgaacaaggcaatgtaccccattatctgctggacgctttggatccggctgaaccattcacagtggctcagttccagactttggccaatcaatctattcagaatatccaaagccggggcaaggtgccgattgttgtcggcgggacaggtctttacatccgctctttaatcgaccctttccaatttgccgagcacggctcagagtctatccgcagcttctggaccgcctttctctctgaacaagggaaagaggctctgcaccgggagctggccaaaagggatcctctcagtgcccagcgtctccatcccaatgatacggtccggattatccgggccctggaaatgtgccaattaaccggtaagcccttttccgaaatccgcggcaatcaagacatgaattatccgcctttgccaccttcgcttctctatgtgggacttaccgcaccaagggaaatcatttatgagcggatcaatcgccgttgtgaacagatggtggccgcggggctgattgaggaaacccacaatttaattaaagaaggctattccccaaaacttaagcctttgcaaagcattggttaccggcacgctttactctatctttatggtaaggtaacccttccggagatgatgagaatttttcaaagggatacccggcatttcgccaaacgtcagctcacttggttccgcagggacccgcgagtggtttggtatgatacttacagtgggaatttgacaaatattcttgaatctttgattggcacttgcagtggaatggaaagtcgtgtagaatag

SEQ ID NO: 1541 - DNA, 981 bp, Desulfotomaculum acetoxidans DSM 771
atgattaatatatctactggtcaaggacctggtggcaataaaaacccgataccgttaattgttattgtcgggcctaccgctgttgggaaaactgagtgcggggtattgctggctaaaactataaacggtgaaatagtctcagctgattccatgcagatttatcgatatatggatataggaacagctaaaccgaccatcgaagaaatgtgtggaatacctcattatatgctggatattattaatcctgatgaagaatatagtgtggcactgtaccaggaagcagctgaaaattatataagagatatatttaatagaggcagcagcccgattctggtaggtggaacaggtttgtatgtccgttcgatcactgaccattataatttcagccgtgctgaaataaattgggaatatagggctaagctcaatcagtcggcagatctacgaggaaatgaatatatacataatctcttaaaaactgttgatccattggcagcagaaaaaatacactgtaatgaccgtaaacgtataattagggcattggaagttttcgatcagacaggaaggcctatttccagttaccatgatagggacacatttactaaacccaaatataaattgcacattttcggtttaatcatggagaggtctcaactttacaggcgtattgaaatacgtatagataaaatgatggaacagggatttttgaaagaggttcgaggtttgctggacaggggctattcttcacaattaacctctatgaaaagtcttggttataaggaacttggagcttatttaaatggcaatatgagtcttgaggaagccgtggaaatgctaaaacgcaataccaggcgtttcgctaagaggcagttaacatggtttaaacgagataataaaattacatggcttgatattagcagacagccggctatggatgatattgttcaagaaattattaagatagttgcaggagtaagctgctaa

SEQ ID NO: 1542 - DNA, 1002 bp, Alicyclobacillus acidocaldarius DSM 446
atgaccgacaggaaacccatcgtctgcgtggtcgggccgacgggtgtcggcaagagcgaactcagcgtcgagatcgcgctgcgctacggcggagaggtcgtctcggcggattccatgcagatttaccggggcatggacatcgggaccgcgaagcttcgcccggacgagatgcgcggcgttccccatcacctgctcgacatcgccgatcccgcgaggaagttcacggttgcggagtggaagcggcaggcggacatggtcatcgacgagatcgtcgcgaggggccgcctgcccgtggtgtgcggcggtacggggctgtatgtccgggcgctcctcgacgatctcgacttttcgcagacgccggaaaacgtccatctgcgcgcggcgctcgaccggcgcgcggacgaggaaggcgtgcaggcgctgtacgaggagctgcgcgcgagggatccggaacgggccaggatgattcatccgcacgaccgaaaacgaattgtccgcgcgcttgaggtcgccatggtccggggcacgggcatgtcggaagactacgactggacgccgcgccaagggcggtacgaggcgctcgtcctcggcatcacgatgccgcgcgaggcgctctatcagcggatcgaccggcgggtggaacacatgtggcgactcggcctggtggacgaggtcaagcgcctgctcgcggccggcgtgccgatgggtgggacggcgatgcaggccatcggctacaaggaagttgtctcctatttgtcgggtgccgtatcggaggaggaggcaattcgcatcatacaacagaacacgaggcggtttgccaagcggcagtggtcgtggtttcggcgtgatcctcgggtgcactggttcgcgaaaggcagcgatgggctgttttcgacggacgagatcgcgcgattgtgggcatgcatcgaccactttttgcaggatatcgggtggtcgactgcgaatagatccagcacctgcagattggagagtgaatcgtag

SEQ ID NO: 1543 - DNA, 849 bp, Rhodoferax ferrireducens T118
atgaaagctgtgaagtattttaggtatttttggcctctagccattatgaaacaagcgttagtagctactgttttggtagcgttcatgggcttgccagtgagcgctcaaacgccatccatcgtggtcgcatccaccacctcgaccgagcagtccggtctgttttccgtgctgctgcccgagttcaaaaaggccagcggcatcgacgtgaaagtcgtggcactgggcactggccaggccatcgacatgggccgccggggcgatgctgacgtgctgttcgtgcatgacaaggtggccgaagaaaaagtcgtggctgagggctttgccgtcaagcgccttgaggtgatgtacaacgactttgtggtcgttggccctgccagcgatcccgtcaaagtcaaaggtaacgatgtggtcgaagcgctcaaaaagctctcggctgccaatggcccgttcatctcgcgcggcgacaagagcggcacccacgcggctgagctgcgtttctggaagatggccgacctggccgacaagcagggcagcggctacaagtcgtgcggctgcggcatgggtccggcactcaatatggcttccagcagcaacgcctacgcgctggccgaccgtggtacctggctcaacttcaaaaaccggggcgacctgaaagtgctggtggaaggcgatcaacgtttgtttaatcaatacggcgtgatgctggtcaaccccgccaagcacccgcatgtgaaggcggtagacgggcagaagtttgtggattgggtcatttcacccgctggtcagggcgtgattgccagctacaaaattggcggcgagcaactgttctttccgaatgcggtgaagtga

SEQ ID NO: 1544 - DNA, 828 bp, Mesorhizobium BNC1
atgctgccctgcccaatgttctctgcgcttgccgcgcttttcatgctggccggagttgccgccgcccaggaccagtccattgtcgtcgcttcgacgacctcgacgcaggattccggcctcttcgatcacattcttccgctattcgaagagaaaacgggcatcgaggtgaaggtgatcgcccagggaaccggccaggcgctcgatacggggcggcgcggcgatgccgatgtggtcttcgtgcatgcgagggaacaggaggagaagttcatcgaagaaggcttcggtgtgaggcgcttcgacgtgatgtataacgattttgtcttgatcggtcctaagagtgatcctgcgggcatcggcggtagcggcgatatcgcggctgcgcttgtcgcaatccagagcaggcaagcgccgtttatctcgcgcggcgacaaatccggaacccattccgcggaactgaagctctgggaggcggccagcgtggacatcgaaaccgccaaggggcagtggtacaaggagatcgggcagggaatgggcgcggcgctcaatacggcctctgccatgaatgcctatgtgctgtccgaccgcggcacctggctgtctttcaagaaccgcggcgatctcgacattatggtcgagggcgacaggcgactgttcaaccagtatggggtcatgctggtcaacccggagaagcacccgagcgtccaggccgaggccgggcagcgtttcatcgagtggctgatctcgcctgagggtcagcaagcgatcggcgaatataagattggtggccagcagctgttcttcccgaacgcggagcaggatcgttcctga

SEQ ID NO: 1545 - DNA, 807 bp, Alkalilimnicola ehrlichei MLHE-1
atgatcagaagcgtttgttggatcctcatcggcctggccgcgctgactctggcgggcacggcccaggcgcgggattacatcaccctggcctccaccacctccaccgagcagtccggcctgttccagcacatcatcccgaaattctcagaggcgacgggcatcgacgtgcgggtgatcgccgtgggcaccggccaggccttcgcccttgcccggcggggtgatgtggacagcctgctggtccacgaccctgtcggtgagcgggcctttgtcgaggccggttatgcggtcgagcggcgcgatgtgatgtacaacgattttgtcctcatcggcccggcagacgaccctgcggatgtgggccatgccgacgacatcgccgatgccctgcagcgcatcgccggggcccgcgcgcctttcacctcccgcggcgacgacagcggtacccaccgggcggagcagcggctgtggcaagcggccggtatcgcgccctccgggcgctggtaccgggcgttgggcggcggtatggggcccaccctcaataccgccgccgccatggatgcctatgtgctgtcggaccgcgccacctgggtcgccttcgataaccgccagcgtctcgagatcctgttccagggggatgaggcgttgcacaacccgtacgggaccctgctgctgagcgccgaacgccatccccacctgaaccacgaacgggcccggcagtggcacgagtggctgctctccgagaccgggcagagcgccatcgcccgctacaccctgcgtggcgagcgattgttcttccccaacgcggactga

SEQ ID NO: 1546 - DNA, 825 bp, Acidovorax sp. JS42
atgaaaaatcacaagcgtttttggcctctagcgcttacacagactgcggtagcagctattgctttggtagcgtatggcagcgctgcggcgcaggccatcaccctggcatcgaccacctccaccgagcaatcgggcctgttcacccacctactgccggccttcaagcaggccaccggcatcgacgtgaaggtggtggccgtgggcaccggccaggcgctggacatggcgcgccgcggcgacgccgacgtgctgttcgtgcatgaccaggtggccgaagaaaagtttgtggctgacggctggggcgtgaagcgctacccggtcatgtacaacgacttcatcctagtgggcggcaagggcgacccggccgccaccaagggcaacgacatcgccgccgcactcaagaaggttgccacggtcaatgccgagtttgtctcgcgcggcgacaagagcggcacccacgccgccgagctgcgctactggaagatcgccaccgacggcgtcaagggcaacggctacaaagagtgcggctgcggcatgggcccggcgctgaacatcgcggcgtccagcggcgcatacgtgctatcggaccgcggcacctggctcaacttcaagaaccgcgacaacctggcggtgctggtggagggcgacaagcgcctgttcaatcagtatggcgtgatggtggtgaaccccgccaagcatccccacgtcaagcaggccgaggcgcaaaagtttgtggactgggtgatctcgcccgccggccagaacgtcattgccagctacaagatcaacggcgagcagctgttcttcccgaatgccaaccagtga

SEQ ID NO: 1547 - DNA, 837 bp, Methylibium petroleiphilum PM1
atggtgaagttcgacaggcgggcgctgctgcgccatctgggcatgttcgcgatcacgctcggcgtggccggcgcagcggtcgcgcaggacaagagcatcgtgatggcgtcgaccacgtcgaccgagcagtccggcttgttcgcgcacctgctgccggcgttcaagaaggccagcggcatcgacgtgaaggtggtggcgctcggtaccggccaggcgctggacatgggccgtcgcggcgatgccgatgtgctgttcgtccatgaccaggcggccgaggagaagttcgtcgccgaaggctacggcctgaagcgcagccccgtgatgtacaacgacttcgtgctgatcggcccgaaagccgatccggtgggcgtgaagggcgccgacatcgtggccgcgctgggcacgctggcgaagagcccgtcgagcttcgtgtcacgtggcgacaagagcggcacgcatgctgccgaactgcgctactggaaggccgccggcatcgaggccccgaagggcacctatgccggctaccaggaatgcggctgcggcatgggcccggcgctgaacatcgccgcgtccagcaatgcctatgtgctggcggaccgcggtacctggctgtcgttcaagaaccgcgccgacctggccgtgctggtggagggcgacaagcgcctgttcaaccagtacggcgtgatcgtggtcgatccggccaagcacccgcacaccaagacggccctggcgcaggccttcgccgactgggtggtctctgcggaaggccaggccacgatcgccagctaccagatcgggggccagcaactgttcttcccgaacgccgcaaccaagtga

SEQ ID NO: 1548 - DNA, 825 bp, Sinorhizobium medicae WSM419
atgctgacccgccgattgttctgtgtgggaatgcttctgatcctggccggcgtgacgccggccctagcccagtcgatcgtcgtcgcatcgacgacctctacccaggactcgggcctgttcgattatattcttccgctgttcgagaaagagactggcatcgatgtgaaggtcgtagcgcagggcaccggccaggcactcgacaccggacgccgtggcgatgccgacgtggtcttcgttcacgccaaggcacaggaagagaagttcattcaggagggcttcggagtgaagcgttccgacgtgatgtacaatgattttgtgttaattggcccaaaaagtgatcccgccggcgtcagtggaatgacggatatcgcggccgccctcgtttcgatcaaagcaaaggaagcgccgtttgtctcacgcggtgaccggtcgggcacccattctacggaactcacgttgtggaaggaagctggcgtcgatatcgaggctgcaaagggcccgtggtacaaggatatcggacagggcatgggagccgcgctcaacacggcatctgccatgaatgcctacgttctttccgatcgcggcacctggctgtcgttcaggaaccgcggtgatcttgctatctccgtcgagggcgacaagcggctgttcaaccagtatggcgtcatgctggtgaacccggaaaaacaccccgatgtcaaggcggagctgggtcagatattcatcgactggttgattgggcctgagggccagacggcgatcggcgagtacgagatcgatggccagcaactcttcttcccgaatgcgagcgggcagcgcatctga

SEQ ID NO: 1549 - DNA, 831 bp, Dinoroseobacter shibae DFL 12
atgagacttgccctgatatcctcgctcttcgctgcttgcctcggcgcagccacaacgctcgccggggtcgcacaggcctcggagccgtccatcctcgtgcagtccacgacctcgacccagaattccgggctcttcgaccatatcctgcccattttcgaggccgagaccggcatcgatgtgcaggtcgtggccgtcgggacggggcaggccctgcgcaatgcggccaacggggacggcgatgtcctgttcgttcatgccaaggctgccgaagaaaaattcgttgccgacgggttcggcgtgtcccgcgccgatgtgatgtataacgacttcgtcatcgtcggtcccgccgcggaccccgccggtgtcggcgggagcagcgatgcggtggcggccctggcgcagatcgccgaagcccaggcgcccttcctcagccgcggcgacgacagcggcaccaacaaggccgagctgcgcctctggtccgagaccggcatcgacgcccaggcggcgtcgggcgactggtatcgcgaaaccggctccggcatgggcgcgacgctgaacaccggcatcgccatgaacggctacgtcatgaccgaccgcgccacctggatcgcctttggcaacaagcagaaccacgagattctcgtggaaggcgaccccaagcttttcaaccagtatgggatcatcctcgtaaaccccgagcgtcacgcccatgtcaaagccgatctcggtcagcaattcgtcgactggatcctgtcggaagaagggcaagccgcgatcgcgtccttcaaggtcgacgggcagcagctcttcttcccgaacgcgggcggttga

SEQ ID NO: 1550 - DNA, 828 bp, Methylobacterium extorquens PA1
ttggaccgccttcgccgcagcttcctgaccctctcgctcctggccgccctcggcacggcctcgccgctgcgggcggagcccgcctcgatcgtcgtcgcctccacgacctcgaccgagcaatcgggcctgttcaagcacatcctgccgctgttcaagcagaagagcgggatcgaggtgaaggtggtggcgctcggcaccggccaagccctcgacgcggcacgccggggcgacgccgacgtcgtgctcgtccacgaccgcccggccgaggacaagttcgtcgccgagggcttcgccaaggcgcggcaggacgtgatgtacaacgacttcgtgctgatcggcccgaaggccgacccggccggcatccgtggcaagggtgtggacgacgccttcaaggccatcgcggcgggacaagcgcccttcgtctcgcgcggcgaccgttccggcacccacagcgccgagttgcggagctggaaggaggccggcatcgacctcccggcggtccgcggcgactggtatcgcgacgtcggacaggggatgggcccggcgctcaacaccgcctcctcgctcggcgcctacatcctggccgatcgcggaacgtggctctcattcaagaaccggggcgacctgaccatcctcgtcgagggcgacaagcgcctgttcaacccctacggcgtaatgctggtgaacccggagaagcaccccaccgtgaaggtgaaggagggccaagccttcatcgattggctggtctcgcccgagggacagcgggcaatcgccgattacaagatcaacggcgagccgctgttcttcccgagcgcgaagaagggctga

SEQ ID NO: 1551 - DNA, 846 bp, Methylobacterium radiotolerans JCM 2831
gtggaccccttccgtcgtcgcctcctgaccctgggattggccgcgctcctgagcgcggccggcctcctgccatcggccgacgccgaaccgaccgcgatcgtcgtcgcctcgacgacctcgaccgagcagtccggcctgttcaagcacatcctcccgctcttccgggagacgtccgggatcgacgtgaaggtcgtcgctctgggcacgggccaggcgctcgacgccgcgcgccgcggcgatgccgacgtggtcctggtccacgaccgtccggccgaggacaagttcctcgccgagggcttcgcgaagaggcggtacgacgtgatgtacaacgatttcgtgctgatcggcccggcctccgatccggccggcgtgcgcggcctgggcgtgcgcgaggccttcgccaagctcgcggccagcaaggcggcgttcgtgtcgcgcggtgatcgttcgggcacccacagcgccgagttgcgcagctggagggaggccggcgtcgatctcgccgccgtgcgcggtccttggtaccgggacgtcggccagggcatgggccccgcgctcaacgcggcctcggctctcggcgcctacatcctcgccgaccgggggacgtggctcgcgttcaagaaccgcgccgacttggtcatcctggttcagggggatccgagcctgttcaacccctacggcgtaatgctggtgaaccccgacaggcaccccggcgtgaaggcgaaggaggggcaggccttcatcgactggcttgtctcgccggaggggcagggggcgatcgcgggctacaaggtcggtggcgaagagctgtttttcccgagcgcgagtgcgctcacgacgcgctga

SEQ ID NO: 1552 - DNA, 828 bp, Methylobacterium populi BJ001
ttggacctccttcgccgcggcttcctgaccctctcgctcctcgctgcgctcggcgccgccacgccgctctcggccgagccggcctcgatcgtggtcgcgtccacgacctcgaccgagcaatcgggcctgttcaagcacatcctgccgctgttcaagcagaagactggcatcgaggtgaaggtggtggcgctcggcaccggtcaggccctcgacgcggcgcgccggggggacgccgacgtggtgctcgtccacgaccgtccggccgaggacaagttcgtcgcggagggctatgccaaggcgcggcaggacgtgatgtacaacgacttcgtgctgatcggcccgaaggatgatccggccggcatccgcggcaagggcgtcgaggaggccttccggaagatcgcggcggccaaggcgcccttcgtctcgcggggcgaccgctccggcacccacagcgccgaactgcggagctggaaggaggcgggcatcgatctcggcgcggttcgcggcgactggtaccgcgacgtcggccagggcatgggcccggcgctgaacaccgcctcgtccctcggcgcctatatcctggccgaccgtggcacctggctctcgttcaagaaccggggcgatctgaccatcctcgtcgagggcgatcctcgcctgttcaacccctacggcgtgatgctggtgaacccggacaagcatcccaccgtgaaggtgaaggaggggcaggccttcatcgactggctggtctcgtccgaggggcagaaggcgatcgagggctacacgatcaacggcgagcagctgttcttcccgagcgcgaagaagagctga

SEQ ID NO: 1553 - DNA, 816 bp, Methylobacterium sp. 4-46
gtggaccgccttcgccgcctgttctgcctgactctcgccgcctggctcgccgccgcgccggcgcgcgccggggagagcatcacggtcgcctcgacgacctcgaccgagcagtcgggcctgttcggtcacctgctgccgcgcttcaccgaggcgaccggaatcggcgtgcgggtggtcgccctcggcaccggtcaggccctcgacgtcggccgccgcggcgacgcggacgtggtcttcgttcacgatcagcccgccgaggaggccttcgtgcgcgacggcttcggcgtggagcgcttccccgtgatgtacaacgacttcgtggtgatcgggccgagggacgacccggcggggatcgccgggcgggacgtcgcccaggccttccgcaagatcgccgccgcgagggcgcccttcgtctcgcgcggggaccgctcgggcacgcacgccgcggagctcaggatgtggcgggaggccgggctcgacctcggcgcggtgcggggcgagtggtacaaggagatcggccagggcatgggcccggcgctcaacgccgccgccgcgaccaacgcctacctgctcgccgaccgcggcacctggctcgccttcaagaaccgccaggacctcaaggtcctggtcgagggcgacccgcgcctgttcaaccagtacggcgtgatcctggtcaatccggccaagcacccgcacgtgaaggcgcgcgcgggtcaggccttcatcgactggctggtctcccccgccgggcagggcgtgatcgcgggctaccggatcggcggcgagccgctcttcgtccccaatgccgggacgtga

SEQ ID NO: 1554 - DNA, 828 bp, Methylobacterium chloromethanicum CM4
ttggaccgccttcgccgcagcttcctgaccctctcgctcctggctgccctcggtacagccgcaccgctgcgggccgagcccgcctcgatcgtcgtcgcctccacgacctcgaccgagcaatcgggcctgttcaagcacatcctgccgctgttcaagcagaagagcgggatcgaggtgaaggtggtggcgctcggcaccggccaagccctcgacgcggcgcgccggggcgacgccgacgtcgtgctcgtccacgaccgcccggccgaggacaagttcgtcgccgagggcttcgccaaggggcggcaggacgtgatgtacaacgatttcgtgctgatcggcccgaaggccgacccggccggcatccgcggcaagggagtggacgacgccttcaaggccatcgcggcgggacaagcgcccttcgtctcgcgtggcgatcgctccggcacccacagcgccgagctgcggagctggaaggaggccggcgtcgatctcccggcggtccgcggcgactggtatcgcgatgtcggacaggggatgggcccggcgctcaacaccgcatcgtcgctcggcgcctacatcctggccgatcgcggcacctggctctcattcaagaaccggggcgacctgaccatcctcgtcgaaggcgacaagcgcctgttcaatccctacggcgtgatgctggtgaatccggagaagcacccgaccgtgaaggtgaaggagggccaagccttcatcgattggctggtctcgcccgagggacagcgggcaatcgccgattacaagatcaacggcgaaccgttgttcttcccgaacgcgaagaagggctga

SEQ ID NO: 1555 - DNA, 819 bp, Methylobacterium nodulans ORS 2060
gtggaccgccttcgccgcctgctctgcctgaccctgctcgccgttctggccgcggcgcccctccgggccgccgagagcatcacggtcgcctcgacgacctcgaccgagcagtcgggcctgttcgggcatcttcttccgcgcttcacggaggccaccggcatcgccgtgcgggtggtggctctcggcaccgggcaggccctcgacgtcggccgccgcggggatgccgacgtggtcttcgtgcacgatcaggccgccgaagaggccttcgtgcgcgatggcttcggcgtgaagcgcttccccgtgatgtacaacgacttcgtggtcgtcggacccaaggatgatccggccggggcggccggccgcgacgtagccgaggccttccgccggatcgcggccgccaaggcgcccttcatctcgcgcggcgaccgctcgggcacgcatgcggcggagttgcgggtctggcgcgaggcgggtctcgacctcggcgcggtgcggggcgcgtggtactacaaggagatcggccagggcatggggccggccctcaacgccgcctcggccaccaatgcctacgttctggccgaccgcggtacctggctcgccttcaagaatcgcggcgatctcaagatcctggtcgaaggcgatccgcgcctcttcaaccagtacggcgtgatcctggtcaatccggccaggcacccgcacgtcaaggcccgcgaggggcaggccttcatcgattggctcgtctcgccggcgggccagggcgtgatcgcgagctatcggatcaacggcgagccgctcttcgtgccgaatgccggccagtag

SEQ ID NO: 1556 - DNA, 825 bp, Diaphorobacter TPSY uid29975
atgaagagttacaagcgtttttggcccctggcgcttacccagactgcggtagcagctattgctttggtagcttatggcagcgctgcggcacaggccatcacgatggcgtcgaccacctcgaccgagcagtcgggcctgttcacccacctgctgccggccttcaagcaggccaccggcatcgacgtgaaggtggtggcggtgggcaccggccaggcgctggacatggcgcgccgcggcgacgccgacgtgctgttcgtgcacgaccaggtggccgaggagaagttcgtggccgacggctggggcgtgaagcgctacccggtcatgtacaacgacttcatcctcgtgggtggcaaggcggatgctgccggcaccaagggcaacgacatcgccgccgcactcaagaagatcgccgcggccaacgcggagttcatctcgcgcggtgacaagagcggcacccatgcagccgagctgcgctactggaagatcgccaccgagggcgtgaagggcagcggctacaaggaatgcgggtgcggcatgggcccggcgctgaacatcgcggcctccagcggtgcgtacgcgctgacggaccgcggcacctggctcaacttcaagaaccgcgacaacctcgcggtgctggtggaaggcgacaagcgcctgttcaaccagtatggcgtgatgatggtgaaccccgccaagcacccgcatgtgaagcaggccgaggcgcagaagttcgtggactgggtggtctcgcccgcgggccagagcgccatcgccggctacaagatcaacggcgagcagctgttcttccccaacgccaacccgtaa

SEQ ID NO: 1557 - DNA, 861 bp, Variovorax paradoxus S110
atgaatccgttcctcaagcagcaccgcgcaggcgcgggcatccgcgcctcgctggccgtggccgttttcttcctggccgcgggcgcggcgcgcgccgagaccatcaccatggcctcgaccacgtccaccgagcagtcgggcctgttctcgcacctgctgccggctttcaagaaggcgagcgacatcgacatcaaggtggtggcggtgggcaccggccaggccatcgacatggccaagcgcggcgatgccgacgtgctgttcgtgcacgacaccgcggccgaggaaaaattcgtggccgaaggcttcagcgccaagcgctaccctgtgatgtacaacgacttcgtgctggtgggcccgcaggccgacccggtcggcgcgaagggcggcgacatcgtcgcggcgctcaagaagatcgcagccgccaatgcgccttttgtgtcgcgcggcgacaagagcggcaccgacgcggccgagcgccgcctctggacgcagaccggcgtggccgaggccgggcagccggtgcccaacgagcgcaagggcacgggctacaaggaatgcggctgcggcatggggccggcgctgaacatcgcggcctcgtccggcgcctatgtgctggccgaccgcggcacctggctcagcttcaagaaccgcgccgggctggcggtgctggtcgagggcgacaagcgccttttcaaccaatatggcgtgatggtcgtgagcccggcgaaattcccctcgctcaacagccggggcgcgcagaagttcgtcgactgggtgatctcgccggccgggcagcagaccatcgcagcctacaagatcggcggcgagcagctgttctttcccaacgcgctgtcgaactga

SEQ ID NO: 1558 - DNA, 297 bp, Mycobacterium MCS
atgaccgcacccgaccgccccgaacccggcccggacgccggtatggaagacatcgaggccgacatcgaggccacccgccgagaactcggcgaaacggtcgaggcgctgtcagccaagctcgacgtcaaacagcaggccaaagacaaggtcgacgagaccaaacaccgggtggtcgagaaggcgcacacagcgcaacacgtcgtagccgacaacccgcagaaatcaatcccggtcgcggcgttcgtcgtggccgtcgtggtcgccgtcggcgttgtcgtatggcgtcgtcgacactga

SEQ ID NO: 1559 - DNA, 249 bp, Nocardioides JS614
gtgagcagcaacggcacgtcaccccagcggctcgaggccgacatcgcccggcagcgcgaggacctggcgacgacggtggaccagctccacgcgaagctcgacgtgaaggcacgcgcccaggacaaggcgcacgagctcaaggaccgggccaccaccgccgacggccggccgcgccccgacctcacggcggccgccgtcgccgccgtcgtcctggccgccggactgctggcctggcggcgccgccgttga

SEQ ID NO: 1560 - DNA, 297 bp, Mycobacterium KMS; identical to SEQ ID NO: 1558

SEQ ID NO: 1561 - DNA, 264 bp, Mycobacterium vanbaalenii PYR-1
atggcagcaggacctgacccgcggcccgagcccgggcccgacgccggcatcgccgagcttcaggctgacatcgaacagacccgcggggaactgggcgcaacggtcggcgcgctctcggacaagctggacgtcaaagcacgcgcccgacaggcggtcgccgacgcgaagcagaacgcaaagagtcgtcccgccgtccaggtcggcgcgctgctcgcggcgggggccgggatcggtctggtcgtctggctgcggcgccgccgctga

SEQ ID NO: 1562 - DNA, 297 bp, Mycobacterium JLS
atgaccgcacctgaccgccccgaacccggcccggacgccggtatggaagacatcgaggccgacatcgaggccacccgccgagaactcggcgaaacggtcgaggcgctgtcagccaagctcgacgtcaaacagcaggccaaagacaaggtcgacgagaccaaacaccgggtggtcgagaaggcgcacacagcgcaacacgtcgtggccgacaacccgcagaaatcaatcccggtcgcggcgttcgtcgtggccgtcgtggtcgccgtcggcgttgtcgtatggcgtcgtcgacactga

SEQ ID NO: 1563 - DNA, 315 bp, Salinispora tropica CNB-440
atgacaggtaacgggcgggccagcggggacaccgaggccctccgggaggagatccggcggacccggatcgaactcagcgaaaccatggaggcactggccgccaaggccgatgtgaagaagcgtctgcgctcctcggccgagcaggcgaaggggcggatgcgcgagcaggcgaccgtggcggcggcccgggtacgcgggcgggcccggccgcgaggtgaacgggttcacggcagttcggtgccgttcaccgcgttggctgcgggtgcggtggccgccgtcgtcgtactgatgatcgtccgggggaggcgtcggtga

SEQ ID NO: 1564 - DNA, 315 bp, Salinispora arenicola CNS-205
atgacgggcaatgggcgggccagcggggataccgaggccctccgtgaggagatccggcggacccgggtcgaactcggcgagaccatggaggcgctggccgcgaaggccgatgtgagaaagcgcctgcggtcctcgaccgagcaggtaaaggaacggatgcgcgagcaggccacgctgacggccgcgcgggtgcgggggcgggctcggccgccgggtgaacgggtccggggtgccccggtgccgttgaccgcgttggccgcgggcgcgttggccgccgttgtcgtactgatgatcgtccgggggaggcgccggtga

SEQ ID NO: 1565 - DNA, 591 bp, Actinosynnema mirum DSM 43827
gtgaccgggccaggaggcatcccgcagaaccggcgggagctggagctcgacatccagctgacccggcaggagctgggcgacacggtcgaggcgctggtgcacaaggtggacgtgcccgcgcgggcgcgggaggcggccgaggacgtgaaggctcgggcgtcggacgtggtggacgaggtcaaggggaaggcggcagaggtggctggtgaggcgaaggtgaaggcggaggagctcgccgacggggccgccgcggtggccggtcaggcgcgggcgaaggcggaggagctggccggggaggccaaggtcaaggccgccgaggccgcggagaaggcggcggagaaggtcggcgcggtcgcgggcgaggccaaggtgaaggtcggcgcggtcgcggacgaggcgaaggtgaaggcggcggaggtcgcggaccgggccgcggtcgtggccgaccaggcgcggggcagggcctcgtacgcggtcgagcagctgccgccgcccgcccgccgggccctcagggagcacccggccgcggtgatcgcgggcgtggtggcggtggggctgctggtgtggcggttggcgcggcgcggcaggtga

SEQ ID NO: 1566 - DNA, 471 bp, Brachybacterium faecium DSM 4810
atgtccaccgcagctgacagacccgaacagggcgaggacctccgcgtgaatccgggggccgaccgccgcacaccagagcagggcacgccccgcctcccgaccgacgccgccggagaagccgcgggcgtcggccaccgcgagccggccgacgatgcagggccggacgagatcgaggctgacatcgcccgcacccgccgcgacctcggcgagacggtcgcagccctctcggaccgtctggaccccacggcgcaggccgagcagcagctccatcacctctcccaccgcgcccacgaacagctggatcgggcgctcgagcaggtggaccaggcccgcgacagcgcccgctccgcattcacccgcgcccggcacacggtcgccgagaccgacagccctctcccgccgctgctcgccgcggccgccggggctgccgtcttcgccggcatcggcctgctgctcatccggcgcccgtga

SEQ ID NO: 1567 - DNA, 408 bp, Catenulispora acidiphila DSM 44928
atgagcactgatcccactgcgaatcccaccgcgaacggcgcgcgccgcccggcgaccgtcgagaagctgcgcgagcaggtcgcccacgaccgcgacgagctggccgagaccgtcaccgctctgcacgccaagaccgacgtcaagggccgcgtccgagagaagaccgccggcgcggagatcgccgccgccgcgatcgcgacccgcgcgggccgggcagccggctcagtgccccgcctgatccgctgggccgccgccaccgcgtccgggcaggtccacaagtccgcgccgcccgctgggagttcgagcgagcgcccgacactgtccctgcgtgaccgactccgtatttacttcgcgatagtgacggcgattctggcgttcatgcgcatccgtcggtggcgcagccgttag

SEQ ID NO: 1568 - DNA, 258 bp, Saccharomonospora viridis DSM 43017
atgagtacgtccgatgacgactttccgcagacgatggaccaggtgcgcaccgacatcgagttgaccaggcaggagctgggggagaccgcgagggaactgttctaccggctcaacgtgggggaacgggccaaggaacggttccaagaccggtctcagaccgtgctgcgggtcctgcgggccaatccggtcgcggtggccatcggaggcggtgtcctcaccgttctgctcggcggtttgctcacgtggaagctgaagtga

SEQ ID NO: 1569 - DNA, 1338 bp, Escherichia coli BL21 (DE3)
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagatcattattggtaaagacacgcgtatttctggctatatgctggagtcagcactggaagcgggtctggcggcagcgggcctttccgcactcttcactggcccgatgccaacaccggccgtggcttatctgacgcgtaccttccgcgcagaggccggaattgtgatatctgcatcgcataacccgttctacgataatggcattaaattcttctctatcgacggcaccaaactgccggatgcggtagaagaggccatcgaagcggaaatggaaaaggagatcagctgcgttgattcggcagaactgggtaaagccagccgtatcgttgatgccgcgggtcgctatatcgagttttgcaaagccacgttcccgaacgaacttagcctcagtgaactgaagattgtggtggattgtgcaaacggtgcgacttatcacatcgcgccgaacgtgctgcgcgaactgggggcgaacgttatcgctatcggttgtgagccaaacggtgtaaacatcaatgccgaagtgggggctaccgacgttcgcgcgctccaggctcgtgtgctggctgaaaaagcggatctcggtattgccttcgacggcgatggcgatcgcgtgattatggttgaccatgaaggcaataaagtcgatggcgatcagatcatgtatatcatcgcgcgtgaaggtcttcgtcagggccagctgcgtggtggcgctgtgggtacattgatgagcaacatggggcttgaactggcgctgaaacagttaggaattccatttgcgcgcgcgaaagtgggtgaccgctacgtactggaaaaaatgcaggagaaaggctggcgtatcggtgcagagaattccggtcatgtgatcctgctggataaaactactaccggtgacggcatcgttgctggcttgcaggtgctggcggctatggcacgtaaccatatgagcctgcacgacctttgcagcggcatgaaaatgttcccgcagattctggttaacgtacgttacaccgcaggtagcggcgatccacttgagcatgagtcagttaaagccgtgaccgcagaggttgaagctgcgctgggcaaccgtggacgcgtgttgctgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 1570 - DNA, 1338 bp, Baumannia cicadellinicola Homalodisca coagulata
atgaaaaaaaaaagatattttggtaccgatggtattcgcggtaaagtaggtgataatccgatcactcctgaatttatcctaaagcttggttgggcagctggtaaggtattagctcgtcacggttcaaataaaattattattggtaaagatacacgtatctctggttatatgctcgagtctgttttacacgcagggttagcatcggctggtctgtctgctgtttttacagggccgatacctacgcctgctatcgcttatcttactaaaactttacgagctgaggctggtattgttatttcagcttcccacaatccattttatgataatggtattaaatttttttctattgaaggtactaagattccagatgctattgaacaagcaatagaagctgaattaggaaaaaaactgatatgtgttgcatcagctaagcttgggagaattagtagaatagatgatgcggcaaaacgctacatagcgttttgtaaaggtactttttcagaatctattagtcttaatggtttaaaagttgttgttgactgtgcaaatggagcaacttaccaaattgcgccaaatatattacgtgaattaggagctaaagtagtagctataggttgtcaaccagatggtatgaatatcaataaagattgtggtaccacagatatacggaagttgcagcatagggtattagcagaaaatgctaatattggtattgcttatgatggcgatggagataggatgatcatggttgatcatttagggtataaagtagatggagatcaaataatatatattatagcacgtgataaaatgcaacaaggtaaactagtaggtggtgttgttggtactctaatgagtaatatgggattagagttatcattaaaacgattagggattccatttatacggactagtgtaggagatcgttatgtacttaataagatgcaggagacaggttggcgtattggtgctgaaaactctgggcatgtaattttgctggaccataataccactggtgacggtattatagctggactacaagtattatccgctatggtaaataatagcatgactctacataatctatgtagagatatacagttatttcctcaaaaattaattaatatatgtttaactagtaaatataacccactaatatcaacaacagtcatacatgcatgtaaagtagctgaacaagagttagcgaagcatggaaggatattaattcgtaaatccggcacggaaaatataattcgagttatggtagaaggtaaagatgaaaatcaggtaacggacctagcaaattatatagcagatgctgtaaaagcatctagctaa

SEQ ID NO: 1571 - DNA, 1332 bp, Psychromonas ingrahamii 37
atgaaaaaaaaatattttggtaccgatggcattcgcggcaaagtaggtgcttctttaattacacctgaatttactttaaaacttggttgggcagcagggcgcgttcttgctaaatcgggttcaaaaaaagtgctaatcggtaaagatccgcgtatttcgggatatatgttagaagccgctttggaggccgggcttgccgcggcaggtttacgtccggtattaatggggcctatgcctacacccgccgttgcctatttaactcagacttttcgtgcgaccgcagggatagttatcagtgcctcgcacaatccatattacgataacggtatcaaattcttttccgatcaagggactaaattgtcagaagagattgaactggaaatagaagcggaaattgataaagaattaaaatgtgtcgattcaagcgagttaggtaaagcataccgcattgaagatgctgcggggcgatacattgagttttgtaaaagtacctttccttcaaaatataacttaaatggtttaaaagtagtggttgattgcgctaatggcgccacttaccatattgcacctctggttattagtgaactgggtgctgatgtgatagcgatgggggttgaacccgatggcctgaatattaatttaaactgtggtgcaacgagcatgcaggcaatttctgagcgggttgttaaagaaaatgcagactttggtattgcctttgatggtgatggtgaccgggtgatgatggttgaccataccggttatgttttggatggtgatgagctgctgtatattattgcgcgtgataaattacgctctggtacgttaaaaggcggcgctgtcgggactaaaatgtctaacttagggctggagcagtcactgaaaacattaggtatcccctttgagcgttctgatgtgggagaccgccatgtaatggagctgatgattaaaaataattggtgcattggtgctgaaaattcaggccatataatatgttctgatcatctctcaacgggcgatggtattgtgtctggattacaagtcattagtgccatgcaaagtagtcgtatgaaattatatgaattacgccagggtataaaaaaatacccgcagattttactcaatttaggttttgataataaaatcgatccattacaggataatgatgtactggctgaagcaaaacgtattgaaaccttacttggtgataaagggcgtgttttactgcgtaaatccggtactgaaccggtatttcgtattatggttgaagcggatgaaagtgaaaaagtggtgcgcggttacgcgaagtcaattgccgacaaagtcaaggtttaa

SEQ ID NO: 1572 - DNA, 1338 bp, Enterobacter sp. 638
atgagtaatcgtaaatattttggcaccgacggcattcgtgggcgcgtgggcgacgcaccgatcaccccagaatttgtgcttaaacttggctgggcggcgggtaaagtattggctcgtcacggctcgcgtaaaattatcatcgggaaagatacccgtatttcgggctacatgctggagtcagcattagaagctggcctttcagctgcagggctttccgcttcattcaccggcccaatgccaacccctgcggtcgcgtatctgacgcgtaccttccgtgcagaagcgggcattgtgatttctgcctcgcacaatccgttctacgataacgggattaaattcttctctattgatggcacaaaattacctgacgaagttgaagaagcaatcgaagcagaaatggaaaaagagctgacctgcgtcgattcttcggagttgggcaaagcaagccgtatcgttgatgctgcgggccgctacattgagttctgcaaaggcacgttccccaatgagctgagcctgagccatctcaaaattgtggtcgattgtgcgaatggcgcgacctaccatattgcaccaaatgttttccgtgagctcggtgcaaaagttatcgctattggctgtgagcctgatggcctcaacatcaacgaagaagtgggtgcgacagacgtgcgtgctttgcaggcccgcgtgttggctgaaaaagccgatctgggcattgcgtttgacggcgacggcgaccgcgtgatcatggttgatcacgaaggtaacaaagtcgacggcgaccagattctgtatatcattgcccgcgaaggtttgcgtcagggccagctgcgcggcggtgcggtaggcacattgatgagcaatatgggcctggaactggctctgaaacaacttggcattccgtttgcccgagccaaagtaggcgaccgctacgtgctggagaaactccaggaaaaaggctggcgtattggcgcagaaaactctggccatgtgattctgctagacaaaacaacgaccggtgacggcatcgtggcgagtcttcaggttgttgctgcgatggtgcgcaatcatatgaatttgcatgacctgtgcagcggcatgaaaatgttcccgcagattctggttaacgttcgctttactgctggtaaaggcgatccgctggaaaatgaaaatgtgaaagcggtcatggcagaagtggaagcagcgctgggaaatcgcggtcgcgtgctgttacgcaaatcgggaacagagccgttgattcgcgtgatggttgaaggcgaagaagaagcgcaggttactgagtttgctcatcgaattgccgatgcggttaaagcggcataa

SEQ ID NO: 1573 - DNA, 1341 bp, Vibrio cholerae O395
atgtctgataagagacgttattttggcactgatggggttcgtggcaaagttggccagtacccaattactcctgattttgtacttaagcttggctgggcggctggacgtgtactggcaaaacaaggcacgagaaaagtcattattggtaaagatacccgtatttctggctatatgttggagtctgcactggaagctgggcttgcagcggcaggattaaaagcgaccttcaccggaccaatgccaacgccagctgtggcctatcttacccaaacgtttcgtgcagaagcggggattgttatttctgcatcgcacaacccttactacgataacggcattaagttcttctcttatgaaggagccaaactgccggatgacattgagttagcgattgaagctgagttagataaagacattgaatgtgttgaatcggctgagcttggtaaagcttcacgcatggtggatgcggcggggcgttacatcgaattttgtaaaagcactttcccttcaaaactcagtctatctggtttgaagcttgttgtggattgtgccaatggtgccacataccacattgcgcccaatgttttccgtgagttgggagcggaagtcattgcgatgggcgttgagcctaatggtttgaatatcaatgaccaagtcggtgcaaccgacgttcgcgcactgcaaaaacgcgttgttgaagagcatgctcatcttggccttgctttcgatggtgacggcgaccgcatcatcatggttgatcacctaggtaataaagtcgatggtgaccaaatcgcttacattattgcccgtgatgcactgcgccgtggcgagctcaaaggtggcgttgttgggacattgatgacgaaccttggcatggagaatggacttaaacagttgggcattccatttgtacgcgctgcggtcggtgatcgctatgttatggaaaaacttctagagaaaggctggaagattggtgcggaaaattcaggtcacgtcatcttactcgataaagtgactacgggggatgcgattgtcgctggcctacaagtgctggcttcagtagtgggtagtgaaatgaccctgcatgaattagcgaaaggtatgacgctttacccacaagtgttggagaatgtccgttttgcaggagataacaatccacttgaagcggatgcggtgaaagcggcggtatctgaggttgaagctgagctaggttcgaaaggccgtgtattactgcgcaaatcgggtacagaacctctgatccgtgtgatggtggaaggggaagatgaaaccttagtgaagcaatctgcattaaaaattgctcaagctgtaaaagataactgctaa

SEQ ID NO: 1574 - DNA, 1341 bp, Yersinia pseudotuberculosis IP 31758
atgagtaaccgtaaatactttggtacagatggcattcgcggtaaagtgggtgaaagtccgattactccggattttgtattgaagcttggctgggctgccggtaaggttctggcacgacatggttctcgtaaaattattatcggtaaagacactcgcatatctggttatatgctggaatcagcacttgaggcgggcctggcagccgctgggctatctgcgctatttactgggccgatgcccacacccgctgttgcttatttgacacgtaccttccgcgctgaagcgggtattgtaatttctgcttctcataaccctttctatgataacggtattaagtttttctccattgatggcaccaaattgcctgatgatgtggaagaggctattgaagccgaaatggaaaaaccgctgacttgtgttgaatccgctgagttgggaaaagctaaccgtattgttgatgctgctggtcgttacattgagttctgcaaagggacattcccaagcgaacttagcctgaatgagctgaaaatagtggtcgattgtgccaatggtgctacgtatcacatcgcaccaagcgtattacgtgaattgggcgcgacagtgattaccatcggctgtgaacctgatggtatgaacatcaacgaagagtgtggtgctacagacgttcgtttgctgcaagaacgtgttcttgccgaaggggctcacgtaggcttggcattcgatggggatggcgatcggctgatgatggttgaccatttggggaataaagttgatggtgaccaaattctgtacattattgcgcgtgaaggcttacgccaaggtcaattgaaaggcggtgcggttggcacgctaatgagtaacatgggccttcaattagccctgaaagatctgggtatcccatttgttcgtgccaaagtgggcgatcgctatgtcttggaagcgatgcaagagaaaggctggcgtattggtgcagaaaactcgggtcatgtaattttattggataaaaccaccactggcgatgggattgtggcaggtttgcaagtgctcaccgccatggttcgtaaccatatgagtttgcatgacctgtgtagtggcatgaagttattaccacaaattttggtaaatgtgcgtttctccggcgagcataatccactgaaatctgatgaagttgaagaagtgacccggcaggtggaaaaagaattgggtggccgtggccgggttctattacgtaaatcgggtactgaaccactcattcgcgtcatggttgaaggtgatgcggaagaatcactgatagctgaaatggcaaaccggattgctgatgcagtaaaggcagcaggttaa

SEQ ID NO: 1575 - DNA, 1341 bp, Vibrio harveyi ATCC BAA-1116
atgtctgataaaagacgttatttcggtactgatggcgtacgcggtaaagttggacaatacccaattactccagattttgtactgaagcttggctgggcagctggtcgtgtactagcgaaacaaggcacaaaaaaagttatcatcggtaaagatacgcgtatctctggttacatgcttgaatctgctcttgaagccggtcttgccgctgctggcctgaaagcaacctttactggtccaatgccaaccccagcggttgcttacctaacgcaaaccttccgagcggaagcgggcatcgttatttcagcgtctcacaacccttactacgacaacggtattaagttcttctcatctgagggtactaagcttccggatgatatcgagcttgctattgaagctgagctcgataaagacattgaatgtgtggagtcagctgagcttggtaaagcaacccgcctgaacgacgcggctggtcgttacatcgagttttgtaagagcaccttcccatcagatcttagcctagcgaacgtgaagattgtggttgattgtgcccatggtgctacttaccacattgctcctaacgtatttaaagagctaggtgctgatgtagttgcaatgggcgttgagccaaacggtactaacatcaatgctgaagttggtgcgacagacgttcgtgcgctacaaaaacgtgttgtagaagagcaagctcacctaggccttgcgttcgatggtgacggcgaccgtattatcatggttgaccatttgggcaacaagatcgatggcgaccaaattgcttacatcatcgctcgtgatgcactgcgtcgcggcgaactaaaaggtggtgtcgttggtacgctaatgactaacctaggtatggaaaatggcctgaagcaattgggtattccgttcgtacgtgctgcggttggcgaccgttacgtgatggagcaattacttgctaaaggttggaagatcggtgctgaaaactcaggccacgttatcttgctagataaagtgactacaggtgacgctatcgtagcagcgttgcaagtgcttgcttctgttgtcggtagcgaaatgacattgcacgacctgtctcaaggtatgacgctttacccacaagtactagagaacgtacgttttgttggtaacagcaacccactagaagcgcaagcagtgctagactcagttgcagcagtagaagcagagttgggcgataaaggccgagtattactacgtaaatcgggcactgaaccacttattcgtgtaatggtggaaggtgaagatgcggaacttgttcaaagctctgcgcttaagattgcagaagctgtaaaagcaagttgttaa

SEQ ID NO: 1576 - DNA, 1338 bp, Escherichia coli HS; identical to SEQ ID NO: 1569

SEQ ID NO: 1577 - DNA, 1338 bp, Escherichia coli E24377A
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagattattattggtaaagacacgcgtatttctggctatatgctggagtcagcactggaagcgggtctggcggcagcgggcctttccgcactcttcactggcccgatgccaacaccggccgtggcttatctgacgcgtaccttccgcgcagaggccggaattgtgatatctgcatcgcataacccgttctacgataatggcattaaattcttctctatcgacggcaccaaactgccggatgcggtagaagaggccatcgaagcggaaatggaaaaggagatcagctgcgttgattcggcagaactgggtaaagccagccgtatcgttgatgccgcgggtcgctatatcgagttttgcaaagccacattcccgaacgaacttagcctcagtgaactgaagattgtggtggattgtgcaaacggtgcgacttatcacatcgcgccgaacgtgctgcgcgaactgggggcgaacgttatcgctatcggttgtgagccaaacggtgtaaacatcaatgccgaagtgggggctaccgacgttcgcgcgctccaggctcgtgtgctggctgaaaaagcggatctcggtattgccttcgacggcgatggcgatcgcgtgattatggttgaccatgaaggcaataaagtcgatggcgatcagatcatgtatatcatcgcgcgtgaaggtcttcgtcagggccagctgcgtggtggcgctgtgggtacattgatgagcaacatggggcttgaactggcgctgaaacagttaggaattccatttgcgcgcgcgaaagtgggtgaccgctacgtactggaaaaaatgcaggagaaaggctggcgtatcggtgcagagaattccggtcatgtgatcctgctggataaaactactaccggtgacggcatcgttgctggcttgcaggtgctggcggcgatggcacgtaaccatatgagcctgcacgacctttgcagcggcatgaaaatgttcccgcagattctggttaacgtacgttacaccgcaggtagcggcgatccacttgagcatgagtcagttaaagccgtgaccgcagaggttgaagctgcgctgggcaaccgtggacgcgtgttgctgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 1578 - DNA, 1338 bp, Serratia proteamaculans 568
atgagtgagcgcaaatattttggtaccgacggcattcgtggcaaggtcggcgatactcctattaccccggaattcgttttgaagctgggctgggcggcgggtaaggtactggcacgtcacggatctcgcaaaattattatcggcaaagatacccgtatttccggctacatgctggagtcggcgctggaagccgggcttgccgctgcggggctgtcagcctcgtttaccggcccaatgcctacgccggcggtggcgtatttaacgcgtaccttccgtgctgaagccggcattgttatttcggcatcacataacccgttttacgacaacggcatcaagtttttctctatcgatggggccaagctgccggacgatgttgaagaagccattgaagccgaaatggaaaagccgctgacctgcgtggaatcctcagaattgggcaaggccagccggatcatcgacgcggccggccgctatatcgaattctgcaaaggcaccttcccgagcgaattgagcctgaagggcctgaaaatcgtggtggactgcgccaacggtgcgacctatcacattgcgccaagcgtgctgcgtgagctgggtgccacggtgattgccatcggcgttgagccggacggcatgaatatcaatgaaaagtgcggcgcgactgatgttcgtcaattacaggagcgcgtactgcaggaaaaagcccatgtcggcctggcatttgacggtgacggcgaccgtgtgatgatggttgatcaccttggcaacaaggtcgatggcgaccaaatcctgtatatcattgctcgtgaagggctgcgtcagggccagttgcgcggtggcgcggttggcacgctgatgagcaacatgggtctggaattggcgctcaagcagttgggcatcccatttgcacgcgcgaaagtcggcgaccgctacgtgctggagaagctgcaggagctgggatggcgtatcggtgcggaaaactccggccacgtgatcctgttggacaaaaccactacaggtgacggcatcgttgccggtctgcaggtgctgactgcaattgttcgtaacagtatgagtctgcacgacctgtgcagcggcatgaaattgttgccgcaaattctggtcaacgtgcgctttgccggcgagcataacccgctggaatccgaagaagtgcgtaaaatcaccgagcaggttgaagtggaattggccggtcgcggccgcgttctgctgcgcaaatccggtactgaaccgctgatccgcgtgatggtggaaggtgaggatgagcagcaggtgactgcgctggcacatcgcatcgccgatgcggtgaagtccgctggttaa

SEQ ID NO: 1579 - DNA, 1341 bp, Yersinia pestis Angola
atgagtaaccgtaaatactttggtacagatggcattcgcggtaaagtgggtgaaagtccgattacgccggattttgtattgaagcttggctgggctgccggtaaggttctggcacgacatggttctcgtaaaattattattggtaaagacactcgcatatctggttatatgctggaatcagcacttgaggcgggcctggcagccgctgggctatctgcgctatttactgggccgatgcccacacccgctgttgcttatttgacacgtaccttccgcgctgaagcgggtattgtaatttctgcttctcataaccctttctatgataacggtattaagtttttctccattgatggcaccaaattgcctgatgatgtggaagaggctattgaagccgaaatggaaaaaccgctgacttgtgttgaatccgctgagttgggaaaagctaaccgtattgttgatgctgctggtcgttacattgagttctgcaaagggacattcccaagcgaacttagcctgaatgagctgaaaatagtggtcgattgtgccaatggtgctacgtatcacatcgcaccaagcgtattacgtgaattgggcgcgacagtgattaccatcggctgtgaacctgatggtatgaacatcaacgaagagtgtggtgctacagacgttcgtttgctgcaagaacgtgttcttgccgaaggggctcacgtaggcttggcattcgatggggatggcgatcggctgatgatggttgaccatttggggaataaagttgatggtgaccaaattctgtacattattgcgcgtgaaggcttacgccaaggtcaattgaaaggcggtgcggttggcacgctaatgagtaacatgggccttcaattagccctgaaagatctgggtatcccatttgttcgtgccaaagtgggcgatcgctatgtcttggaagcgatgcaagagaaaggctggcgtattggtgcagaaaactcgggtcatgtaattttattggataaaaccaccactggcgatgggattgtggcaggtttgcaagtgctcaccgccatggttcgtaaccatatgagtttgcatgacctgtgtagtggcatgaagttattaccacaaattttggtaaatgtgcgtttctccggcgagcataatccactgaaatctgatgaagttgaagaagtgacccggcaggtggaaaaagaattgggtggtcgtggccgggttctattacgtaaatcgggtactgaaccactcattcgcgtcatggttgaaggtgatgcggaagaatcactgatagctgaaatggcaaaccggattgctgatgcagtaaaggcagcaggttaa

SEQ ID NO: 1580 - DNA, 1338 bp, Escherichia coli C ATCC 8739; identical to SEQ ID NO: 1569

SEQ ID NO: 1581 - DNA, 1341 bp, Yersinia pseudotuberculosis YPIII
atgagtaaccgtaaatactttggtacagatggcattcgcggtaaagtgggtgaaagtccgattactccggattttgtattgaagcttggctgggctgccggtaaggttctggcacgacatggttctcgtaaaattattatcggtaaagacactcgcatatctggttatatgctggaatcagcacttgaggcgggcctggcagccgctgggctatctgcgctatttactgggccgatgcccacacccgctgttgcttatttgacacgtaccttccgcgctgaagcgggtattgtaatttctgcttctcataaccctttctatgataacggtattaagtttttctccattgatggcaccaaattgcctgatgatgtggaagaggctattgaagccgaaatggaaaaaccgctgacttgtgttgaatccgctgagttgggaaaagctaaccgtattgttgatgctgctggtcgttacattgagttctgcaaagggacattcccaagcgaacttagcctgaatgagctgaaaatagtggtcgattgtgccaatggtgctacgtatcacatcgcaccaagcgtattacgtgaattgggcgcgacagtgattaccatcggctgtgaacctgatggtatgaacatcaacgaagagtgtggtgctacagacgttcgtttgctgcaagaacgtgttcttgccgaaggggctcacgtaggcttggcattcgatggggatggcgatcggctgatgatggttgaccatttggggaataaagttgatggtgaccaaattctgtacattattgcgcgtgaaggcttacgccaaggtcaattgaaaggcggtgcggttggcacgctaatgagtaacatgggccttcaattagccctgaaagatctgggtatcccatttgttcgtgccaaagtgggcgatcgctatgtcttggaagcgatgcaagagaaaggctggcgtattggtgcagaaaactcgggtcatgtaattttattggataaaaccaccactggcgatgggattgtggcaggtttgcaagtgctcaccgccatggttcgtaaccatatgagtttgcatgacctgtgtagtggcatgaagttattaccacaaattttggtaaatgtgcgtttctccggcgagcataatccactgaaatctgatgaagttgaagaagtgacccggcaggtggaaaaagaattgggtggtcgtggccgggttctattacgtaaatcgggtactgaaccactcattcgcgtcatggttgaaggtgatgcggaagaatcactgatagctgaaatggcaaaccggattgctgatgcagtaaaggcagcaggttaa

SEQ ID NO: 1582 - DNA, 1338 bp, Escherichia coli SMS 3 5
atgagtaatcgtaaatatttcggtaccgatgggattcgtggtcgtgtaggggatgcgccgatcacacctgattttgtgcttaagctgggttgggcagcgggtaaagtgctggcgcgccacggctcccgtaagatcattattggtaaagacacgcgtatttctggctatatgctggagtcagcactggaagcgggtctggcggctgccggtctttccgcactcttcactggcccgatgccaacaccggccgtggcttatctgacgcgtaccttccgcgcagaggccggaattgtgatatctgcatcgcataacccgttctacgataatggcattaaatttttctctatcgacggcaccaaactaccggatgcagttgaagaagccatcgaagcggaaatggaaaaagagatcagctgtgttgattcggcagaactgggtaaagccagccgtatcgttgatgctgcgggtcgctatatcgagttttgcaaagccacgttcccgaacgaacttagcctcagtgaactgaagattgtggtggattgtgcaaacggtgcgacttaccacatcgcgccgaacgtgctgcgtgaactgggggcgaacgttatcgctatcggttgtgagccgaacggtgtaaatatcaatgccgaagtgggggctaccgacgttcgcgcgctccaggctcgtgtgctggctgaaaaagcggatctcggtattgccttcgacggcgacggcgatcgcgtgattatggttgaccatgaaggcaataaagtcgatggcgatcagatcatgtatatcatcgcgcgtgaaggtcttcgtcagggccagctgcgtggtggcgctgtgggtacattgatgagcaacatggggcttgaactggcgctgaaacagttaggaattccatttgcgcgcgcgaaagtgggtgaccgctacgtactggaaaaaatgcaggagaaaggctggcgtatcggtgcagagaactccggtcatgtgatcctgctggataaaaccactaccggtgacggcatcgttgctggcttgcaggtgctggcggcgatggcacgtaaccatatgagcctgcacgacctttgcagcggcatgaaaatgttcccgcaaatcctggtaaacgtgcgttacaccgcaggtagcggcgatccgctggagcatgaatcagtcaaagctgtgaccgcagaagttgaagcggcgctgggtagccgtggacgtgtgctgttgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 1583 - DNA, 1338 bp, Shigella boydii CDC 3083 94
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagatcattattggtaaagacacgcgtatttctggctatatgctggagtcagcactggaagcgggtctggcggcagcgggcctttccgcactcttcactggcccgatgccaacaccggccgtggcttatctgacgcgtaccttccgcgcagaggccggaattgtgatatctgcatcgcataacccgttctacgataatggcattaaatttttctctatcgacggcaccaaactaccggatgcggtagaagaggccatcgaagcggaaatggaaaaagagatcagctgtgttgattcggcagaactgggtaaagccagccgtatcgttgatgctgcgggtcgctatatcgagttttgcaaagccacgttcccgaacgaacttagcctcagcgaactgaagattgtggtggattgcgcaaacggtgcgacttatcacatcgcgccgaacgtgctgcgtgaactgggggcgaacgttatcgctatcggttgtgagccgaacggtgtaaacatcaatgccgaagtgggggctaccgacgttcgcgcgctccaggctcgtgtgctggctgaaaaagcggatctcggtattgccttcgacggcgacggcgatcgcgtgattatggttgaccatgaaggcaataaagtcgatggtgatcagatcatgtatatcatcgcgcgtgaaggtcttcgtcagggccagctgcgtggtggtgctgtgggtacattgatgagtaacatggggcttgagctggcgctgaaacagttaggtattccatttgcgcgcgcgaaagtgggtgaccgctacgtactggaaaaaatgcaggagaaaggctggcgtatcggtgcagagaattccggtcatgtgatcctgctggataaaaccactaccggtgacggcatcgttgctggcttgcaggtgctggcggcgatggcacgtaaccatatgagcctgcacgacctttgcagcggcatgaaaatgttcccgcagattctggttaacgtgcgttacaccgcaggtagcggcgatccgcttgagcatgagtcagttaaagccgtgaccgcagaggttgaagctgcgctgggcaaccgtggacgcgtgttgctgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 1584 - DNA, 1338 bp, Salmonella enterica serovar Newport SL254
atgagtaatcgtaaatatttcggtaccgatgggattcgcggacgtgtaggcaatgcccccattacacctgatttcgtgcttaaactgggttgggctgccggaaaagtgctggcgcgtcatggctcgcgtaaaatcattatcggtaaagatacgcgtatttccggctatatgctggagtccgcgctggaggcgggccttgccgctgcgggactgtcggcctcgtttaccggacctatgccaacgccagccgtcgcctatctgacgcggactttccgcgcggaggcgggtatcgttatctcggcttcgcataacccgttctatgataacggcattaaattcttctctatcgacggtacgaaactgcctgacgatgtggaagaagccatcgaagccgaaatggaaaaagagatcacctgcgtagactccgccgagctggggaaagcgagccgcatcgtcgatgccgccggacgctatattgagttctgtaaaggcaccttcccgaacgaactgagcctcaatggcctgaaagtggttgtggattgcgccaacggcgctacctaccatatcgcgccgaatgtgctgcgcgagctgggcgcgaccgttatcgctattggctgtgagccaaacggcgtcaacattaacgaagaagtgggcgcgaccgacgtgcgcgcgttgcaggcgcgcgtgttggcggagaaggcggacctcggcatcgcgcttgacggcgacggcgaccgggtcatcatggttgaccatgaaggcaataaagtcgatggcgatcagattatgtatatcatcgcgcgcgaagggctgcgccaggggcaactgcgcggcggcgcggtgggaacgctgatgagcaatatggggctggagctggcgctcaagcagcttggcattccgtttgcccgggcgaaagtgggcgaccgctacgtgctggaaaaattgcaggaaaaaggctggcgcatcggcgcggaaaactctggtcacgttattctgttggataaaacgaccactggcgacggtattgtagcggggctacaagttctggcggcaatggtgcgtaatcatatgagtctgcacgatctgtgcagcggtatgaaaatgttcccgcagattctggttaacgtgcgttacaccgccggtagcggcgatccgctggaaaatgaagcggtgaaagcggtaacggcggacgtagaagccacactcggcaatcgtgggcgggtactgctacgtaaatccggtaccgaaccgctgattcgcgtgatggtggaaggcgaggatgaagcgcaggttacggcattcgcccatcgtatcgcggatgcggtaaaagccgtttaa

SEQ ID NO: 1585 - DNA, 1338 bp, Salmonella enterica serovar Heidelberg SL476
atgagtaatcgtaaatatttcggtaccgatgggattcgcggacgtgtaggcaatgcccccattacacctgatttcgtgcttaaactgggttgggctgccggaaaagtgctggcgcgtcatggttcgcgtaaaatcattatcggtaaagatacgcgtatttccggctatatgctggaatccgcgctggaggcgggccttgccgctgcgggactgtcggcctcgtttaccggacctatgccaacgccagccgtcgcctatctgacgcggactttccgcgcggaggcgggtatcgttatctcggcttcccataacccgttctatgataacggcattaaattcttctctatcgacggtacgaaactgcctgacgatgtggaagaagccatcgaagccgaaatggaaaaagagatcacctgcgtagactccgccgagctgggtaaagccagccgcatcgtcgacgccgccggacgctatattgagttctgtaaaggcaccttcccgaacgaactgagcctcaacggcctgaaagtggttgtggattgcgccaacggcgctacctaccatatcgcgccgaatgtgctgcgcgagctgggcgcgaccgttatcgctattggctgtgagccaaacggcgtcaacattaacgaagaagtgggcgcgaccgacgtgcgcgcgttgcaggcgcgcgtgttggcggagaaggcggacctcggcatcgcgcttgacggcgacggcgaccgggtcatcatggttgaccatgaaggcaataaagtcgatggcgatcagatcatgtatatcatcgcgcgcgaagggctgcgccaggggcaactgcgcggcggcgcggtggggacgctgatgagcaatatggggctggagctggcgctcaagcagcttggcattccgtttgcccgggcgaaagtgggcgaccgctacgtgctggaaaaattgcaggaaaaaggctggcgcatcggcgcggaaaactctggtcacgttattctgttggataaaacgaccactggcgacggtattgtagcggggctacaagttctggcggcgatggtgcgtaatcatatgagtctgcacgatctgtgcagcggtatgaaaatgttcccgcagattctggttaacgtgcgttacaccgccggtagcggcgatccgctggaaaatgaagcggtgaaagcggtaacggcggacgtagaagctacgctcggcaatcgtgggcgggtactgctacgtaaatccggtaccgaaccgctgattcgcgtgatggttgaaggcgaggatgaagcgcaggttacggcattcgcccatcgtatcgcggatgcggtaaaagccgtttaa

SEQ ID NO: 1586 - DNA, 1338 bp, Salmonella enterica serovar Schwarzengrund CVM19633
atgagtaatcgtaaatatttcggtaccgatgggattcgcggacgtgtaggcaatgcccccattacacctgatttcgtgcttaaactgggttgggctgccggaaaagtgctggcgcgtcatggctcgcgtaaaatcattatcggtaaagatacgcgtatttccggctatatgctggagtccgcgctggaggcgggccttgccgctgcgggactgtcggcctcgtttaccggacctatgccaacgccagccgtcgcctatctgacgcggactttccgcgcggaggcgggtatcgttatctcggcttcgcataacccgttctatgataacggcattaaattcttctctatcgacggtacgaaactgcctgacgatgtggaagaagccatcgaagccgaaatggaaaaagagatcacctgcgtagactccgccgagctggggaaagcgagccgcatcgtcgacgccgccggacgctatattgagttctgtaaaggcaccttcccgaacgaactgagcctcaacggtctgaaagtggttgtggattgcgccaacggcgctacctaccatatcgcaccgaatgtgctgcgcgagctgggcgcgaccgttatcgccatcggctgtgagccaaacggcgtcaacattaacgaagaagtgggcgcgaccgacgtgcgcgcgttgcaggcgcgcgtgttggcggagaaggcggacctcggcattgcgcttgacggcgacggcgaccgggtcatcatggttgaccatgaaggcaataaagtcgatggcgatcagattatgtatatcatcgcgcgcgaagggctgcgccaggggcaactgcgcggcggcgcggtggggacgctgatgagcaatatggggctggagctggcgctcaagcagcttggcattccgtttgcccgggcgaaagtgggcgaccgctacgtgctggaaaaattgcaggaaaaaggttggcgcatcggcgcggaaaactctggtcacgttattctgctggataaaacgaccactggcgacggtattgtagcggggctacaagttctggcggcgatggtgcgtaatcatatgagtctgcacgatctgtgcagcggtatgaaaatgttcccgcagattctggttaacgtgcgttacaccgccggtagcggcgatccgctggaaaatgaagcggtgaaagcggtaacggcggacgtagaagccacgctcggcaatcgtgggcgggtattgctacgtaaatccggtaccgaaccgctgattcgcgtgatggtggaaggcgaggatgaagcgcaggttacggcattcgcccatcgtattgcggatgcggtaaaagccgtttaa

SEQ ID NO: 1587 - DNA, 1338 bp, Salmonella enterica serovar Agona SL483
atgagtaatcgtaaatatttcggtaccgatgggattcgcggacgtgtaggcaatgcccccattacacctgatttcgtgcttaaactgggttgggctgccggaaaagtgctggcgcgtcatggctcgcgtaaaatcattatcggtaaagatacgcgtatttccggctatatgctggagtccgcgctggaggcgggccttgccgctgcggggctgtcggcctcgtttaccggacctatgccaacgccagccgtcgcctatctgacgcggactttccgcgcggaggcgggtatcgttatctcggcttcgcataacccgttctatgataacggcattaaattcttctctatcgacggtacgaaactgcctgacgatgtggaagaagccatcgaagccgaaatggaaaaagagatcacctgcgtagactccgccgagctggggaaagcgagccgcatcgtcgatgccgccggacgctatattgagttctgtaaaggcaccttcccgaacgaactgagcctcaatggcctgaaagtggttgtggattgcgccaacggcgctacctaccatatcgcgccgaatgtgctgcgcgagctgggagcgaccgttatcgccatcggctgtgagccaaacggcgtcaacattaacgaagaagtgggcgcgaccgacgtgcgcgcgttgcaggcgcgcgtgttggcggagaaggcggacctcggcatcgcgcttgacggcgacggcgaccgggtcatcatggttgaccatgaaggcaataaagtcgatggcgatcagatcatgtatatcatcgcgcgcgaagggctgcgccaggggcagctgcgcggcggcgcggtggggacgctgatgagcaatatggggctggagctggcgctcaagcagcttggcattccgtttgcccgggcgaaagtgggcgaccgctacgtgctggaaaaattgcaggaaaaaggctggcgcatcggcgcggaaaactctggtcacgttattctgttggataaaacgaccactggcgacggtattgtagcggggctacaagttctggcggcgatggtgcgtaatcatatgagtctgcacgatctgtgcagcggtatgaaaatgttcccgcagattctggttaacgtgcgttacaccgccggtagcggcgatccgctggaaaatgaagcggtgaaagcggtaacggcggacgtagaagccacgctcggcaatcgtgggcgggtactgctacgtaaatccggtaccgaaccgttgattcgcgtgatggtggagggcgaggatgaagcgcaggttacggcattcgcccatcgtatcgcggatgcggtaaaagccgtttaa

SEQ ID NO: 1588 - DNA, 1338 bp, Salmonella enterica serovar Dublin CT 02021853
atgagtaatcgtaaatatttcggtaccgatgggattcgcggacgtgtaggcaatgcccccattacacctgatttcgtgcttaaactgggttgggctgccggaaaagtgctggcgcgtcatggctcgcgtaaaatcattatcggtaaagatacgcgtatttccggctatatgctggagtccgcgctggaggcgggccttgccgctgcggggctgtcggcctcgtttaccggacctatgccaacgccagccgtcgcctatttgacgcggactttccgcgcggaggcgggtatcgttatctcggcttcgcataacccgttctatgataacggcattaaattcttctctatcgacggtacgaaactgcctgacgatgtggaagaagccatcgaagccgaaatggaaaaagagatcacctgcgtagactccgccgagctggggaaagcgagccgcatcgtcgatgccgccggacgctatattgagttctgtaaaggcaccttcccgaacgaactgagcctcaatggcctgaaagtggttgtggattgcgccaacggcgctacctaccatatcgcaccgaatgtgctgcgcgagctgggcgcgaccgttatcgccatcggctgtgagccaaacggcgtcaacattaacgaagaagtgggcgcgaccgacgtgcgcgcgttgcaggcgcgcgtgttggcggagaaggcggacctcggcatcgcgcttgacggcgacggcgaccgggtcatcatggttgaccatgaaggcaataaagtcgatggcgatcagattatgtatatcatcgcgcgcgaagggctgcgccaggggcaactgcgcggcggcgcggtggggacgctgatgagcaatatggggctggagctggcgctcaagcagcttggcattccgtttgcccgggcgaaagtgggcgaccgctacgtgctggaaaaattgcaggaaaaaggctggcgcatcggcgcggaaaactctggtcacgttattctgttggataaaacgaccactggcgacggtattgtagcggggctacaagttctggcggcgatggtgcgtaatcatatgagtctgcacgatctgtgcagcggtatgaaaatgttcccgcagattctggttaacgtgcgttacaccgccggtagcggcgatccgctggaaaatgaagcggtgaaagcggtaacggcggacgtagaagccacgctcggcaatcgtgggcgggtactgctacgtaaatccggtaccgaaccgttgattcgcgtgatggtggaaggcgaggatgaagcgcaggttacggcattcgcccatcgtatcgcggatgcggtaaaagccgtttaa

SEQ ID NO: 1589 - DNA, 1338 bp, Aliivibrio salmonicida LFI1238
atggctgagcgtaaatattttggaacagatggagttcgtgggttagtcgggcaatcgccgattacgcctgaatttgttatgaaacttggttgggctgctggaaaagtattggctaaacaaggtacaaagaaagttattatcggtaaagacacgcgtatttcaggttacatgttggaatcagcattagaagcgggtttagctgccgcaggccttaaagcgaagttcaccggcccaatgccaacccctgcagtcgcgtatttaacgcaaacttttcgtgccgaagccggtattgttatttcggcttctcataatccgtattacgataatggcattaaatttttctcctctgaaggtacgaaattaccggatgatgttgagatggccattgaagctgaacttgataaaccaatgacgtgtgttgaatcagcattattaggtaaagcgtcacgtttaaatgatgcggctggtcgctatatcgagttttgtaaaagtacatttccaaaagagcttagcttagctggcgttaaaatggttgtcgattgtgctcatggggcgacataccatattgcccctaatgtttttaaagagcttggcgcagagattattactattggttgtgagcctaatggtaccaatatcaatcatgaagtaggggcaacggatgttcgcgccttacaagcaaaagtacttgaagaaaaagccgattttggtgtcgcttttgatggtgatggtgaccgcatcattatggttgatgatcttggtaataaagttgatggtgaccaaattgcctatattattgctcgtgatgcattacgtcgtggtgagttaaaaggtggcgttgtaggcactctaatgaccaatatgggcatggaagtagctttgcgtaatttaggtataccttttgtacgctctaacgttggtgaccgctacgtcatggaaaaattattggaaaataattggaaaattggtgctgaaaattcaggtcatgttattttattagacaaagtaacgacgggggatgcaattgtagctgctctgcaagttatcgcttcaattgttggcagtaaaatgtcattgaaagaactttgtaatggtatgacgttattcccgcaagttttggaaaatatccgttttgttggtgataataatccattagataccgagttagttaaagcagctcaggctgatgtagaaactaaacttggtgataatggtcgagttttattacgaaaatcaggaactgaaccattaattcgcgttatggttgaaggtgaaaatgctgagcttgtgcagcaatatgctcttcaaattgtagatgcagtgaaagaaagctgttaa

SEQ ID NO: 1590 - DNA, 1338 bp, Escherichia coli O157 H7 EC4115
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagattattattggtaaagacacgcgtatttctggctatatgctggagtcagcactggaagcggggctggcggctgcgggcctttccgcactcttcactggcccgatgccaacaccggccgtggcttatctgacgcgtaccttccgcgcagaggccggaattgtgatatctgcatcgcataacccgttctacgataatggcattaaattcttttctattgacggtactaagctgccggatgcagttgaagaagccatcgaagcggaaatggaaaaagagatcagctgtgttgattcggcagaactgggtaaagccagccgtatcgttgatgctgcgggtcgctatatcgagttttgcaaagccacgttcccgaacgaacttagcctcagtgaactgaagattgtggtggattgcgcaaacggtgcgacttatcacatcgcgccgaacgtgctgcgcgaactgggagcgaatgttatcgctatcggttgtgagccaaacggtgtaaacatcaatgccgaagtgggggctaccgacgttcgcgcgctccaggctcgtgtgctggctgaaaaagcggatctcggtattgccttcgacggcgacggcgatcgcgtgattatggttgaccatgaaggcaataaagtcgatggcgatcagatcatgtatatcatcgcgcgtgaaggtcttcgtcagggccagctgcgtggtggcgctgtgggtacattgatgagcaacatggggcttgaactggcgctgaaacagttaggaattccatttgcgcgcgcgaaagtgggtgaccgctacgtactggaaaaaatgcaggagaaaggctggcgtatcggtgcagagaattccggtcatgtgatcctgctggataaaaccactaccggtgacggcatcgttgctggtttgcaggtgctggcggcgatggcgcgtaaccatatgagcctgcacgacctttgcagcggcatgaaaatgttcccgcaaatcctggtaaacgtgcgttacaccgcaggtagcggcgatccgctggagcatgaatcagtcaaagcggtgaccgcagaagttgaaacggcgctgggtagccgtggacgtgtgctgttgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 1591 - DNA, 1338 bp, Azotobacter vinelandii DJ
ttgagcaaaaaatatttcggcaccgacggcatccgtgggcgagtaggcgagtatcccatcacgccggatttcatgctcaagctgggatgggctgccggaaaggcctttcgtcgccagggcatatgccgtgtgctggttggcaaggatacccgcatatccggctacatgttcgagtcggtgttggaggcggggctctccgccgctggtgccgatgtgttgctgctcgggcccatgccgacaccggccatcgcctatctgacgcggacctttcatgccgaggccggcattgtcatcagtgcttcgcacaatccgcattacgacaatggcatcaaattcttttccgggcagggaaccaagctgcccgacgaactggagctggtcatcgaggaactgctcgacaatccgatgacggtggtcgactcggcccaactgggcaaggtttcccgtatcaacgatgcggcaggccgttatatcgagttctgcaagagcagcgtgccgaccggtaccagcttcgccggtctcaagatggtcgtggactgcgctcatggtgccacctacaaggttgcccccaatgtgttccgcgagttgggggccgaggtggcggttctggcggcccagcccaacgggctgaacatcaatgaccgttgcggctccaccgatatcgtcgcgctgcaggccgaggtactcatgcagcgtgccgatctgggtgtcgccttcgacggcgatggcgaccgtgtgctgatggtcgatcacaccggagcggtggtagacggtgatgagttgctctttctcattgcgcgcgacatgcacgaacacggcaagttgcagggaggcgtcgtcggtaccctgatgagcaatctgggattggagctggctctgcaggatatggggattccattcgtgcgggccaaggtcggcgaccgctatgtcatggctgaactgctggcccgcaactggcaactgggcggcgaaggttccggacatatcgtctgctgccatcactcgacgacgggcgacggcatcatcgctgcgctgcaggtgctgagggccctgaagcaccgtggacaaaggcttgcggaggcgcgccagggaatgcgcaaatttccccaggtgctggtcaacgtgcgctatgcgggcgacaaggaccccgtcgggcatccggtcgtgcaggaggcttgcgagcgagtgaccgagcagatggccgggcgggggcgggtgttgctgcgcaaatcgggcaccgagcccttggttcgggtgatggtcgagggtgacgacgagagccaggtacggcttcatgctgataacttggcaaagattgtttcggatgtatgtgcttga

SEQ ID NO: 1592 - DNA, 1338 bp, Dickeya dadantii Ech703
atgagctgccgtaaatattttggtaccgacggtattcgtggcaaagtcggcgatacgccaattacgcctgatttcgttttgaaacttggttgggcggcagggaaagtgctggctcgtcacggctcaagaaagatcattatcggcaaagatacccgcatttctggatatatgctggagtctgcactggaggccgggttggctgctgctgggctttctgcttcctttactggtcctatgccgactcccgcagtagcctatctgacccgaacctttcgagctgaggctgggattgtgatttccgcttcgcacaatccgtattatgacaacggcatcaaatttttttctatcgatggcactaaattgcctgatgaagtggaagaagccattgaagctgaaatggaaaaaccgttgacttgcgttgagtcggctgagttggggcgagccagccgtattgtcgatgccgccgggcgttatatcgagttctgcaagagcacttttcccaacgagctgagtctgaacaatcttaagattgtcgtcgattgcgcaaatggcgctacttatcatattgctcccagcgtattacgcgagcttggcgctaaagtaacagtcattggttgcgaacctgatggtatgaatatcaatcagcaatgtggtgccacggatgtggaaagtcttcaggaacgtgtgctgagagataaagccgatgtaggtctggcttttgatggtgatggtgatcgactgatcatggtcgatcatctggggaataaggttgatggcgaccagatcctctatatcatcgcccgagaggctttgcgtcaaggacaattgcgtggcggtgcggttggaaccttgatgagtaatatgggcctggaagtggcattgaaacagctgggaataccttttgctcgagcgaaggtcggagaccgatatgtacttgaactgatgcaagaaaagggttggcgtatgggggcggagaactccggtcatgtcattttgctggataaaactactactggagacggcattatagccggtctgcaagtgcttaccgcgatggcccgtaatcatatgaatcttcacgatctatgtagtggaatgaagctgtttcctcagatcttggtcaacataagattttctggcgagcatgatccgctggaacatgagtcggtaaaacgtattactcaggatgttgaaacccaactaggtaataaagggcgtgtactattgcgcaagtcgggtacggagccgttgattagagtcatggtggaaggtgaggatgaagtccaggtaactgaaatggcccatcgtatagccgaggctgtcaaatcggcgggatag

SEQ ID NO: 1593 - DNA, 1338 bp, Dickeya zeae Ech1591
atgagtagccgcaaatattttggcactgacggtattcggggcaaggtcggcgatctgccgattacacctgattttgtactgaaattgggttgggcggccggtaaggttctggctcgccacggttccagaaagattatcatcggcaaagatacgcgtatctccggctatatgttggagtctgcacttgaagccggcttggctgctgcggggttgtccgcatcgtttaccggcccaatgccaaccccggctgtggcatatttgacccgcactttccgcgctgaggccgggatcgttatttcggcttcacataatccttactacgataacggcatcaagttcttttcgattgacggcaccaagctgccggacgaagtagaagaggcgatcgaagcggaaatggaaaaaccgctgacctgtgtggaatccgccgaattgggccgggcaagccgtatcgtcgatgccgccgggcgttatattgagttttgcaaaagtacatttccgagtgagctgagtcttaatggcctcaaaattgtggtggattgtgcgaatggtgcaacgtaccacattgcgcccagcgtgctgcgcgagttaggcgcacgggtgattgcaattgggtgtgagccggatggggtgaacatcaatgagcaatgcggcgctaccgatgttacccaactgcaggcgcgagtcctgtctgaaaaagccgacgtgggtctggcgtttgatggcgatggtgatcgtctgattatggttgatcaccagggcaacaaagtggatggcgaccagatcctgtacatcatcgcgcgtgaagcgttgcgccaggggcagcttcgcggtggtgcagtcggcacactgatgagtaacatggggcttgaagtcgcgctaaaacagcttggtgtgccgtttgcccgcgctaaagtgggtgatcgctatgttctggagctgatgcagtcaaaaggctggcggctgggggcggagaattcaggccacgttatcctgctggataaaacgacgacgggtgacggcattatcgcaggtttacaggtgctgacggcgatggttcgcaaccacatgagcttgcatgacctgtgcagcggtatgaaactcttcccgcaaatactggtgaatgttcacttttccggtgagggtgacccgttggaaagcgatgcggtgaaacaggcgagccaggatgtggaagcacagctggcgggccgtggccgggtgttgctgcgtaaatcgggtacggagccgttaatccgcgtgatggtggaaggggaagatgaggctaccgttacacagatggcgaaccacatcgccgatgcagtaaaagcagcgggctaa

SEQ ID NO: 1594 - DNA, 1338 bp, Pectobacterium carotovorum PC1
atgagtaaccgcaaatattttggtaccgatggcgtacgcggcaaggttggcgatacgccgattacacctgattttgtgcttaaactgggttgggcggcagggaaagtgctcgcgcgacacggttctcgtaagattattatcggcaaagatacccgtatttctggctatatgttggagtctgcgctggaagctgggctggctgcggcgggtttatcggcttcttttaccggccccatgcctacgcctgcggttgcttatctgactcgcacgttccgcgcagaagcggggatcgtgatttctgcttctcacaacccgtattacgacaacggaattaaattcttctcaattgacggcaccaagctgccggatgaagtcgaagaagcgatagaagctgaattggaaaaaccgctgacgtgcgttgagtctgctgaattaggtaaagccagccgcattgttgatgctgctggacgctacatcgagttttgtaagggaacgttcccgagcgaactgagcctcaatggtttaaagattgtcgtcgattgcgccaatggtgcgacctatcatattgcccccagcgtattgcgcgagcttggcgctaaagtcatcgcgattggttgtgaaccggatggcatgaatatcaatgaagagtgcggagcgaccgacgtcagacagctacaagctcgcgtactggctgaaaaagcggacgtgggtctggcctttgacggcgatggcgatcggctcatcatggtcgaccatttgggcaacaaagtcgatggtgaccagatcctctatatcattgcccgtgaaggcttgcgtcaaggacaactgcgcggcggtgcggtaggcacgctgatgagtaacatggggcttgaggttgcgttaaagcagctcggcatcccgtttgctcgtgccaaggtgggcgaccgctatgtattagaaatgatgcaggcaaaagggtggcgcattggtgcagagaactccggtcatgtgatcctgctggataaaacgacgacgggagacggtgtgattgccggtttgcaagtacttaccgcgatagtgagaaaccatatgagcctgcatgatttgtgcagcggtatgaagctgtttccacagattctggttaacgtacggtttacgggtgaaaacgatccgctggaagataaaaaagtgcagcagattacgcaggatgtggaaaaagagttggccggacgcgggcgggtactgctgcgtaaatccggtactgagccgcttatccgcgtcatggttgagggtgaacatgaagagacggtaatcgcgctggcaaaccgtattgccgatgcggtgaaagccgctggttga

SEQ ID NO: 1595 - DNA, 846 bp, Bacillus cereus ATCC 10987
atgaaagaaaaacaagtgttttatgttaatggttttcttgggattattggaattttgattttagccgctatcggtgtatttttcctcgtgcaagaaattttcataggagcagcattaactattattttagctgcagttcttgctacaggtattggtattgttcaaccaaatcaagcaaaagtcattacgtttttcggtaattatttaggaacaattcgtcaaaacggtttatttttaacgattccgttcgcgttccgtcaaactgtatcattacgtgttgagaactttaatagtaagaaattaaaagtaaatgatgttgacggaaatccaattgaaattgcagctgttatcgtctataaagttgttgattctgcaaaagcgatgttcggcgttgaacattatgatcgatttgtagaaattcaaagcgaaacggcaatccgccacgttgcaacgaaatatccttatgataatttccaagatgaaacttgcattacgttacgtggaaatactgaagaaatttctgaagaattaaaacgtgaattagaagcacgccttgaaattgctggcgtagaagtgttagaaactcgtttaacacatttagcttatgcaacagaaattgcccatgcaatgctacaacgccaacaagcaaaagcagtattagctgctagaaaagagattgttgaaggtgctgtgaagatggcaaaagattcaatccatatgttagatgaagaaggcgtacttgaattagatgacgagcgtaaagcgaatatggtgaacaacctattagttgccatcgtttcagataaaggtgcgcaaccagttattaatacaggaagcctatactaa

SEQ ID NO: 1596 - DNA, 846 bp, Bacillus anthracis Ames 0581
atgaaagaaaaacaagtattttatgttaatggttttcttgggattattggaattttgattttagccgctatcggtgtatttttccttatacaagaaatttttataggagcagcattaactattattttagccgcagttcttgctacaggtattggtattgttcaaccaaaccaagcaaaagttattacgttcttcggtaattatttaggaacaattcgtcaaaacggtttatttttaacgattccgttcgcattccgtcaaactgtatcgttacgtgttgaaaactttaacagtaaaaaattaaaagtaaatgatgtcgacggaaatccaattgaaattgccgctgttatcgtatataaagttgttgattctgcaaaagcaatgttcggcgttgaacattacgatcgatttgtagaaattcaaagcgaaacggcaatccgccacgtcgcaacgaaatatccttatgacaatttccaagatgaaacttgcatcacgttacgcggaaatactgaagaaatctctgaagaattaaagcgtgagttagaagcacgtcttgaaattgctggtgtagaagtattagaaactcgtttaacgcacctagcttacgcaacggaaattgcccatgcaatgttacaacgtcaacaagcgaaagcagtattagctgctagaaaagagattgttgaaggtgctgtgaagatggctaaagattcaatccatatgttagatgaagaaggcgtactggaattagatgacgagcgtaaagcaaatatggtaaacaacttattagttgccatcgtttcagataaaggtgcgcaaccagtcattaatacaggaagcctatactaa

SEQ ID NO: 1597 - DNA, 846 bp, Bacillus anthracis str Sterne; identical to SEQ ID NO: 1596

SEQ ID NO: 1598 - DNA, 846 bp, Colwellia psychrerythraea 34H
atgaacgagaatataggtttttcaattaatggttacggcatttttattgccttgttagctgcagcagcatttattgttagccaagccgcgataggaaatatagaaatagtcactgtaattgtattcatcgttactatggcagcaattccaggtttttttatggtgcaaccaaaccaagcgaaagtaatgactttttttggtagctatgttggctcggtaaaggcatgtggtttacgttggactattcctctgtttatgcgcaaaaatatttcattgcgtattcgaaactttgaatccaatcagatgaaagtgaatgataatcacggtaatcctattgaaatagccaccgtagttgtatggtcggtagatgataccgcagaggcttcttttgaagtggacgattatatcagttttgtaaatattcaaagtgaatcagctttacgtaatatggctattagctatccctatgatcaacatgaaggtgatgagatcgctctacgtagtcatcctcaagaagtctctgaagcattaaaaatagaaatacagcaacggttaggcaaagcgggcgtgcgagtacatgaagcacgtattagtcatttagcttatgcaccagaaatcgctaatgctatgctgcaaagacaacaagcttctgccattatagcagcacgcagacttatcgttgatggcgctgtgggcatggtagagatggcattgagtcaactatcagaaaaaggtattgttgagcttgatgaagaacgtaaagcagctatggtcagtaatttattggtcgtactatgtagcgataaaagtactcaacccgtagttaatacgggtagtttatattga

SEQ ID NO: 1599 - DNA, 942 bp, Thermobifida fusca YX
atggctcgggaagccgcggtggcggtggagaacctggaaactcaagtggaagagcgcctgatcgaaggcgcatccggcataccggtcctcatcttctccctggtcatgatgctggccggggcaggcggggccatcggcggagtggtgcggatcaacacgctggacgcggctgatgtgagcgcggtcgcgctgatcgtggtgggcgcgctgctgttcctcgccggtctcttcctcctgtgcgggttgaccatgatcgaccccaaccaggcacgtgtcgtgcagctcttcggccgctacatcggtacgctccgcattgacgggctgcgctgggtcaacccgctgacgacccgcaagccggtgtccacccggatccgcaaccacgagaccgccgtcatgaaagtcaacgacgcggacggaagccccatcgagatcgccgctgtcgtggtctggcaggtcgaggacaccgctcgcgccgtcttcgaagtcgacgactttgtccagttcgtcagcacgcagaccgaggcggccgtccggcacatcgccaacaactacccctacgacaaccacgagggcactgaccgcctgtccctgcgggacaatgccgatgagatcaccgagaagctctctgcggaactcgccgaacgcgtagcctcggcgggggtgcgcatcatcgagtcccgtcttacccacctcgcgtacgcgccggagatcgcccaggcgatgttgcagcgccagcaggcgggggcggtcatcgcagcccgccagcagatcgtggagagcgcggtcggcatggtggaactggcgctcaaccggctggctgagcagggtgtggtggacctcgacgaggagcgcagggccgcaatggtcagcaacctgctcgtcgtgctgtgcggcgaccgtcccacccagccggtcgtcaacacaggaacgctgtactcgtag

SEQ ID NO: 1600 - DNA, 909 bp, Novosphingobium aromaticivorans DSM 12444
atgtccgattcgaagacccattcggccagcaccgaaaccgcagcctggtcgaccagcggctatttcatgctgatcctcatgcttgtgctgattggcctcactgcggcgcgcgtggtcggcttcgccggcggcaaccccggcgaggacgaggtgccgggcttcgtcgcgacgattgcggccctgccagtcgcgatcgtgttcatcgcctcgggattctacatgatccagccgaaccaggcagccgcgatcaccttgttcggctcctatcgcgggactgaccggaaccacggccttcgctgggtctggccgtggatggccaagacccggatatcggtccgcgccaacaacgtcgtctccgaaaagctcaaggtgaacgatctgcggggcaatccgatcgagatcgccgcgaacgtcgtctggcgcgtatccgatacggcgcaggccctgttcgacgtcgacgactacaaggccttcgtcttcgtccagatcgaaagcgcggtccgctccatcggctcgcgctacccctacgacgacatcgagcatcacgaggtgacgctgcggggccaccatgaccagatcaacgatgaactgcgcacggaactcaacgcgcggctggtcctggcggggataacggtcgacgaatgcggcctcacgcacctcgcctatgctcctgaaatcgccggggccatgctgcgccgccaacaggcggaagccgtgatctcggcgcgccggaagctggtcgaaggcgcggtctcgatggtcgagatggcgctgacccagctgtccgagaagaacgtggttgaactcgacgacgaacgccgcgccgccatggtttcgaacctcatggtcgtgctgtgcggcgaacgcgacacgcagcccgtcgtcaacaccggcacgctgtaccagtaa

SEQ ID NO: 1601 - DNA, 918 bp, Deinococcus geothermalis DSM 11300
atgaacaaactggagcaagccccgctgacggttggtcccgaagggggcgtctcgcccgcgagcggggtggcgagtgtggaacggcgtgccttcgggctgccgggcgttccggcagtgttgctgtggctggtgctggtcgcgttggcgttctgggtcacgctaagcggtctgagtatcggtctggggtttgtgctcggcctgctggcgctgtttaccctgttgggattttttgtcgtgcagcccaaccaggccaaggttctcaccctctttggccgctacgtgggcaccgagcggcgcaacggcttctactggaccaaccctttcaccgtgcgccagaatgtgtccctgcggattcgcaacttcaactccgaacggttgaaggtgaacgaccagaccggcaaccccatcgagattgccgccgtgattgtctggcgagtggtggatacggcccgcgccgtctttgacgtcgaggactacgccgagtttgtggcgatccagtccgagacggccctgcgtcacctcgccgcggggtacccctatgacgactacgacggcaagagcctttccctgcgcggcaatcccgatgaggtctctgaggcgcttgcccgcgaactcgccacccggctgcggcacgcgggcgtggaggtgctggaagcccgcctctcccacctcgcctactcgcccgagattgccggggcgatgctgcaacgccagcaggccagtgcgatcatcgccgcccgacagcagatcgtgcagggggctgtcggcatggtcgagatggccctgacccagctttccgaacaagacatcgtgcagctcgacgaggaacgcaaggcgcagatggtcagcaatctgctcgtcgtgctgacgagcgagcgcggcacccagcccgtcgtgaacgccgggagcctgtattga

SEQ ID NO: 1602 - DNA, 903 bp, Sphingopyxis alaskensis RB2256
atggtcgagagtggggcaccggcgctcaatcgcagccgcgaaacgcgcgccaatacgcaaagcggctattggatgctgttcatctggctggtgctgctcggcatcgccgtctgggcggcgatcaccaatgccaacgccgacgtggtgatggcatggaaatggatcgtcgcggccaccgccgcggtcgtcggcacgctcatcctttgcggcttttatctcatcaaccccaatgaagccgcggcgatccagctgttcggcgcatataagggcaccgaccggcaggaagggctgcgctgggtgctcccctggctgacgcgcaagaagatcgcggtgcgcgcgaacaacgtcatttcggacaagatcaaggtcaacgacctgcgcggcaacccgatcgagatggcggcgcaggtcgtgtggcgcgtcaccgacaccgcgcaggcgctgttcgacgtcgacgattacaaggagttcgtcatggcgcagatcgaggcggcggtgcgctcgatcggctcgcgctacccctatgacgatatcgaacatcaggaagtcacgttgcgtggcaaccatgaagaggtcggcgccgagctgcgcaaggcactgatcgagcggttgaccgtcgcgggcatcaccgtcgacgaatgcggcctcacccacctcgcttatgcgcccgagatcgcgggggcgatgctccgccgccaacaggccgaagcggtgatcgccgcgcgcaagaagctggtcgagggcgcggtgacgatggtcgaaatggcactccagcacctgtcggacaaaaaggtcgtcgacctcgacgacgagcgcaaggcggcgatggtgtcgaacctgatggtcgtgctgtgcggcgaacgcgatacgcagccggtcgtcaacgccggctcgctttactga

SEQ ID NO: 1603 - DNA, 846 bp, Shewanella amazonensis SB2B
atggtacaagaaaaacgtggattttccctcagtggctatctggtgtttgtggtgctgattgccctgcatctggtgttttttgccatgatggccaccacctctcaatatggtggcgtgataggtaatgtattgaccgccctatgctggcccggcttttttatggtgcagcccaatcaggccaaggtgctgacattgttcggcagttacgtgggctcggtgagaaacacggggctgcgctggaccatccccctctttgccaagcgcaccatctcgctgcgtatccgtaacttcgagagtgccaaaatcaaggtgaacgataacctcggtaaccccatcgaaatcgccaccatagtagtgtggtcggttaccgacagtgccgaggccgtgttcgaggtggatgattacgaaagctatgtgtccattcaaagtgaagcggcgcttcgcaacatggccagcagttatgcatacgatccccaggatgagaacgaagtggcactcagaagccatccccaggccatcgccgataagctcaagcaggaaattcaggagcgtcttggccgtgccggcgtcaccgtactggaagcccgtatcagccacctggcgtatgcccaggaaattgccagtgccatgttgcagcgtcagcaggccaccgccatcatcgccgcccgggccaaaattgtcgaaggtgcagtgggcatggtggaaatggctctggagcggctaaaagcccagaacgtggtggagctggatgaagagcgcaaggcggtgatggtgagtaacctgttggtggtgctgtgtggtgataagagtactcagcctgttgtgaacacgggttccctgtactga

SEQ ID NO: 1604 - DNA, 903 bp, Sphingomonas wittichii RW1
atggacgaatcctctttcgtcgaactgcaggcgagtcgcgagcggtccgccgccaccgccagcggctggttcatgctgttcgtcgcgctggtgctgctcggcatcgcgatcgccaccgtcgtcggcctgatcgcgaacgaagggccgctgtcgatgctgccggtcgcggtcctcgcggtgctcggcttcgtcctgtcgatcagcggcttctacgtcctccagcccaaccaggcggcggcgatcctgctgttcggcgcctatcgcggcaccgaccgcgcgaccgggctgcgctgggtctggccgtggatgtcgcggcggctgatctcggtccgcgccaacaatgtcgtatcggaggcgctgaaggtgaacgaccggcgcggcaacccgatcgagatcgcggcgcaggtcgtctggcgcgtgtcggacaccgcccaggcgctgttcgacatcgacgattatcgcgacttcgtgatcgtccagatcgaggcggcggtgcgcaccatcggatcggcctatgcctatgacgacatgggacccgaggagatcaccctgcgcggccatcatgaggaggtgaacgccgcgctcaagaccgagctcaaggcgcggctcgcggtggcgggcctgaccgtcgacgaatgcgggctgacccacctcgcctatgcgcccgagatcgccggcgcgatgctccgccgccagcaggccgaggcggtggtcgcggcgcgccagacgctggtcagcggcgcggtgtcgatggtcgaactggcgctcgatcaattgtcgacgcgcggtgtcgtcgagctggacgacgaacggcgggcggcgatggtgtccaacctgatggtggtgctgtgcggcgagcgcgacacccagccgatcgtcaacgccggcacgctctaccaatag

SEQ ID NO: 1605 - DNA, 846 bp, Bacillus cereus cytotoxis NVH 391-98
atgaaagaaaaacaggtgttttatgtaaatgggtttctaggtattatcgggctcttagtcttagctggtatcggtgtattttgcctcgtacaagaagtatttatcgtagctgcactttgtatcattttagctgccattcttgctactggcattggaattgttccaccaaaccaagcaaaagttattacatttttcggtaattatttaggaacgattcgtgaaaatggtttatttttaacaattcctttatccttccgtcaaactgtttctcttcgcgtagaaaattttaatagtaaaaaattaaaagtaaatgatattgatgggaatccagttgaaattgcagctgttgttgtttataaagttgtggattcagcaaaagcaattttcggtgtagaacattatgatgaattcgtagaaattcaaagtgaaacagcaatccgccacgtcgcaacgaaatatccgtatgataattttcaagatgataaatgcatcacactacgcggaaatgctgaagaaatttcagaagaactaaagcgtgaactagaagcacgcttagaaatcgctggtgtagaagtattagaaactcgtttaacacatttagcttacgcgacagaaattgcgcatgccatgctacagcgtcagcaagcaaaagcggtactggctgcgcgtaaagaaattgttgagggtgccgttcaaatggcaaaagactctattcagaagctagatgaagaaggtatacttgatttagatgatgaacgtaaagcaaatatggtgaataacttattagttgccatcgtttcagataaaggagcacaaccggttattaacacaggaagtctatattaa

SEQ ID NO: 1606 - DNA, 948 bp, Frankia EAN1pec
atgagcaccgagacaccccaggtggacgtcgaacatgtcgttgtcgacatgcccgaaccgagcgtccgggaacaccatgcgaaggaccactcgggcctgttggccctgctggcgagcctgctgggcatgctggcctgcctcgcgctcggcatcgccgggatcgtcgtcgccgccgaccactccgcccccgtcggcgccgtcctcatcgtggtcggcgtgctcggcctcatcgccgcgttcttcgcgctgtgcggcctgaccgccgtcgcgccgggcgaggcccgggtcgtcgcgctgttcggccgctacgtagggacgatccgcaccaccgggctgcgctgggtgaaccccttcaccacgcgcaagaaggtctccacccgcatccgcaaccacgagagcggcgtggcgaaggtgaacgacgccgacggaaacccgatcgaaatcgcggccgtcgtggtctggcaggtgaaggacaccgcgcaggccgtcttcgaggtggacgacttcgtcgagttcgtggccatccagtccgagaccgccgtgcggcacatcgcgacgagctacccctacgacgcggcccccgaggtcatgtcgctgcgcgacaacgccgaggagatcaccgcgaagctctcactggagatcgcggcccgggtcgcctccgccggtgtacacgtgatcgagtcccgcatcacccggctggcgtacgcgccggagatcgcccaggcgatgctccggcgccagcaggcgggcgccgtcgtcgcggcccgctcgcggatcgtcgagggcgccgtgggcatggtcgaggcagcgctggaacgcctcgaccgggaaaacatcatcgagctggacgaggaacggaaggcaaccatggtcagcaacctgctcgtggtcctgtgcagcgaacagtcgacgcagccggtcatcaatgccggatccctctacacctga

SEQ ID NO: 1607 - DNA, 846 bp, Bacillus weihenstephanensis KBAB4
atgaaagaaaaacaagtattttatgttaatggatttctcggcgttattggaattttagttttagccgctatcggtgtattttgccttgtacaagaaatgtttgtaatagctattttagctctcatattagcatctgttttagctacaggtatcggtatcgttcaaccgaatcaagcgaaagttattacgttcttcggtagttatttaggaacaattcgtcaaaatggtttatttttaacaattccattcgcgtttcgtcaaactgtatctttacgtgttgaaaactttaacagtaagaaattaaaagtaaacgatgttgagggcaatccaattgaaattgcagccgttatcgtatataaagttgttgattccgcaaaagcaatgtttggtgttgagcattacgatcgattcgtagaaattcaaagcgaaacagcaatccgccacgttgctacaaaatatccttatgataatttccaagatgaaacttgtatcacgttacgaggaaatactgaagaaatctctgaagaattaaagcgtgagttagaagcacgccttgaaatcgctggcgtagaagtattagaaactcgtttaacgcatttagcttacgcaacagaaattgcccatgcaatgctccaacgtcaacaagcaaaagcagtattagctgctagaaaagagattgttgaaggtgctgtgaagatggcgaaagattcaatccatatgttagatgaagaaggcgtactggaactcgatgacgagcgtaaagcaaatatggtgaacaatttattagttgccatcgtttcagataaaggtgcgcaaccagttattaatacaggaagcctatactaa

SEQ ID NO: 1608 - DNA, 882 bp, Caulobacter K31
atgtccgacgcgccgaatatcaatcgatcggccgaacgcgcctttggcgggatcggcggggggttgccgctgttgtcgcttccgctcctgatcgccgccgctgtcttcgccttcgcggcggctcaggtgatgtggggcgtgatcggctcgctgatgatcgttctgttcgtgctggtcgcctgcggcttctattcgctgcagccgaacgaggcctacgttatcaccctgttcgggacctacatgggcaccgaccgccggacgggcctgcgctgggtgttgccctggtacgggcgcaagaaaatcagcctgcgggtgcgcaacgtcaccagcgagaggctgaaggtcaacgacaagcgcggcaacccgatcgagatcgccgccaacatcgtctggcgggtttcggacaccgcccaggccctgttcgatgtcgacgactacattgccttcgtgaacatccagattgaaacggcgctccgagaaaccgcctcgcactatgcctacgaccacgacgacagcggcgagcccacgctgcgcgccgacgccgatcaggtcggcgagggcctgcggaccgatcttcggggccgcacagcggtggccggggtgtcgatcgacgagacgcacctgatgcacctggcctatgcgcccgagatcgcggggacgatgctcaagcgccagcaggccgaggccgtgctggccgctcgccgcacgatcgtcgccggcgcggtgggcatggtcgaacacgcgcttcagcaactcagcgaccggggcgtggtcacgctggacgaggaacgcaaggcggcgatggtgtccaatctgctggtggtgctgtgcgccgaccgcgaggcccagcccgtggtcaacactggcacgctctacggctga

SEQ ID NO: 1609 - DNA, 912 bp, Opitutus terrae PB90 1
atgagcacttcagcaacccaccccactcccgatcagcgcgccgtcagtcaggaaaaaccggctctcgccgcttccggctggccggcgctttttgtcgtcctgcttctctacctcgcgtcgatcggcttgatcatcggcggagtttccgtgctgcgcgggcccgcgatcgtgctcggcgtgctgctgctgatcgtcgcgatcatcggctcctgcgggttcttcatgctgcagcccaacagcgcggctgtcctactcctgttcggtgactatcgcggcaccgtgcgcaaaacggggttcctcttcgccaatccgttctaccaaaaactcaaaatctcgcttcgcacccgaaacttcaacggcgagaaactcaaggtgaacgacaagcgcggcaatccgatcgagatcgccgccgtggtcgtgtggcgcgtgcgcgacaccgcgcaagcgatgttcgacgtcgacaactacgaaaactacgtcgtggtccagagcgagtcggccgtgcggcacgtggcgaccagctacgcttacgatgacgccgagcacaatgagctcacgttgcgcgccggcggtgaggaagtttccgccgcgttgcttcgcgagttgcaggagcggcttagccgcgcgggcgtcgaggtgcaggaggcgcgcttgacgcacctcgcctacgcgccggaaatcgcgcaggcgatgctccggcgccaacaggccgaggcggtcatcgctgcgcgccagaagatcgtccaaggcgccgtcagcatggtcgagatggcgctcaacgaactctcgagcaagaaggtcgtggcactcgatgaagagcgcaaagccgcgatggtctcgaatctcctggtcgtgctctgcggcgaatccgaggcccaccccgtgatcaacaccggcacgctctaccactga

SEQ ID NO: 1610 - DNA, 882 bp, Stenotrophomonas maltophilia R551 3
atgaaagagaagtcgctgtcttcgctcaacggcctcggcacgctggccggcgccctgcttgtcgccctcgccggcggcgccctgttcgtactgggggtggcagccaaggccagcaccggctccccgaacctgctgctgatgctggccggcatcctggtagcggcgctggcgatcttcgccctggccggcctgtacacggtccagcccaaccaggcggcggtgctgagcctgttcggcaaatacgtgggcaccgtgaaggacaacggcctgcgctggaacaaccccttctacagcaagcgccgggtcagccagcgcgtgcgcaatttcgagagcggcaagctcaaggtcaacgagctcgatggcagcccgatcgagatcgccgcggtgatcgtgtggcaggtggtcgatgcgtctgaagcggtctacaacgtggacgactacgagagcttcgtgcacatccagtccgaatcggcgctgcgtgcgatggccaccagctacccctacgaccagcacgaagaaggccagctcgcgctgcgcagccacgccagcgaaatctcccagcacctgaagaacgaactggccgagcgcctggccgatgccggcgtgcaggtgatcgacgcgcgcatcagccacctcgcctacgccgccgaaatcgcccaggcgatgctgcagcgccagcaggccaatgcggtgatcgccgcacgtacgcgcatcgttgccggtgcggtcggcatggtcgagatggcactggccgaactgcagaagaatggcgtggtacagctggatgaggagcgcaaggcgcacatggtcagcaacctgttgaccgtgctgtgctcggaccgcggcacccagccgatcgtcaacgccggctcgctgtactga

SEQ ID NO: 1611 - DNA, 849 bp, Alteromonas macleodii  Deep ecotype
atgcaagaaaagaatgggttttcaataaatggatatttgatgattggcgtactgttactggcgcaaagcgctgcgttcttctatgcggtgggagggaatgcagaagccggtggagtgctaagcctattagtagctagcttgtggagtggtttctttatggttcagccaaatcaggccaaagtgatgacctttttcggcagctatgtaggtacggtgtcggatgtgggtttacgttggactattccattttttcgcaaagtaaatatctcacttcgcattcgtaactttgaaagcgcaaaaattaaagtgaatgacaatcagggtaatcctatcgagattgcatccatagtggtgtggaaagtaacagataccgcagaagcagtatttgatgttgatgattacgaaagctttgtaagaatacaaagtgaatcggctattagaaatatggcgagcagttttccgtatgatccgcgagacgacgaacaagcagaagtggcgcttcgcagtcatccacttgaaatatcagaacgccttcagcaagaaatacaggctcgtttagccaaggcgggcataactattctagagtctcgtattagtcaccttgcttacgcacaagaaatagccagtgcaatgttacaacgacaacaggcatcggctattgttgctgcacgaaaacaaattgttgatggggcggtaggaaccgtagaaatggctcttcaacgtttgaatgaaaagggcgtagttgagcttgatgaagagcgcaaagcaacaatgataagcaaccttttagtcgtcttgtgcggcgataaatcaacgcaacctgtgattaacacaggcacaatttactaa

SEQ ID NO: 1612 - DNA, 846 bp, Bacillus cereus AH187
atgaaagaaaaacaagtgttttatgttaatggttttcttgggattattggaattttgattttagccgctatcggtgtatttttcctcgtgcaagaaattttcataggagcagcattaactattattttagctgcagttcttgctacaggtattggtattgttcaaccaaatcaagcaaaagtcattacgtttttcggtaattatttaggaacaattcgtcaaaacggtttatttttaacgattccgttcgcgttccgtcaaactgtatcattacgtgttgagaactttaatagtaagaaattaaaagtaaatgatgttgacggaaatccaattgaaattgcagctgttatcgtctataaagttgttgattctgcaaaagcgatgttcggcgttgaacattatgatcgatttgtagaaattcaaagcgaaacggcaatccgccacgttgcaacgaaatatccttatgataatttccaagatgaaacttgcattacgttacgtggaaatactgaagaaatctctgaagaattaaaacgtgaattagaagcacgccttgaaattgctggcgtagaagtgttagaaactcgtttaacacatttagcttatgcaacagaaattgcccatgcaatgctacaacgccaacaagcaaaagcagtattagctgctagaaaagagattgttgaaggtgctgtgaagatggcaaaagattcaatccatatgttagatgaagaaggcgtacttgaattagatgacgagcgtaaagcgaatatggtgaacaacctattagttgccatcgtttcagataaaggtgcgcaaccagttattaatacaggaagcctatactaa

SEQ ID NO: 1613 - DNA, 846 bp, Bacillus cereus B4264
atgaaagaaaaacaagtattttatgtaaatggttttctcggtattattggaattttgattttagctgctatcggtgtatttttccttgcacaagaaattttcataggagcggcactaactattatattagccgcagttctcgctacaggtatcggtattgttcaaccgaatcaagcaaaggttattacgttcttcggtaattatttaggaacaattcgtcaaaacggtttatttttaacgattccgttcgcattccgtcaaactgtatctttacgtgttgaaaactttaacagtaaaaaattaaaagtaaatgacgttgatggaaatccaattgaaattgcagctgttatcgtatataaagttgttgattctgcaaaagcaatgtttggtgttgaacattatgatcgatttgtagaaattcaaagcgaaacggcaatccgccatgttgcaacaaaatatccttatgacaatttccaagatgaaacctgcgttacgttacgcggaaatactgaagaaatctctgaagaattaaaacgtgagttagaggcgcgtcttgaaattgctggtgtagaagtattagaaactcgtttaacgcacttagcttacgcaacagaaattgcccatgcaatgctacaacgccagcaagcaaaagcagtattagctgctagaaaagaaattgttgaaggtgctgtgaagatggcgaaagattccatccatatgttagatgaagaaggcgtactagaactcgatgacgagcgtaaagcaaatatggtaaacaacttattagttgccatcgtttcagataaaggtgcgcagccagttattaatacaggaagcctatactaa

SEQ ID NO: 1614 - DNA, 846 bp, Bacillus cereus G9842
atgaaagaaaaacaagtattttatgtaaatggttttctcggtattattggaattttgattttagcggctatcggtgtatttttccttgcacaagaaatttttataggagcagcactaactattgtattagccgcaattctcgctacgggtatcgggattgttcaaccaaatcaagcgaaagttattacgttctttggtaattatttaggaacaattcgtcaaaacggtttatttttaacgattccattcgcattccgtcaaactgtatctttacgtgttgaaaactttaatagtaagaaattaaaagtaaacgatgttgagggaaatccgattgaaattgcagctgttatcgtatataaagtagttgattctgcaaaagcaatgttcggtgttgaacattacgatcgatttgtagaaattcaaagcgaaacggcaatccgccacgtcgcaacaaaatatccatatgacaatttccaagatgaaacttgcattacgttacgcggaaatactgaagaaatctctgaagaattaaaacgtgagttagaggcacgtcttgaaattgctggtgtagaagtattggaaactcgtttaacgcatttagcttacgcaacagaaattgcccatgcaatgctacaacgtcaacaagcaaaagcagtattagctgctagaaaagaaattgttgaaggtgctgtgaagatggccaaagattcaatccatatgttagatgaagaaggcgtactggaactcgatgacgagcgtaaagcaaatatggtaaacaacttattagttgccatcgtttcagataaaggtgcgcaaccggttattaatacaggaagcctatactaa

SEQ ID NO: 1615 - DNA, 846 bp, Bacillus cereus AH820; identical to SEQ ID NO: 1596

SEQ ID NO: 1616 - DNA, 843 bp, Desulfitobacterium hafniense DCB 2
atgaaagaaaaaaaagcctgggtactcaatggttatcttgctgtggttgtcgttttggcttcgctcatcggcggcacagccctgctcattcaaacacagtttaccctgggaatcgcccttatcctcataggtgtgattctgtccagcggtatcgttgtcatccagcccaataaatcccatgtgattacctttttcggcagctatattgggaccatacgtgaacctggtctttggctcaccattcccctttccacacgtaaatctgtttccttacgggtccgcaatttcaacagcaagactttaaaggtcaatgatgtggaaggaaaccctatcgaaatcgccgccgtgatcgtcttccgtgttgtggataccgccaaagcaatctttgatgtagataggtacgagcaattcgtagagatccaaagcgaaaccgctctccgtcatgtaaccagccgttacccctatgacaacttcgaaaaggacggctattctttgcggggtcattccgaagaagtggccagagaactctctctggaacttcaggaacgcctcaaagtggctggagtagaagttatggaagcccgcctgacccatttagcttattcgactgaaatcgccggtgccatgctccaacgtcaacaggccaatgccattctggatgcccgtcaaattatcgttgaaggcgccatgggtatggtccagatggctgtggaacgcctagaaacgaataatgtcgtccagcttgatgaggagcgcaaagccgccatgatcaataatctgctggtggccatcgtatctgaccgctccgctcagcctgtcattaatacaggtaccctctactaa

SEQ ID NO: 1617 - DNA, 870 bp, Clostridium cellulolyticum H10
atgcaagaggtgaaaggaaaaacttactcgggaggcctcactcttctaatgactatgcttgttcttattttaagtgtagtgacttttatagtaggtgtaaatatggaatttgctgtattggttatacttggacttgtattattcacaggatttatatttataattccgggattttttactattcagccaaatcaagctatggttttggtgcttttcggaaaatatgtcggaactgttaaaaatgaaggctggcattgggccaatcctttctattccaagaaaaagatttcgttaagatccagaaatattaatggcgataaaataaaggtaaacgatgaaatgggtaatcccattgaaatagcagctgtaatagtatggagagttgaaaataccgcagaggctatatttgacgtagataattatgttgactacgtaaatgttcagagcgagtctgctttgagacatttggcaggaatgtatccgtatgacaatacagaagatacacacacaatttctctgagaggaagcacagatgaggttgctgaagcacttaaaaatgaacttcaacagaggttgggaaaagcaggtgtaattgttgaagaagcaaggctgtctcatttggcatatgcacctgaaatagctgcggcaatgcttcaaagacagcaggcggctgctataattgctgcaaggcaaaaaatagtagagggtgccgtaggaatggttcagatggcactaaccaagctcagtgaaaatgaaatagttgaacttgacgaagaaagaaaggccgcaatggtaagcaacttgttagtagttttatgcggtgagaaaaatacacagccggttataaacactggaactttgcataactaa

SEQ ID NO: 1618 - DNA, 918 bp, Actinosynnema mirum DSM 43827
atgagcgtgacgacgagcgaggtgcaggcgaggatgccggctccggcggtgcgcgagcacgagctgacgggggtgggcggcgcgatcgtggccgtggtgggcttcctggccgtgctcggtggcgcggggctcgtcgcgctgggggtcgcgcaggcggccaacatcccgctgatcctggtgggggccctggtctcggcggtcgccatggtggtgctgggcgggctgttcacggtggcgccgggcgaggcgcgcgtggtccagttcctcggccgctacaccggcacggtgcgcgccgacggcctgcgctggacgaacccgttcaccacgaaggcgaaggtctccaccaggatccgcaaccacgagacgaccacgctgaaggtcaacgacgcggacggcaacccgatcgagatcgccgcggtcgtggtgtggcaggtcgacgacaccgcgcgggcgatgttcgaggtggacgacttcgtgcagttcgtggcgacgcagaccgagaccgccgtcaggcacatcgcgaccagctacccgtacgacaaccacgacgaggccgggctgtcgctgcgggagaacgcggacgagatcaccgagaccctgtcggtggagatcgcggcgcgggtccaggcggccggggtcaaggtcatcgagtcgcggttgacgcacctggcgtacgcgccggagatcgcccaggccatgctccagcggcagcaggcgggcgcggtggtcgcggccaggtcgcggatcgtggagggcgccgtgggcatggtgcagctggcgctggaccggctcgccgaggaggacgtggtggagctggacgaggagcggaaggcggcgatggtgtcgaacctgctggtggtcctgtgcggtgacaaggcgacgcagcccgtggtcaacacggggtcgctgtaccactga

SEQ ID NO: 1619 - DNA, 846 bp, Geobacillus WCH70
atgaaggaaacaaaggcatggtatatgaacgggtttgctgggattattggtattgctgtattagtggcagtggcgattattagtttgcttcagcagctagtcattattgccgctctattcgttgttgccgccatcgtgttggccagcggcatcaccattgttcagccgaaccaagcaaaagtgttgattttctttggccgctatttaggtacgattcgcgacagcggactatttcttactgttccgcttacgattaggcaaaacgtttctttgcgcgtccgtaattttaccagcaaaaaattaaaagtaaacgatgttcaaggcaaccctatcgaaattgccgctgttattgtatttcgggtcatcgattccgcaaaagcgatttttgatgtggatgactatgaagagtttgtagagattcaaagtgaggcagccattcgccatgttgcgacgaaatatccttatgatacctttaccgctgatgatgaaatcacattacgaggcaatgcagatattatttccgatgtccttgccaacgagttgcaagagcgcctaaaagtagctggagtggaagtaatcgaagctcgccttactcatctcgcctactctccagaaattgcaagcgcgatgttgcaacgccagcaagcagccgcgattttagcggcaagaaagaaaattgtcgaaggtgctgtctccatggcgcaaatggcgatcgagcaacttgacaaagaaggaattttagagttagatgatgaacgaaaagcaaacatggttaacaatttaatggtcgccatcgtatccgaacgcgcgacccagccggtgatcaataccggaagtctatactaa

SEQ ID NO: 1620 - DNA, 933 bp, Eggerthella lenta DSM 2243
atgctggcgcttctgctcgccgtcgtcgcgctgtgcgtcgcgttgatcgtgacgggggcgaccatggctccgcccgatgatgcgcctatcacgaccgcgacgcaaacgctcggcattgcgctgctggtggcgggcatcgtcgccgtatgcgtggcgcccgtcctgctgctgatgggcttcttcaccatccagccgaaccaggcgcgcgtgctcatcctgttcggcgactacaagggcaccgtgcgcgacgaaggtttccactgggccaacccgttctactcccgcaacgccggctccacggtcgacgtggccacgggcaagcccatcgcgaagtccacgaaggtctcgctgcgcgcccgcacgtacaacggcgagcacctcaaggtgaacgacaagtgcggcaaccccatcgagatcgccgacgtcatcgtgtggcgcgtcgagaacacggcgaaagcgctgttcgacgtggacgactacaacacctacgtgcatacgcaaagcgagacggcgctgcgtcatgtggccaccacgtacgcctatgaccagatgcccggcgagcccgaagacgagatcacgctgcgcagcaacatcgaggaggtgtccgaggcgctcaaggaagagttggcggtgcgcctggagaaggccggcgtggtcatcgacgacgcgcgcctcacgcacctggcgtacgcgccggagatcgcccaggcgatgctgcgccgccagcaggccgaagccgtcatcgccgcccgcgagaagatcgtgcagggcgcggtgagcatggtggacatggcgctggccgagctgtcggcgaagaacgtggtagacttggacgacgagcgcaaggccgccatggtgtcgaacctcatggtggtgctctgcggcgagtccgacgcgcagcccgtgctgaacacgggaacgctgtaccagtag

SEQ ID NO: 1621 - DNA, 864 bp, Dyadobacter fermentans DSM 18053
atgattgaaaaagaattacgctcgatgtctggctatctgctgtttgtgattggcctgctgctgttgctaggcggctttgtgaatatcgtgtcgtccggccaggggctcaccagcgtgctgattatcgcggccgcactgatcattctgatcggcctgacggtcattaaccccaacgagggtgtggtgaccacgtttttcggggattacatgggcaccatgaagcagaacggcctgcgttgggtgaacccgctgttccgccggaagaagatcagcctccgcgcccgtaacctcaacggccagaagctgaaagtcaacgacaagctcggaaacccgatcgagatcgcagcagtagtcgtttggcgcgtgggtgacaccgcgaaggcctcatttgaagtggatgattatgtaaaatatgtagaaatccagtcggaggcggccgtgcggcacctggcgggcatttatgcttacgacacaatggaagatgaggaggcaaacatccaggaggtgactttgcgcgacggcagcggcaagatcaacgaaatgctcgaggccgagctgaccgagcgtttgagtcgtgccggcatcgacgtactcgaagcacggatcagtcacctcgcatatgcacccgagatcgccggcgcgatgctgcaacgccagcaggcctcagcggtggtggcggcccgccgacagatcgtcaatggcgccgtcggaatggtggacatggcgttggcaatgctgtcggacaagcagattgtggagctcgatgaagagcggaaagcggctatggtgagtaatttgttggtagttttgtgcggtgagaaagcggcgaccccaattctgaacgccggcactttgtatccataa

SEQ ID NO: 1622 - DNA, 876 bp, Chitinophaga pinensis DSM 2588
atggaaaagatcgttaaacccgtctccggctatctggccatcgttcttggcattattgccttccttgcagctgtctacctgtttctggtaggaacgcaaacaggtacaggcatttttacattgctgggaatcgtcttttttatcgcgttcgtcttcactgtaaaaggcattattatagtgaaccccaatcactcacgcgtactgaccttctttggtaagtatatcggtaccgtaaaagaaaacggcttaatgtgggtaaaccccttctacaaaacagcccatctttccctgagagcgcacaaccataatggtcagcagctgaaagtgaatgataagatggggaaccccatcgaaattgccgctgtaactgtatggcgggttaccgatacgtataagtcatcatttgaggtggataactatctgcagtatgtgaatgtgcagagtgaagcggctgtacgccacctggcggtaagctattcttatgacagaatggaagataccgacgttgatacggatatcaccctgcgtgatggcggcgacaaggtaaatgagatgctggaaaaagaattgaacgaacgcctgagtcctgccggtatcacagtactggaagcacgtatcagtcacctggcttatgcacctgaaatcgccggcgcaatgctgcaacgtcagcaggcgacagctatcgtagctgcacgtactaagatcgtagaaggcgctgtaggcatggtagaactggcactcgacagattatcacaaaaggaaatcgtagttttggacgaggagcgtaaagctgccatggtatccaatctgctggtagtgctttgcggcgaatcaaaagtagcgcctgttgtaaatacaggtaccctccatcaataa

SEQ ID NO: 1623 - DNA, 930 bp, Catenulispora acidiphila DSM 44928
atgacgacggatcagggcggacaggagccgacaccggtggcggaagccgcggaggtgcaggccgcggaggtgccgatcagcgagcagtcggcgcgcgacgtctcggggtggggcgcgctgggcgcggtgatcgtgctcgccgggatcgccatcgcggtggcggcgctgaccatggacgcgacgcgcgcctgggccgttatcccgggcggcgcgggcttgttcctgctggtgggcttgactccggtctcgccggggcaggcgcgcgtggtcacgctgttcggccagtacgtcggcacgatccgcacgaccgggctgcgctgggtgaacccgctgacctcgcggcgccaggtctccacccgcgtgatcaacagcgagacggcgacgctgaaggtcaacgacgccgacggcaacccggtcgagatcgcggcggtcgtggtctggcaggtccgggacaccgccaaggccgtgtacgcggtcgacgacttcaacgacttcgtcgccatccagaccgagaccgccgtccggcacatcgccggcggctacccgtacgacgcgcgcaccgagggccaggtctccctgcgccagaacgccgacgagatcaccgcccgcatgtcggaggagatcgccgagcgggtggtgctggcgggcatcaacgtgatcgaatccaggatcacccggctgtcctacgcccccgagatcgcccaggcgatgctgcgccgccagcaggccgacgcggttgtcgccgcccggcagcgcctggtgcaaggcgcggtgggcatggtgcgctcggccctggacgccctgagcgaggaggacatcgtcgaactggacgaggagcgcaaggccgcgatggtcagcaacctgctggtcgtgctctgcagcgagcaggcgacccagccggtcgtgaacaccggcacgctctaccagtaa

SEQ ID NO: 1624 - DNA, 1059 bp, Anaerococcus prevotii DSM 20548
atggacaagttagaaaagaaactcgaaaactctgataatgtcgaagaaaagatccttaaggcaaagaagaatggtcttctaatgcttttggtctactttattctcctggcaggagcaattttaacgatagcagtaaatggaaatattatcgatagtggtaattacacaagtctaaatatagtatttctagtaataggaatagtttttgtagccttaggatggattatgcttttgggtcttaagcttctaaaacctcaagaatcattagtcctaacgctttttggtaagtatatcggaactataaagggcgagggcttctattatgtgaaccctttcgtttcagcagtaaatcctgctgccaacaccaagctaggccaatctggagatgtaagtgatggcataaagatttttgataagtctaattcctaccaatctaccaataagaaaatttccctaaaggtaatgaccctaaataacagcaaacaaaagatcaacgattatttaggaaatcctgtagaaattggtatagcagtaatgtggaaggtaaacgacactgccaaggcagtattcaatgtagacaattacaaggaatatttgtccctacagacagatacagccctaagaaatatcgttcgccaatatccttacgatgtaaaccctcattatcaaattgacacaacaggcgatggagagccagatgatggatctcttagaggttctagtgaaatagtagctagaagaatcaaggaagaaattcaaaaaagagtagaatttgcaggtcttgagataatagaagcaaggattacccacctatcttactcatctgaaatcgccgcagcaatgcttcaaagacaacaagcatcagccctaatcgacgctagagccatgatagtagatggagcagtgggcatggtagagatggctcttgccaagcttgaagaaaatggagtagtcgacctagatgaagaaagaaaagccgccatggtatcaaacctcctagttgttctttgtggcaaccatgaagcaagcccaatagtcaatacaggaagcttgtattaa

SEQ ID NO: 1625 - DNA, 987 bp, Atopobium parvulum DSM 20469
atgagcactgaaaaaattatcaaatccaagagtggttggctatttttgctgattgctattgctctttttgtaatagcagtcctgtttttggcaaattttgtgattagcgctatagctgcagatagaaatcctcgcctggagccatcggtcccaagcattattggtgcgttggttttcttctttgctggtttgtttgtttcaagcggcttgtttagtcttcagcctggtcaggcaagggtttgcgtgttgtttggtaagtacatcggaaccgttaaggacgagggccttcgctgggcaaatccttactacgctaagactctgtccgcaggcaacctttccactcttgtcacagttggagacacttctagcgtaaacgtgcacacctctatcatttctactcgtgctcgcacgttgaatggcgatgtcctcaaggttaatgatcgcatgggcaatccaatcgagattgctgaggtagttgtttggcgtgtcagcgataccgcaaaggctctcttcgatgtggatgattacgatagctacgttgctatgcaggcagagactgcacttaggcacgtcgctagcatttacagctacgaccacatggaggatgaatccgagtctaataccgcaattaccttgcgttccaacatcgaggaagtctccgaggctcttcagtctgagttgagccgcaacctttccgttgccggtattactgtcgacgacgcccgtctcacacatctctcttatgctcctgaaattgcacaggcaatgctccgtcgccagcaggcagaggccatcattgccgcacgtaagaagatcgttgagggtgccgtttccatggttgacatggctctcactcagctttccgagaatggcgttgttgagtttgatgaagaccgtaaggccgttatggcttctaaccttatggttgttctctgcggcgagtctgaggctcagcctgtgcttaacactggttctttgcagcagtaa

SEQ ID NO: 1626 - DNA, 843 bp, Desulfotomaculum acetoxidans DSM 771
atgcaagaacgctcggcttggaaaattaacgggtttctggctttattgctattgctgcttcttcttgcagctgttctcagctcattagtctttcttaggattggtatagcagtaatattaattatcttatttgtggttttatcggcaggaatggttattgttcaaccaaaccaggcaaaagctgtcaccttctttggcaaatacatgggcagcatcaatacaaacggtatttggctgacaattcccttttcccagcacaagaaggtatccttaagagtccgcaattttaacagcgcaaagctaaaggttaatgacgtagaaggcaatcctattgagattgctgctgtaattgtctttagagtagtggattcagcaaaagccttgtttgatgttgataactatgaacaatttgttgaaatacaaagtgaaacagctctgcgtcatgttgccaccaaatacccctatgacaactttgaggaagccggttactcactgagaggcaataccgaggaagttgcttcggaactggccaaagagcttcaatcccgtcttactctagcaggagtggaagtaacggaggcccgcttaacccacctggcttatgctactgaaatagccagtgccatgctgcagcggcagcaagcaaacgccatcatagcggccagacaaaaaattgtagaaggcgctgtcggaatggctcaaatggccatagaaaagttactcaaagaaggaaccgtttccctggacgatgaacgtaaaattgctatgatcaataacctcatggtagcaattgtttcggaaaaagctgctcaaccggtgattaatgctggcagtctgtattag

SEQ ID NO: 1627 - DNA, 1200 bp, Thermobifida fusca YX
atgaccgagcgggtcgtactcgcatactcaggaggactcgacacctccgtggctatcggctggatcgccgaagagaccggggctgaagtcatcgcggtcgccatcgactgcggccaaggcggagaggacatggaagtcatccgccagcgggccctggcttgcggcgcggtggaggcggtcatcgccgacgccaaggaggagttcgccaacgactactgtgtgccggccatccaagccaacgcgctctacatggaccgctacccgctggtctccgcgctgtcgcggccgctgatcgtcaagcacctggccgaggctgcgcgctaccacggggccaccatggtcgcgcacggctgcaccggtaaaggcaacgaccaggtgcgtttcgaagcgggcctggcagcgctcttccccgagctgaaggtcctcgccccggtccgggactcgggcatgacccgcgacaaggcgatcgcgttcgctgaagagaagggtctgccgatcgacgtcaccaagaagtcgccgtactccatcgaccagaacctgttcggccgcgccgtggagaccggcttcctggaggacatctggaacggccccatcgaggacatctacgactacacccagaacccggccgagccgcgggagcccgacgaggtcgtcatcaccttcaccgccggggtgcccaccgccctcgacggcaaggagctcagcccgctggagatcatccaggagctgaaccggcgcgccggcgcccagggcgtgggccgtatcgacatggtcgaagaccgcctggtgggcatcaagagccgcgaagtctacgaggcgcccggcgcgatcaccctcatcaccgcgcaccaggagctggagaacgtcaccgtcgaacgcgagctggcccgcttcaagcgctgggtggaccagcggtggggcgagctggtctacgacggcctgtggttctccccgctgaagaacgcgctggacaagttcatcctcgaagccaacaagcacgtcaccggcgacatccggatggtgctgcacggcggccgggccgtggtcaccggtcggcgcagcgaggcctccctctacgactaccacctggccacctacgacagcggcgacacctacgaccagagcctggcccgcggattcatcgacatctggagcatgcccgccaagatcgccaacatgcgcgaccgccggctctcctga

SEQ ID NO: 1628 - DNA, 1200 bp, Chlorobium chlorochromatii CaD3
atgagcaaagaaaaaattgcaatagcctactcgggtggtctcgatacctccgttatgattaagtggcttaaagataagtacgatgccgacattgttgccgttactggtaatcttggtcagcaaaaagagattgaaaatcttgagtcaaaagcgttggcaacaggcgcttcatccttccattttgtggacttgcgcactgagtttgttgaagagtacatttggcgtgccctgaaagcaggcgcgttgtatgaagatgtttacccgcttgcaacagcgcttgggcgtccactgcttgcaaaagcgttggttgacgtagccgttgccgaaaattgcaccatgcttgctcacggctgcacgggcaaaggcaacgatcaagtgcgctttgaagtaacctttgcttcacttgcgccacacatgaaaattttagcaccactccgcgtttgggaatttacctcacgcgaagctgaaattgcctacgctatggagcacaacattccagtttctgccaccaagaaaaatccctactcggttgacgaaaacatttggggcattagcattgagtgtggtgttttagaagaccccatgattgcacctcccgaagatgcctaccaaattaccacgtcgcctgaaaaagctcctgatactccagccgttgtagagcttgagtttgttgagggtgtgcccgttgctatggatggcaaaaaaatgaacggactcgacattattgtgcagcttaacaccattggtgcagcacatggcattggtcgtttagatatgattgaaaaccgcgtagtcggcattaaatcgcgcgaaatttacgaagcaccagcagcaaccattctgcactttgcccaccgtgaattggagcgcctaacgcttgaaaaatcagttttccaatacaaaaagaatatcagccaagattacgccaacatcatttacaatggcacatggttctcaccgcttcgcacttcgcttgatgcctttgtcaacgaaacacaaaagccggtaaccggtttagtgcgcttaaagctctacaaaggcaatgttaccttgcttggtagaacgtcgccttattcgctctataacgaggcgcttgcaacctacaccgaagccgatacctttaaccacaaagcggctgaaggctttattcacctttatggacttgggttaaaaacttttaaccaaattcataaaggatag

SEQ ID NO: 1629 - DNA, 1203 bp, Frankia CcI3
gtgaccgaacgcgtcgtgcttgcctactcgggcggcctcgacacgtccgtggccatcggttggatcggcgccgagaccggcgccgacgtcgtcgcgctggcggttgacgtcggccagggcggcgaggacctcgaggccatccggcagcgcgccctcacctgtggcgcggtcgagtcgatcgtcgtcgacgcccgtgaggagttcgccgagtccttcgtcgctccggcgattaagagcaatgcgctctacatggaccggtatccgttgatctcgtccctgtcgcgacccgtcatcgtcaggcatctggtcgccgcggcccgcgagcacggggcggacgccatcgcgcacggctgcaccggcaagggcaacgaccaggtgcgcttcgaggtcggggtggcggcgctcgcccccgggctgagcgtgctcgccccggtgcgcgactcggggatgacccgggacaaggcgatcgccttcgcggaggaacgcggcctgccgatcgacgtgtcgaagaaatcgccgtattccatcgaccagaacctgtggggccgcaccgccgagtgcggcgtcctcgaggacccgtgggcccagccgccggaggatgtcttcgtctactccgcggaccccaccgtcgcgcggatccccgacgaggtgaccatctcgttcatcgacggtgtcccggtggggttggacgggcgctccctcccgctcgccgatctcgtcgccgagctcaacgtccgggcgggcgcccacggcgtgggccggatcgacctgatcgaggaccggctcgtcggcatcaagagccgggagatctacgagtgcccggcggcgatcacgctgctaacggcccaccgggacctcgaggacctcacgcttgagcgggacgtcgcccggttcaagcggggcatcgaccagcggtggggtgagatcgtctacgacggtctgtggtactcgccgctgaagagcgcgttggacgccttcgtcgactccgccagcgccggagtgtccggggaggtgcggatccggctcgtgggtggcgtcgcccaggtcgtcggccggcgcagcccggccagtctgtacgaccacgcactggccacctacgacgccggcgaccagttcgaccagcgcgacgcccgcgggttcatcgagctctggggtctgccgacgaaggtctgggcggcgcgcgagcagcggctgaacccgtga

SEQ ID NO: 1630 - DNA, 1206 bp, Acidothermus cellulolyticus 11B
atgaccgagcgcgtcgtcctcgcctattcaggcgggctggatacctccgtctgcatcgggtggatcaccgagcagaccggagctgaggtgatcgccgtggcggtggacgtcggccagggcgaggacatggaggtgatccgcaagcgggctctggcctgcggggcggtcgaagccgaggtgatcgacgcgcgtgcggagttcgccgcggactactgcgttcctgcgctccgggcgaatgccctgtacatgggccggtatccgctgatctccgcgctctcgcgaccgttgatcgacaagcacctggtcgccgccgcgcatcggcacaaggcgacggccgtagcgcacggcagcaccggcaagggcaacgaccaggtccggttcgaagtgggcatcgggtcgctcgacccggagcttcggatcctcgccccagtccgggactccgggatgaccagggaccgggccatcgccttcgcggaagccaagggactcccgatcgaggtgacgaagaagtcgccgtactcgatcgatgccaacctctggggccgggcgatcgaaaccgggttcctggaggacatctggaacgctcccatcgaggagatctacgcctacaccgctgatccggccgtgccgcgccccgccgatgaggtggtggtctccttctcggacggcgtcccggtcgcgatcgacggacgcccggtgagcccgctggaggcgatcaccgagctgaaccgccgggccggggcgcagggtgtcggccggatcgacctggtcgaggaccgtctcgtcgggatcaagagccgcgaggtgtacgaagcgccgggggccgtcgctctgatcaccgcccatcaggagctggagaacgtcaccgtcgagcgggatctcgcccgattcaagcgccttgtcgatcaacgctgggctgaactcgtctacgacgggctctggttctccccgctcaagcgggcgctcgacgcgttcatcgacaccgcgcaacgtcatgtgaccggcgacatccggcttgtcctgcacggcggccgggctgtggtgaccggacggcgcagcccgcaggcgttgtacgactaccggctcgccacgtacgacaccggagacctcttcgaccagtcgttggcgaaaggctttgtcgagctgtgggggctgcccagccggacggcggcccgccgggaccttgcggcaggcgccggtgagtga

SEQ ID NO: 1631 - DNA, 1203 bp, Mycobacterium gilvum PYR-GCK
atgtccgagcgcgtcatcctggcctactccggaggcctggacacctcggtggccatcagctggatcggtaaggagaccggtaaagaggtcgtcgccgtggccatcgacctgggtcagggcggtgaggacatggaggtcgtgcgccagcgtgcgatcgactgcggcgccgtcgaggccgtcgtggtcgacgcgcgcgacgagttcgccgagcagtactgcctgccggcgatccagtccaacgcgctctacatggaccgctacccgctggtctcggcgctgagccggccgctgatcgtcaagcatctcgtcgacgccgcccgggagcacggcggcggcatcgtggcccacggctgcaccggcaagggtaacgaccaggtccgcttcgaggtcggattcgcctcgctggcaccggatctcaaagtcctcgccccggtccgcgactacgcgtggacccgcgagaaggccatcgcgttcgccgaggagaacgcgatcccgatcaacgtcaccaagcgctccccgttctcgatcgaccagaacgtctggggtcgcgccgtcgagaccggcttcctcgagcatctgtggaacgccccgaccaaggacgtctacgactacaccgaggacccgacggtcaactggagcagccccgacgaggtcgtcgtcggcttcgagaagggtgttccggtctcgatcgacgggaacccggtgaccgtcctgcaggccatcgagcagctcaacgagcgtgccggcgcgcagggcgtgggccggctcgacgtcgtcgaggatcgtctggtcggcatcaagagccgcgagatctacgaggcccccggcgcgatggtgctcatcaccgcccacaccgagctcgagcacgtcaccctggagcgtgaactgggccggtacaagcgcctgaccgaccagaagtggggtgagctggtctacgacggactgtggttctcaccgctgaagtcggcgctggagtcgttcgtcgccaacacgcaggagcatgtcagcggagagatccggctggtgctgcacggcgggcacatcgcggtcaacggtcggcgcagctcggaatcgctgtacgacttcaacctcgccacctacgacgagggtgacaccttcgaccagtcgtcggcgaagggcttcgtgcacgtgcacggtctgtcgtcgagcctgtccgcacgccgggatctggcggggaagtga

SEQ ID NO: 1632 - DNA, 1209 bp, Salinispora tropica CNB-440
atgactgagcgggtcgttctcgcgtactccggagggctggacacctccgtcgcgatcccgtacctggccgagcagaccggcgccgaagtgatcgccgtggcggtcgacgtcgggcagggcggtgaggacctggaggcgatccggcagcgggcgctcgactgcggggccgtggagtccgagctggttgacgcgcgtgaggagttcgccgccgagtactgcctgcccgcggtccgcgccaactccctctacatggaccggtacccgctggtctccgccctgtcccggccgctgatcgtcaagcacctggtggccgctgcccgcaaacacggcggcaccatcgtgtcgcacgggtgcaccggcaagggcaacgaccaggttcgcttcgaggtcggcctgggggcgctcgccccggatctgcggatcgtcgccccagcccgggacttcgcctggacccgggacaaggcgatcgcgttcgccgaggagaaggggctgccgatcgacgtgtcggcgaagtcgccctactcgatcgaccagaacctgtggggccgtgccgtcgagaccggcttcctggaggacatctggaacccgccgatcgaggacctgtactcgtacaccgctgacccggccgagccgcgggacgccgacgaggtcgtcatcaccttcgacgccggcaacccggtcgccatcgacggggagacggtcaccccgtaccaggcgatcctggagctgaaccggcgtgccggcgcgcagggcgtcggccggctggacatggtcgaggaccggctcgtggggatcaagagccgcgaggtgtacgaggcgccgggcgcgatcgcgctgatcaccgcccaccaggagctggaggcggtcaccgtcgagcgggacctcgcccggttcaagcgcagcgtggaccagcgctggggcgagctggtctacgacggcctgtggttctctccgctgaaggacgcgctggacgccttcgtcgacgacgcgcagcagcacgtctccggcgaggtacggctcaccctgcacggcgggcgggtcaccgccaccggccggcggtccgaggccagcctgtacgacttcggcatggccacctacgacaccggtgacaccttcgaccagtccctggccaaggggttcgtgcagctgtggggcctgcccagcaagttgtcggcggcgcgggacgcccggctgggtggggcgcggtga

SEQ ID NO: 1633 - DNA, 1197 bp, Mycobacterium tuberculosis F11
atgtcagagcgcgtcatcctggcctattccggcggtctggacacctcggtggcgatcagctggataggcaaggagaccggccgtgaggtggtggcggtggcgatcgacctcgggcagggcggcgagcacatggacgtcatacggcagcgggcgctggactgcggcgcggtggaggctgtcgtcgtcgacgcccgcgacgagttcgccgaaggctactgcctgcccaccgtgctgaacaacgcgctgtacatggaccgctacccgctggtgtcggcgatcagccggccgctgatcgtcaaacacctggtcgccgcggcgcgcgagcacggcggcggcatcgtcgcgcacggctgcaccggcaagggcaacgaccaggtccggttcgaagtcgggttcgcctcgctggcaccggatttagaggtgttggcgccggtgcgcgactacgcgtggacgcgggagaaggcgatcgcgttcgccgaggagaacgcgatcccgatcaacgtcaccaaacgttcgccgttctccatcgaccagaacgtctggggccgcgcggtggagaccggcttcttagagcacctgtggaatgccccaaccaaggacatctacgcctacaccgaagaccccacgatcaactggggggtccccgacgaggtgatcgtcggcttcgaacgcggcgtgccggtgtccgtcgacggcaagccggtgtcgatgctggcggcgatcgaggagctcaaccgccgcgccggagcgcaaggtgtcgggcgcctcgacgtcgtggaggatcggctggtgggcatcaagagccgcgagatctacgaggcgcccggcgcgatggtgctgatcaccgcgcacaccgaactcgaacacgtcaccctggagcgtgagctgggccggttcaaacgccagaccgaccagcgctgggccgaactggtctacgacgggctgtggtactcgccgctgaaggccgcgctggaggctttcgtcgccaagacccaggagcacgtgtccggcgaggtgcggctggtgctacacggcggccacatcgcggtcaacggccggcgcagcgcggaatcgttgtacgacttcaacctggccacctacgacgagggcgacagcttcgaccagtccgccgcccgcggcttcgtctacgtgcacgggctgtcctccaagctcgccgcccgccgggatctgcggtga

SEQ ID NO: 1634 - DNA, 1203 bp, Frankia EAN1pec
gtgaccgaacgcgtcgtgcttgcctactcgggcggcctcgacacgtccgtggccatcggctggatcggtgccgagaccggcgccgaggtcatcgccctggccgtcgacgtgggccagggcggcgaggacctcgaggcgatccgccagcgcgccttcacctgcggcgccgtcgagtcgatcgtcgtcgacgcccgcgaggagttcgcggcatccttcgtcgccccggcgatccgcgccaacgccctgtacatggaccgctacccgctcatctcctcgctgtcccggccgatcatcgtgaagcacctggtcgaggccgccaaacagcacggggcggacgcgatctcgcacggctgcacgggcaagggcaacgaccaggtccgcttcgaggtcggcgtgatggcactggccccgggcctgcgcgtgctggccccggtgcgcgactcgggcatgacccgggacaaggcgatcgccttcgccgaggagcgtggcctgccgatcgacgtctcgaagaagtccccgtactcgatcgaccagaacctgtggggccgcacggccgagtgcggggtcctcgaggacccgtgggcgcagccgccggaggacgtcttcgtctacacggccgacccgacggtctcccggccgtccgacgaggtcacgatctcgttcaccgacggcctgccgaccgggctggacgggcgggcactgtcgctggtggacctcgtcgccgagctcaacacccgggcgggtgcccagggcgtcggtcgcatcgacatgatcgaggaccggctcgtcggcatcaagagccgggagatctacgagtgcccagcggcgatcacgctgctgaccgcgcaccgtgacctggaggacctcaccctcgagcgggacgtcgcccggttcaagcggggcatcgaccagcgctggggcgaaatcgtctatgacgggctgtggttctcgccgttgcgggcagccctcgacgccttcgtggactcggccagtgtcggtgtcaccggcgacgtccggatccggctggcgggcggcgtcgcccaggtcgtgggccgtcgcagcccgggcagtctctacgaccacgcgctggccacctacgatgccggcgaccagttcgaccagaccgacgcgcggggattcatcgagctgtggggcctgcccaccaaggtctgggcggcccgcgaacagcggctcaacccgtga

SEQ ID NO: 1635 - DNA, 1209 bp, Chlorobium phaeobacteroides BS1
atgaaaagggaaaaaatcgctttagcctattccggcgggctcgatacatctgtcatgatcaagtggctgaaagataaatacgatgctgatatcattgccgtgaccggcaatctcggccaagagaaagaaatagaaaaccttgaacaaaaggcttttgatacgggagcgtcagggttctctttcctggatttgcgcaaagaattcgttgaaaactatatctggcccgcgctcaaggccggggcactgtacgaagaggtgtatcctctcgcgacagcccttggccgcccgctgctagccaaagcccttgtggatgtcgctctctccgaagactgcaccatgatcgcccacggatgtaccggcaagggtaacgaccaggtccgttttgaagtaaccttcgcttcgcttgcacctcacctcaaggttcttgccccgcttcgcgaatgggagttcaattcgagggaagcagagatggcctatgctgaaaaacacggtatcccggtttccgccacaaaaaagagtccctactccatcgatgaaaacatctggggaatcagcatcgagtgcggtgttcttgaagatccgatggtagctccgccggaagacgcgtatcagatcacgacatctccggaaaaagcccctgacaacgccgcggtaatcgatattgaatttgaacagggtgtgcctgtcgcgcttgacggcaggaaaatggaaggcctggatcttattgtggaactcaacaagcacggtgccgcccatggagtcggccgtctggatatgatcgagaaccgggttgtcggcatcaagtcaagagagatctatgaagcgcctgcggctacgatcctccattttgcccatcgtgaacttgaaaggctgacactggaaaaaaccgtttttcaatacaaaaacacgatcagccaggactacgccaaccttatctacaacggcacctggttctccccgatgcgcgaagcacttgacggattcgttgacgcaacccagaagcatgtcaccggccttgtcagggtcaagctcttcaaaggctcagtcaccctgctcggaagaacatctccctggtcgctctacaatgaagaactggccacgtacaccgaagccgacaccttcaatcacaaggccgccgaagggttcattcacctctacggcctcggtctgaaaacctacagcgaggttcaggcgaataacagaaagtaa

SEQ ID NO: 1636 - DNA, 1242 bp, Beutenbergia cavernae DSM 12333
atgagcagcacgtccagcaagcgcgtcgtcctcgcctactcgggcgggctcgacacgtcggtcgccatcggatggatcggggaggcgaccggcgccgaggtgatcgccgtcgccgtcgacgtcggccagggtggcgaggacctcgacgtcatccggcagcgtgcgctcgactgcggcgccgtcgaggcctacgtcgccgatgcacgcgacgagttcgcgaccgagtactgcatgcccgcgctcgccgccaacgcgatgtacctcgaccggtacccgctcgtgtcggcgctgtcccggcccgtgatcgtcaagcacctcgtgcgcgcggcgcggcagttcggggccgacaccgtggcgcacggctgcaccggcaagggcaacgaccaggtccggttcgaggtgggcatcacgtcgctcgccccggacctcgcctgcctcgcgccggtgcgggacctggcgctcacgcgcgacaaggcgatcgcctacgcgaacgagcacgcgctcccgatcgagaccacgaagaacaacccgttctcgatcgaccagaacgtgtggggccgcgccgtcgagaccgggttcctcgaggacatctggaactccccgacgaaggacgtctactcctacaccgacgaccccacgttcccgcccgtcgaggacgaggtcgtcatcacgttcgagcagggcgtcccggtggcgatcgacggcgtcgccgtcacgccgctgcgggcgatccaggagatgaaccggcgcgccggcgcccagggcatcgggcggatcgacatcgtcgaggaccggctcgtcggcatcaagtcgcgcgaggtctacgaggcgccgggggcgatcgcgctcatcgccgcgcacgccgagctggagaacgtcaccgtggagcgcgagcaggcgcggttcaagaggacggtcgggcagcgctggaccgagctcgtgtacgacggccagtggttctcgccgctcaagcactccctcgacgcgttcatcgccgacacccagcggtacgtctccggcgacatccggatgaccctgcacggcggccgcgccgtcgtcaccggccggcgcagcgacacgagcctgtacgacttctccctcgcgacctacgacaccggcgacgcgttcgaccagagcaacgcgaagggcttcatcgagatcttcggcctgacgtcgaagctcgccgcggcgcgcgacgtcgccttcggcaatggccccgacctcgggacgcagcagctgtga

SEQ ID NO: 1637 - DNA, 1395 bp, Eggerthella lenta DSM 2243
atggctcagcagcagactcagcaaacccagcagaaggacaaagcggtactggcgtattccggcggactggatacgtccgtgtgcatcaagtggctccaggaggagaagaacctcgacgttatcgccgtggtcggcgacgtgggacaggagcatgagggccttgagaagatcaagcagaaggcgttgaaaaccggcgccgtggaatgcctggtcgtggacatgcgcgacgtgttcgcccaggacttcctgtccaaggcgctggccgccaacgccctgtacgagaacaagtacccgctcgtgtccgcgctgtcccggccgctgatctccaagcaccttgtggacgcggcgcacaagttcggcgcgaagtacatcgcgcacggctgcacgggcaagggcaacgaccaggtgcgcttcgaggcgagcatcctcatgcttgatccggacatcgagattatcgccccggtgcgcgaatgggatctgcacacccgctccgaggagatggaatgggctcaggcgcacggcatcgaggttcccaccacgaagaagtcgccgtactccatcgacgataacctgtggggccgggccatcgagtgcggcgtcctggaggatccctggatggagccgccgacggacatctacacgatgacggtcgatcccaccgaagctcccgacgagccgcagtacgtggagctcgagttcgcgcgcggtctgccgtacgccatcgacgggagccagaagagcttcctcggtatcatctacgcgctgaacgagatcgccggcaagcacggctacggccgcatcgacatgatcgagaaccggctggtgggcgtgaagagccgcgagtgctacgaggtgccgggcgcgctgtcgctcattcaggctcacaaggcgctggaagacctggtgctggagcgcgaggtgctgcacttcaagctgggcatggagcaggagtgggcgaagtgcgtgtacaacggccagtggttctcgccgctcaaggaagccgtcgacgcgttcctcgcctccacgcagcgctgcgtggccggcaccgtgaagctcaagttctacaagggatcctgcaccgtggtgggccgcaagagcgcctactcgctgtacgattacgcgctggccacctacgacaaggacgactcgttcgaccacgcggcggccaagggcttcatccagctgcagacgctgtcggccaagacgtgggcctcgaaccgtcggcaggagggcgcaccggccgagctgttcgacgcgcagaagaaggtcggcccgttgacgaagggtgcgtacgaggacgtgacgccggtgtggaagcaggtggccgaggctgagaacgcggcggtcgtcgaagaagcggaagcggccctgcagggcgctgccgagaaggcttaa

SEQ ID NO: 1638 - DNA, 1209 bp, Saccharomonospora viridis DSM 43017
atgactgagcgggtggtgctcgcgtactcgggcgggctcgacacctcggtggcgatcggttggatcgccgaggagaccggtgccgaggtggtggccgtcgccgtcgacgtcggtcagggcggcgaggacatggagaccatccgcaagcgcgctctggagtgcggtgcggtggaggcggtcgtgtccgatgccaaggacgagttcgccgaggagtactgcttgcccgcactgcaggcgaacgcgctgtacatggaccgttatccgctggtttcggctctgtcccggccgctgatcgtcaagcacctggtgcgggcggccgagcgttacggcgccaccaccgtggcgcacggttgcaccggtaagggcaatgaccaggtgcggttcgaggtgggcatcggcgcgctcgctcccgacctgaaggtcatcgcccccgtgcgcgacttcgcgtggacccgggagaaggcgatctcctgggcggaggagcgcaacctcccgatcgacgtgacgaagaagtcgccgttctcgatcgaccagaacgtgtggggccgggccgtcgagacgggcgtgctggaggacctgtggaacgagccgccgaaggaggtctactcctacacccaggacccgaccgtccacttccaggctcccgacgaggtcatcatcaccttcgagaagggtgtcccggtcgccatcgacggcaagaaggtcacggtcctggaggccatccaggagatgaaccagcgcgccggtgcgcacggtatcggcaggctcgacatggtggaggaccggctcgtcgggatcaagagccgggaggtgtacgaggctcccggtgccatcgcgttgatcaccgcgcaccaggagctggagaacgtcacggtcgagcgtgacctcgcccggttcaagcgtcaggtcgaacagcgttggggcgagctggtgtacgacgggctgtggttctcgccgttgaaggacgctctcgacggcttcatcgccaaggcccaggagcacgtgtcgggcgacatccggatggtcctgcacggcggtaccgccaccgtcacggggcggcgcagcgatgagtcgctctacgacttcaacctggccacctacgacgagggcgacacgttcgaccagtcgttggccaagggcttcgtgcagctgtggggcttgcccagcaagatcgccgcgaagaggcagcagaacaagaacaacaactga

SEQ ID NO: 1639 - DNA, 1242 bp, Jonesia denitrificans DSM 20603
atgactgaacgtattgtccttgcatactccggtggtttggacacctcggtagcaatcgggtggatcgctgaagcgacaggtgctgaggtgattgctgttgctgtcgatgtaggccaagggggagaagacctcgaagtaatccgccagcgtgccctggactgtggtgcggtggaagcatacattgctgatgcgcgtgatgagttcgcaggtgaatactgcatgcctgctttgcaggctaacgccctgtaccttgaccgttacccgttggtgtcggcactgtcacgcccaactattgtcaaacacttggtgcgggctgctcgccagtttgatgcgacaaccgtggctcacgggtgcacaggcaagggcaacgatcaggttcgtttcgaggtgggtattacttctcttgcaccagacttgaaatgcctcgcaccagtgcgtgatcttgcgctgacaagggataaagcaattgcttacgcggagaagaactcgctgcccatcgctacaacgaagcacaacccgttctccattgaccagaacgtgtggggccgcgcggtggaaacaggattcttggaagacatttggaacgcccctaccaaagacgtctacaactacactgatgacccgaccttcccgccagtagctgacgaagtagtcatcacctttgaccggggtgttcccgtggcactggacggtgttgctgtgactccactgcaagccatccaagaaatgaaccgccgagccggtgcacaaggtgtgggacgaatcgacattgttgaagaccggctcgtgggaattaagtctcgcgaaatctatgaagcacccggtgcaatggctctcatcgcagcacaccaagaactcgagaatgtcacccttgagcgggaacaagcacggttcaagcgcacagtggaacagcggtggactgaattggtctatgacggcatgtggttctctcccctcaagcggtccttggacacgttcatcgcggacacccaacggtacgtgtcaggtgacattcgcatgacactgcacggaggtcgcgccaccgtcacaggccgacgctcagacgcatctctgtatgatttcaaccttgcgacctacgatgaaggagatgcgtttgatcagtcacaagcacgtggcttcatcgaaatctttggtctcaccgcaaaacttgccgctgcacgtgacgtgaagttcggcaacggtgttgacttatccggccagtcagttgctacgcaggaataa

SEQ ID NO: 1640 - DNA, 1596 bp, Methanosarcina barkeri fusaro
gtgcagcaccatatagactcgtttaacaagtttatagactacgggctgcaaaaaatcatagatgaacagaaaataatagaaaccgatatcgaggatacctacctcaaacttggaaaaattcgggtagagcatcctgtggtaaaggaagctgacggggcaatcgaaaaactttatcccaacgaggcaaggctcaggaacctctcatactcaggccctctctacctcgaaatgagcgtggtaaaagagggaattgagtccgaaccaatggaagcaaaaataggacagctccctataatggtcaaatctaagatctgtaaccttccaggacttagcgaaaccgaaaaagttcgctatggggaagatccacttgaccctgggggatatttcattatcggcggcaccgaaagggtggttatgaccctagaagatctcgctcctaacaaaattcttgtagagtatggggagaggtacggcgacactatagaagttgcaaaggttttctcacagaaacgcggatacagagctctagtaatcgtagaaagaggaagaaagtctctgctcgaggtttctttcccgtcgatttcaggccgagtattcttcattactcttatgagagctcttgggattgtaactgacgaagatattgtaaatgcagtttcaagtgatcccgaaattataaagttcatgctggaaaaccttgaagaagccgaagtcgaaacccaggacgaagcaatcgagaaaatcggggcccgggtcgctgcaggccaggctaaggaataccagataaaaagagcaaactatgttattgacaggtacctgtttccccatcttggaaacgacatgaaagacagaatctccaaggctcacttcctggcaagaatggctgagtcctgtttcgagctggccctgggcaagcgttcggaagatgataaagaccactatgcaaacaaaagactgaaactagctggagacctgatggaagacctcttcagggtatctttcaacaggcttgcaagagacataaaataccagctcgaacgcgcaaacatgagaaacagggagttaaatgtcgcaacaatagtcagggccgatgtgttaactgaccgcctgcagcacccactggcaactggaaactgggttggaggaagaacaggtgtgtcccaactccttgacagaaacgactatatctccacgctttctcatctgcgccgggtaatttcacctctttcacgagctcagcctcactttgaggcccgagacctgcatgcaacccagtggggaaggctttgcccttcggaaactcctgaaggtccaaactgtggtctggtgaaaaactttgccgagatggttgaactttcaacaggtatagaagatatcgatgggattaagaaaatcctccatgacctgaacgtcgagcgcgtggttgtaaaggtaccggaactcccgtccaaaatgaaagaaacattacttgatgagttcggagaagagattgttgaagaatacgaagagccttcggaaagcgaaagcaaattcaaagatgatgagttttacgattactcagatatggacgattccggatcaatgttcggtgattga

SEQ ID NO: 1641 - DNA, 1557 bp, Methanospirillum hungatei JF-1
ttgattgatttaagtatactttctcaggcttacttttcccgtgaacatgtagcccgtcaccagctggactcatacaatcattttcttctcaacaatctccagaaggtcgttgatgagcagcgggtaattgagacggatattgaaacacgggggaaagggaatgaaccggtctctgttgaacttggagatctgaaaattttaaaaccactggtccgtgaagcggatggttctcagtccgaactctatcctggtgaggcacggttgcgaaacatcacctatgcagcaccgattcagcttgacctgactcttgttcagggaggagtcagacatgagccggtgactgcaactatcggacaattaccgatcatggtgggctcagttgcctgcaatctgtatggcatgacagatgaggagcggacttctcatggagaggatccccttgatccgggtggctattttattgtgaacggtactgagcgtgtgctcatgacgcttgaagatcttgcctcaaacaagatcatgacagaatataccgagcggtacaatgagcgtatctacgttgccaaggtgttctcccagtttcgtgggtaccgtgccctggtcgttgtagagcggaaccgcaaaaacctgcttgaagttaccttcccgtcggttgccggtcatcttcggtttgttgatatgatgcgggcccttggtatgaccagcgatgctgatatcgtccgtgctgtctcaaccgatgaagagatcctcacgttcatgatgcagaatcttgaggagagcgaatgtgagaccgttgaatgcggtgtcatgtacgtcgggaagaagctggcacccaaccagactcgcgattatcagcgcaaacgtgcagagtttgttcttgataattatcttctgccacacctcaattacctgatgccccgtacagtgaacgaagaggatgaagagtgtatgaaaattgtgcattctgtccggcttgcaaaggctcatttccttggccggatggcagaggcatgttttgatctggttcttgaccggcggcgtattgatgataaggatcattatgcaaacaagaggctcaaactggccggtgacttaatggaagacctcttccgtatctctctgaaccggctgacccgtgatgtcaagtatcagctggaacgtgccagcatgaggcaccgcgacctctcgatcgccaccgcagtccgtgcagatgtgctgactgagcgtctccttcatccgcttgcaaccggtaactgggtcggaggaagaactggtgtgtcacagctgcttgaccgcgttgatcacatgagtgtcctttcacacttacgcagagtcatatctcccctctcccgttcccagccgcacttcgaggctcgtgatctccacccaacccagtggggtcgtatctgtccaagcgaaactcctgaaggaccaaattgtggtctggtgaaaaattttgcccagatggtggagattagtaaaggcgtccattcagatgaagagattattcggatgctctatggtatgggtgtagagaggataggagttgagatttga

SEQ ID NO: 1642 - DNA, 1629 bp, Methanococcoides burtonii DSM 6242
gtgcagcatcacatcgactcttataacaagtttgtcaaacatggtcttcagaagatcattaatgaacaaggtataatcgagaccgatctcgaggatatctatgtcaaacttggtaagataagggtggaacatccagtagtaaaagaagccgatggtgcaattgagaaattgtatccaaacgaggcaaggttgcgtaacctttcttattcggctcctcttttcctggaaatgtctgttgtacagaatggtgaggaaggagagccaaaggaagcaaaggtcggccagcttcctgttatgatcaaatcagatatctgtaaccttgttggtattagtgatgctgaaatggtccagcatggtgaggacccacttgatcctgggggatatttcattgtcaatggtacagaacgtgtcgtgatgacacttgaggacctcgctcctaacaagatccttactgagcttggtgagcgttatggggactctattgaagtttcaaaggtattctctcagaggagaggttacagggcactggtagttgtagaaagaggcaggaaatcccttttggagatttcattcccatcgatctccggacgtatcaatttcattacattgatgcgagctctgggggttgagactgatgaagatgtcgcaaagatcgtttcaactgaccctgagattatgaaattcatgttcgagaaccttgaagaggcagaggtcttcacaatagaagatgctattgagaagatcggtggtcgcgtggcttccggccaggcaagggaataccagatgaagcgtgcgaactatgttatcgaccgttatcttcttccgcatcttggcaacgatcctgctgacaggataccaaaagcacatttccttggtagaatggcagaatcatgcttcgagcttgctcttaaaaggcgctctgatgatgacaaggatcactactctaacaagaggcttaagctaacaggtgaccttatggaggatcttttccgggtagctttcaaccgtcttgcacgtgatgtgaagtaccagcttgaaagggctaacatgaggaacagggaactgaatgtcgcgacacttgtgcgtgcggatgttcttaccgaccgtcttcagcaccctcttgccactggtaactgggttggcggaagaagtggtgtatcacagttgcttgaccgcacagattacatttcaactctttctcacttaaggcgtgtcatttctccactttcaagggcgcaacctcactttgaggcccgtgatcttcacccaacccagtggggacgtctttgtccttcagagactccggaaggtccgaattgtggtcttgtgaagaactttgctcagatggtcgaactttcgactggtctggaggataaagatgttgttaaaaatgtcctctatgggcttggtgtagcccatgtggagctctacgttccagaaattatattggaactggctgctgatgtggattatgaggaagatctggaactggcacctcatacggataccgatgaacctgctgagaaggtcgaggttaaagcagagcctggacctaacgatgttgactatcatgaattcatggatgaaaatgccgatcccgtgggcggcgatgagacggaggcacaataa

SEQ ID NO: 1643 - DNA, 1491 bp, Methanosaeta thermophila PT
ttgctggacagaagcgttctttacagggcctattttaccaaggacaagttggtgcaccaccacataaattcattcaacgaattcatagacagaggtctgcagaaggttatcgatgaggtcaggataatagagacgaacatcgagaacacctacgtcaagctcggcaagatcagggtggagaagcctgtggtcatggaggctgacggatctgtcgagaggctctatccgaacgatgcccgtctcaggaacctgacctatgcgtcgccaataaagctcgagatgtccatagtcgacaggggcgaggagaaggagccggtcgaggcgatgatcggcatgctcccgatcatggtgatgtcgaaggtctgcaacctctacggcatgagcgaggaggagatggtctcctacggagaggatcccctcgatcctggaggatactttatagtgaacggatccgagcgcgtcataatgacgctcgaggatctggcgccgaacaagatactcgtggagtacaatcagaggtacgatgagttcatagaggttgcgaaggtcttcagccagaggcagggctacaggtctctcgtcatagtggagcgcggcaagcgatcgatactagaggtctcattcccgtctgtcgctggcaggataaacttcgtgactcttgtaagagccctcggactcgagactgatatggacatagtgaaggccgtatcagataaccccgagatcatgaagttcatgctcgagaacctcgaggaggctgaagtctcgacgacagaagaggccctggagaagataggcaacagggtcgcggccggccaggcgaaggagtaccagaagaagcgtgccgcttatgtcctggacagatacctgcttccgcatataggagtggaggagaaggacaggtacgctaaggctctcttcctctcaagaatggctgaggcgtgcttcgagctggcgcttggtaaaagaggagaggacgacaaggaccactatgcgaataagaggctgaagctctccggagacctgatggaagatctcttcagggtcgcattcaacaggctcaccagggatatcaagtaccagctcgagcgcgccagcatgcgcaacagggagctgaatgtcatcaccacagtgagagcggatgttctgacggagaggatgatacatcctctcgcaacaggcaactgggttggtggcaggaccggcgtatcgcagcttctggatagaacggattacatggcgagcctgagccatctcaggagggtcatatcgccgctatcgagatcgcagccgcactttgagaccagggatctccatgcgacacagtggggaaggatatgcccgagcgagactcccgaggggccgaactgcgggctggtcaagaacttcgctcagggagttgagctctcaaagggcgttgaggattacgaagaggtcaagaccatgctgatcaatctcggtgtgaggccggtaggtggttatggtggctga

SEQ ID NO: 1644 - DNA, 3393 bp, Thermofilum pendens Hrk 5
atgagctcgcgcgccgtgcaggcaaagctatccagggaggataggtggagagtggtaaaagcatacgtagacgagctaggcctcgtcaggcaacacttagactccttcaacgcttttctagagcgtggactccaggagatagtggacgaggtcggcggtatcaaggttgagtcgcagggtgttgagataaagtttgggaaaatagaggttggtcagcccacgtttagggaggctgacggtagcgatctcgctttgacacctatgatagcaaggctgagaaacataacctacgcggcaccgctctaccttacaatgacgctctacgtcgacggggaggagaggcggacggagtccgtctacataggtagtctgcccataatggtgaaaagcaagaagtgcgttctctacggtctcaagtcggaagacgagatagttaagtacggcgaggacccgtacgaccccggagggtacttcatcgttaacggctctgagagagtaatcgtgatgcaggaggatctgtcggtgaacagggttctcgtggactacggcggcgctagcggctccgtcacgcatacagcaaaggttttcagcgttgccgctggccaaaggtcgccgcttacagtcgagagaacgaaggatgggatgatatacgcctccttcccggcttgcccgtcgaaaataccagtagtagtgttgatgcgcgcgctgggtctaaagacggaccaggagatagcctacgccataggcaacgatccgataattcagcaggagtttctgcccgtattaatggagcaatcgaagatcgccgctacgcccgaggaggctctcgactacataggctccagggtgtccccgggccagccgagaaacgtgaggatagagagggcgcaagccgttctagatgaaaacttgttgccgcacataggtagaggccccgctgctaggatttctaaggctttcttcgtggggcagatggtttcccggttgctcgaactcaagctcggcatgcgcgggcccgatgataaggatcacctcgcgaataagaggatacggcaggccggcgagctgatagcgcaggtgttcaggagcgcgtttagacagctagtaaaagagatgacttactccatcgagaggcacacttccaagactcgggatatcaacctggtgagtatagtcaggccggacataattaccgagaggttaaaccacgcactcgcgactggcaactgggtgggcggcaggacgggtgtgagccagattctggacaggacgaactacctctcgacaatctcccacttgaggagggttgtctcgccgctatccaggactcagccgcacttcgaggctagggagcttcacccgacgcagtggggcaggctttgccccgtagaaagccccgaggggcagaactgcggcttggtaaagcacttggcgcttctggctactctctcgaacgggacggacgagaagcaggtgtacgacctgctggtaggcaggctgggagtagtccccgtggagaagacggtggggaagaatatctcgggggctagggtctacctcaacgggcggctcataggctacgttgaggacggcaagggtctcgcggagactttgaggaagcttcgaagagagggaagaataagtcacgaggtcaacgttgccttctattctcatgaatacaccgtcggcggggttaagggtaggatagaggaggtttacgtcaactgcgacgctgggaggatacgaagacctctgatagtagtcgaaaacggtgaaccgaggcttaaacacgaacatgtagagctgttgaggaaaggcgagtggacttggagcgacctcatagagaacggcatagtcgagtacctagacgcagaggaagaggagaacgcctacatagctacggatgtgtccgagctaactcctcagcacactcacctcgagattgtcccggcggcgatcctaggcattatcgcgatgacgataccctttatcgagtacaatcagtcgccgagaaactcgtatcaggcggcgatggctaagcagtccctgggaataccgcactacaacttcaagctccgcatggaccccaggatgcacgtgatgtactacccccagaaaccgctcgtgaagactcgcatcttcgacctgctacccttagacaacctgccctacggcacaaacatggtggtagcggttctgacaggcggaggatacaacatccaggatgcggtggtcatcaacaaggctgcgatagaaagaggcatgtcgaggtccgtcttctttagaacatacgaagccgaggagaggaggtatcccggtgggctcgaggataggttcgaaaagccctccctagaaaaggaccttctagacgttaagcctcctcaggcttacgaggctatagaccccgtggacggcatagcctacgtggaggcagagctctacggcggtcaagctgtggtgagtaggacgagcccgccgcgcttctacacgagcaccctggaacctagggttatgaccaagagaaaggacacctccctactcctgcgacacggtgaaaaagggataattgaccgcgtcttcataatggagagccccggaggcataaagctcgccaaggtaagagtgagagatctgcgccccacggagctcggggataagttcgcctcgcgccatgggcagaaaggcgtcgtagggatgcttgtaccacaggaagatatgccgttcacggaagaggggataacccctgacctaataatcaacccgcacgctattccttcgaggatgaccgtcggacagctactcgaggcgataacggggaaggctgccgcgctcgccggtaggaggatcgatgctacggcttttgaaccgccgtcgttagatgagataagagagatactcaggagctatggcttcaggagcgacgggaaagaggttctctacgacggggttaccggggagaagttggaggccgagatatttatcggtgtcgtgtactacgagaagctacaccacctcgttgccgacaagatgcacgcgagagccaggggtagggtacagatactaacgcggcaacccacggagggtagagcgcgggaaggaggtctgaggttcggcgagatggagaaggactgcctagtcgggcacggagcctccatgctccttagagagcgtctcctcgaaagctcagacaagactacgatatgggtttgcgagaactgcggctatatggggtggttcgacgcgaggaagaatacccccgtatgccctgtctgcggcgataagggaaggcttagccccgtcgaggtatcctatgcgtttaagctacttttgcaggagcttacggggctagggctctctgtgcgactgatccttaaagacaaaatccagtcgtga

SEQ ID NO: 1645 - DNA, 3384 bp, Pyrobaculum islandicum DSM 4184
atggtagatcttcttccactccccgtcgtcacaagccagcaggatgattcattccccacaaaagatgacagatggactttagtagagagatttattagagataaaggacttgctaaccatcagataaagtcttttaacgactttttagataagaaactccctaagattgtagaagactttaaagttattgagacggaaattaagggccttaagctagttttagagcgtattgaagttggctggcctaggattaaagaaagcgacggctctgaatcgttaatctatcccatggaggcccggctacgtaatgcgacatattccgctccactatatttaaccgccactctttatgtagacgatgagccatatgtcacagagactttttacataggcgaattgcccataatggttaaatccaagaggtgtaatctaactagacttaagcctagtgagtatgtaaagaaatttgaagatccgcaagacttcggcggctatttcataataaatgggagtgaacgcgttattatctctcaagaggatttagtaaccgataggcctatttatgataagggagataagccatcggtaaaatatattgcaaaaaccatctcaaccggcataggctatagaagtacgcttgttgtagaacttaacaaagacggcattatatatgtcaccctttctgccatgcctgtaaaaataccgtttccagtatatatgaaagctcttggtcttgagactgacgaagacgttgtcaaggcggtttctgacgacccagaaatacaaaaagagctactgccctctcttatagcggctaaccaaattgccataacaaaggaggatgcgttagatttcataggcggtaaagttgccgtgggccaacctaaacctattagagttgaaaaagcgcttcaactacttgaccgttattttctccctcatttaggcactactgtacctgatgagaaaaaacaacaggaaattagactgaagaaggccctcatgctgggccaaattgtcaagggccttatagagttagacctcggcagaagaaagcccgacgataaagaccatgtcgctaacaaaagagttagactagtgggcgatttgatgactcaactcttcaggacagtctttaagcagtttttgcaagagttaaaaagccagttagagaagtattatgcgcggggtagaattccgcatattcagactatagtgagaccagacataatcacagaacgtgtgagacaagcgctcgctacagggaattgggttggtggtaaaacaggcgtatcccagatattagatcgcactaattatatgtcaactttaagctacttaagacgtgttgtatcatcgctttctaggacacaacctcactttgaggcgcgtgatcttcatccaactcaatggggtagactttgtgccgtggaaacgccagagggacaaaacgtcggtcttgttaaaaacttggcgcttctcgcagagataactacaggtgttgacgagggggaggtagagcagttgttatataacctaggcgttgtgcctattttaaaggccagagacgagggcatccgtggtgcggaggtctacatcaatgggagattaataggtatacatcctaacccagacgaattagccaggacagtaagaagcctaagaagacaggggaaaataagtgatgaaataaacatagctgtcttaaacaatgctgtatatgtcaactgcgacggaggccgcattagaaggcctctcttagtcgtagaaaatggaaaactcaaattaacaaaagaaattgttgaaaaagttagacgtggcgaattgacgtgggacgacttagtaaaaatgggagttatagagtacctagatgctgacgaagaggagaatgcctatatcgccacagatcctcacgatgacttaagcaaatacacacatgtcgagattataccatctgctatacttggcgccgtggcgtctataataccctatcttgagcataaccaatcgccgcgtaatcagtatgaagctgcgatggctaaacaatctctcggactaccgcagtctaacttcctctataaacttgattcacgaggccacatgttatattaccccgaaagacctattgtcacaacaagaggcttagagcttataggctattcaaaaaagccggctggacaaaacgccgttgttgcacttctcacatacacgggctacaatatggaagacgccattattttaaacaaagccgcagtagagcgtggcatgttccgttcggtcttctaccgcacttatgaaacagaggaacagaaatatcctggcggagaggaggataaaatagaagtaccagatagttcagttaaaggttatagaggacctgaagcatacagccacctagacgaagacggcatagctccaccagaggtctatgttagtagcaatgaggttattataggcaaaacgtcgccgcctagattttacacgacgctagagacagaacgtattttaaaagagagaagagattcctctgttgctgtaagacgcggcgagaagggcattgtagatagggtaattattacggagtctccagaaggcaataggttagtaaaagtgagactgagagaacttaggattccagaactaggcgataagtttgcctctcgccatggccaaaagggcgtcgttggcatgatattgagacacgaggatatgccgtttacggaggagggcatagtcccagatataatcgttaatccacatgcgttgccatcgcgtatgactgtaggacagcttttagaaagtatagcagggaaaataggggcgtctcttggcgcattagtagatgcaacgccgttcgaaggtgtgaaagaagaagaactaagaaaactactaatgaagctaggctataagtgggatggcaaagaggttatgtacagtggaataacaggcgaaaagcttgtggcagatatcttcataggcgtagtctactaccagaaactgcatcacatggttgccgataagatccacgcaagagcaagagggcctgtccagatcttaactagacaaccaactgaggggcgttcgcgcgagggcggccttaggttaggcgaaatggaaagagacgtcttgatcgcacacggcgcctcggcgttgctatatgaaagacttgtcgaatctagtgacaaatatacgatgtatgtatgtgagctgtgcgggctcccggcttatttagatgccagaacaaacaagccgagatgtccgatacacggcgacactgggcagttcgctaaagtaatagtgccgtatgcatttaaactacttctgcaagagctgatagcccttggcatatatccaaagctcgagctttctgaaattttagaatag

SEQ ID NO: 1646 - DNA, 1551 bp, Methanocorpusculum labreanum Z
atgatcgacagaagtgtattatcaggcgcgtacttttcccaggaacacgttgcacgccaccagctggactcctataacaattttgtccagtttaacctccagaaagtcgtagacgaacagcgtatcgtcgagaccgaaatcgtcaacagaggaaagaaccaggaggccgtgtgggtcgaactgggaaaaatccgtgttgaaaaacccatcgtcagggaagcagacggttcgcagagcaagctctatccggccgaagcccgcctaagaaacctttcctatgcggccccgatgatccttgaaatgaccctccaccagggagacaaagtctatccggtccaggaaacgaccatcggtcagctcccggtcatgatcggcagtcaggtctgtaacctctgcggtctgtcccaggaagagagaaccgagcagggcgaggatccgagcgatcccggaggatacttcatcgtcaacggaaccgagcgtgtattaatgacgctcgaagatcttgccagcaacaagatcatgaccgagttcaccgagagatacaacgagcagatccatgtatccaaagtgttctcccagttccgcggctaccgcgctctcgtcgttgtcgagaagaacaagaagaacctcctcgacgtctccttcccgagcgttgccggccacctgcggtttgcggacctcatgcgtgcgcttggtctcgagtccgatgaagagatcgtatcggccgtctccctctcagaagacgtcctcacctacatgatgcagaacctcgaagaaagcgaatgcgccaccgtcgaggagggtgtcatgtatgtcggtaagaagcttgcgcccaaccagaccaaggattaccagagaaaacgcgccgagttcgttttggacagctaccttctcccgcacttaaactacgccatccccggctccttaaaacccggagacgaaggctacgaagtgtatgcaaaggatgtccggatcgccaaagccgaattcctcggcagaatggcagaggcatgtttcgacctcgcactcaacaagaggagaatcgacgacaaagatcactactccaacaagcgcctgaaacttgcaggtgacctgatggaggatctgttccgtatctcgttaaacagacttacccgcgatgtcaagtatcagcttgaacgcgcgagcatgagacacagagaactcgcgatcggaaccgtcgtccgtgcggatgtcttgaccgaacgcctgattcacccgcttgcaaccggaaactgggtcggcggaaggactggtgtctcccagcttatggaccgcgtcgaccacatgtcggtcatttcccacctgcgaagagttatctctccgctgtccagatcccagccccacttcgaggcccgtgatctgcacccaacccagtgggggcgcatctgtccgtccgaaactccggaaggaccaaactgcggtttagtgaagaactttgcccagcttgtcgagatcagtaaaggaaccgatgaggacgaggtcctccgtgtaatacagggcatgaagatccagccgatcaggagcgaataa

SEQ ID NO: 1647 - DNA, 1542 bp, Methanoculleus marisnigri JR1
ttgtcgagagcatattttgcgcgggagcacgtagcgcgccaccagttagactcttataacaatttcctcctgcacaaccttcagaaagtcgtcgacgagcagcgcgtcatcgagaccgatatcgagactcgggggaaaggaaaggaggctgtatgggttgaactgggcaaggtcgaggtgaaaaaacctcttgtccgtgaagcggacggatcgcagtccgaactcttcccgagcgaggcgcgcctgagaaacctcacctatgcggcgcccattcaactcgagatgacgcttgtccagggcgaagaagcgcaggacccgatcgtcaccactatcgggcagttgccggtgatggtggggtcggccgcctgcaacctctacaacatgagcgaccccgagcggatcgagcacggcgaagatcccctcgatccaggcggctacttcgtcgtcaacggcacggaacgggtgctgatgacgctcgaggatctcgcctcgaacaagatcatgaccgagttcaccgagcgatacaacgagcggatctacgtggcgaaggtcttctcgcagtaccggggctaccgcgcgctcgtgatcgtcgagaggaacaggaagaacctgctcgaggtctcgttcccttcggtcgccgggcacctccgcttcatcgacctgatgcgggcgctggggctgcagggcgaccacgacatcgtggaggcggtttcgaccgacgaggagatcctcaccttcatgatgcagaaccttgaagagggcgagtgcgacaccgtcgacgaaggcgtcatgtacgtcgggaaaaaactcgcacccaaccagacccgggactaccagcggaaacgtgcggagttcgttctggacaactacctcctcccgcacttaaactacctgatgccggtgggcctgaaggaggaagaccccggataccggacggcagtcgagggcgtccgcctcgcaaaggcgcacttcctcggccgcatggccgaggcctgtttcgacctggtgctcgatcggcgccggatcgacgacaaggaccactactcgaacaagcggctgaaacttgccggcgacctgatggaagacctcttccggatctcactcaaccgcttaacgagggacgtgaagtaccagctcgagcgggccagcatgcgccaccgcgacctctcgatcgggaccgccgtgcgcgcggacgtcctgaccgagcggctgctgcacccgcttgccaccggcaactgggtgggcgggcgcaccggcgtctcgcagctcctcgaccgcgtggatcacatggcggtgctctcgcaccttcgccgtgtaatctcgcctctctcccgctcgcagcctcacttcgaggcccgtgacctgcaccccacccagtgggggcggatctgtccgagcgagacgcctgagggaccgaactgtggactggtgaagaacttcgcccagatggtcgagatcagcaagggtgtaatcaacgaagaggaagtgaagaacattctgtacgatatgggcgtcatcgccctccggagagagacggcatga

SEQ ID NO: 1648 - DNA, 3384 bp, Pyrobaculum calidifontis JCM 11548
atggtcgacttgctccccctcccgatactctctaaggatggcgatggtgagtttccttcccgggacgacaggtgggcgcttgttgagagatttattaaagataaggggcttgcgaatcaccagataaaatcgtttaacgattttctagacaaaaggctaccgcgcattgttgaagagtttaaggttgtcgaaactgagatcaaggggcttaagctggtattggaaaagatcgaggtggggtggcctaggataaaggagagcgacggctctgagtctttgatataccccatggaggctcgacttagaaatgccacctacgccgcgcctctttatctcaccgcgacgctgtatgtcgatgacgagccttatgtcaccgagactttttacataggtgagttgcctattatggttaagtctaagaggtgtaacttgacgaggctaaagcccagcgaatatgcgaaaaagttcgaagacccgcaggattttggagggtacttcatcatcaacggcagtgagcgcgttataatctcacaggaggacttagtaacagacaggccaatatacgacgtaggcgataagccttctgtaaaattcctagcaaagacgatctccacggggattgggtataggagtacattgaccgtggaactgaataaagacggcgttatatacgtcacgctttccgcaatgcctgtaaaaatcccgttcccaatatacatgaaggccttaggcctagagacggatgaagatgtggtgaaagctgtctcagacgaccccgatattcagaaagagcttctcccctcgcttatcgcggcgaatcaggtggctataactagggaagacgcgctcgactacataggcggcaaagttgcagtgggccagccgcggcctgtgagaattgagcgtgcgcttcagttgttggataggtacttcctcccgcaccttggcacaactaccccagacgagaagaagcaacaggaaattaggctaaagaaggcgcttatgctaggccaaatagtcaaagggcttgtcgagcttcaacttggccgtagaaagcccgacgataaggaccacgtggggaacaagagggttagacttgtcggtgacttaatgacgcaactatttagaaccgtatttaagcagtttctgcaagagctaaggagtcagcttgagaaatactacgctagggggaggatacctcacatccagaccatagttaggccagacattatcactgagagagtgaggcaggcgctcgccacgggcaactgggttggaggcaagaccggcgtctcgcagatactagacagaacaaactacttgtccacgttgagctatctaaggcgagtagtctcgtcgctttcaaggacgcagccacattttgaggcccgcgacttacaccccacccagtggggcaggctgtgcgccgtcgagacgccggagggtcaaaacgtcggcctagtaaagaacttggcccttctcgccgagattaccacaggggtagacgagagagaggttgaacaactactgtacaacttggggactgtgcctgtgctcaaggcccgcgaagacggcatacgcggcgcagaggtgtatctcaatgggcggctcatagggattcaccccaacgccgaagagcttgtcgccactgtgagaagccttaggaggcaggggaagataagcgatgaaatcaacatagcccacataaacggctctgtactggtcaactgcgacggcggccgcattaggcggcctctcctggtggttgaaaacggtaggctgaagcttacaaaagacatagtggagcgcgtgagaaagggagacttgacttgggacgacttagtgaaaatgggcgtggtggagtacctagacgcagacgaggaggagaatgcacacatagctgtagaccccagaggggatctgtccggctacacgcatgtggaaataattccatcggccatacttggcgcaatagcctccataatcccctacctagaacacaaccagtctccgcgcaaccagtacgaggcggcaatggcaaagcagtcccttggacttccgcagtccaacttcctctacaagctggattcgagaggccacatgttgtactaccccgagaggcccattgtgacaactaggggacttgagctggtgggctactccaagaggccggctggccaaaacgccgtagtcgccttgttgacatacactgggtacaacatagaagacgccgtaatcttaaacaaggcctctgtagaacgcggcatgttccgctcagtcttctaccgcacttatgaaacagaggagcagaagtaccccggcggcgaggaggacaggatagaggtccccgacagctctgtcaaaggctacagagggcccgaggcctacagccacttagacgaagacggcatcgcgccgcccgaggtctatgtgagcagcaacgaggtgcttattgggaagacgtctccgccgaggttttacacaacgcttgagaccgagcgcattctcaaggagaggagagacgcgtctgtggccgtgcggaggggagagaagggcattgtggacagggtcatcatcactgagtctcctgagggcaacaagctggtgaaagttagacttagagagcttagaatccccgagcttggggacaagtttgcctcgcgccacggccaaaagggcgtcgtcggcatgttgcttaggcaggaggatatgccgtttacagaagacggcatagtgcccgacataattgtcaacccacacgcgctcccctcgcgtatgaccgtgggccagctcctggagagcatagccggcaaagtgggcgccgccacggggcaattggtagatgcgacgccgttcgagggcgtgggggaggaggacttgaggaagttgttgttaaagctgggcttccgctgggatgggaaagaggtcatgtacagcgggatcactggggagaagctcgtcgccgacatattcataggcatagtgtactaccagaagttgcaccacatggtggccgacaagattcacgcaagggcgagggggcctgtgcagatattgacaaggcagcccaccgaggggcgttcgcgcgagggaggccttaggcttggcgaaatggagagagacgtcctcatagcgcacggcgcctctgcgcttttgtacgaaagactcgtcgagtcgagcgataagtacgtcatgtacgtgtgcgagttgtgcggattgcccgcgtacttagacgctaagacaaataagccgaggtgccccatacacggagacactggccaatttgccaaggtggtagtcccatatgcgttcaagctactgcttcaagagctaatggcacttggaatttaccccaagcttgagctttccgaggtcttagactag

SEQ ID NO: 1649 - DNA, 1500 bp, Methanococcus maripaludis C5
atggaatcccgtgtcgttgttgatgcattttttaaagagaacagtttagtaaaacaccacatcgattcctacgatgattttgtgaagaataaaattcaaaagatcatcgatgaggtaactggtgtcgaaacagaaattaaaggaggatacaaagtatcctttgcaaaagtgagagttacaaaaccaataaataaagaagctgacggttctgtaaaagaaataacacctatggaagcgagaattagaaaccttgcatactctgcaccgctttatcttgaaatgataccaacagttggcgaagatgaagaagaaaaggtattatcccctgttgaagtttatatcggagaacttccagtaatgcttggttcagaaatctgccacttgtgcggaaaatctgatgaagaattgataaaatacggcgaagatatacaagatcctctaggttattttattgttaacggttcagaaaaagcagttgttgctcaagaagaccttattcctaacagaattatatgtgaaaaggtagaaaaaaacaacaaagttgtagatatcgcaaaagtattttcaactagacatggatttagggcactttgtacggttgagagaaatccagatggattattaaatgtttcattcccgggaatgcctagcacaattccactagttatattaatgagagcgcttggtgcagaatcagatagagaaattatcgaattaatttcggacgaaccaacagttgttatgcaattaattgcaaacttacaggaagcacgagaagagcatgcaataaacacgactgaagatgcactcgaacatatcggaaaaagagtagctccaggacagcctaaagagtacaaattaaaaagagcagaaacaattctttgcaactatttattgccacacatgggcgtagaatctgagaaattaggtgctaaatgtaaatatcttggaagaatggctaaaaactcaatcgaactctacttaggattaagggttgaagatgataaggaccattattcaaataaaagattaaaattagctggagacttgatggaagatttgttcagacattcattcaaccagttaattaaagatattaaataccaactcgaaagacaagcaattagaaacaaagaaccttcaattcaagctgcagttagaagcgatgttttaactgaaagaatgagacatgcgatggctacaggaaactgggtgggtggaagaacaggggtatctcaacttctcgatagaaccagttatcttgcaacagtatcccaattaagaagagttgtatctccactttcaagatcacaacctcacttcgaagctagggacttgcacgcaacccaatggggtaaaatatgtccatccgaaacaccagaaggtccaaactgtggtctggtaaaaaaccttgctgtaatgtgcaaagtaactactgatgaaggcgacgatagcgtaatcgaattattaagagaactcggtctcacaaaggaaaactaa

SEQ ID NO: 1650 - DNA, 3384 bp, Pyrobaculum arsenaticum DSM 13514
atggttgatctacttcctctacccgtgatatcaccctctggagacggagggcttcttacaaaagacgataggtgggccttggtggagaggtttataaaagacaaggggctcgccagccaccagataaagtctttcaacgacttcctagacaagaagctcccccgcattgtcgaggatttcaaggtggttgatacagagattaaggggctgaaactggtgttggagaaaatcgaggttgggtggccgaggattaaggagtcggacggttccgagtcccttatctaccccatggaggctcggctccgcaacgccacctactcggcgcccttgtacctaaccgcggttttgtacgtagatgatgagccctacgccacagaaacgttctacataggggagttgcccataatggttaagtcgaaacgttgcaacttgacccggctgaggccaagtgagtaccctaagaggtttgaggacccccaagacttcggcggctactttatcataaacgggagcgagcgggttattataagccaggaggacctcgtcgctgataggccaatttacgacaagggcgacaagccctccgtgaagttcttggccaagactatatccaccggcatagggtacagaagcacgttgactgttgagctgaacaaagacggggtgatttacgccacgctttcggcaatacccgtcaaaatacccttccccatttacatgaaggctctcggcctcgagacagacgaggacgtggtgaaggccgtgtcggacgacccagacatacagaaagagctcctcccctcactcgtggttgccaaccagatagcgataacccgcgaagacgcgcttgactacataggcggcaaggtggcagtggggcaaccccggcccgtcagagtggagcgggcgttgcaactgctagataggtacttcctgcctcaccttggcaccacggtgccggatgagaagaagcaacaagaaattaggctgaaaaaggcgctgatgctggggcaaattgttaagggtcttgtggagctccagctggggaggaggaagcccgacgataaggaccacgtggcaaacaagagggtgcgcttagttggcgacttgatgacccagctcttccgcacggtgtttaagcagttgctccaggagctgaggagccagctggagaagtactacgccagggggaggataccccacctgcagacaattgtaaggccggacataataaccgagcgcgtcaggcaagccctagctacgggtaactgggtagggggcaagacgggtgtctcccagattttagaccgcaccaactacctctccactctgagctacctgaggcgtgttgtgtcctccctatccaggacccagccccacttcgaggcccgcgacctccacccaacccagtgggggaggctgtgcgcagttgagacgcctgagggccaaaacgtggggcttgtgaagaacctcgccctcctcgccgagataaccactggtgtggacgaaaacgatgttgaacagatgctcttacagcagggcgtcgtgcctatactaaaagctagagaggagggggtccgtggcgccgaggtctacctaaacgggaggctgataggtatccacccagaaccggaagaattggtaaagacggtaaggagcttgaggaggcagggcaagataagcgatgagataaacatcgcttacctcaacggcgtcgtttacgtgaacagcgacggggggcgcataaggaggcctctcctagtcgtggaagacgggaagctgaaactcacaaaggacattgttgagagggtgaagaggggggagctcacctgggacgacctattaaaaatgggcgtagtggagtacctagacgccgacgaagaagaaaacgcccacatagctgttgaccccgagggcgacctaagcaattacacccatgtggagattataccatcctccatcctgggggcaattgcctcgattatacccttcctagagcacaaccagtcgccgagaaaccaatacgaggccgcgatggccaagcagagtctgggcttgccgcagtccaacttcttgtacaagctggactccagaggtcatatgttgtactacccagagaggccgatagtgactaccaggggtctggagttggtgggttattcgaagcggcctgcaggccagaacgccgtagtggctctgctcacctatacggggtacaacatcgaggatgccgtcatcctaaacaaggcgtcagtggagcgcggcatgttccgctcggtgttctaccgcacatacgagacggaggagcagagatacccaggcggcgaggaggacaaaatcgaaatacctgacagctcggtcaaggggtatagggggccagaggcctacagccacctagacgaagacggcatagccccgcctgaggtgtatgtgagtagcagcgaggtgttgataggcaaaacatctccgccgaggttctacaccacgctggagacagagcggatactgaaagagagacgtgacgcctcggtggccgtaaggcgcggggaaaagggtatagtggacagggtcatagtcacggagtctcccgagggcaacaagcttgttaaggtgaggctgagggagctcagaattccggagctcggcgacaagttcgcaagccggcacggccagaagggagttgtggggatgttgcttagacaagaggatatgccattcacagaggagggcattgtccccgacataatcgtaaacccacatgccctgccctcgcgtatgaccgtcgcccagttgctagaaagcatggccgggaaggtcggcgccgccacagggaacctagtagacgccacaccctttgagggggtaaaggaggaggacttgaggaagctgttgctaaaactcggctacaagtgggacggcaaagaggtcatgtacagcggcataaccggcgagaagctcgtagcggacatcttcataggcattgtgtactaccagaagctacaccacatggtagccgacaagatacacgcccgcgctaggggccccgtgcagatcctcacgagacaacccaccgagggccgctcccgcgaaggcggcctaaggctgggagagatggagcgcgacgtcttgatagcgcacggcgcctcggcgttgctctacgagaggcttgtggagtcgagcgataagtacacgatgtatgtctgcgagctgtgcggcctgccggcgtatctggatgccaagagtaataagccgaagtgcccaatccacggcgatacggggcagttcgccaaggtcacggtgccctatgcctttaagcttctgcttcaagagctgattgcgctgggtatataccccaagctggagctctctgaggtgctggactaa

SEQ ID NO: 1651 - DNA, 3375 bp, Metallosphaera sedula DSM 5348
atgctttcagttgacgatagatgggtaatagtagaggcatactttaagtccagagggttagtaagacagcatttagactcatttaatgattttataaagaataagcttcaggaaattatagatgagcagggagaaataatcaccgagatacctggtctaaagattagactaggtaagataagggtaggaaaacctagggttagggaagcagacaagggcgacaaggagataacgcccatggaagccaggctgagaaacctgacctacgctgccccaattttcctaaccatgacacctgtagagaacaacatagagggagatcccaccgaggttcatataggcgatattcctattatgctcaaatcgatagctgatccaacttcggagttcagccaagacaaactagtggaaataggagaggatccaaaggacccaggtggatactttatcattaatggaagtgaaagagtaatcgtaactcaggaagacttagcaacaaatagagttctgactgatgtgggaaaggcgggctccaatgttacccatacagctaaaataatttcgagcacctctgggtatagggttcctatcaccatagagagattgaaagattccacaatccacgtttcattcccttcagcgcccggtagaattccattcgcaatattaatgagagcccttggggtagagaccgacgaagatattacactggcagtgtcccttgacccacaaatacagaacgaacttttaccttctttggaacaggcgagctctatttcttcaaaggaagacgcattggacttcataggcaacagggtagctataggtcagaaaagggaaatgaggatacagaaagctgaacagattttagataaatatttcttaccacatataggtactaatccatcagatagagtagccaaggcttactatctggccttcgcagtctcaaagctgatcgagctttatcttggcagaagggaacccgacgacaaggaccattatgctaacaagaggctgaaattggcgggagacttattcgctagtctctttagagtagcgtttaaggcctttgttaaggacctagtgtttcagctcgagaagtcaaaggttaggggaagaaggttagccattaatgcccttgtaaggcctgacataatttcggagagaattaggcatgcacttgccacaggaaattgggttggaggaagaacaggcgtaagccagcttttagatcgtaccaattggttatcaatgttaagccatctaaggagggttgtatcttccctagccaggggtcagcctaactttgaggccagggatctacacggaacccaatggggcaggatgtgcccattcgagacaccagagggtcctaacagcggtcttgtgaagaacatagctctcctggcccagatatcagttggaataaatgagaagagccttgagagaactctttacaatttgggtgtagtccctatagacgacgccataaagaaggttaagtctgaggaaggccaatctgagaattatcagacctggagcaaggtaattctaaacgggagactaataggctattatcctgatgggcgtgaactggcagagaaaataagagagagcagaagagagggtgagttaagcgatgaggttaatgtaagctataacattacagaaacctttaacgaggtatacattaattcagatagtggaagagtaagaaggccccttatcgttgttaagcacggtaaaccacttgtgactaaggaagatatagagaacctgaaaaagggtaagataacctttgataccttagttaaagaggggaaaattgaattccttgatgcagaggaagaagagaatgcgtatatagctcttgagccaaaggatgtaaccaaggaccatacccacttagagatatgggctccagcaattctaggcataacagcttcaattattccataccctgagcacaaccagtctcctagaaatacctatcagtcggctatggcaaagcaggccttaggactgtatgcagccaattatcaaataaggacagacactagagctcatctccttcattatcctcagaagccaatagtccaaactagggctttagaggccataggatatacggagagacctgcaggaaataatgcgatatttgcccttatgtcctacacaggatacaacatggaagatgccgttatcatgaataagtcgtccgtggatagagggatgtttaggtccactttcttcaggctttactccgccgaggaaatcaagtatccaggagggcaagaggatgaaatccttcttcccgagcccggcgtaaggggatataagggaaaggattactataggcttctggaatctaacggaatagtttctcctgaggttgacgttaagggaggagatgtattaatagggaaggtaagcccaccaaggttccttcaggaattcaaggaattgtcacctgatcaggctaagcgtgatacgtcgataataactaggcacggagaacgtggtactgtagatctagtattggtgaccgagacctctgagggaaataagttagtaaaggtgagagttagggacctgagaataccagaaataggagacaaattcgctactagacatgggcagaagggagtaataggaatgctaataccccaagtggacatgccatatacaactagtgggctagttccagatataatactgaatcctcatgcgcttccctccagaatgactgtaggtcagataatggaagcgatagcaggaaagttcgtagcagccactggtaatcctattgacgcaacaccgttctataatactcccatagaggaaattcagaggaagcttctggaacatggttatctaagcgacggatcagaggttgtatatgatggtagaacaggagagaaattgaaaggaagaatattgtttggtatagtttactatcaaaaattacaccatatggtagcggataagatgcatgggcgtggtagagggccagttcaaatactcactagacagcccaccgaaggaagagctagggaaggaggacttagatttggggaaatggaaagggactgccttataggatacggtgcagcgatgttaatcaaggatagattactagataactcagatagggcaacagtatacgtttgtgaacagtgcggatatgtaggctggtatgataggactaagaacaagtatatatgcccaattcatggtgataagacaactttataccccgtggtaatatcatatgccttcaagttgttgcttcaggaacttatgagcatggttatcgcacctaagttagttctgggagacaaagttcctgttggaggtaattccaatgagtga

SEQ ID NO: 1652 - DNA, 1500 bp, Methanococcus vannielii SB
atggagtcccgtgttattgtagatgcattttttagagaaaacagtctggttaaacaccatattgattcttatgacgattttgttgaaaacaagattcaaggaatcattgatgaggtaactggcgttgaaacggaaatcaaaggaggttataaggtatcctttggaaaagtaagggtaactaaacccataaataaagaagcagatggttcagtaaaagaaataacgccaatggaagcaagaattagaaatcttgcatactctgcgcccctctaccttgaaatgatacctttaattggtgaaggtgatgaagaaaaaacactttcaccaattgaagtttatattggagaacttccagtaatgctcggtgcaaaaatctgtcatctctctggaaaaagcgaagaggacatgattaactatggtgaagatccaaaagacccattaggttattttattgttaatggttcagaaaaagctgttgttgcccaggaagatttgattccaaacagaatcctctgtgaaaaggttgaaaaaaacaacaaaattgttgatattgcaaaagtattttcaactagacatgggtttagggcgttatgtactgttgaaagaagtccagatggacttttaaacgtatctttcccaggtatgccaagcactattccgttagttatactaatgagggcacttggtgcggaatctgaccgggaaattatggaattaatttcagacgagcctactgtagtcatgcagttagttgcaaacttacaggaagctagagaagaacatgggataaacacaactgaagatgcacttgaacatatcggaaaaagagttgctccaggacagccaaaagaatacaaattaaaaagagctgaaacaattctatgtaattatttgttgccacatatgggaattgaatctgaaaaattaggtgctaaatgtaaataccttggaagaatggctaaaaattcaatagaactttatttaggttcaagagttgaagacgataaagatcattatgcaaacaagagattgaaattagcaggagacttgatggaagacttatttagacattcattcaaccagttaattaaagatattaaataccagcttgaaagacaggcaataagaaataaagaaccttctattcaagcggcagttagaagcgatgtgttaactgaaagaatgagacatgcaatggctacaggaaactgggtaggtggaagaacaggggtatcccagcttcttgataggactagttatcttgcaacagtatcccaattgagaagagttgtatcaccactatcccgatcacaacctcacttcgaagcaagagacttgcacgcaactcaatggggtaaaatttgcccatcagaaacaccggaaggtccaaactgtggtctggttaaaaatcttgcggtaatgtgtaaagtaactactgatgaagaagatgaaggtattattcaattaataaaagaaattggactttcaaaagacatttaa

SEQ ID NO: 1653 - DNA, 1533 bp, Methanococcus aeolicus Nankai-3
atggaatcccgtataattgttgacgaattttttaaagaaaatagtttggttgaacaccatattaactcatataataaatttgtggaaaatagcatccaaaaagttatcgacgaagcagctcctattgaggcagaagtaaaaggaggattcaaagtaaaatttggaaaagttagagtaggaaaaccgataaataaagaagcagacggctctgttaaggaaatttatccagttgaggcaagaattagaaatttatcctactcggcccccttatatttggaaattactcctataatgggcggaggtgaagatgaagaaggtaataaatatgaagtagaagagggagaaactgttgaggcctatattggggagctccctgtcatgcttggttccattatatgtcatttaaatggtaagtccgaagatgaattggtaaaaatgggggaagacgcaagagaccctatgggctattttattgttaatggttcagaaaaggcagttgtagcacaggaggatttaattccaaatagaatattgtgtgagaaagtagaaaaaacaggaaaaccagtttatattgcaaaagtattttcaacaagacatggatttagggcattatgtgctgtggaaaaacacgacgatggaagattaaatgtgtccttcccaggaatgtctggaaatattccacttgtgatattgttaaaagcattaggtgctgaaaatgatagtgcagtatttaaaataatttcggaagaccctgctgttagtatgcagttgatagcaaacatactagaaacaagagaggaacatcaagtaataacccgagaagatgctctggaatatatcggaaaaagagtggccccaggtcagccaaaagaatataggcttaaaagagctgaaactatactttgtaactatttattgccacatatgggcgttaaaaaggaaaatttgtttgaaaaatgtatttatttaggtagaatggccaaaaatgccatagaattatatttgggattgagggttgaagatgataaggaccactatgcaaataaaagattaaaattagcaggggaccttatggaagacctttttaggtattcatttaaccaattgaacaaagatatgaaataccaattagagagacaggcaataagaaataaatctccatcaattcaagccgcagttagaagtgatgttttaactgaaagaataagacatgctatggcaacaggaaactgggttggcggtagaactggagttagtcaattacttgatagaacaagttatttggcaacagtttcgcaacttagaagattggtatctcctttatctaggtcacagccacactttgaagcaagggatttacatgctacacagtggggaaaaatttgtccatcagaaactcctgagggtccaaactgtggtttggttaaaaacatagcagtaatgtgtgaaatcactacacaggaacaagatgataaaataattgatttattaaaagaatcaggatatgtaaaatcggctaaggatagttattaa

SEQ ID NO: 1654 - DNA, 1500 bp, Methanococcus maripaludis C7
atggagtcccgtgtcgttgttgatgcattttttaaagaaaacagtttagtaaaacaccacatcgattcctacgatgattttgtgaaaaataaaattcaaaagatcatcgatgaggtaactggtgtcgaaacagaaattaaaggaggatacaaagtatcctttgataaagtgagagttacaaaaccaataaataaagaagctgacggttctgtaaaagaaataacacctatggaagcgagaattagaaaccttgcatactctgcaccgctttaccttgaaatgataccgacagttggcgaagatgaagaagaaaaagtgttatctcctgttgaagtttacattggagaacttccggtaatgcttggttcagaaatctgccacttgtgcggaaaatcagaagaagaattaataaaatacggcgaagacacaaaagatcctttaggttattttattgttaacggttctgaaaaagcagttgttgctcaggaagaccttattcctaacagaattatatgtgaaaaggtagaaaaaaacaataaaatcgtagatatcgcaaaagtattttcaaccagacatggatttagggcattatgtactgttgagagaaacccagatgggttattaaatgtttcattcccgggaatgcctagcacaattccactagttatattgatgagagcacttggtgcagaatcagatagggagattatcgaattaatttcagacgaaccaacagttgtcatgcagttaattgcaaacttacaggaagcaagagaagagcatgcaataaacacgactgaagatgcactcgaacatatcggaaaaagagtagctccaggacagcctaaagagtacaagttaaaaagagcagaaactattctttgcaactatttattgccacacatgggcgtagaatctgcaaaattaggtgctaaatgtaaataccttggaagaatggctaaaaattcaatcgaactctacttaggattaagggttgaagatgataaggaccactattcaaacaaaaggttaaaattagctggagacttgatggaagatttatttagacattcattcaaccagttgattaaagatatcaaatatcagctcgaaagacaagcaataagaaacaaagaaccttcaattcaagctgcagttagaagtgatgttttaactgaaagaatgagacatgcgatggctactggaaactgggtaggtggaagaactggggtatcccaacttctcgataggaccagttaccttgcaacagtatcccaattaagaagagttgtatccccactttcaagatcacaacctcacttcgaagctagggacttgcacgcaacccaatggggtaaaatatgtccgtccgaaacaccagaaggtccaaactgtggtctggtaaaaaaccttgctgtaatgtgcaaagtaactactgacgaaagcgacgataacgtaatagaattattaaaagaactcgggctcacaaaggaaaactaa

SEQ ID NO: 1655 - DNA, 1569 bp, Candidatus Methanoregula boonei 6A8
atggtctatctgatcgacagaagcgttttatctagggcatactttgcacgggagcatgttgcgcgccaccagcttgactcctttaactatttcctgacagaaaatcttcagaaagtggtcaatgaacagaagattatcgaaaccgatatcgagaaccggggccggaataacgacccggtctgggtcgagctcggcaatattgaggtaaaaaaaccgctcgtgcgcgaggccgatggttcgcagggtgaactgtacccgagcgaagctcgcctgcgcaacctcacctacgcagcaccaattcagctcgggcttacgctcgtacacggagaggatcgccaggagccgatcgtcacgaccatcgggcagctgccgatcatggttggttcggttgcctgcaatctgtatggtatgagcgatgaggaacgcgtttcccatggggaagatgcgtttgacccgggcgcgtatttcatcgtcaacggcactgagcgcgtgctcatgaccttagaggatcttgcctccaacaagatcatgaccgagttcaccgagcggtataacgagcggatctatgtggccaaggtgttctcgcagttccgcggctaccgtgcgctcgttgttgtcgaacgcaacaagaagaatctgcttgaggtctcgttcccctcggttgcaggccacctcaagttcgtggacctgatgcgggccctgggcatgaccaatgatcaagaagtcgtgaatgcggtctcgactgatgaggacatcctcaccttcatgatgcagaacctcgaagaaagcgagtgcgactcggttgagggcggcgtcatgtacgtaggaaaaaagcttgcccccaaccagaccaaggactaccagaagaagcgcgccgagtttgtgctggacaattacctgcttccccacctcaactatgcgctgcctactaccctcaaggagggtgatgagggctatgatgaggctgttgcctcggtccgactcgcaaaggcgcacttccttggccgcatggcagaggcctgcttcgaccttgtgctgaacaagcgccggatcgatgacaaggatcattactccaacaagaggctcaagctcgcaggcgaccttatggaggatctcttccgtatctcgctcaaccgcttgacccgggatatcaagtatcagcttgaacgggcaagtatgcggcatcgcgacctctcgattgccactgcagtcagggccgatgtgctcaccgaacgcctgcttcaccctcttgcaaccggtaactgggtgggtgggaggactggtgtctcccagcttctggatcgggtagaccacatggcagttctctcgcacctgcgccgtgtcatctctcctctctcgcgctcgcagcctcatttcgaggcccgtgatctgcacccgacccaatggggccggatctgcccaagtgagacaccagaagggccgaattgtggtctggtaaagaacttcgcgcagatggtggagatcagcaaaggagtcaatgacgaagaggagatcatgcgcatcctgcattcactcaatgtcgagcacattcggggtgaagtcagatga

SEQ ID NO: 1656 - DNA, 1500 bp, Methanococcus maripaludis C6
atggagtcccgtgtcgttgttgatgcattttttaaagagaacagtttagtaaaacaccacatcgattcctacgatgattttgtgaagaataaaattcaaaagatcatcgatgaggtaactggtgtcgaaacagaaattaaaggaggatacaaagtatcctttgataaagtgagagttacaaaaccgataaataaagaagctgatggttctgtaaaagaaataacacctatggaagcgagaattagaaaccttgcatactctgcaccgctttaccttgaaatgataccaacagttggcgaagatgaagaagaaaaagtattatcacctgttgaagtttacattggagaacttccagtaatgcttggttcagaaatctgccacttgtgcggaaaatcagaagaagaattgataaaatacggcgaagatacaaaagatcctttaggttattttattgttaacggttcagaaaaagcggttgttgctcaagaagaccttattcctaacagaattatatgtgaaaaggtagaaaaaaacaacaaaatcgtagatatcgcaaaagtattttcaactagacatggattcagggcattatgtactgttgagagaaatcctgatggattattaaatgtttcattcccgggaatgcctagcacaattccactagttatattaatgagggcacttggtgcagaatcagatagggagattatcgaattaatttcggacgaaccaacagttgtcatgcaattaattgcaaacttacaggaagcaagagaagagcatgcaataaacacgactgaagatgcactcgaacatatcggaaaaagagtagctccaggacagcctaaagaatacaagttaaaaagagcagaaacaattctttgcaactatttattaccacatatgggcgtagaatctgaaaaattaggtgctaaatgtaaatatcttggaagaatggctaaaaactcaatcgaactctacttaggattaagggttgaagatgataaggatcattattcaaataaaagattaaaattagctggagacttgatggaagacttatttagacattcattcaaccagttaattaaagatatcaaataccagctcgaaagacaggcaataagaaacaaagaaccttcaattcaggctgcagttagaagcgatgttttaactgaaagaatgagacatgcgatggctaccggaaactgggtaggtggaagaacaggggtatcccaacttctcgatagaaccagttaccttgcaacagtatcccagttaagaagagttgtatccccactttcaagatcacaacctcacttcgaagcaagggacttgcacgcaacccaatggggtaaaatatgtccatccgaaacaccagaaggtccaaactgtggtctggtaaaaaaccttgctgtaatgtgcaaagtaactactgatgaaggcgacgatagcgtaatcgaattattaagagaactcggtctcacaaaggaaaactaa

SEQ ID NO: 1657 - DNA, 3348 bp, Nitrosopumilus maritimus SCM1
atggcagattcatccacaaaacgttggccagtaattcaagatattttgaaaagagagggtattgcacgtcagcacctaaactcatttgatgaatttttagaaagaggattacaaagtattatcaacgaggttggtcagatcgatattgaaaatgctgagtacccttacaaaattcaactaggtaaagtcaaattacaacaaccaagaatgatggaacttgatggttctattactcatatcactcctgcagaagctagattgagaaacgtatcttattctgcacctgtaatgatggaagcaagtgttgttgaagatggaaaaatccttgaatcaagatttgtccacattggtgatgttcccgttatggcaaaatcaaacgcttgtatcttacacaatttttctactcaaaaactagttgaacatggtgaggatccaaacgatcctggtggttactttatcattaatggttctgagagagtaattgttggattagaagatctttcttacaacaaaatcattgttgatagagaaacagtaggtggaaacattgtacacaaagccaaagtttattcttcaattgttggctatcgtgcaaaattagaacttgtcatgaaaaatgatggactaattgttgccagaattcctggttctccagttgatattccagtagttactttgatgagagctctaggtttagaatctgatagagagattgcagcagcagtttcattggtagatgaactccaagatgaactagaagcatcttttgaaaaagcaggagatgttccaactgcaaaagatgccattgtttacatcagtaagagaattgcccctggaatgcttgaagaatttcagattaaacgtgctgagactttacttgattggggtttgttgcctcacttgggcaaacaccctgaaaatagaaaagaaaaagcgcaattcttgggagaagcagcttgtaaattattagaactaaaacttgactggattagacctgatgacaaagaccactatggaaacaaagtcattaaatttgcaggacagatgcttgcagacttgtttagaactgcatttagaaatcttgtccgtgatatgaaatatcaattagaacgttctggacaaaaacgtggaattaatgcagtagctgctgcaattcgtccaggaattattactgataaactaaacaacgcaattgccactggaaactggggtcgaggcagagtaggtgttactcaattacttgatagaacaaactatctttctacaattagtcaccttagaagaattcagtctccactaagtagaactcagccaaactttgaagcaagagacctgcatgcaacacactttggaagaatttgtccaagtgaaactcctgaaggctctaactgtggtcttgtaaagaatcttgcattatctggaataatttctgtaaacgtaccatctgaagaaattgtagagaaactctatgatcttggaactgtccacttctttgatgcaaaagaagatttgaagaaagacggaactagaatctttgttgatggtagactaattggatattacaaagatggtgaacaactagcagaatctcttagagacttaagaagaaactcaaagattcatccacatgttggtgtatccttccacaaatctgaaattgaaggttcaacccgaagactttacgtaaactgtaatgcaggacgtgttttaagaccactaatcatcattaaagataacaaaccattacttactgctgatttactagacaaaatttcaaagaaactcatctcgtggactgatctcttgagaatgggtgttttggaaatgattgatgcaaatgaagaagagaactgttatgtcacactagatgaaaaggatacaaagaaacacactcaccttgaagtcttcccaccagcaatccttggtgcaggtgcttcaatcattccatatcctgaacacaaccaatctccaagaaacacatacgagtctgcaatggcaaaacagagtttaggattctcaacccctatgatgaatacaagtacatatgttagacaacactttatgctatatcctcaggttccaatagttaacacaaaagcaatgaaacttttgggattagaagatagacctgcaggtcagaactgtgtggtagcagtgttaccatttgatggttacaacattgaggatgccatcgttcttagtaaagcatcagttgatagaggattaggaagaacattcttctttagaatctatgatgctgaagcaaaacaatatcctggtggaatgcgtgacgcatttgaaattccaaatgctgaagataacatcagaggttacaagggagaacgtgcatacagactcttagaagaagatggtgttgttgcaacagaagctccagtaaaaggtggagatattttaattggaaaaactagtcctccaagatttatggaagaataccgagagtttgaatcatctggtccttacagaagagatacatcaattggtgttagaccttcagaaactggtgttgttgatactgtagttatgacccaatcaaatgaaggtggaaagatgtacaagattagagcaagagatatgagaattcccgaaattggtgacaagtttgcatcaagacatggacaaaaaggtgtcttaggaattttagctaaagcagaagatttgccatatactgcaagtggaatgtctcctgatgttttgattaatcctcatgcattcccatctagaatgactgttggtatgatgatggaatccatatgtggaaaatctgccgcattacgtggaaagagatttgatggttctgcatttgttggagaaaaaatggatgaagtaagagaagtaatggatgcacatggctttgaatattctggtaaagaaataatgtatgatggaagaactggaaaatcattcccagtcgaagttttcatcggagttgtatattatcaaaaattacaccacatggttgcagacaagattcatgcaagagcacgtggacaagttcaaatgttaacaaaacaaccaacagaaggaagagcaagaggtggtggccttagattcggtgaaatggagagagattgtcttattgcttatggcgcttctatgattcttaaagacagattacttgacgagtctgataaatctgatatttttgtatgtgagaggtgtggtcttgttgcttatcatgatgttaaacaaagaaaatatgtttgcagagtttgtggtgataaagccaaagtctcatcagtttcagttgcttatgcattcaaactactcttacaagagatgcagagcctcaacgtcgcaccaagattgttaatcaaggagaaactataa

SEQ ID NO: 1658 - DNA, 3384 bp, Thermoproteus neutrophilus V24Sta
atggtagatctcctcccccttcccgtcatcgtaagtcagcaggacgggaagttccccacgagagacgacaggtgggttctcgtggagaggtttataaaagacaaggggcttgctaaccaccagataaagtcctttaacgatttcttggataagaagttgcccaagatagtggaggacttcaaggtggttgagacggagataaagggtctcaagttggttcttgagcggattgaggtggggtggcccaagattaaggagagcgacggttccgaatccataatatatcccatggaggcaaggttgcgcaacgccacgtattcggctccgctgtatctcaccgcgactctatacgtcgacgacgagccgtatgtcaccgagactttctacatcggcgagttgccgataatggttaagtcgaagaggtgtaacctcaccaggttgaggcctggcgagtatataaagaagtttgaagatccgcaggacttcggcggctacttcatcatcaacgggagcgagcgggtgataatatcccaggaggatctggtggcggataggcctatctacgacaggggggataagccctctgtaaaatacatcgccaagacgatatccacaggcatagggtatagaagcacgctgactgttgagcttaaccgagacggcgttatctacgtcaccctttccgcgatgccggtcaagataccgttcccgatctacatgaaggccctggggcttgagacggacgaagacgtcgtcaaggccgtgtccgacgacccggagatccagaaggagcttctgccgtctctcatcgccgccaaccaaatagcgattacgagggaagacgccctagacttcatcggcggcaaggtggcggtgggtcagccaaagcccattagggtagagaaggcgtatcagctcctcgacaagtacttcctcccgcatctgggcactacgacccccgacgagaagaggcagcaggagattaggcttaagaaggcgttgatgttggggcagatcgtaaagggcttggtcgagttgcaactgggccgtaggaagcccgacgataaagaccatgttgccaacaagagggttaggctagtcggcgatttgatgacccagctgttccgcaccgtcttaaaacagtttctacaggagctcaagagccagcttgagaagtactacgccagggggaggataccccacatacagacgatagtgaggcccgacatcatcaccgagcgcgtgaggcaggccttggccaccggcaactgggtaggcgggaagacgggcgtgtcccagatcctagaccgcaccaactacatgtctaccctgagctacctcaggcgggtggtgtcgtcgctgtctaggacccagcctcacttcgaggcgcgcgacctacaccccactcagtggggcagactgtgcgccgtggagaccccggaaggccagaacgtgggcttggtcaagaacctggcgctactcgccgagatcaccaccggggtagacgagggggaggtggagcagttgctgtacaacctgggcgtggtgcctctgttgaaggccagggaggagggcatccgcggcgccgaagtctacataaacggcagattgatcggcgtgcatccaaacccggaggagctcgcgaaaaccgtcaggggcatgaggaggcaggggaagatcagcgacgagataaacatagcatacctagacggctccgtgtatgtgaactgcgacggcggccgcatcaggaggcctttactcgtcgtcgagggcgggaggctcaagctgacgaaggagatcgtggaaaaggtgagacgtggcgacttgacttgggacgacttggtcaagatgggggttatcgagtacctagacgccgacgaggaggagaacgcccacatcgccgttgacccagacgtcgacctcagcaactacacacatgtggagatcgtgccgtcgtctatactcggcgccgtgggctccattatcccctacctcgagcacaaccagtcgccgcgtaaccagtacgaagcagctatggcgaagcagtcgctcggcctaccccagtccaacttcttgtacaagctggactcgcggggccacatgttgtactaccccgagaggcctatagtgaccacgcgcggtttggagctcgtgggctactccagaaggccggcgggccaaaacgcggttgtggcgctactcacctacacgggctacaacatagaggacgccgtgatcttgaacaaggcctctgtggagcgcggcatgttccgctcggtcttctacagaacgtacgagaccgaggagcagaagtacccaggcggggaggaggacaagatagagatccccgacagctccgtcaagggctacaggggcccggaggcctacagccacctggacgaggatggaatagccccgcccgaggtctacgtcagtagcaacgaggtcctggtggggaagacctctccgccgaggttctacacaacgctggaggccgagcgtatcttgaaggagaggagggacgcctctgtggctgtgagaaggggggagaagggcatcgtggacagggtcatcattacggagtctccagagggcaacaagctcgtcaaggtgaggttgagggagctgagggtgccggagcttggggataagttcgcctcccgccacgggcagaagggggtcgtgggcatgttgcttaggcatgaggacatgccgtttaccgaagacggcatcgtgcccgacataatagtcaacccacacgcgttgccgtcgcgtatgaccgtggcgcaactactcgagagcatggccggcaaagtaggcgcctccctcggcgctttggtagacgccacagccttcgagggggtgaaggaggaggatctgaggaagctgttgcttaagctcggctacaagtgggacggcaaggaggtcatgtacagcggcatcaccggcgagaggctggtggccgacatattcataggcgttgtctactaccagaagctacaccacatggttgccgacaagatccacgcgagggcaaggggccccgtccagatcttgactaggcagccgaccgaaggccgctcccgcgagggcggtctgaggcttggcgaaatggagagagacgtgttgatagcccacggcgcctcggccctgctgtatgagaggcttgtggagtccagcgacaaatacaccatgtatgtctgcgagctctgtggactaccggcgtatctagacgccaagtcaaacaagcctaagtgccccatacacggcgacacaggccaattcgccaaggtggttgtgccctatgcctacaagctacttctacaggagctcatagcacttgggatatatccaaagctggagctcaccgaggtgttggagtag

SEQ ID NO: 1659 - DNA, 1566 bp, Halorubrum lacusprofundi ATCC 49239
atgaacaggcaagaccgacgcgtggtgtcacgtgagtatttctcggacgaacggctcgccgaacaccacttccgatcgttcaacaacttcctggaccgcggcatgcaggaggtcgtcgacgagaaggagacgatcgagaccgatatcggcgacaaagagggccaagagcccgtctacgtcgaactcggcgatgtgcggatggtcactccgcgcgtccgcgaggccgacggctccgaagagctgctgtacccccaagaggcccggcttcggaacatcacctactcggcgcccgtgttcatggagatgtccatcgtgcgcggcggcgaagacgagcccgagcaggtcgtcgacacgaccgagacgaaggtcggccggatgccgatcatggtcggctcgaacaagtgcaacatggccggcttctccgacgacgagctcatcgacatcggtgaagatcccgtcgaccccggcggctacttcatcgtcaacggctccgagcgcgtgctgatgacctcggaggacctcgcgccgaacaagatcctcgccgagtacgactcgaagtacggcgacgagatccaggtcgcaaagacgttctcccaacgccgcgggtaccgtgcgctggtgctttgcgagcgcaaccgtgaagggctgctcgaagtgtcgttcccgtccgtctcgggctcgattgacttcgtgaccctcgttcgcgccctcgggctcgaatccgacgaggagatcgttcaccgcgtctcggacgaccccgagattgtgaagttcatgctggagaacttggaggaggccgaggtgcagacgaccgagggggccatcgaaaccctcggcgagcgcgtcgcctccggacaggggaagaactaccagctcaagcgggccaactacgtcatcgaccgctacctcctcccgcacctccacgaggagggcgtcgacgaggaggacgtgcggatcaacaaggcgtactacctctgccggatggccgaggcgtgcttcgaactcgccttggagcgccgcgaggccgacgacaaggaccactacgcgaacaagcgcctgaaggtctccggcgacctgatgcgcgacctgttccggaccgcgctgaacaagctggcacgcgacgtgaagtaccagcttgagcgcgcgaacatgcggaaccgcgatctcacggtcaacacggttgtccgctccgacgtactgaccgagcggctcgaacacccgatcgcgacggggaactgggtgggtggtcgctccggcgtctcccagctcgttgaccggacggactacatgggtgtgctctcgcacctccggcgcctgcgctcgccgctgtcgcggtcgcagccgcacttcaaggcgcgagacctccacgcgacccagtggggtcgcatctgtccctccgagactccggaggggccgaactgtggactcgtgaagaacttcgcgcaggcgatggagctctcacaaaccgtagacgacgaacaggggctgaaacgagaactggcgtcgatgggtgtcgaggggattcccggcatcgagggcgtcgaccgacagacggcggacgactaa

SEQ ID NO: 1660 - DNA, 1566 bp, Halorhabdus utahensis DSM 12940
atggacacggaaaatcgacgcaccatatcacgggagtacttctcaagggatcgactcgccgaacaccacttccggtcgttcaacgcgtttctcgaccggggcatgcaggaagtcgtcgacgagaaagccaccatcgaaaccgacatcggcgacaaggagggcgaggaaccggtctgggtcgagttgggcgacgtccggatcgtcaccccgcgagtccgggaggccgacggcagcgaggaactgctgtacccccaggaagcccgcctccggaacattacctacgccgcgccggtcttcatggaaatggcgatcgtcaagggcggcgaggaagaggaagagcgggtcgtcgaccagaccgagaccaaggtcggccggatgccgatcatggtcggctcacagaagtgtaacatcgccggcttctccgacgaggaactcatcgacatcggcgaggaccccgccgaccccggtgggtacttcatcgtcaacggctccgagcgcgtcctgatgaccagcgaggacctcgcgccgaacaagatcctcgccgaatacgacacgaagtacggcgacgaggtgcaggtcgccaaaacgttctctcagcgccgtggctaccgtgcgctggtgctcaccgagcgcacccgggacggcctgctcgaagtctcgttcccgagcgtttcgggctcggtcaacttcgtgacactcgtgcgggcactcggcctcgaaagcgacgaggagatcgtccaccaggtcagtgacgatcccgagatcgtgaagttcatgctcgagaatctggaggctgccgaagtccagacccaggaggaagccatcgagacgctgggtcagcgcgtcgcctccggacagggcaagaactaccagctcaagcgggccaactacgtcatcgaccggtaccttctgccccatctccacgaggagggcatcgacgaggaggagacccggatcaacaaggcctactatctctgtcggatggccgaggcgtgtttcgaactcgcactcgaccgccgggagtcagacgacaaggaccactatgccaacaagcgcctgaaagtgtcgggcgacctcatgcgggacctcttccggacggcgctgaacaagctcgcacgtgacgtgaagtaccagctcgaacgcgccaacatgcgcaaccggcaactgtcggtctcgacggtcgtccggtcggacgtgctgaccgagcgactcgaacacccgatcgcgaccgggaactgggtcggcgggcgctccggcgtgagccagcttgtcgaccggaccgacttcatgggtgtgctttcccatctccgccggctgcgctcgccgctgagtcggtcacagccacacttcgaagcgcgggaccttcacgccacgcagtgggggcggatctgtccctcggagacgcccgaggggcccaactgtgggctggtgaagaacttcgcgcaggcgatggagctctcccagcacgtcgaggacgaacgggaactcaaacagacgctcgctgagatgggggtccagggcatccccgccatcgagacagccgcacaacagcccgcggacgattaa

SEQ ID NO: 1661 - DNA, 1512 bp, Candidatus Methanosphaerula palustris E1 9c
gtggcacgccatcaacttgactcttttaacaattttctccagtataacctccagaaagtcgtaaatgagcagcgggtgattgagacagacattgaaaaccggggcaaatccaacgaacccgtctgggtggaactcggtaccatcgaagtgaagaaaccgttggtccgcgaggccgacgggtctcagagcgaactcttcccaaccgaggcacgacttcggaacctgacctatgcggcaccgatgcacctggatatgacgctggtccagggggatgatcggcaagaagccgttctgactacgatcggacacctgccgatcatgatcggatcatcagcctgcaatatgtatgggatgcccaacagcgagcggattctgcatggagaggatcccctcgatcccgggggctacttcatcgtcaatggtacagaacgggtgctgatgactctggaggatcttgcatccaacaagatcatgaccgagttcaccgagcggtacaatgaaaggatctatgtggcgaaggtcttttcccagttccgtggctaccgtgcgctggtcgtcgtcgagcggaacaagaagaacctgctcgaggtctcgttcccatcggtcgccggacatttgaagttcgtggacctgatgcgtgcactcggcatggacagcgaccacgccgtcgtggaagcggtctcgaccgacgaggacattctgacctttatgatgcagaacctcgaggagagctcctgcgactcgatcgagagcgggatcatgtatgtcgggaagaaacttgcccctaaccagaccagggactaccagcgcaagcgtgcagagtttgtactcgacaactacctgctccctcacctcaactacctgatgccagcaaacctgaccgaggaagaccccggataccagacggccgtcgagggtgtccggctggccaaggcccatttcctcgggcggatggcagagtcctgtttcgacctggtgctggacaagcggcgtatcgatgataaagatcattactccaacaagcggctgaaactggccggcgacctgatggaggatctcttccggatctcgctgaaccggttgaccagggatatcaagtaccaactcgagcgggcaagcatgcgccatcgtgacctctccattggaacagcggtccgtgccgatgtgttgaccgaacggttgctccaccccctggctacaggaaactgggtcgggggacggaccggggtctcgcaactgcttgaccggatcgatcacatggccgtgctctcgcacctccgccgtgtgatctctccactctcccgttcccagccccacttcgaggctcgtgatctgcatccaacccagtggggacggatctgcccgagtgagacgcctgaaggaccgaattgtggtcttgtgaagaattttgcacagatggttgagatcagcaaaggagtgcaggacgaggatgagatcgttggtgtactctataatcttggcgttgaagcgctgaagggtgagatgagatga

SEQ ID NO: 1662 - DNA, 1563 bp, Halomicrobium mukohataei DSM 12286
atggacgtcaacgaccgacgtgcgatctctcgggagtacttctcgcgggagcgcctggcggagcatcacttccgatcgttcaactccttcctcgaccggggcatgcagcaggtcgtcgacgagaaggagacgatcgagaccgacatcggcgacaaggagggccaagagccagtcttcgtcgaacttggcgacgtgcgcgtcgtcacgcctcgggtccgcgaggccgacggcagcgaggaactgctctacccacaggagggccgactgcgaaacatcacctactccgcgccggtcttcatggagatggcgatcgttcggggcggcgacgaggaagaggaggtcgtcgtcgaccagaccgagaccaagatcggccgcatgccgatcatggtcggctcgaacaagtgcaacatcgacggcttcaccgacgaggagctgatcgacatcggcgaggacccggccgaccccggcggttacttcgtcgtcaacggctcggaacgagtcctgatgaccagcgaggacctcgcgcccaacaagatcctcgcggaacacgacaccaagtacggcgacgacgtgcaggtcgccaagactttctcccagcgccgtggctaccgcgcgctggtcctctgtgaacgaacgcgagacggcatcctcgaagtctccttcccgagcgtctcgggttcgatcaacttcgtgaccctcgtgcgtgcgctgggcctggagtccgacgaggagatcgtccaccgcgtcagcgacgacccggagatcgtgaagttcatgctggagaacctggaggccgccgacgtgcagaccaccgagggcgcgatcgagacgctgggcgagcgagtcgcctccggccagggcaagaactaccagctcaagcgagccaactacgtcatcgaccgctatctcctcccgcacctccacgaggagggcgtcgacgaggaggacgtacgcatcaacaaggccttctacctctgccggatggcggaagcctgcttcgaactcgcgctcggtcggcgcgacgcggacgacaaggaccactactccaacaagcgcctgaaggtcagcggcgacctgatgaaagacctgttccggaccgcgctgaacaagctggcacgcgacgtgaagtaccagctcgaacgggcgaacatgcgcaaccgtcagctctcggtgtcgacggtcgtccggtcggacgtgctgaccgaacggctcgaacacccgatcgcgacgggcaactgggtcggcggccgctccggcgtgagccagctggtcgaccggaccgactacatgggtgtgctctctcacctgcgacgcctccgttcgccgctctctcggagccagccacacttcgaggcgcgtgacctgcacgcgacccagtggggccggatctgtccgtcagagacccccgaaggacccaactgtggtctggtgaagaacttcgcgcaggcgatggaactctctcagaacgtcgaagacgaacaggatctcaaacaggaactcgccgacatgggggtccaggggatccccggaatcgagcgaatcgagcagccagcggacgattaa

SEQ ID NO: 1663 - DNA, 1023 bp, Dechloromonas aromatica RCB
atgaagccccggctgttattgaccgccctttgtctctccctgtcgctttctgcaatgccggcagtggccggcgacggccatgaccacggagatgccccgcccgctgccagcggcagtggccccaagcgccagccagacggcagtgtcttcctgcccaaaccggcgcaacgccagattggtgttcgtaccctgctggtagagctaggcgaactgccccgtacccatgaactggctggcaaggtggttatggacccgaacgccggcggcaaagtgcaggccatcgtcgccggtcgtgtcacaccgggaccacgaggtctgccgctgcccggccaagcagtcaagaagggcgaggtgctcgcctacgtcacgccggaggtcggcggcaacagccgttccctggccgaaagccgcctgcgccgcctacgcgaactctccgacactgtgccgcgcaaggtcatcgaggaagcagaagccgccgtggccaacgagcaactggtggcgccggtcagcggcgttatcgcctcggccaacgtcgtctccggtcaggtgctcgaagcccgcgaaaccctgttcgagatcgtcaatccggaacgcatgctgatcgaggcgctggctttcgacatggccgtcgccagcgatgtggccggggcctttgtcgccgtcggtgagcagaagctgccgctgcgcctggttggcgtcgcccgcagcctgcgcgagcaagcactgccgctgaccttccggggtgaaggcggcgctttggcggcgttggccgtcggccagccggttcgggtcttcgtgcagacgcgcagcacggtgccgggcatccgcgtgccgatggcggcgctgatgaagaaccctgcgaaccagagcatcgtctggatcaagacggcgccggaacgctttgagccgcgcacagtaaccgccgagccgctggacggcacccacgtggcggtgaccagcggtctgaaagccggggatcgggttgccgtccgcgcggccactctgattaaccagatacgctga

SEQ ID NO: 1664 - DNA, 1119 bp, Acidovorax sp. JS42
atgaagcgcgcttctttgcatcgcctggcctggctcggcgtggtgctggcactcgtgggcccactgaccgcgcaggccggggaaggccatgaccacggcgacgcacccgctgcgccgagcgcaaacggcccccaacgccagcccgacggcagcgtgttcctgcccaagccggcccagcgccagctgggagtacgtacgatggtggctgctgaggccgagctgccgcgctcggtcgagctgaacggcaaggtgctgatggatcccaacgccggcggcaaggtgcagccgctgaacgccggccgcatcgagcccggtccacgcggcctgcccaacccgggacaggtggtgcgcaagggcgaggtgctggcctacgtggtgccctcgaccgcgcccatcgagagatcgaatcaatccgcgcaattggccgagttgcgcgcggccaagtcgctcgccgacaagcgcgtgacgcggctgaaggagttgtcggataccgtgccgcgcaaggacatcgaggcggccgaaagcgaggcagccagcctggccgagcgcatggcggccgttggcggcggcctggcaacgcgggaagcgctggtggccccggtgtcgggcgtgatcgcctcggcccatgtggtggccggtcaggtggtcgatgcccgcgaactgctgttcgagatcatcgacccgagccgcttgcgcatcgaggcactggccttcgagccctcgctcgcggccaatgtcggcagtgccacgctggcagtcggtgaccagcgtgtgccgctggagtacctgggtgcggcgcgcagcctgcgcgagcaagcgctgccgctgggcttccgcgctcagggtgcggccctgaacggcttggccgtaggacaacccgtgcgcgtcttcgtgcagacgaagcagaaggtcaagggcatcgcggtcccggtcgcgtcgctgatgaagaacccggccaaccagaccgtcgtctgggtcaagacttcgcccgagcgcttcgagcctcgcagcatcacgaccgaggccctcgatggtgtgaacgtcgcggtcacatcgggcctgaaggccggggaccgcatcgccacccaaggcgccaccctgatcaaccaggtgcgctga

SEQ ID NO: 1665 - DNA, 1134 bp, Polaromonas naphthalenivorans CJ2
atgaagacacgctttgtgatctcagcagcaggcgccgccttctctgcggccttgttgacgttcacggtcccggtctgggcttcgggagatcacgaaggtggtcacggcgctgccgaggccgacctttcggtcattggcagtggcccgaaacgattgcccgacggcagcgtcttcctgcccaaaccagctcagcgccagatgggcgtgcgcacgctggttggcgagtcgaagcagttgccgcgggcgaccgagttgtctggcaaggtcgtcatggaccccaacgccggcggcaaggtgcaggccttggtggccggccggctgcaagccggtccgcgcgggctgccatcggtcgggcaagccgtgcgcaagggagaggtgctggcctatgtgctgccttccgtagcggcaatcgaacgctcgaaccaggcggctcaactggccgaactcggcgccgaccggagtctggccaacaagcgcctggcgcgtttgaaggaactggccgataccgtgccgcgcaaggagatcgaagcggcagaaagtgaagtggccagccttggtgcgcgcctggcagcggtgggggtcgggctgtcggcgcgcgacacactggtggcgccggtgtcgggggtcattgcttcggccaacgccgtggcaggccaggtagtcgatgcgcgtgaactgctgttcgaggtgatcgatccctcgcgtttgcgcatcgaagcgctagccttcgacgccgcattggctgcggatgtggggggcgcctttttgacagtgggcggccagaaggtgccgctcgtcttcgtgggcgcgtcgcgctcgctgcgcgagcaggcgctgccgctggcctttcgggccgaaggcgcggcgctcagtcagcttgccgttggccagccggtcgccgtggtgctgcaaagccgcagccaggtaacgggcgtgccggtgcctgctgcatcgttgactaagaatccggccaaccagaccgttgtgtggatcaaaactgcgcctgaacgttttgaggcgcgcgttgtcacagtggagccgctcgatggcgcgacggtggcagtgacttcaggcctgaaggccggtgatcgtgtggccacacaaggcgccacgctgatcaaccaaatccgctaa

SEQ ID NO: 1666 - DNA, 1113 bp, Methylibium petroleiphilum PM1
atgaagcgcgccctgatcgcctccagcctcgcgctgctgatcgcctcgaccgggcttgccccggtccatgccggcgaaggacacgaccacggcgacgcccccgcagcgcccagcgccaacgggccgcagcggcagcccgacggcagcgtcttcctgcccaagccggcgcagcgccagctgggcgtgcgcacgctcgtcaccgaagctgccgaactgccacgcaccgtggaactgggcgccaaggtgctgatggacccgaacgccggtggcaaggtgcaaccgctgaacgccggccgcatcgagcccggcccgcgcggcctgcccaaccccgggcaggcggtacgcaagggtgaagtgctggcctatgtcgtgccgtcggctgcgccgatcgaacgctccaaccaggccgcgcagctcgccgaactgcgtgccgccaaggcgctggccgacaagcgcatcgcccgcctgcaggaactggccgacacggtgccgcgcaaggagatagaagcggccgaaagcgaagccgccagcctgacggcgcgcatcgcagccgtcgggggtggcctgtccacccgcgaggcgctggtcgcgccagtgtccggcgtcatcgccgccgccaacgtggtggccggccaggtggtcgatgcccgcgaactggtcttcgagatcatcgacccctcgcggctgcgcatcgaggcgctggccttcgacgctgccatcgcagcgaacatcggcacggcgacgatggccgtgggcaaccaacgtgtgccgctgaccttcatcggcgccacgcgcagcctgcgcgagcaggcgctgccgctcgccttccgggctcagggtgatgcgctgaccctgctggcagtcggccagccggtgcgcgtgttcgtgcagaccaaggacaagatcaagggcatctcggtgcccgtcgcctcgctgatgaagaacccggctaaccagaccgtcgtgtgggtcaagacggcgccggagcgcttcgagccccgaaccgtcaccaccgagccgctggacggcgtcaacgccgcggtcacgtcgggcctggagccgggcgaccgggtcgcgacgcaaggcgccaccttgatcaaccaggtgcgctga

SEQ ID NO: 1667 - DNA, 1119 bp, Methylibium petroleiphilum PM1
atgaagcgccccgccctgacggccgcgggcgcggccctgctgatcgccctgacgacttgcatcccgatggcccgtgccggcgagggccacgaccacggcgacgcgcctgcggcgcccagcgccaacggcccgcaacggcaacccgacggcagcgtgttcctgcccaagccggctcagcgccagctgggtgtgcggaccgtcgtgagcacggccgccgatctgccgcgcacggtggagctgggcgcccgcgtgctgatggacccgaatgccggcggccgggtgcaggcgctgcacgccggccgcatcgagcccggcccgcgcggcctgccccaccccgggcaggcggtgcgccgcggcgaggtgctggcccacgtgctgccgtcggccgcgccgatcgagcgctccaaccaggctgcacagctggccgagctgcgcgccgcccgggcgctggccgacaagcgcgtcgcacgcctgcaggcactggccgacacggtgccgcgcaaggagatcgaggccgccgagagcgaagcggccagcctggcggcgcgcatcgcggcggtgggtggcggcctggcgctccgcgagccgctgacggcgccggtggcgggcgtgatcgcctcggcgcacgtggtggccggccaggtggtcgacgcccgcgagctggtgttcgagatcgtcgacccgacgcgcctgcgcatcgaggcgctggccttcgacgccgccctcgcctcgaacatcggcagcgcgacgatggccgtcggcgagcggcgcgtgccgctggtgttcgtcggcgccgcacgcagcctgcgcgagcaggcgctgccgctggccttccgcgccgagggcgcggcgctggaggcgctggccgtcggccagccggtgcgggtgttcgtgcagacgcgcgacaaggtgcagggcatcgccgtgcccgtggctgcgctgatgaagaacgccgccaaccagaccatcgtctgggtcaagacggccccggagcgcttcgagccccgtgcggtgaccaccgaagcgctggacggcgtgcacgccgcggtgacctcgggtctgaagcccggtgatcgggtcgcgacgcaaggcgcgaccctgatcaaccaggtccgctga

SEQ ID NO: 1668 - DNA, 1110 bp, Delftia acidovorans SPH-1
atgaagtacttcctttcagctctcatggtcgcactgtgcgcctccgttcacgccgctcctggtgcgcatggccccaatggcgagcatcttgacggcccctccgtccccacaacgtccaatagcctgagccgattgcctgacggtagcgtcaacgtaccgatgctcgcccaacgacgattggcgattcggaccacgttcatcaccgagcaggatgccggcgtgacggtgcaactgcctgctcgcattgtcatggaccccaatgcaggtggtcgagtgcagacggcgctgggcggccgcattgaggcaggtcccagagggttgcctgtcgcggggcaagcggtacgcaaaggagatgtcctcgccgttgtcgcgcaccagccagaccccatcgcactggcgaaccagcatgcagccttggcagagctccgcagcggcctggaattggctcgccaacgagtcaaacggcttgaaggcctcgaagggtctgtacctcgcaaagacattgacgcagctcgagcggaacgctcaggtctggaagctcggtcatccgcagtgggggccagcctgagcacacgggagaggttggtggctccgataaccggagtgatctcccgcgcggatgccgtggcaggacagttcattgagccacgcgatgtggtgtatgagattgttgacccgggccgtgtactggtggaggcatcgacagccgatgcagcgctggcgggcaagctgtcctccgcctccttgtcaggcattccagatgccgaactccaactcattggagccgcgcgcgccttgcgcgatggcgtgttgccactcacgttccgattgagctccaagcaggcgcttgccgtggctgtgggtcagccggtcacagtgctggccacccgcaaagacacgaccaagggctatgtcctgccggcgcaagctgttacccggaacgctgcgaatgagcccgtcgtttggattaagtccggagccgagcggtacataccgcagccagtgcagtttcgccccttggatgcccagcgcgtggtggtcacgcaaggtctgggcagcgacaaccgggtcgtggtccagggtgcaccgctgattgcacaaatccgctga

SEQ ID NO: 1669 - DNA, 1107 bp, Leptothrix cholodnii SP 6
gtgaaaatcatcctcaccctcctgagcctggccctcgtcgccacggcccatgccggccccggggcgcacggccccaacggcgagcacctcgacacgcccagcgtgagcacgcccgacggcctggcacgcctgcccgatggcagcgtgaacgtgccgatgctggcgcagcggcgcttgggcctgcgcacgctgctggcggtcgaaagcgatgccgccgctaccgtggaactgcccgcgcgggtcgtcatggaccccaattcggcgggccgggtgcagacgctcatcggcggcaaggtcgagcccggccccaagggcctgccgatcgccggacagcgggtgcgccgtggtgacgtgctgggttacgtggcccaccatgtcgacccgctggccgcggccagccagcaggcccagctcgtggagctgcgcagcagccgccagctggccgagcagcgggtccagcgcctgcagtcgctcgaaggcacggtgccgcgcaaggagatcgacgcggccaagctggagctggacagctacaccgcccgcgaaaacgccatcggcgccagcctgggcagcaaggagcggctggtcgcgccggtttcgggcgtcatcgcgcgcgccgacgtcgtcaacggccaggttgtcgaatccaaggacgtgctgttcgaggtgatcgacccggcccgcatgctgatcgaagcgagcgtggccgacgtcaagctgagcacgcagctggccggcgccacgctggcgggcatcgccgactggaagctgcagttccttggcgcggccggtgcgctgcgcgacggcaccctgccgctgaccttcaaggcgaccggaaccggcgccacgccgctggccctcggccagccggtgaccgtggtggcggcgctcaccaacaaggtcaagggcatcgtgctgcccgcgcaggcggtgacgcgcaattcggccaacgagactgtggtctggatcaaggccggcgccgagcgctacatcccgcagccggtgcaggttcgaccgctcgatgcgcagaccgtcgtgatcacgcaggggctcggtgccgacaaccgggtggtcgtgcagggcgcgccgctgatcgcgcagattcgctga

SEQ ID NO: 1670 - DNA, 1113 bp, Thauera sp. MZ1T
atgaaaccgggaatcctgctggtcatgctgtgcctcgttacggcaagtgcatcgtggaacgcattcgctggcgacgggcacgatcacggcgacgaaggctccgcgcccgtcggcggcaacggtccgcgacgcttgcccgacggcagcgtattcctgcccaagccggcacaacggcagatcggcgtgcgcacgctggtcacggaagcgggggagctgccccgcaccgtggcgctcgccggcaaagtggtgatggaccccaacgcgggcggaaaagtgcaggcgctggtcgccggccgcctcgaagccgggccgcgcggcttgcccggagtcgggcagaccgtgaagaagggcgaggtgctggcgtatgtcgtgccgtcggcggggcagatcgaacgctcgaaccagatggcgcagctcgccgagttgcaggccgccaaagtgctcgcggagaagcgcgtggcgcggctgaaggagctcgccgacacggtgccgcgcaaggagatcgaagcggccgagagcgaactcgcgagtctcgcggcccgcgcgacggcggtgggtgcggggctcagcaatcgcgatgcgctcgtggcgcccgtcgcgggcgtcatcgcgtcgagcaacgccgtcgccggtcaggtcgtcgatgcgcgcgaactggtgtttgaaatcgtcgatccgaagcgcctgcgcgtcgaggcgctggcctacgatgccgacaccgccatcgatgtggccggcgcgagcgttgcggtgggcgagcaacgagtgaggctcgacttcctcggcgcggcgcgcagtctgcgcgagcaggcgctgccgctcgctttcggtgccgcgggcgattccctggcgcgtttcgctgtcgggcaaccggtcgaggtgttcgtgcagacgcgcagcacgctgcagggcgtgagcgtccctgcaggatcggtgctgaagaacccggcgaaccagatcatcgtgtgggtcaagaccgcgccggaacgcttcgagccgcgcaccgtcaccatcgccccgctcgatggggcgaacgtcgccgtgacgtcgggcctcgcggccggggagcgtgtcgccacgaacgcggcaaccctgatcaaccagatccgctga

SEQ ID NO: 1671 - DNA, 1116 bp, Diaphorobacter TPSY uid29975
atgaagcgcaacttccgtttcctaatgacgacggccatggcggctgcattggctctggctgctcccgcgttcgctcacgacggccatgaccacggcgacgaagcgccggctgcgtcttccaatggcccccagcgccagcctgatggcagcgtgtttcttccgaaaccgtcgcaacgtcagatcggtgtacgcacccagctgatcaagcaggagcccttggcccgcagccatgaactggctggcaaagtaatcatggacccgacgacaggcggcaaggtccaggcaatggtaatgggccggctggtgcccgggccggatggtctgccgcagatcggccaatccgtgcgcaagggccaggtgctggcttacatcgaaccggccagcggtgtgctggagcgctcaggccagatggcccaggttgccgagctgcgtgcgggccaagcgctcgcgcagaagcgcttggcccggctgcgcgagctgtcggagaccgtgccccgcaaggagatcgaagcagccgaaagcgaagtgaacagcctgaccgaacgcgcccgcgccttgagcgggggcctcgccggcagggacgtactgaaggccccagtcagcggcgtcatcgcatccagccccgcagttgccgggcaggtcgtggatgcgcgcgaactggtgtttgaggtggtcgatccgacccaactgcgcatcgaggcgcttgcctacgatccggcaatggcacagaacctggccggtgctgcactcgcagtaggcggtcagaaggtgccgctgagcttcgtcggtgccgccagcagcctgcgcgagcaggccctgcccatgctgttcaagggcaccagcgaaagcctctcgcgcttggcggtcggtatgccggtggtggtcttcgtgcaagaggcgacgacggtacctggctaccgcgtgccttccggtgcgctgatgaagaaccctgccaaccagaacatcgtctgggtcaaagaccaggccgagcgcttcgagccgcgtgtcgtgaacatcactcctttggatggtgcatccatcgctgtcacttcgggcctggcggacggcgaccgcgtggttgtcgagggcgcgtccctgatcaatcaagttcgttga

SEQ ID NO: 1672 - DNA, 1101 bp, Azotobacter vinelandii DJ
atgaaagcgaacttcctgattttcgccgcctgcctgagcctgggcgctccggccctggcggacgacggccacgaccatggcgaggccgcgccggtggccaacgccaacggtccccagcgtttacccgatggcagcgtgttcctgcccaagccggcgcagcgccagctcggcgtgcgcacgctgccggtgagcctggacgaactgccgcgcagcttcgaactgagcggcaaggtggtcatggatccgaacgccggcggcagggtccaggccatgctggccgggcgcctggaggccggaccgcgtggcctgcccggcatcgggcagactgtgaagaaaggcgaggtcctggcccatgtggtggccagcagcgacgtgctggagcgggccaaccaggccgcgcaactggcgcaattgcgcgccgcccggcaattggccgagcagcgtgtggcgcggctgcgcgaactgagcgacacggtgccgcgcaaggacatcgaggcggcggccagcgaggtcgccagtctggcggcgcagatcgccgcgctgggtgccggcgccggggcgcgcgaagcgctggtggcgccggtttccggggtgatcgcctcggccagcgcggtcgccggccaggtggtcggcgccggcgaactgatcttcgaagtgatcgacccgacccggctgcgcgtcgaggcgctggtctacgacccgcagcaggccgccgacgtggcgggcgccagcctggccgtgggcggcgagcgcgtgccgctgactttcgtcggctctgcccgcagcctgcgcgagcaggcgctgccgatgctgttccagggcgagggcgaggccctggcgcgcctggcggtggggcaggcggtgcgggtcttcgtgcagagcgccagccgggtcagtggcatccgcgttccggcggcgtccctgatgaaaaatgccgccaaccagaacgtggtctgggtcaagaccgcgccggaacgcttcgagccgcgcgtcgtcgtcttcgccgtgctggacggcgcctcggtggcggtgaccgccgggctgcaggccggcgagcgcgtagtgacccaggccgccggcctgctcaaccagatccgctga

SEQ ID NO: 1673 - DNA, 945 bp, Thermobifida fusca YX
atggtcgttgccgcactgctcacgttgatcgcaggcggctgccttctcgccgcccaccacctgctgcgtgcccagtggccttcccgaggcccgcatgtcgctgtggtcgcctggcaggcgctggggctggcgtgggggatatccaccattggcgccctgctagcgttcggcctcgccccctacgggcagggaattcttctcggtctggccgccctcgccgaggatgctgccgcgaacggcctccaactgggggttctggctgaggggcacttcgctgcaacccgcgtggcagcaatcgtcgccgcggtcggcctgaccaccgtgctcctctgggggctggcggtctccttcatccaggtcgtgcggacccgccgccgccatcgggcacttctcgccctggtcgcccgcgaccacccggagattcccggggcgcgggtgctcgaccatcccgcagcggcggcctactgcctgcccggcgtgctgaacccgcagatcgtcatcagcgcgggagccctggaagtactggaccgccgagagcttgccgcagtcctcgcccacgagcacgcccacctgcggcaacgccacgaccttgtcctcctcccgttttcttcgctgaaacgcgccttcccgaagatccggctgatggaacgctgctacaacgcggtggcgctcctcatcgaaatgtgcgcggacgaccatgcccgccgctaccactcgccccgcgagctggcgacggcattggtgcggttcggcgcggcaggcaaggcggcaatccccctcggcgccatggcggtggtgcccaacgagaaccagcccgaggtgttggcgcgggtttcccggctgttgaacccggtgaaactgtcccgcagggccacggcggcggtgttgagcgggtcggcttccctcatggcggtgaccctaacactgtggcatctgcctctgtaa

SEQ ID NO: 1674 - DNA, 1224 bp, Frankia CcI3
atgacgaccgcggcacttctcgccctgttcgcgggcgtgttggcctggccggtcccacgcctgctggccgccgcgcgctggccctaccgatgtccacgggcggcgatcgtgctctggcaggcggtcggtctggccggcggagtgtcggcgctactcgcggcgatcgcgttcaccgtctcaccgctgtccggcgacaccccgaccgccatcgtcgaccatctcgacaacatcgcggccggcgcgccgctgacgggcctgggcctgatcaacctcatcggcctcgctgtggcggcggccttggcctcccggctgttcggggtgctcggcacctccagcgccgccacccttcgcgagcgtcaccgacaccgcgacctggtcgatctggctggccgtcggcatcgccggcatgagacctgcgtcccgcccggccatgcgtcccatcattccggcacagccgcggactctggtgcggccaccgaccctggcacaaccgccgacggcgggggcgcaaccggctgctgcctgtgcgaacaccgggaccgggccggcattctactgcgtatcctcgatcatcccgtcgcggtcgcctactgcgtgccgggggtgcggcacgcccgggttgtggtctcccgcgggctactgaacaccctcgacgccaccgaactggacgccgtgctcgcccacgaggcggcccacgtcgccggtcgtcacgacctcgtcatccagccgttcgtcgcgtgggagcggaccttcccgttcctggacccggccagggaggcgaccgcggccgtctcgctcctcgtcgagatgctcgccgacgacgcggcggcccggcagacaagccgccgatcgctcgcgcgggccttggcccggctgggcggggcaagggcaccggtccccgccggggcgctggggatcatcgattctccggccgctgtgctgcccgcactcggctcccacgagcctacggcggtcggcgtccgcgattccggcccgcccggcccgggcaacccagacgccggcgggccagaccccggcgatgcggcgcccggccagacacgaccggtcggcggcggcccccggcgcggcacggccaatccggtcatctcgcggatcacccggctcctcgacccgccggaagtgccatggtggatgccgccgtgcgcctacttcggggcgatcatcgtgctcgccgcgcccccgcttattctcctagtcggctga

SEQ ID NO: 1675 - DNA, 951 bp, Mycobacterium MCS
gtgtccgcgctggccttcacccttgtcgcgctgctccttgtggggccggtgccggcattgttggcccgcgcgtcctggccgatgcgcgcgccgcgcgccgccgtggtgctgtggcagtccatcgcgctggccggtgtgctctcggcgttctccgcgggtatcgcgatcgcgagccggctgttcgtccccggtcccgatggcagaccgaccgccaccatcaccagcgagatcgaggtgctcgggtggccgttgtggctgctctacgtcgtggtcttcgccctcacgctgctcatcggcgtccgcctgatcgtctcggtgctacaggtggccgtcgccacccggcgcaggcgcgcccaccaccggatgatggtcgatctgctcggggtctcccgcgactcggtgcccaccgacgtgcgccgacaggcgaccggcctgcgcgtactcgacgtgaagcaaccgctggcctactgcctgcccggggtgcgcagtcgggtggtgctcagcgacggcgcgctcaagaccatgacccgcgacgagatcgccgcgatcctcacccacgaacgcgcacatctgcgggcgcgacacgatctcgtcctggagatgttcaccgcggtacacgccgcgttcccccggttcgtccgaagcgccagcgccctcgacgcggtgcgcctgctggtcgaactgctcgccgacgacgccgccgtgcgcaccgccgggcccaccccgctcgcccgcgccctcgtcgcctgcgccgcgggccgtgccccgtccggtgcgctggccgcgggtggtccgagcaccgtgatccgcgtgcgccgactcgggggcctgccgaacagcctggcaatcgccgcggtcgcgtacctggccgccgcggtggtgctggtcggccccacggtggccgtcgccgtgccgtggctgaccgaactgcaccgcctgttcatccgctag

SEQ ID NO: 1676 - DNA, 1005 bp, Arthrobacter FB24
atgttctggacctcatatttgctggcggtcctggcgatagtcctggcgtggccggtgcctatcctcctttcgcgcgcgcaatggccggcccgatcacctttcaccgccatgctgctctggcaggcgatcggcctcgccggcggcctgtcaatgatcggcgccatgctggtttacgggctcgagccgatcggtgacaatctcctggccggactgcgcggtctggccggcatggtccttttcgatgcgcccacgacggcactggggttctggcaccttttcgcgctgtcggcagcggccctcctcaccgcgcacctcgtgtttaccctgctgctgacctactaccggatcgaacgccagcgcaggcgccaccgcgaactcctggcgcttctggcgtcaccgtcgacggacggtccgggaaccgtggtcatcaaccacgattcacccgtggcgtactgcctccccggcggcgcccgctccgtcaccgtcctgagcgacggcctgatggcggcgctggagcctgcagagcttcgcgccgtcctgatccacgagaacgcccacctgagccagcgccaccacctcctgctgtgggctttcgcggcgtggcgccaggccctcccctggctgccgaccacccgactagcccaggaagccgtgagctccctgatcgaaatgctcgctgacgacgtcgccctgaagaccgaaagcaaagccacactgatcaaggcgatcgccatcgttgccagcggaccaagcggtgtgcccgccagccgggtggggttcaacggcgccggacttccgtcggcagcagatggaatagtcgacggcggcatccagggagcgtccggcggtgccggttctgccggcaccacggcatccagggtcagccggctgctgtctccccaggacccgctgccggctccgctgcggggccttgtcctcgcaggctgcctgctgctgctggcattgcccacagccctgctgattgtccccgggctgctcggctag

SEQ ID NO: 1677 - DNA, 951 bp, Mycobacterium KMS; identical to SEQ ID NO: 1675

SEQ ID NO: 1678 - DNA, 936 bp, Mycobacterium vanbaalenii PYR-1
gtgtccgcgctggccttcacgatcgtcgccctgctgttgtcggggccggtgcctgcgctgctggccagagcgtcatggccgttgcgcgccccccgcgccgcgatcgtgctctggcagtcgatcgcgctggccgcggtgctgtcggcattctcggccgggatcgcgattgcgagccggctcttcgtgcccggtcccgacggcaggcccaccgccaccatcgtcagtgagatcgaggtgctgggctggccgctgtggaccgcgtacgtggtcgtcttcgtcctcaccttgatgatcggcgcaaggctgatcgtgtcggtgctgcaggtcgccatcgccacccgccgccgtcgggcccaccaccgcatggtggtcgatctggtcggctcccacgatcaccggcaccggtcgggcgccggcctgcgcattctcgacgtcgccgaaccactggcctactgcctgcccggggtccgcagccgtgtcgtggtcagcgagggtgcgctgaaagcgttgtccgacaacgaaatggccgccattctggaacacgagcacgcccacctgcgggcccgccacgacctggtgctcgagatgttcaccgcggtccatgccgccttcccgcggctggtccgcagcgggcacgcgctcaacgccgtgcggttgctgatcgagttgctcgccgacgacgccgccgtgcgggccgagggtccgaccccgctggcgcgggcactcgtggcctgcgcctccggccgggctccccgcggcgcgctggccgccggcggaccgaccacggtggttcgggtgcgccgcctcggcggtgcgcccaacagcaggatccttgccgccggcgcgtacatcaccgccgcggcggtactggtcgtgccgacggtcgcgctggcagtgccgtggctgaccgagctccagaggctgttctcggcgtag

SEQ ID NO: 1679 - DNA, 951 bp, Mycobacterium JLS
gtgtccgcgctggccttcacccttgtcgcgctgctccttgtggggccggtgccggcattgttggcccgcgcgtcctggccgatgcgcgcgccgcgcgccgccgtggtgctgtggcagtccatcgcgctggccggtgtgctctcggcgttctccgcgggtatcgcgatcgcgagccggctgttcgtccccggtcccgatggcagaccgaccgccaccatcaccagcgagatcgaggtgctcgggtggccgttgtggctgctctacgtcgtggtcttcgccctcacgctgctcatcggcgtccgcctgatcgtctcggtgctacaggtggccgtcgccacccggcgcaggcgcgcccaccaccggatgatggtcgatctgctcggggtctcccgcgactcggtgcccaccgacgtgcgccgacaggcgaccggcctgcgcgtactcgacgtgaagcaaccgctggcctactgcctgcccggggtgcgcagtcgggtggtgctcagcgacggcgcgctcaagaccatgacccgcgacgagatcgccgcgatcctcacccacgaacgcgcacatctgcgggcgcgacacgatctcgtcctggagatgttcaccgcggtacacgccgcgttcccccggttcgtccgaagcgccagcgccctcgacgcggtgcgcctgctggtcgaactgctcgccgacgacgccgccgtgcgcaccgccgggcccaccccgctcgcccgcgccctcgtcgcctgcgccgcgggccgtgccccgtccggtgcgctggccgcgggtggtccgagcaccgtgatccgcgtgcgccgactcgggggcctgccgaacagcctggcaatcgccgcggtcgcgtacctcgccgccgcggtggtgctggtcggccccacggtggccgtcgccgtgccgtggctgaccgaactgcaccgcctgttcatccgctag

SEQ ID NO: 1680 - DNA, 936 bp, Mycobacterium gilvum PYR-GCK
gtgtccgcgctggccttctccctcctcgcgttgctcctctcggggccggtgcctgcgatgctggcgcgagcagcctggccactgcgcgctccgcgggcggcgatcgtgctgtggcagtcgatcgcggcggccgcggtgctgtcggcgttctccgccggaatcgcaatcgcgagcaggcttttcgtacccggtcccgacggcaggcccacctcgacgatcgtcggtgagatcgccgtcctggggtggccgttgtggaccgcctacgtcgtcgtcttcctgctgacactcgtcatcggcgcccgattggtcgtctcggtactcaacgtcgcgatcgcgacgcggcgacgccgggcacaccaccggatggtcgtcgacctcgtcggggcccaccacagccggacccgctcccgcagcagcctgcgcgtcctcgacgtcgacgaaccgctggcgtactgccttccgggtgtccgcagccgcgtcgtcgtcagcgagggggcgctcaagacgctcgccgacaacgagatgtcggcgatcctggagcacgagcacgcccacctgcgtgcccgccacgacctggtgctggagatgttcaccgcggtccacgcggcctttccccggctggtgcgcagcggccacgcgctcaacgccgtccgccttctgatcgaacttctcgccgacgacgccgcggtgcgggccgaagggcccacgccgttggcccgggcgctggtcgcgtgcgcgtccggccgcgctccccgcggtgcgctcgccgccggcgggcccaccaccgtcgtgcgggtgcgccggctcggcggcaaacccaacagcaggatgctcgcggcgggcgcctacgccgcagcggcggcggtgctggtcgtgccgaccgtcgcgttcgcggtcccgtggctcaacgagctgcatcggttgttcctcgtctag

SEQ ID NO: 1681 - DNA, 906 bp, Salinispora tropica CNB-440
atgacgtacgcgctgcacttcgggctcgcggtgctggcctgctggctaaccgcacaggtgatggcccgttcgacctggacctggcgtagcccgcgggtggccattctctgctggcaggcgatcggcctggcggctggcctggcggcgatgggtctcccgatggccctcggcctggccgcatacgacctgccgaccggaagcgccctctgggccctcgccggggagctgcgcggcggcgccgcaccgattagggtaaacgcgctccagctcgggctcgtcggtctcggctgcggaatcggcgtcgtgctgttcaccaccaccctccgcagcctgcacagcgccgtccgggcccaacgccgccatcgggatctgctcacgctggtggcccggcaggatccgacggtgcccggtgcgctggtgctcgaccatccgagcgcggccgcgtactgcctgcccggggtacggcctcgggtcgtggtcagtgccggcgccctcgacctgctggaccaggccgaactggcggccgtactcacccacgagcgggcccacgcccaggaacggcacgatctcgtcctgttgccgttcaccgcgctccgccgggtgctgccctggttccgctgggtacgggacgcacacgagcgagtcgccctgctcgtcgagatgcgtgccgatgacaaggcccgcgagctacacgccgaggcacccctggcgggcgcactgcgccggttcgccgctgctggtgaccggctcgccccggccggcaccctgggcatcggtgaccacgacctcgaactgcgggtccaccggctgctggagtcggggcgaccgccccggctggtcggcaccgccgcactagcagtgacgaccacgctggtcgccctaccggtgtcgctgttcctgagttga

SEQ ID NO: 1682 - DNA, 951 bp, Mycobacterium tuberculosis F11
gtgtccgcgctggccttcaccatcctcgcggtgctgctggctggcccgaccccagccctgctagcccgggcaacgtggccactgcgcgcaccgcgcgccgccatggtgctgtggcaggcgattgccctggccgcggtgctgtcgtcgttcagcgccggaatcgcgatcgctagcaggctgctcatgcccggtcccgacggacgccctacgaccagcttcgtcggcgcggccggccgcctcggctggccgctgtgggcggcctacatcaccgtctttgcgttgactgtgctggtcggtgcccggctggcggtcgccgtggtgcgcgtcgccaccgccacgcgacgacgacgggcacaccaccgcatggtggtcgatctcgtcggggtcggacacaatggcgcgcttgcccagccgtgcgcgcgggcccgcgaccttcgggtcttggacgtcgcgcagccccttgcctactgtctgcccggtgtgcgtagccgggttgtggtcagcgaaggcacactgaccgcgctcgccgacgccgaggtcgcggcgatccttacccatgagcgggctcatctacgcgcccgccacgatcttgtcctggaggcgtttaccgcggtgcacgcggctttcccgcggttggtccgcagcgccaatgcgctgggggcggtgcagctactcgtcgagctcctggccgatgacgccgcggtgcgcgccgccgggcgcactcccctggctcgggcattggtcgcctgtgcgtccgggcgggcgccgtcgggtgcgttggccgtcggaggtcccagcacggtgctccgcgtgcgccggctgtcggggcgtggaaatagcgcggttctgtccgcggccgcatatctagctgcggccgccgtcctggtggtgcccaccgtcgcgctggccgtaccgtggctcacgcagctgcagcggctgttcatcgcctag

SEQ ID NO: 1683 - DNA, 1296 bp, Frankia EAN1pec
atgacgaccgcggcccttctcgccctgttcgcgggcgcgctggcctggccggttccgcgcctgctggccgccgcgcggtggccgcaccgctgcccgcgcgcggcgatcgtgctgtggcaggcgataggcctcgcgggtggggtctcagccctgctggccgccgcggccttcactgtggctccgttgtcgcagggcatcccgtcggcgctcgccgaccacgcctccaaccttctcgccggtgagcccctggtcgggctcggccggacgaacctcgtcgggctggccatcgcggcggcgctggcggcacgcctgttcggcgtgctggccatgtcgaccgcggcgaccctgcgcgagcgccaccggcaccggcacctcgtcgacctcgccggccaccgccaccggcaccgcgggcacgaccacggtgaccccgagcaccccgacagcctgggcggctcgggcggctcgggcggctcgggcggctcgggcggctcgggcggctccggaggctcgggcgacgtcgccgggcacgaggagcacggcaccggctgccgcctgtgcgagcaccgggacagggccgggacccggctgcggatcctggaccatcccgtcgccgtcgcctactgcgtccccggggtgcgccatgcgcgggtcgtcgtctccgccggcctgctgcggacgctgacccccgaggagctggacgccgtcctcgcccacgaggaggcgcacgtcagcggccggcacgacctggtcatccagccgttcgtcgcctgggagcgcaccttccccttcctgcgcccggcccgcgaggcgacggccgccgtctcgctgctggtcgagatgctcgcggacgacgccgccgcccggcgcacctgcggccggaccctcgcccgggcgctcgcccggctcggcgtcacccgcgcagcggtgcccgccggaacactgagcgtgacgggcccggacctccccagccagcgaccacccacgacgggcgcctcaccctccgcgccggcgaacgggtcggtcccacccttcgagccggcgagactcgggccggcaagcacgccggagtcacccgccgtactcggagtcgccggcgcgggtcggctggcggccgtcgccgccgcggtcgccacggaccgctccgacccggcgcgtaacgggggcgtgcggacgccggtcgtcgcccggattgcccggctgctcgacccgccggccgtcccgatctggctgcccgggaccgcctacctcaccgccgcgatggtgttcctcaccccggtggtcctgctcctcacctga

SEQ ID NO: 1684 - DNA, 906 bp, Salinispora arenicola CNS-205
atggtttacgtgctgcacttcggcctctcggtgctggcctgctggctcaccgcgcaggtgttgacccgttcgacgtggacctggcgcagccccggggtggccatcctctgttggcaagcggtcggtctgggggctggcctctcgacgatcggtctgccgatggcgctcggtctgaccgcatacgacctgccgcccggcagcgccctgtgggcgctcgccggagatctgcgtcggggggccttgccgggcgggatgagcgcggtccagctggggttggtcggcgtcggaggcggaatcggtgtggtgctgttcagcacgaccgtgcgcagcctgcgcagcgccgtcgtggcgcagcgccgccatcgggacctgctcgcgttggtcgcccggcaggacccgacagtgcccgacgcgctggtgctcgaccatccgagcgcagcggcgtactgcctacccggggtacgtccccgcgtggtggtcagcgccggcgccctcgacctgctggaccgggccgagctggccgccgtgctcacccacgagcggacccacgcccaggaacggcacgacctcgttctcctgccgttcacggcgctccgccgggttctgccctggatgcgctgggtgcgggacgcgcacgaacgggtcgccctgttggtcgagatgcgggccgacgacaaggcccgcaagttccacgccgaggcgcccctggcggctgcgctgcgccggttcgccgccgccggtgatcggatcgccccggcaggcacgctgggcatcggcaaccaggacctcgacctgcgggtccgccggctactggagtcgaggcgaccgccccggctgctcggcgccgccgcattgggtgtggcgaccatcctggtcgctctgccgatctcgctgttcctgagctga

SEQ ID NO: 1685 - DNA, 993 bp, Arthrobacter chlorophenolicus A6
atgttctgggcctcatacctgctggcggtcctggcgatcatactggcgtggccggtacccatcctgctgtcgcgcgcgcagtggcccgcgaggtcgccgtttactgcgatggtgctctggcaggccatcgccctggcaggtggcctgtcaatgatcggtgccatgctggtgtacggcctcgaacccatcggggacaacctgatcgccgggctccggtccctggccggcatggtgctcttcaacgcccccaccacggccctggggttttggcatattttcgccctgtctgcggcagccctgctgactgcccaccttgtcttcaccctgctgctgacttattacaggattcagcggcagcgacggcgccaccgcgagctgctggccctgttggcgtccccctcaagccaggacaccggcacattggtcatcagccatgactccccggtggcctattgcctgcccggcggagcccggtcggtcacggtcctctccgacggcctcatggcggcccttgagccggcagagctccaggccgtcctgacccacgaaaacgcccacctgagccagcggcaccaccttctgctgtgggcgttcgctgcgtggcgccaggccctcccctggctgcccaccacgcgcttggcgcaggagtcggtgagctcgctgatcgaaatgctggccgacgacgttgcccttcggaccgccagcaaagccacactcatcaaagcaatcgccatcgtggccagcggttcgcccgccggaccgaacggtcacggcgccagccaggccgcccccgggatggcgctgtccggccttgacgctgccgcgggaactgcgggctccgactccgcccgcaccacggcgtcccgtgtcagccgcctgctctcgccacagaccgaactgccgcgggccgcacggagcctggtcctcaccgcatgcgtgctgttgctggcgatccccaccgccctgctggtggtccccggcctgctgggctga

SEQ ID NO: 1686 - DNA, 990 bp, Kytococcus sedentarius DSM 20547
atgtcccccaccctggtcctcgcggtgctcgccgtgctgttgaccctcggaaccccggccctgctgccgctgctgcccgggctccggcgcacgcccgcggcgggcctgctgctgtggcagggctgcgccgtggggggcttctccgccatcgtcctgctgccggtggtcgcggcccacgagttcggcggactcttcacggccaacgacacggtgcacccgtggctggtggccgccgccgcggcgctctcggtggccctcatcgcccgcctgctcctcgccgcgcacacggtggggaccgacctgcggaccctgcgccggcgccaccaggaggcggtggacctgctcgacccccgccaccgcgagggcgaccgcctgcgggtgatcgactcccccagccccgtggcgtggtgcctgccggggaggcgcgcccgcatcgtcatgtcccgggcggcgctggaggacctctccgtcgaggagctgcacggggtctacctgcacgagcgcgcccacctgcgccaccggcacgacctggtggtcgagttcttcacggtcatggacgcggccgtcccacgcgcgctgcggcacccccgcgccctggccgaggtgggcctgatggtggagctcctcgccgaccgcgcggcggcccgggaggtggggccggtgacgatggggcgggcgctcgcccacctgggggccggcagggcgctcgggcgggggcgcggacccggtcaggcgcgggacgacgacccatgcgacggggacgaccgcgggcgcggcgcggggtccgtggcgacccgcgccccctccccgtcggcaggagtcgcgctcacggcgggcgggcacctgcgggccacggtggtgcgggtgactgccctgcaggaggcccggcggccccatcgggcacaggcagccctggtgacgacggccgccgtcgtcgctgccctgggtccgggcgcggtggccgtcaccgcggcggtcacgggcgcctga

SEQ ID NO: 1687 - DNA, 945 bp, Catenulispora acidiphila DSM 44928
gtgttcgctgacgcctggccgctggccgtcctcgcgatcctgctcgcctggccggtcccggtgttcctggcccgcgccgcttggccgcggcggcatgcgcgcgccgccatcgcgttgtggcaggcggtcggcgtcgccggtggtctggcgctgatcggggcgccgttggcggtgggcgtcgccccgctcgacggtcatctgcgcaccgggctggtcgagctgtggcgcgacgccttccatctgcgcgtgcccgcggcgctcggtctggcccaggagatcgcgctggcgctcgccgccgtgctgacggtccggctggtcggtgtgaccttgctctcggcgtggcggatagagcgcgatctgcggcgccagcgcgacgccgtcgacctcgccgccgagcacgccgaccgggatctgcgcgtcctggaacacgccgcgcccgccgcctactgcctgcccggcacgcggccgcgcatcgtcatcaccgagggcaccatcgccgcactcgcccccgacgagctcgaagcggtcctcgcccacgagcgcgcccacgcccggtggcgccacgagctcgtggtccagcccttcgtcgcctgggagtcggcgctgccgctgcctccggcccggcgcgcgaccgcctcggtcaccgccctcgtcgagatgctcgccgacgaccacgccgcccgctccgtcggacgtccggcactggcccgcgcgctcgtcgctatcggcggcaccgccggtccggtaccgaatcagcgcacggacggcgccccgggttccggctccgatcccaaccccgtccgcgccacgccgaccctcgaccgcgtccagcgcctggtccgccggcccaaggcgaccagcctcgccgaacgcctcatcggcccggcggcctggctcgccgcggtgctgctcgtcgccgggccgacctggtacgtcctgcgctga

SEQ ID NO: 1688 - DNA, 894 bp, Saccharomonospora viridis DSM 43017
gtgatcctcgtcgggcatcaggtcgcggccggggccgtcgccgtgctggtgatggtgtggttgttgcgtagccgttggacccatgcccatccgcgaccggctctggtgttgtggcagatcagtggcctgaccttcgtgatctccgtggtcggggtgctgctcggtttcgggctcgcgccgtttcgccggggctttctgcccgcgttgttcgacctgcccacgcggtgggccgagctggatctttggcatttcgcggcggtggtcgcggggctggtgttgggtgcctggctggtgctgaaccagatcctctgtctgctggacacggcacgggccagggcgcgacaccgattgctgttgcagttggtggcgcagccgaactccgacgcgttcgtggtcgatcatccggcggcggtggcctactgcgtgccgggcaggcgtccgcgcatcgtggtgagtgcgggagcgcgcaagctgctcagcgagacggaactcgacgccgtcctcgcgcacgaacgcgcacatgcccatgaacggcacgacctggtggtggccccgttccaggcactgcggcggctcttcccgcgcagtggcgtgttgacgcgggtgtgttcggtcatcgagctgttggtcgagatgtgcgccgacgacaaggcggcccgccagcacggcagggagccgttggcgcgtgcgctggagcggttccacgccaacggggcgggtggtatcccggtgggcgcgctcgccgtggtgggcgccgacgaggccgtgcgggcgcggatccagcgattgcggcagccgcagcagggagggttcccgctgatctggccgctggcgtgtgggctgttgttgacggcgttcggcacgtcggtgggtgtcttcgccatgcctctctaa

SEQ ID NO: 1689 - DNA, 1005 bp, Nakamurella multipartita DSM 44233
atggatgcggacctggccccggccgcggggccgacgccggtcgccgcgatcggctgcctgctggtcctgatcggggtgacgctggcggcgccggtcagcctggcgctggcccacgcccgctggccccggcgcgcgccggcctgcagcctgctgctgtggcagggggtctgcctgggcgcgggattctcggtggtggccgggctggccctgctggccgtcgagccgtccgggcacaccctggtcggcgccgggctgagttggtgggggtcgctgttcgcgggggagctggcgccctggcgcgcggtctgcgggctgctcgggctggccgtcgccgtgctgttgctgaccaccctgatccgcacggcctggcgcacggtgcgccggcgccgcgggcaccgacaactgctggatctgctgacccgaccgatcccgccccgggtgccgatcggcgccggctgccaggtccggttgatggatcaccgcagcgcggtcgcgtacaccctgcccggtctgcacgcccggctggtcgtctccaccgggctggtcgacctgctcaccccggtcgagctggccgcggtggtcgaacacgaacgggcccacctccgggcccggcacgacatcctgatcctgccgttccagtcctgggtggccgcagtcggccgggtgcgtggggtgcgggaggccgggcggtcggtgacggagttgaccgagatgctcgccgacgacgtcgcgcgggcccggtcggccccgggcgcattggcctcggcgctcacccgggtcgccctggagggacggacccgggccggtaccgacggccccgacaccatcggcggccaggccgccggaagtgacgcgcatcgggccggatcggggacgtgcgtgaccgaccgggtgcggcggatgaacgatccgcggccgttgccgctgttcgcccgggccttgatcgtgctcacggcggccggcctgctggcgatcccggccaccgtgctgaccctgacctggtag

SEQ ID NO: 1690 - DNA, 1539 bp, Synechococcus sp. CC9605
atgcagttccctccgaccagcggtcagcctcagatgcaggttcaaaagctcccgacagggatcgagggctttgatgatgtgtgccaaggcggcctgccgatcggccgcagcacgctgatcagcggcacgtccggcaccggcaagacggtgttttcactgcacttcctccacaacggcatcaaacagttcgacgaacccggcatcttcgtcacctttgaggaatcgcccctcgacatcctgcgcaatgccgccagcttcggctggaatctgcaggagatggtcgagcaggacaaactcttcattcttgatgcctcaccggatcctgacggtcaggacgtggccggcagttttgatctctccggcttgatcgagcggatcaactacgccatccgcaaatacaaggccaagcgcgttgccattgactcgatcacggcggtgttccagcagtacgacgctgtgttcgtcgtgcgccgtgagatctttcggttgatcgcgaggctcaaggaaatcggcgtcaccacggtgatgaccaccgaacggatcgacgagtacggcccgatcgcccgctacggcgttgaagaatttgtgtccgacaacgtggtgattttgcgcaacgtgctcgagggagagcggcgtcggcgcaccctggagattctcaagctgcggggcaccacccacatgaagggcgagttcccattcacgatgggcacccatggcatcagcatcttcccgcttggggccatgcgcctcacccagcgctcatccaacgtccgggtcagttccggcgtgccgcgcctggacgacatgtgcggcggtggtttcttcaaggactcgatcatcctggccaccggagccaccggaacgggcaagacgatgctcgtctccaaattcatcgaagacgcatgccgtaacaaggaacgcgccatcctgttcgcctacgaggagtcgcgcgcccaactgctgcgcaacggcaccagctggggcatcgacttcgagcagatggagcaggacgggttgctcaagatcatctgcgcctaccccgaatccacgggtcttgaagatcacttgcagatcatcaagacggagatcagtcagttcaaaccgtcgcggatggcgatcgactctctctccgccctggcgcgcggtgtgagccacaacgccttccgtcagttcgtgatcggggtgaccggctacgccaagcaggaagagatcgccggcttcttcacgaacacctccgaggagttcatgggcagccattcgatcacggactctcacatctccacgatcaccgacacgatcctgctgctgcagtacgtggagatccgcggcgagatggcccgtgccttgaacgtgttcaagatgcgcggttcatggcacgacaagggcatccgcgaatttgtgatcacgggcaatggtcctcagatcaaggattccttctccaacttcgagcggatcatctccggtgtgccccatcgggtcaccaccgatgagcgcagcgagttgtcgcgcatcgcccgcggcgtctccaccgaggattga

SEQ ID NO: 1691 - DNA, 1515 bp, Rhodospirillum rubrum ATCC 11170
atgacccttcccctgctgacagaagtcgagaagcttcccacgggaattcccgggttcgacctgatcgcccatggtggactgccggccggtcgaacaacgttgatcgtcggcacggctggcagcgccaaaaccatcttttccgcccagttcctggccgccggcattcagtccttcgatcagggcgcggtttttgtaaccttcgaggaatcggtcgccgatatccggcgcaatctggccgggttcggctgggacattccggcctgggaagccgccgggaaatggagcttcgtcgacgcctcgccctatccgctcgaagatggcgacgtggtcggctcctatgatctgggcggcctgctcgcgcgcatcgaacatgcggtgcgccagactccggccacccgggtcgtgcttgattccctgggggcggtgttcatgcgcttcgccgacccggcgaccttgcgcaacgaattgctgcgcatcgccgccgcgctcaaggacatgggcgtcaccaccctgatgaccgccgaacgctccgaggaagaagggcccctgacccgcaccggcatcgaggaattcgtcgccgacaacgtggtgatcctgaggaacctgcgcgagggcgagcggcggcggcgcacctgcgaaatcttgaaataccggggcgcctatcaccagaagggcgaattccccttcgccatcctgcccggatcgggggtccaggtgattccgctttcggccatggaactgcgtcagggatcgtcggatctgcgcatcccctcgggatcggtcgatctcgatggcatgtgcgggggcgggttcttccgcgattcggtggttctggtctcgggggcgacgggcacgggcaaaaccctgatgagcacccatttcctcaatggcggactgcaggcgggcgagcggtgcctgctcttcgctttcgaggaaagccggccgcagttgttccgcaacgccagcggctggggcatcgacttccaggcggccgaagactcgggccagttgcgcgtcgtctgcgactatccggaagtggcctccatcgaagaccatctgatcaagatcaaagaggaaatcgacaccttccacccccatcgggtggccgtcgacagcctgtcggcgatcgcgcggatctgttcggaacggggctttcgcgaattcgtcatcggcttgacctcgttcatcaagcatcaggaggtcgccgcccttttcacctcgaacacgccgaccctgatgggcggatcatcggtcaccgaggcccatatctcctcgatcaccgacagcatcatcttgctgcgctacgtggagacctttggcgagatcagccggggcgtgatggtcttgaagatgcggggctcgcgccacgagaaggagatccgcgagttcgccatcgatgccaccggcatgcatatcggccgccccttccgcaccgtgaccggcatcctggccggcaatccccaatactcccaccaaagcgaggccgaccgcctcgacagactatttcccaagtga

SEQ ID NO: 1692 - DNA, 1530 bp, Prochlorococcus marinus MIT 9515
atgaaagaaaaaaaaattaacaaatcaaataaaatgcaagtccagaaattacctacgggtatagatggctttgatgatgtttgtaggggaggcttgccggcttcgagaagtactcttgttagtggcacctctggcactggtaaaactgttttttctttacaatatttacatcatgggatttgtaatttcgatgaaccagggatttttattacctttgaagaatcacctttagacataatcagaaatgccgctagcttcggatgggatttacaaaaattaattgatcaaaataaactttttattttggacgcatcacctgatcctgatggacaagatgttgcgggcaatttcgatctttctggtttgattgaaaggattagttacgcgataagaaaatataaagcaaagagagtggccatagactcaataacggcggtttttcagcaatatgatgctatttatgttgtaagaagagagattttcagacttattgcaagattaaaagaaattggtgttactactgtaatgacaacagaaagagtggatgattatggtccaatagctcgttatggagttgaggaatttgtatctgataatgtagtactgcttagaaatgtactcgagtcagaaaagagaagaagaacactagaagtcttgaaattaagaggtacagttcatatgaagggagaattcccgtttacgatgggagatgatggtataagtgtttttgccttaggagcgatgagattaactcaaagatcctcaaatatcagaataagttcaggagttaaagatctagatgaaatgtgtggaggtggttatttccaagattcaataattctggctactggtgccactggcacaggtaaaactatgctggtatcaaagtttattgaggatgcttataacaataatgaaagagcaatactctttgcctatgaagaatctagagctcaactaaatagaaatgctactagttggggaattgattttgaaaaaatggaaagtgatgggttattaaaaattatttgtgcatatcctgaatcaacgggtttagaagatcacttacagattataaaaacgcaaataaatcaattcaaacctaagagattggcaatcgactccctctcagcattagctagaggtgtaagtttgaatgcttttagacagtttgtgattggagttacggggtattcaaagcaagaggagatagcaggtttcttcacaaatactgctgaggaatttatgggaagtcattccattacagactctcacatatcaactattacagacactatattattactgcagtatgtagagattaaaggagaaatggcaagagcaataaatgtatttaaaatgagaggctcatggcatgataaaaggattagagaatatataattacaagtagaggtcctgaaataaaagattcattttcaaattttgaacaaatatttagcggtgcccctcatagagttatttctgatcaaaatatacagaacgtatttaaaggaattgataaaatttag

SEQ ID NO: 1693 - DNA, 1530 bp, Prochlorococcus marinus MIT 9301
atgaatgataagaaaattggcaaatcaaataaaatgcaagtacaaaaattaccaactggaatagagggctttgatgatgtttgcaggggtgggctgcctgtatctcgaagtacactcgttagcggtacctcaggaactggtaaaactgttttttcactacaatatttacatcatggaatttgtaactttgatgagcctggaatcttcgtaacatttgaagaatcccctttagatattattagaaatgcagctagttttggttgggacctacaggaattaattgatcaaaataaactttttattttggatgcttctcctgaccctgatggtcaggatgtagcgggtagctttgatttgtctggtcttattgagagaattagttatgcaattagaaaatataaagctaaaagagttgcaatagattcaataactgcagtctttcaacaatatgatgctatttacgttgttagaagagaaatatttagactgatagcaagattaaaagaaataggtgtaacaactgttatgactacagaaagggttgatgactacggaccaattgctagatatggagtagaagaatttgtatctgataatgttgtcttattaagaaatgttcttgagtcagaaaagaggagaagaactctagaagttttgaagttaagaggaactgtacatatgaaaggtgaatatccatttactatgggaaccgatggaataagtgtgtttgcacttggagcaatgagattaactcagagatcctcaaatattaggattagctctggagttaaagatcttgatgatatgtgtggaggaggttattttcaagattccattattctcgccactggagctactggtacaggtaaaacaatgcttgtatcaaaatttgttgaagatgcttatgataataatgaaagagcaatactttttgcatatgaagaatctagggctcaattactaaggaatgcgactagctggggaatagactttgaaaaaatggaaagtgatggattattgaaaattatttgtgcatatcctgaatcaactggtttagaagatcacttacaaattattaaaacgcaaattaatcaatttaaaccaaaaagaatggcaattgactctctctctgcattagccaggggtgtaagtttaaatgcatttagacagtttgtaattgctgttaccggttataccaaacaagaagagatagcaggcttttttactaatactgcagaagaatttatggggagccactctataactgattctcatatctcaacaattacggatacgatattgttacttcaatatgtagaaataaaaggtgagatggcacgagctttaaatgtgtttaaaatgcggggatcatggcatgataaacgaattagagaatttattattacaaatagtggcccagaaataaaagattctttttctaattttgaacaaatatttagtggtgcccctcatagagttgtacctgatcaaaatgttcaaaatgtttttaaaggattagataaaaattag

SEQ ID NO: 1694 - DNA, 1533 bp, Roseiflexus sp. RS-1
gtgagtctaaatctgcgccaaccagccatcgaaaaactgccaaccggcatcagtggcttcgacctgatcgccaacggcgggattcccgccggtcgaaccacgctcgtctccggtaccgctggcagtgccaaaacggtctttgccgcccagtttctcgccgaaggcattcgcaaatatggcgagcacggggtgtttgtcaccttcgaagaaccaccctcggatatccgccgcaacatggaatccctcggatgggatattgcaacgtgggagagcgaggggaagtgggcatttgtggacgcatcgccccaacccggcgaggaaatgctcttcgccggcaactatgatctcggcgcgctgctggcgcggatcgaaaatgcggttcgtcgcatcggcgccagacgcctgtcgatggactcgctcggcgcaattttcacgcaattcgccgatagcgccgttgtgcgtcgtgaactgttccgcgtcgtctcggcgctgaagcgcctgggggtcaccgctatcatgaccggtgaacgcactcaggagtatggcgatattgcgcgctacggcgtcgaagagttcgtggcggataatgtcattattctgcgcaacgtgctggaggacgaaaagcgccgccgcactatcgagatactgaagtttcgcggtacgtcgcaccagaaaggggagttcccattcacaatcatctctggtgaagggatggtggtgataccgctctccgcgatcgaactcaaacagcgctcgtccgatattcgcgtgacctccggcaaccccgaactcgaccgcatgtgcggtggaggtttcttccgtgactcgatcctgctcgtgtcgggtgcgacgggcaccggcaagacgctgatgaccaccgagttcatggcaggcggggtcaggcggggtgagcgctgcctgttgtttgcgttcgaggagagtcgcgagcagttgttccgcaacgccactggctggggcatcgatttcgagcagatggaacgggatgggttgctgcgcgtcgtctgtgagtatcccgaaactgccgggcttgaggatcatctgatcgcaatgaaaaagttgatccaggagttccgccccaatcgcgtggcggtcgatagtctctccgcactcgaacgcgtctcgaccatccgtggcttccgtgagtttgtgatcagtctcacgtcgtttatcaagcatcaggaaattgccggtctgtttacggcaaccacccctagtttgatggggggagagtcggtgacggagacccatatctcaacgttgaccgactcgatcatcctgctgcgctatgtcgagatgttcggcgagatgcgccgcgggttgacggtgctgaagatgcgcggctcgatgcacgataaggatattcgcgagtttaccatcgataaccggggcatgcacatcggtcgcccgttccgccaggtgaccggcattctgtctggcaatccgatccatatcgcgcctggcgagatcgaccggatgaaccagttgttcaatgatgacgagccgcagacgtga

SEQ ID NO: 1695 - DNA, 1722 bp, Candidatus Methanoregula boonei 6A8
atgaaaaaaaataagactgctgcaatcgtgggagcggcagaaatcgaaaaagtccactcagggatcaagggtcttgacgatataacagggggcgggctccccaaaggccgtccctcgcttgtcagcggcggcccgggatgcgggaaaacactttttgctatggagttcatcatccgggggatcatcgattacggtgaacccggtgtctttgtagcgttcgaggagaagatcgacgacctgaagttgaatttcaggtcaatgggatttgacctcgacaacctcatccgccggaagaaactggtcctcgatcatatcactatcgatcgctccgagatcgaggaagccggcgagtacgatcttgaagggttgttcatccggcttggcgcactcatcgacgaggtcggcgcaaagcgtgtttctatcgacactctggaggccctcttctccggttttgcaaacgaggcaatccttcggtcggagctgcgccggctcttcctctggcttaaagaccgtggtgttaccgccgttgtcacgggcgagcgcggggaccgtacaatcaccacgtacggccttgaagaatatgttgcagattgcgttatcacccttgaccaccgggttacaaaccagatcgcgacccggcgcctgcacattgtcaagtaccggggaagtatccacggtactgacgaatacccgttcctgatcagtgaagacgggatctccgttctccctatcacctcgttatccctcactcacaaggcatcgggtgagcggatctttaccggcattccccggctcgacacgatgctggaggggaaaggattctaccgcgggtcatccatccttatatccgggcaggcggggaccggcaagacaagtattgccgcgacgtttatcgatgcagcgtgcaggcggaacgagaaatgcctcttttttatcttcgaagaatccgagagccagcttttgcggaacatgaagtccatcgggataaaccttgaaccatgggtcaaatccggtctcctgaagttccacgcggtccggccgacggcgtacagcctcgagatgcatctctcggtgatgctgaaacttatcggggaattcaaaccaagggttgtggcagtcgatcccatttccaacctctaccccattggagatgatatccaggttcgctcgatgctgatgcgtctcattgactttgccaagtctctccagataaccgggctctttaccagcctttcgaacgatgtgaatgtcggggtctattcggtcgagccgaccgagatgcacgtatcttccctgatggatgcgtggctcatcctcaagaatatcgaagggaacggggagcggaaccgcgcgttttccatcatcaaggtgcgggggatggcccattcaaaccagcttcgcgagtttatcctgtcggacaaaggcatccggcttctcgatgtgtacaagggcagcgagggagtccttttcggctccgcccgtatagcacaggagggcaatgaaatcgacgaccggctctgcaagaacgaggagatcgaacgcaagaagcgggaactcgaaagccggcggaaactcatggaaaacgagatctctctgctcagagagcgattcgcacaggaggaagacgagatgatgatccttatcgggcaggacgtctcccgcgagaaagtagccgcaaagaccaaaagggagatcgcaacccagcggcacgtcgaccgataa

SEQ ID NO: 1696 - DNA, 1533 bp, Roseiflexus castenholzii DSM 13941
gtgactcagaatccgcgtcaaccagctatcgagaaactgccaaccgggatcagcggcttcgatctgattgccaatggcggcattccagccggtcgcaccacgctggtttccggcactgccggaagcgctaagacggtcttcgcggcacagtttctcgctgaaggaattcgcaaatatggcgagcctggggtgttcgtcacctttgaagagccgccgtctgatattcgtcgcaatatggagtcgctcggatgggatattccagcctgggagagcgaagggcgctgggcattcgtcgatgcgtcgccacaaccgggtgaggaagtcctgtttgcgggcaattacgatcttggcgccctcctggcgcgcatcgaaaatgcggtgcgtcggattggcgccaaacgcctgtcgatggactcgctcggcgcgatctttacgcagttcgccgacagtgcagtggtgcgccgcgagttgtttcgcgtcgtctcggcgctgaaacggatgggtgtcacggcgatcatgaccggcgaacgcacgcaggagtatggcgacattgcgcgctacggcgtcgaagagttcgtcgccgataatgtgatcatcctgcgcaatgttctggaagatgagaaacgtcggcgcaccatcgagattctgaagttccgcggtacatcccaccagaaaggcgagttccccttcacgatcatgtcgggtgagggcatggtcgttatcccgctctcagcgatcgaacttaagcagcgctcgtctgatattcgtgtcacctcgggtaacccggaactcgaccgtatgtgcggcggcggcttcttccgcgactcgatcctgctggtgtcgggtgcgacaggaaccggcaagaccctcatgaccaccgagttcatggcgggtggggtcaatcgtggcgaacggtgtctgctctttgcgttcgaggaaagccgtgaacaactgttccgtaatgcaaccggctggggcgttgatttcgagcagatggagcgtgatgggttgctgcgcgtcgtctgtgagtatccagagacggcagggcttgaggatcacctgatcgctatgaagaagttgatccaggagttccgccccaatcgtgtggcggtcgatagcctctccgctctcgagcgcgtctcgacgatccgcggctttcgcgagtttgtgatcagcctgacgtcgtttatcaagcatcaggagatcgccggtctgtttaccgcgacgacgccaagcctgatggggggcgagtcggtgaccgaaacccatatttcgaccctgaccgactcgatcattctgctccgatatgttgagatgttcggcgaaatgcgccgcgggttgacggtgttgaagatgcgtggctcgatgcacgataaggacattcgtgagtttacaatcgataatcgcgggatgcatattggtcgtccgtttcgccaggtgaccggcattctttcggggaatccgatccatattgcgcccggtgagattgatcgcatgaatcagttgttcaatgacgatgaacaacagtcgtga

SEQ ID NO: 1697 - DNA, 2367 bp, Shewanella sp. ANA-3
gtgctgactttattagatcaattagataaaggaaccctttggcgctcacccggtggcattcatccacctgaagtcaaattcctctccaacaccacaccaattagccaactgccattagcgcaggaatacctagtgcctgtgccacaggtaggtgagaactgcactcttgcggtcaaagtgggtgacaaagtattaaaaggcgcgccattaactcaaggcacctcgatttggcatttgccggtgcatgcgccaacctctggcactgtggtcaccattgagccaagagccagtaaccacgcctcggccttgccggtcaatacctgcgtgattgccgctgatggtgaagaccgctggtgcgagttaacgccaggctcaattgagctcagtaatcatgagatgattgccaaaatccatggcgcaggcattgccggtatggggggcgccgccttcccaagtcatatcaagctgaaccccgtcagtgaaatcgaattagtcattatcaacggcgtggagtgtgagccttatatcagcgccgacgatcgcttaatgcgcgaatacagccaagacattctggcgggtattgggattatccatcgcctcctagcgcccaagcgcattgtgattgcgattgaagacaacaagcccgaagcgattaaagccatgcaacaggcggtgagtcaatccgcgcttccagcgggcagcacgcgggtaacggcgataccaaccaagtatccttctggcggtgaaaagcagcttattcaaatcatcacggggcgtgaagtgccctcgggcgctatccccgctaagcttggcattgtcgtgcataacgtgggaaccgcgtttgcgattcaccaagccgtgacccaaggtaaaccgctgattgaacgtgtggtgacagttaccgggcaaaatgtgggtaagcccggcaactattggttacccataggtacgcccgttgagcatgtgctcaaatacactgaatttaacgccgaagccgatcaaaaagtgattattggcggccctatgatgggccatgcgttaccaaccatccaagtgccgattttaaaaggcacaaactgtattttggtgcccagcagtcaagagattggaacaacaccagaggaaaaggcctgtattcgctgcggcgaatgtgccaatgcctgccctgcactcctgctaccacagcaactgttttggcatgcaaaagccgaagaatatgacaaggcggccagctacaaccttaaagactgtatcgaatgtggttgctgtagttatgtgtgccccagtgatatcccactggtggaatactaccgcatcgctaaatcggcgctaaaacaagccgccgatgaaaagcatcaagccgagcgcgccaaacagcgcttcgaggcgcgtattcaacgcctcgaggaagaaaaactcgcccgcgaagccaaggctaaagaagccgctgcgcgtcgccaagcgaccatgacctcaacggacaaaaatgccgtcgccgaagccatggcgcggattgcggccaaaaaagcggctgctgcagaaaccacagcggataacgctccggtcgaggtcgttgcggctgatgcaagcagcactgaggcgcctaagggtaaggcggccgttgccgccgcgattgctcgagctaaagccaagaaagctgctgcggctcaaggggccgatgatgcagaatcgtctcaacaagccgtgtctcctgagcaaagcgagccaactgagcaaaccgagtctttatcgcaaaaagataaagtcgccgctgccatcgctcgtgccaaagcgaaaaaagcggcgttgaaggccgactcggatgccaatagcgacactgacgccgcgacaagcaacacagataagtcagcaacagaaacaacggctaacgcagaagcggatgacaaaaaagccaaggtcgctgcagctgttgcccgtgcgaaagccaaaaaggccgccgcacaacaagctgaatcgagtgaggttgccgaagttcagcccgagcgagtagctgacgctaagccagaatcagagtcaggctctattccaagcacgccactcagccctgaagatgagaaaaaggccaaagtcgcagctgccgttgcccgcgcgaaagccaaaaaagccgccacgcagcaggctgaatcgactgaggttgccgaagttcagcccaagttagccgtagacgctgaaccagactctgaatcaggctctcaatcaggcgatgaatcaagctcagtcgctgaaccaagtgcgccactcagtcccgaagatgagaagaaagccaaggtcgctgctgcggttgcccgcgcgaaagccaaaaaagcggccagagaagcgaatgcgatcagcgacgcaaatgaatag

SEQ ID NO: 1698 - DNA, 1614 bp, Verminephrobacter eiseniae EF01-2
atgctgtaccacctctacgaaacccagcgctcgctgatggagccctttaccgactttgcgcaggcggcatccaaattgctcagcaatccgggctccccgctgagccagaccgggacggcccagcgcatggccgcagcctatgacctgctctaccgcttgggcaaggattacgaaaagccggcgttcggcatccacaccgtggatgtcgacggtgtcggtctggccatccatgagcgcgtcgagatcgacaagccgttttgcgcactgcgccgcttcaagcgcttctcggacgacccggccacattgaccgggctcaagggccagcctgtggtgctcatcgtggcaccgctgtcgggccactatgccagcttgctgcgcgataccgtgcgcaccatgctccgggagcacaaggtctacatcaccgactggaagaatgcacgcatggtgccgctgtccgaggggccattccatctggacgactatgtcaattacatgcaggaattcatccgccacctgcaggccaagtatggccattgccatgtggtcagcgtctgccagcccaccgtgccggtgctggcggccgtgtcgctgatggccagccgtggcgagcagacaccgctgaccatgaccatgatgggcggccccatcgatgcgcgcaaatcgcccacggcggtgaacaacctggcgatcaaccgcagcttcgagtggttcgagaacaacgtgatctaccgcgtgccggagaagtttcccggcgccggccgccgggtctatcccggcttcctgcaatacacgggctttgtcgcgatgaaccccgaccgccacgccagcagccactacgactacttcaagaacctggtcaagggcgacgacgccagtgccgaagcccatcgcaatttctacgacgaatacaacgccgtgctcgacatggatgccgactactacctggaaaccatacagaccgtctttcaggactacaaactggtgcacggcacctgggacgtgcgttcgcccgaagaccggatcgagcgcgtgcgcccgcaagacatcaccagcacggcgctgttcacggtcgagggcgagctcgatgatatttccggctccggccagaccgaggccgcccacgggctgtgcagcggcatcgcgcaccaggcgcagcgccatctggaggtcaagggtgccggccactacggcatcttcagcggccgccgctggcgcgacatggtgtacccccaggtgcgcgacttcattcttgcgcacccgtcgccgccaaagaacgcgctggcaccggccgttgccgctgctaccgctgctgcggaggcgccggtcgcagtgccggtgacccccgccagcaaggccggcagcgaaccggcgcagcagacggcacagacggtcgaggcggtgccgccggcgacttctgcgccccgcgctgcggccaaaaccccggcagcgcctgcgatagccacgcgctgggtatcgcccgagccggccagcgccgtggccgccgtggccgccgtggccgccgtggccgccgagtcggccgggccgggcacggcccgcagggccgccaaggcggcggcaacgccggccccccgcagcaaggcgcgcaaggcttga

SEQ ID NO: 1699 - DNA, 2658 bp, Shewanella baltica OS185
gtgttaactttattagatcaattagataaaggaaccctttggcgatcacccggtggaatacatcctcctgaagtcaaattcctctccaacgcgacgccgattggccaacttccattagcctcgacgtacttagtgcctgtccctcaagttggtgaaaactgtacgcttgcggtgaaggttggcgatagcgtcttaaaaggcacgccactaacgcaaggcacctcgatttggcatttacctgtgcatgcgccaacatcgggcactattgttgctatcgaaccaagggcgagcaaccatgcctctgcattgccggttaacacttgcgttattgcagccgatggcaaagacacctggtgcgagttagtacaaaatcaacttgatgacttaagccatcagcaaatcgttgataaggtacgctcagccggcattgccggtatgggcggcgcagcgtttccgactcatattaagcttaatccggtcagtgaaatcgatttagtcatcatcaacggcgtcgagtgcgaaccttatatcagcgccgatgacagattaatgcgcgaatatagccaagatatcctcgcgggtattggcataattcatcgactattaacgccaaaacgcattgttatcgccattgaagacaataaacctgaagcggccaaagccatgcaagctgctgtcagccaatgcggactcccagcgggcagcattcgggtcacggttatcccgacaaaatatccttctggcggtgaaaagcagttaattcaaatcattactggccgcgaagtgccctcgggcgccattcccgccaaactcggtatcgtggtacataacgtcggtactgcctatgcaattaatcaagccgtcactcaaggcaagcctttggttgaacgcgttgtgactgtgacaggcagaaatgtcggcaaaccagggaactactggttaccgataggcacgcccgttgatcacgttctgactgcaactgaattcacgccagagcctgaccaaaaggtgattattggcgggcctatgatgggccatgcgttagcgaatatccaagtgcctattttaaaaggtactaactgtattctggtgccaagcagccaagaaattggtagcacgcccgaagaaaaagcctgtatccgctgcggcgaatgcgccactgcctgccctgcactcttgttgccacaacaactcttttggcacgccaaggccgaagaatacgataaagccgccagttacaatctaaaggattgtattgaatgcggttgttgtagttacgtttgcccgagtgatattccattagtcgagtattaccgcattgccaaatcagcactcaaacatgccgccgatgagaagcagcaagcagagcgcgccaaacagcgcttcgatgcccgcttagcgcgtcttgaagaagaaaaactggcccgtgaaactaaggcgaaagaggcgtctgaacgtcgacaagccagcatgacaggcacagataaaaatgccgtcgccgaagccatggcacgcatcgccgcgaaaaaagccgcagcggcacaagcagtcactggcgaatcaattaacgaagagtcaagcgtcacaacaactgacaccacggaagtgccaaaaggtaaggccgcagttgccgccgccatcgcccgtgctaaagcgaaaaaagcagcccaagcaaatgccgatggcactgacaccaatggtgctgcaactgacagtgctaaaacagacaatgcggtgaatattgatgcaaacgactccatctcagcaacagttgcgatagcgcaggaagcgccttcatcccagaaagacaaagtcgctgcggcaattgcgcgcgccaaggccaaaaaagccgcacagcaaacagataccgcgccgcttgaacctgcagaaaccgctgacagcacatcagagctcagcgctgccgatgataaaaaggcgaaagtagcagcagccgttgctcgtgccaaggccaagaaagcggcgcagcaaggagaaaccgccgctagcgatactgaagttagcaatactgacgttagcgttaatgacgttaatgacgttaatgatgctgaagcgattaagaaagccaaagtagccgccgcggttgcccgtgctaaagcgaaaaaagccgcccaacaagctgagacaaatgctgaaaatggtttaaaccagaccgcgactccagcagttgattccgcagctaacgttcaagcagttgtgaatgctgatgcagaaaccgctgttaatgcagccgctactgatattgaagttagcaacactgacgttagcgttagtgacgctgaagcgattaaaaaggccaaagtggctgccgcagttgctcgtgctaaagcgaagaaaatagcggctgcatcagcagagtctaaaactgagtctgaaatagagtctgttgacgagattcgagctgaagctaacgtggcatcgccctcgatagcagcaacgcttgagactgcaataactggagccgaaaccgttttgccatcggtagaatctgctgcagagcccattgaaacagcgccgttatccagtgatgaactgaaaaaagcgcggattgctgcgaccatcgccaaggcaaaagccaaaaaagcggcactcgcccaagaagccaatgcttcgagcgactcaagtgtaactaatgattaa

SEQ ID NO: 1700 - DNA, 2739 bp, Vibrio harveyi ATCC BAA-1116
atgttgtctttgattgaacaaattcgtactggttcgctatgggatttcccaggcggcgtgcatccggcagaaaacaaaaagcaatccaacaaaactgaattggttcatgcagccattccgtcggaaatcgtcctacctctgaaacaacacatcggtaaagcaggtaatctattgattgctgttggtgacacagtgttgaaaggtcaacagctaacggcgtcagacagtggttttaccgttcctgttcatgctccaacttctgggcaaataacagctattgagccacgcactgttgcgcacccatcaggtttgagcgaactgtgcgcagtgatgacgccagatggtaacgatacttggtgtgagaaaacgccagtagccgattacacccaagaatccgctgatgcattgatcgacgtgatccgccttgctggtatctctggcatgggtggcgcaggcttccctaccgctaagaagatccaatcgggtattgcacgtaccgaaattcttatcgttaatgctgcagaatgtgaaccttacatcaccgccgatgacaaactcatgcaggaacatgcagacgaactgatccaaggtatcgagatcgtcgagcatatccttaagccaaaactgaccatcattggtattgaagataacaagccagcagcaatcaaagcactggaacaagcggcgatgaacaaagacatcgtgatccgcgttatcccaaccaagtacccttctggtggtgagaagcagctcatcaagattttgaccaacaaagaagttcctagcggcgctatccctgcagatattggcatcctggttcaaaacgttggttctctctactcaattaaacgtgcagtgatcgatggcgaacctgtggtaaatcgcatcgtgactctgacgggtaaaaccttcaagcaaccacgtaacgtttggacgctacttggtacgccagtacaagcactgttagacgagtttggctacaaagcagataagaaactgcagcgcctgatcatgggtggtccaatgatgggctttacactcccccacgctcaggttcctatcactaaaacggcaaactgtattctggcaccgaagcgtcgtgagatcgcctctgaccaatacgaaatggaatgtatccgttgtagccaatgtgcggaagcgtgccctgcctcgctattgccacagcagcttcagtggtatgcaaaaagccaagaatacgaaaagcttgaagaactgaaccttaaagattgtattgaatgtggcgcgtgtgcatttgtgtgcccaagtgaaattccacttgttcaatactatcgccaagcgaaagctgaaatccgtacacgcgctcaagaagccgcagcagctgaacgagctaagctgcgctttgaagagaagaaagcgcgtatggaacgcgaaaaagcagaacgtgaaaatcgctttaagaaagccgcggatgatcgtcgtaaagacatgaaagcctctggcggtgacgatgcgattgctgcagccatcgctcgcgtgaaagcacaaaaagacaatgccgaagccaaagcggaaccagctgtgaaacctgcggttgcagccgcgattgccaaagcaaaagcgaaacaagctgcggcggctcaatctggtgcagcggagcctgataactcagaaatggcgaagctacgcgaagaacgcaaacgtattgctcgcgagcgcaaagcggcaaaagaacaagatgacacatctgcggataatgctgacgataagaagtctgcggttgcagccgctattgctcgtgctaaggcgaagaaagctcagcaagaagacgcatcaacacctactgaagctggtgataagaaagcagccatcgcggcagctatcgccagagctaaagcgaaaaaagcacaacaagaagattcgaccgaatctgtagaaacggaagcacctgttaaacaagctgaagatccgaagaaagccgctgttgctgcagcgatttctcgtgccaaagcacgtaaagctcagcaagaaggttctacagaatctgaagaaacggaagcgcctgctaaacaagctgaagatccgaagaaagcagcagttgccgctgccattgctcgtgctaaagcgcgtaaagctcagcaagaaggttctactgagtctctagaaacggatgcgcctgctgaaccagcagaagatccaaagaaagcagcagttgccgctgccattgctcgtgccaaagcacgtaaagctcagcaagaatcgcaaacagaacctgttgaagcggaagctccttctgaagagccagaagtcgatccgaagaaagccgctgttgccgcagctattgctcgtgctaaagcacgtaaagcgcagcaagaggcacaaacagaatctgttgaagcggaagctccttctgaagaaccagaagtggatccgaagaaagccgcggttgccgcagctattgctcgcgcaaaagcacgcaaagctcagcaagaagcacaaacagaatctgttgaagcggaagctccttctgaagagccagaagtggatccgaagaaagccgcggttgccgcagctattgctcgcgctaaagcacgcaaagctcagcaagaagcacaaacagaatctgttgaagcggaagctccttctgaagagccagaagtggatccaaagaaagctgctgttgccgctgccattgctcgcgctaaagcacgtaaagctcagcaagaagcgaataagaacaatactgaggagaacgagtaa

SEQ ID NO: 1701 - DNA, 2667 bp, Shewanella baltica OS195
gtgttaactttattagatcaattagataaaggaaccctttggcgctcacccggtggaatacatcctcctgaagtcaaattcctctccaacgcgacgcctattggcaaaatgccattagcctcgacgtacttagtgcccgtccctcaagtcggtgaaaactgtacgcttgcggtgaaggttggcgatagcgtcttaaaaggcacgccgttaacgcaaggtacctcgatttggcatttacctgtgcatgcgccaacatcgggcactattgttgctatcgaaccaagggcgagcaaccatgcctctgcattgccggttaacacttgcgttattgcagccgatggcaaagacacctggtgcgagttggtacaacatcaacttgatgacttaagcaatcagcaaatcgtcgataaggttcgctcagccggcattgcgggtatgggcggcgcagcgtttccgactcatattaagcttaatccggtcagtgaaatcgatttagtcatcatcaacggcgtcgagtgcgaaccttatatcagcgccgatgacagattaatgcgtgaatacagccaagatatcctcgcaggtattggcataattcatcggctattaacgccaaaacgcattgttatcgccattgaagacaataaacctgaagcggccaaagccatgcaagctgctgtcagccaatgcggactcccagcgggcagcattcgggtgacagttatcccgacaaaatacccttctggcggtgaaaagcagttaattcaaatcattactggccgcgaagtgccctcgggcgccattcccgccaaactcggtatcgtggtacataacgtcggtactgcctatgcaattaatcaagccgtcactcaaggcaagcctttggttgaacgcgttgtgactgtgacaggcacaaatgtcggcaaaccagggaactactggttaccgataggcacgcccgttgatcacgttctgactgcaactgaattcacgccagagcctgaccaaaaggtgattattggcgggcctatgatgggccatgcgttagcgaatatccaagtgcctattttaaaaggtaccaactgtattctggtgccaagcagccaagaaattggtagcacgcccgaagaaaaagcctgtatccgctgcggcgaatgcgccactgcctgccctgcactcttgttgccacaacaactcttttggcacgccaaggccgaagaatacgataaagccgccagttacaatctaaaggattgtattgaatgcggttgttgtagttacgtttgcccgagtgatattccattagtcgagtattaccgcattgccaaatctgcactcaaacaagccgccgatgagaagcagcaagcagagcgcgccaaacagcgcttcgatgcccgcttagcgcgtcttgaagaagaaaaactggcccgtgaagctaaggcgaaagaggcgtctgaacgccgacaagccagcatgacaggtacagataaaaatgccgtcgccgaggccatggcgcgtatcgcggcgaaaaaagctgctgcggcacaagctgtcactggtgaatcaattaccgaagagtcaagcgtcacaacaactggctccacggaagtgccaaaaggtaaggccgccgttgccgccgccatcgcccgtgctaaggcgaaaaaagctgctcaagcaaatgctgatggtactgacaccaatggtgctgaaactgacagtactaaaacagacaatgcggtgaatgttgatgcaaacgactccatctcagcaacagatgtgatagcgcaggaagcgccgttatcccaaaaagacaaagtcgctgcggcgattgcgcgcgccaaggccaaaaaagccgcacagcaaaccgatactgcaccgcttgaatctactgaaaccgctgataacacaccagcactcagcgctgacaatgataaaaaggcgaaagtagcagcagccgttgctcgtgccaaggccaagaaagcggcgcagcaagtagaaaccgccgctagcgatactgaagttagcaatactgacgttagcgttagtgatgttagcgttagtgacgttaatgatgctgaagcgattaaaaaagccaaagtggccgccgcagttgctcgcgctaaagcgaaaaaagccgcccaacaagctgagacaaatgctgaaaatggtttaaaccagaccgcgactccagcagttgattccgcagctaacgttcaagccgttgactcaactgccagtgcagaaaccgctgttaatgcagtcgctactgatattgaagttagcatcactgacgttagcattaacgacgctgaagcgattaaaaaggccaaagtggccgccgctgttgctcgtgctaaagcgaagaaaatagcagctgcatcaacagagtctaaaactgatgctgaaatagagtccgttgacgatatccaaactgaagctaacgtggcatcgccctcgatagcagcaacgcttgatactgcagcaactgaagctgatgccgttttaccatcggtgggatccactgcagagcccattgaaacggcgccgttatccagtgatgaacttaaaaaagcgcgaattgctgcgactatcgccaaggcgaaagccaaaaaagcggcactcgcccaagaagccaatgcttcgagcgactcaagtgtaactaatgattaa

SEQ ID NO: 1702 - DNA, 2208 bp, Salmonella enterica serovar Heidelberg SL476
atgcttaaactattttccgctttcagaaaagataaaatctgggatttcgacggtggtattcatccgcccgaaatgaagacccagtcaaacggcacgccgctgcgccaggtgcctttagcgccgcgcttcgttatccccttaaaacagcacattggcgctgagggcgagctgtgcgttagcgtcggcgatcgcgtgctacgcggccaggcgcttacccgtggacgtgggagaatgctgccggtacacgcgcccacctccgggacggttatcgctattgccccccactcgacggcacatccttcggcgctggcggagttaagcgtcatcattgatgccgacggcgaggaccgctggattgaacgcgagggctggtctgattaccgcgcccacagccgtgaagcgctcattgaacgcattcatcaatatggcgttgccgggcttggcggcgcagggtttcccaccggcgttaaattgcagggcggcggcgataaaatcaccacgcttattatcaatgccgcagagtgcgaaccttacattacggcggacgatcgtctgatgcaggactgcgccgcgcagattgtggaaggtattcgcatcctggcgcatattctgcaaccgcgtgaggtattaatcggcattgaagataacaaaccgcaggctatttccatgctgcgcgccgtactggctgacgctcacgatatttcgttacgtgtgatcccaaccaaatacccttccggcggcgcaaaacagctcacccaaatactgacgggaaaacaggttccccacggcgggcgctcctctgatattggcgtgctgatgcaaaacgtcggtacggcttatgccgtgaaacgtgccgtggttgacggcgaaccgatcacagaacgcgtcgttaccttaacgggtgaagcggtaagccgcccgggtaacgtctgggcgcggctcggcactcccgttcgtcatttgcttaacgatgccgggttctgcccttctgctgaccagatggtcatcatgggcggcccgttgatgggattcacccttccctggcttgacgtaccggtcgtaaaaatcaccaactgcctgctggcgccatccgtgactgaaatgggagcgcctcaggaagagaaaagctgtattcgttgcagcgcttgcgctgacgcttgccctgccgaccttttaccgcagcagctttattggttcagcaaagggcagcagcatgacaaggctaccgctcaccatattgctgattgtatagaatgcggcgcctgcgcctgggtctgccccagtaatattccgctcgtccaatatttccgtcaggaaaaagcggagattaatgcgatcaggcttgaagaaaaacgcgccgccgaagccaaagcacgttttgaggctcgtcaggcaagactggagcgcgaaaaagccgcccgccttgcacgtcataagagcgcagcggtacaaccagcggcaaaagatcaggatgccattgccgctgcgctggcgcgggtaaaagagaaacaggcgcaggccacgcaaccggtggttattcaggcgggtagtctgccagacaatagcgccgtcatcgcggcccgtgaagcgcgtaaagcgcaagcgcgcgctaaacaagccgctcatccggtggctgacagcgcgatacccggcgacgacccgcgtaaagccgcagtggaggcggctatcgctcgcgccaaagcccgcaaacaggagcagcaggccggaagcgaacctgccgaaccggtcgatccgcgcaaagccgcggtggaggcggccatcgcccgcgccaaagcccgcaaacaggagcagcaggccggaagcgaacctgccgaagcggtcgacccgcgcaaagccgcggtggaagcggctatcgcccgcgccaaagcccgcaagcaggagcagcaggccggaggcgaacctgccgaagcggtcgatccgcgcaaagccgcggtggaagcggctatcgcccgcgccaaagcccgtaagcaggagcagcagaccggaagcgaacctgccgaaccggtcgatccgcgtaaagccgcggtggaagcggccatcgcccgcgccaaagctcgtaaacaggagcagcaggccggaagcgaacctgccgaaccggccgacccgcgtaaagccgcggttgctgcggctatcgcccgcgttcaggcaaaaaaagcagcacagcagcaggttgttaacgaggattaa

SEQ ID NO: 1703 - DNA, 2199 bp, Salmonella enterica serovar Schwarzengrund CVM19633
atgcttaaactattttccgctttcagaaaagataaaatctgggatttcgacggtggtattcatccgcccgaaatgaagacccagtcaaacggcacgccgctgcgccaggtgcctttagcgccgcgcttcgttatccccttaaaacagcacattggcgctgagggagagctgtgcgttagcgtcggcgatcgcgtgctgcgcggccaggcgcttacccgtggacgtgggagaatgctgccggtacacgcgcccacctccgggacggttatcgctattgcgccccactcgacggcgcatccttcggcgctggcggagttaagcgtcatcattgatgccgacggcgaggaccgctggattgaacgcgagggctggtctgattaccgcgcccacagccgtgaagcgctcattgaacgcattcatcagtatggcgttgccgggcttggcggcgcggggtttcccaccggcgttaaattgcagggcggcggcgataaaatcaccacgcttattatcaatgccgcagagtgcgaaccttacattacggcggacgatcgtctgatgcaggactgcgccgcgcagattgtggaaggtattcgcatcctggcgcatattctgcaaccgcgtgaggttttaatcggcattgaagataacaaaccgcaggctatttccatgctgcgcgccgtactggctgacgcccacgatatttcgttacgtgtgatcccaaccaaatacccttccggcggcgcaaaacagctcacccaaatactgacgggaaaacaggttccccacggcgggcgctcctctgatattggcgtgctgatgcaaaacgtcggtacggcttatgccgttaaacgcgccgtggttgacggcgaaccgatcacagaacgcgttgtcaccttaacgggtgaagcggtaagccgtccgggtaacgtctgggcgcggctcggcactcccgttcgtcatttgcttaacgatgccgggttctgcccttctgctgaccagatggtcatcatgggcggcccgttgatgggattcacccttccctggcttgacgtaccggtcgtaaaaatcaccaactgcttgctggcgccatccgtgactgaaatgggagcgcctcaggaagagaaaagctgtattcgttgcagtgcttgcgctgacgcttgccctgccgaccttttaccgcagcagctttattggttcagcaaagggcagcagcatgacaaggctaccgctcaccatattgctgattgtatagaatgcggcgcctgcgcctgggtctgccccagtaatattccgctcgtccaatatttccgtcaggaaaaagcggagattaatgcgatcaggcttgaagaaaaacgcgccgccgaagccaaagcacgttttgaggctcgtcaggcaagactggagcgcgaaaaagccgcccgccttgcacgtcataagagcgcagcggtacaaccagcggcaaaagatcaggatgccattgccgctgcgctggcgcgggtaaaagagaaacaggcgcaggccacgcaaccggtggttattcaggcgggtagtctgccagacaatagcgccgtcatcgcggcccgtgaagcgcgtaaagcgcaagcgcgcgctaaacaagccgctcatccgatggctgacagcgcgatacccggcgacgacccgcgtaaagctgcagtggaggcagccatcgcccgcgccaaagcccgtaagcaggagcagcaggccggaagcgaacctgccgaaccggtcgatccgcgtaaagccgcggtggaggcggctatcgctcgcgccaaagcccgtaagcaggagcagcaggccggaagcgaacctgccgaaccggtcgatccgcgcaaagccgcggtggaagcggctatcgcccgcgccaaagcccgcaagcaggagaagcaggccggaagcgaacctgccgaaccggtcgatccgcgtaaagccgcagtggaagcggctatcgaccgcgccaaagcccgcaagcaggagcagcaggccggaagcgaaccggtcgatccgcgcaaagccgcggtggaggcggctatcgcccgcgccaaagcccgcaagcaggagcagcaggccggaagcgaacctgtcgaaccggccgacccgcgtaaagccgcggttgctgcggcgatcgcccgcgttcaggcaaaaaaagcagcacagcagcaggtagttaacgaggattaa

SEQ ID NO: 1704 - DNA, 2115 bp, Salmonella enterica serovar Dublin CT 02021853
atgcttaaactattttccgctttcagaaaagataaaatctgggatttcgacggtggtattcatccgcccgaaatgaagacccagtcaaacggcacgccgctgcgccaggtgcctttagcgccgcgcttcgttatccccttaaaacagcacattggcgctgagggcgagctgtgcgttagcgtcggcgatcgcgtgctacgcggccaggcgcttacccgtggacgtgggagaatgctgccggtacacgcgcccacctccgggacagttatcgctattgcgccccactcgacggcgcatccttcggcgctggcggagttaagcgtcatcattgatgccgacggcgaggaccgctggattgaacgcgagggctggtctgattaccgcgcccacagccgtgaggcgctcattgagcgcattcatcagtatggcgttgccgggcttggcggcgcggggtttcccaccggcgttaaattgcagggcggcggcgataaaatcaccacgcttattatcaatgccgcagagtgcgaaccttacattacggcggacgatcgtttgatgcaggactgcgccgcgcagattgtggaaggtattcgcatcctggcgcatattctgcaaccgcgtgaggtattaatcggcattgaagataacaaaccgcaggctatttccatgctgcgcgccgtactggctgacgctcacgacatttcgttacgtgttatcccaaccaaatacccttccggcggcgcaaaacagcttacccaaatattgacgggaaaacaggttccccacggcgggcgctcctctgatattggcgtgctgatgcaaaacgtcggtacggcttatgccgtgaaacgcgccgtggttgacggcgaaccgatcacagaacgcgttgtcaccttaacgggtgaagcggtaagccgaccgggtaacgtctgggcacggctcggcactcccgttcgtcatttgcttaacgatgccgggttctgcccttctgctgaccagatggtcatcatgggcggcccgttgatgggattcacccttccctggcttgacgtaccggtcgtaaaaatcaccaactgcctgctggcgccatccgtggctgaaatgggggcgcctcaggaagagaaaagctgtattcgttgcagcgcttgcgctgacgcctgccctgccgaccttttaccgcagcagctttattggttcagcaaagggcagcagcatgacaaggctaccgctcaccatattgctgattgtatagaatgcggcgcctgcgcctgggtctgcccgagtaatattccgctcgtccaatatttccgtcaggaaaaagcggagattaatgcgatcaggcttgaagaaaaacgcgccgccgaagccaaagcgcgttttgaggctcgtcaggcaagactggagcgcgaaaaagccgcccgccttgcacgtcataagagcgcagcggtacaaccagcggcaaaagatcaggatgccattgccgctgcgctggcgcgggtaaaagagaaacaggcgcaggccacgcaaccggtggttattcaggcgggtagtcagccagacaatagcgccgtcatcgcggcccgtgaagcgcgtaaagcgcaagcgcgcgctaaacaagccgctcatccgatggctgacagcgcgatacccggcaacgacccgagtaaagctgcagtggaggcagccatcgcccgcgccaaagcccgtaagcaggagcagcaggccggaagcgaaccggtcgaagcggtcgatccgcgtaaagccgcggtggaagcggctatcgcccgcgccaaagcccgtaagcaggagcagcagaccggaagcgaacctgccgaaccgatcgatccgcgcaaagccgcggtggaagcggctatcgtccgcgccaaagcccgcaagcaggagcagcagaccggaagcgaacctgccgaaccgatcgacccgcgcaaagccgcggtggaagcggcgatcgcccgcgccaaagcccgtaagcaggagcagcagaccggaagcgaacctgccgaaccggccgacccgcgtaaagccgcggttgctgcggctatcgcccgcgttcaggcaaaaaaagcagcacagcagcaggttgttaacgaggactaa

SEQ ID NO: 1705 - DNA, 1077 bp, Shewanella oneidensis
atgaatccagagctcatcactatgctaaaagaaacggcaaatatgtttgcgtttcttgcacttgagttaaccttgttattcctcgtgataagttatctcgttggtatgctgcaggagtttgttacccctcaaaaagtgcagtccattttgagttcgcgtaatggcaaaggttatttaattgctgcgctgcttggatctatcacgccattttgctcttgttcaacgatcccatttttaaaaggtctactcagggctcgtgcgggttttggtccaatgatggtgttcctatttgccagcccattattgaatccgattattattggattatttgtcgtcactttcggagttaaagtcgcggtcttttactttgtgatggcaatgggagtatctgtgatcgcgggctttacactggaaaagctgggatttgaaagatatatccgtaaagaggcctacgaacaacaagagttaggcgcatctgctgggaataataagcaatcttctgctccatcctcttgctgtgatacaacaccagctccagttgcatcctcttgttgtggggtaacatctgagccagttacatcttcttgctgtggaacccaacctgcgcctgttgcatccttatgttgtgacgatcgttcgtcaattttaccgccgcaggtgcgcacagagcatcgttggttacgcgtttggcgcacaacgtggaaggactttaagcaagtatcaccctatctttttgttggggtgttactcggctcatttatctatggctttatcccaacagaattcattgttaactacgcaggcgaagccacttggtatgctatccctcttgcggcggttattggcattcctctttatattcgcgccgaagcggttatcccgctcagcgcggcattagtccaaaaaggtatggcgatggggtctgtcatggcattaatcatcggtagtgccggtgccagcatcacagaagtgattttgttaaaatcaatctttaaaaatcaaatgattgccgcatttctaggtgttattttagctatggctatcgcctctggatttctttatggtttagtcttttaa

SEQ ID NO: 1706 - DNA, 915 bp, Colwellia psychrerythraea 34H
atgacaattacacaacaaatggtatttgataccttaaacatgtttgcttttttagccgtagagctaaccgtactgtttttactgatcagttatattgtcggtgttcttcaggaatatattccgccgagtaaaattcagagtattttaagtagtaagaatggcaaaggttatatcgtcgccgggtttcttggtgccattacgcctttttgctcctgctcaacaattccttttttaaaaggattacttagagcaaaagccggctttggcactatgatggtgttcttatttgctagcccattacttaacccaattatcattggtttatttgccgttacctttggcttaaaagttacggcattctattttaccatagcaatgggtgtttcaattgctgcgggttatttgttagagaaatttggtttcgaaagatacattaaacctgaagcctacattactcctgaaagtaaaagctgtgcaactagctgtggtaataatatcgagacggtaagtaaatggactaagatttggcacagcacctggtctgattttaaaaaagtattgccttatttaataggtggtatcgcattaggttcaatgatttacggatttatgccaacagaatttgttgccagcgtagcaagtgagagcaatccctttgcagtgcctattgcagcagtgattggtattccactctatataagagctgaagcagtaatacctttaagtgcagcattagcagcaaaaggcatgggacttggtgcagtaatggcattaattattggcagtgcaggagcaagtttaaccgaagttatattgcttaaatcgttattcaaaaatccaatgataattgcctttttaacggtaatattatcaatggcggtaggtgctggttatttgtattcatttcttttctaa

SEQ ID NO: 1707 - DNA, 1026 bp, Jannaschia CCS1
atggctgaccaaacccttatcccgcgcgtcctgccccagatctggggccgcatcgacaaggtcgccctgaccttcgtgctgatcgtggccgtgctggccgccttcgaccgcagcgctgtcacccccactttgcaggaaacgctggagcactttggcggcacgttgccgtttatcctgttcgccgtcatggccatcggcgtgatgaaggccacggggtccgagcggcttctggacggcgcgttcgcaggccgcgaggcgcggatgatcgtggtcggtgccctcgcgggcggcctttcgcccttttgttcctgcgaggtgatcccctttgtggcagcccttctggccgctggcgcaccgctcagcgcagttatggcattctggcttgcctcgcccctgatggaccccgcgatgtttgtggtcacagcgggcggcatcgggtttgacttcgcggttgcgaaaaccgtggccgccgtggcgcttggcatctttggcggcgtgatggtgatgaccttcgcccgcacgcctgttttcgccgacccactgcgcgaacagcccatgaaaagcggatgctgtgcgcccaagaaaaccaccttgaactggcgtttctggcaagaggcggaccgccgcgcgacatttgcacaggccgcgtgggacaatttcatcttcctcggcaaatggttgatgctggcctatctgctgcaatcgctgttgatctcttacgtgcctgccgcgctgattgcgcaggttgtcggcggcgacgggctgatgccgattatcgtcggtgcactcgtgggcgcgcccgcctacctcaacggctacgccgccgttccgctgattgcgggtctgctggagcagggcatgagccccggagccgccatgtcctttgtcattgccggaggcgtcagttgcatccccgcagccgtcgccgtctgggcgttggtgaagccccgtgtttttgcagcctacctcggcctcgcccttgcgggtgcaatcattgcgggtatggtctggagtgtgatcgcctaa

SEQ ID NO: 1708 - DNA, 1032 bp, Ruegeria sp. TM1040
atggctgatacttctctttccctgcggccgatgcgggccgctcttgaagggatgcagagtccgtggaccctcggcgcgcttattctggctgttgtcgctttggtggatggcgcaaatttctggccggttctgagttttgcagcgcaggccttgttgtcgacatccaagtacatcctttttgcggtgactctcttggcctatctcaaggccactggcgcagaggcgatggtggcgcgggcctttgtggggcgcgagacacggatgatcttccttgcagcgcttcttggggggcttgctccgttctgttcttgcgaggtgatcccattcatcgccgggctattggcgctgggcgcgccgctttcggcagtgatggcgttctggttgtcgtcgccgctgatcgacccgccgacattgttgatcactgcggcggcgcttggctggccctttgcgctggcaaaggcggtgagcgcggtggcgcttggtctatttggcggttttgtcgtcaaggcattgcgccgtggcgggctttttgcggagcctctgaaacgagctcctgtcaaaagctgctgcggatgcgcagcgcctgccaccgatgcacggcccaattggcgtttctggcaagacgcagagcgccgcgagatattccgcggtcagtttgtggagaacgctctgttcctgttgaagtggcttgcgtttgcctatgtgcttgaggcgcttctggtgacctatgtgcgtccagagtggattgccgcgatcgtgggaggagaaggcgttgtcccgattgcaatcgctgcggtggttggaatgcccgcctatctcaactcctatgtggcgccgccattgttggctggattgatgagccaggggatgagcgcgggtgcggcgcttgcctttatgatcgctggtgccgtgagctcgatcccggcaatggcggcggtgtggtcgctggtgaagccgcgggtctttgccacctatctcgggcttggtgtttcgggggcgatcctgtcgggcgtcgtcttccagatgatctga

SEQ ID NO: 1709 - DNA, 951 bp, Shewanella frigidimarina NCIMB 400
atgtggaaatttaaaatgataaatattactcaacaaatgcttatagaaaccttaaacatgtttgccttccttgctgtagagctaacggtcttgtttttagtgatcagttactttgtcggcatacttcaggaatacatcccaccatcaaaaatacgaaccattttgagtggtaaaaatggcaaaggatatatcgtggcgggattattaggggcaattaccccgttctgttcgtgctccactattcctttcttaaaagggcttttacgagcaaacgcaggattcgggccgatgatggttttcttgtttgcaagtcctctgctcaatcccattattattggattatttgccgtgaccttcggtctaaaagtaacagccttctattttgctatcgcaatgggagtatcagtaattgcaggttttacccttgaaaaactgggctttgataagtatgtaaaacctgaagccaattttgcaccagatgtgacaaatgcacctgaaaaaacaacttgcgggtcttcctgtggcggcaaaaccaaacaggtcagtaaatggcgaaaaatttggaacagcacatggagtgactttaagaaagttcttccttatttaatcggtggtatcgctcttggttcaatgatttacggctttatgccaacagagtttgtggtaagtgttgcaagtgaaaacaacccttttgctattcctatcgctgctgtcattggtattccattgtacattcgtgctgaggctattattccattaagcgccgcattggcagcaaaagggatgagtcttggcgcagtcatggcgttaattattggtagtgctggagcaagtttaactgaagtcattttgcttaaatctatcttcaaaaaccaaatgattgtcgctttcttattcgtcatattgagtatggcaatgggtgctggatttctataccaatcaatattttag

SEQ ID NO: 1710 - DNA, 1077 bp, Shewanella sp. ANA-3
atgactcccgaaactatcactatactgaaagaaacggtcaatatgttcgtctttcttgcatttgagctaaccttgttatttcttgccataagctacctcgtcggtatgctgcaagaattcatcacgccgcaaaaagtgcaatccatattaagttcccgccatggtcgaggctatatagtggccgccttgctcgggtctatcactcccttttgctcctgctccactatcccattcttaaaaggtttactcagggcccgtgcgggatttggccctatgatggtattcctatttgccagcccattacttaatccggtgattatcgggctttttgtggtcacctttgggtttaaggtcgcgctattttattttacggtcgctctgggtgtctctgtaatagcaggttacttgctggaaaaactcggatttgaacaatatgtgcgtcaagaggcctatgctcaggcagatacagccactgctgcttcatgttgcgatactaaaccgtcaccgaccgcgagtagcggttgcgaagtaacccccgcacccgttgtcagcgcatgttgtgatagtaaaaccgcccccgcggtgaccttgtgttgcgttactcaagctgagcctattgcaacttcgtgttgcccttcccaaaccgtgccgcaaaacaaacctcagagccgctgggtaaaggtttggcgcgccacttggaaggacttcaaacaagtgctgccctatctgtttatcggtgtgctattgggttcaatgatctacggatttatgccaacggagttaatcgttcagtatgctggagaagccacatggtatgcgatccccattgccgcattaattgggatcccactctatattcgcgccgaagcggttatcccactcagcgccgcgttaatccaaaaaggcatggcgatgggctcagtaatggcgttgatcatagggagcgccggagcaagtttgaccgaagtcatattacttaaagccatttttaaaggtcagatgattgccgcatttctcagcgttattttaggcatggctgtgggtgcagggtttctgtatagctatctatttagctaa

SEQ ID NO: 1711 - DNA, 1077 bp, Shewanella putrefaciens CN-32
atgactcccgaaactatcactatgctgaaagaaacggtcaatatgttcgtctttcttgcatttgagctaaccttgttatttcttgccataagctacctcgtcggtatgctgcaagaattcatcacgccgcaaaaagtgcaatccatattaagttcccgccatggtcgaggctatatagtggccgccttgctcgggtctatcactcccttttgctcctgctccactatcccattcttaaaaggtttactcagggcccgtgcgggatttggccctatgatggtattcctatttgccagcccattacttaatccggtgattatcgggctttttgtggtcacctttgggtttaaggtcgcgctattttattttacggtcgctctgggtgtctctgtaatagcaggttacttgctggaaaaactcggatttgaacaatatgtgcgtcaagaggcctatgctcaggcagatacagccactgctgcttcatgttgcgatactaaaccgtcaccgaccgcgagtagcggttgcgaagtaacccccgcacccgttgtcagcgcatgttgtgatagtaaaaccgcccccgcggtgaccttgtgttgcgttactcaagctgagcctattgcaacttcgtgttgcccttcccaaaccgtgccgcaaaacaaacctcagagccgctgggtaaaggtttggcgcgccacttggaaggacttcaaacaagtgctgccctatctgtttatcggtgtgctattgggttcaatgatctacggatttatgccaacggagttaatcgttcagtatgctggagaagccacatggtatgcgatccccattgccgcattaattgggatcccactctatattcgcgccgaagcggttatcccactcagcgccgcgttaatccaaaaaggcatggcgatgggctcagtaatggcgttgatcatagggagcgccggagcaagtttgaccgaagtcatattacttaaagccatttttaaaggtcagatgattgccgcatttctcagcgttattttaggcatggctgtgggtgcagggtttctgtatagctatctatttagctaa

SEQ ID NO: 1712 - DNA, 1137 bp, Vibrio harveyi ATCC BAA-1116
atgaatccagaaatcatgaccatggctaaggaagcgcttgatatgtttgcgtttctagcaaccgaacttatcatcctattcctagcgattagctacatcgttggtgtgttgcaagattttctaacgccagaaaaaatccaatctatcctgagctcgaaaaagggtaaaggttactttatcgctgcgctactaggttcgattacgcctttctgttcatgttcgaccattcctttcttgaaaggtttattgcgtgcaagagcaggttttggacctatgatggtgttcctatttgctagtccactacttaaccctgtaatcattggtttgtttgtagtgacctttggttggaaggtagcggtattctactttgctatcgcgatgacagtgtctgtggttgcgggctatgttcttgaaaagctaggcttcgaacgttacgtaaaaccagaagcgtacgaagcagcaggcacctcttcatgtggtacatcttgcggtgattcaagcaagaaaaaagaacaggcgaaacctgcatcaagctgtggtaccagcgcttgtggcgaacctgcacctgttgcagcaaaaacatcatgctgtagtgagccagcgcctgtggtagcgaaaacatcttgttgtggtgatagcgcaccaaaagcagaacctaaagtagaagtgtcttgctgctcatcagacggtagtgcaacagcgaccatcgtggaagaaaaagagcctagccgctgggtacgtatttggcactcaacttggaaagactttaaacaagtgttcccttacctaatgatgggtattgcgattggttcattcatctacggcttcatcccaacggatcttattgcggagtacgcaggtgaagcgaagtggtacgcgattccagtagcagcaattattggtattccattgtacatccgtgcagaggcagttattccactaagtgcggcgctagtacaaaaaggtatggcactgggttctgtaatggcacttatcattggtagcgcaggcgcaagtcttacagaagtgattttattgaaatcaatctttaagaaccaaatgattgcagccttcctatttgtcatcctaagcatggcaatgggtgccggttacctgtacacctttatctttgcttaa

SEQ ID NO: 1713 - DNA, 1002 bp, Escherichia coli E24377A
atgagtagttggcttgcgatgctgcaagatgccgcagagatgtttgtgtttctcgccgtcgagctttcgttgctgtttatagtgattagtgccggtgtcagcctgataagacaaaaggtgccagaccataaaatccagcagatgatgggggccagaaaagggagaggctatctcctggctgctctgttgggagccgttaccccgttctgtagttgctcgacaatacccatgttacgtggattgttgtcagcgaaagccgggtttggtccgactctcacttttttatttgtttcaccattacttaatcccattatcgtcggactaatgtggatgacctttggttggaaagtcaccttgttgtacgcgattatcgccgccggcgtctccgttcttgccagtattatcctggattctctggggtttgaacgtcatatcattgccagtaaaagctcatcagcaaattgttgtgctctagcaaaaacttcgccgggaacgacatatacgcccataaaagtgagttgttgtagtccagcggctaaagccattgagaaccccgtagttacctgttgcagtaccaaagctgtagtaagtattaatcccataaaactagccaccaaagatgcgttgcaacagtttaaagatgtactgccatatcttttgttaggagtattaataggatcttttatttatggctttattccctcagcgtggattgccgctcatgcaggagcagataatcccttcgccatcccattaagcgccgttgtcggtattccgctgtatatccgggctgaggcagttatccctctggcatctgttctgatgacaaaaggaatgggtctgggagcattaatggcattaatcatcggcagtgccggcgcaagcctgacggaagtgatattacttaaatcaatgttcagaatgccgatgatagctgcattcctgacggttatattaggtatggctatcttgatgggctatttgactcaattgctattttaa

SEQ ID NO: 1714 - DNA, 1047 bp, Dinoroseobacter shibae DFL 12
atggccgagacctccacacagcctcctgacctcggccacgccaaacggcgccgcctgccccgccccgatgcggccctcaccgccatcgccgttatcctggtcgcggttgcggtcctcgacacggccgccctgcgcccggtcatcgagaacacgctcgggtcctttgggcatacgctgatcttcatcctgttcgcgatcggcactgtcgcctatctgcgcgccgcaggggccacgaccctgctggccaaggtttttcaaggcaacgagacccgcatgatcgtgctggccgccgccttcggcgggctctcgcccttttgttcctgcgaagtgatcccgttcatcgccgccctgctcgccgtcggcgcgccgctgagcgcggtgatggcgttctggctggcgtcgccgctcatggacccggccatgttcttcatcacctccggtgctctgggcctcgatttcgccttgggcaaaacggtcgcggccatcgggctggggatgatgggcggcttttccgtgcgcgcccttgccgggacagccctctacgccgaccctttgaaatctgcgccgaagtccgggtgttgcggctgtggcccgacgcctttcgatgggcggccggtctgggcgttctggcgcgaagccccgaggcgtcgcgagtttcgcgacgtcgcggtccacaaccttctgtttctcggaaaatggctgctgctggcctatgtgctggaatcgctcatgctgcgctacgtgcccgcagacctgattgcgagcgccatgggcggggacggcataggcccgatcctgatcgccagcatcgtgggcgcgccgctttacctcaacggatacgcggctgtcccgctgattgcgggtcttctggaacagggcatgtccccgggtgcggcaatgtccttcgtgattgcgggcggcgtcagttgcattccggccgccgttgcggtctgggcgttggtgaaaccgagggttttcgcgtcgtatctggggttttccctgaccggcgcgatcctcgccgggcttgcctggaacatgattgcgtga

SEQ ID NO: 1715 - DNA, 924 bp, Shewanella woodyi ATCC 51908
atgttgtcacaaagcaccatcaatatgctccaagaaacattgaacatgtttatttttcttgcggtagaactaaccctgctgttcctagccatcagctatcttgtcggggtactgcaggagtatattccaccgagtaaaatccaaaatattttaagttcaaaaaatggcaaaggttatcttgttgcaggttttttaggtgcgatcacccccttctgctcctgctcaacaatcccatttttaaagggattactcagagcaaaggcaggatttggcaccatgatggtgttcctgttcgccagcccactgctcaatccaattataattggactatttgccgtcaccttcggacttaaagtaacactcttctattttgttatggccatgggcgtttcggtgatagcaggctatgcgctggagagattaggatttgaaaagtacattaaagccgaagcttatgaagaaccaaagcctagctgttgtggcacaagctgtggcgctaaacctgcagccattagcaaatggagaagaatatggaacaccacttggaaagactttaagaaggtacttccctatctaataggcggtattgcggtgggctctatgatctacggatttatgccaactgagttcgttgccaaagtcgccagcgacagtaacccctttgccgtacctattgccgcaatcataggtatcccgctctacattcgcgcagaggcagtcataccacttagtgcagcactggcagctaaagggatgggattaggcgctgttatggcattgattattggcagtgcgggcgccagtctaacagaggtgatactgcttaaatctttgttcaaaaatcagttgataattgcctttctcactgtgattatcaccatggcaatcggtgctggttacctgtatggctttatctttagttaa

SEQ ID NO: 1716 - DNA, 1080 bp, Escherichia coli SMS 3 5
atgaatagttggattcctatgttgcaagatgccgcagagatgtttgtttttctggctgttgagctttcattgctgtttattgtcattagtgccggtgtgagcctgataaggcaaaaagtcccggatcataaaattcagcagatgatgggggcgagaaaaggtaaggggtatctgttggcctcgttgctgggagccgttacccctttctgtagttgctcaacaattccaatgttgcgaggattgttgtctgcgaaagcggggtttggtccgacactcacttttttgtttgtttcaccgttgcttaatcccattatcgtgggactaatgtgggttacctttggctggaaagtaactttgctgtatgcgatcatcgctgccggtgtttcagttctttccagtattatactggattatttagggtttgaacgtcatattgttgaatacaaaaattcagtatcaggtagttgcgccaccaagtgcggtgattctgaagcttcggtaaaaacgaattgctgtacttcatcagcaaaaaccataattaacttaaagacagtaaagaaagagcaaaatatatcggcgtgttgtccctcaattctatcagaaaaatcttctgaaagttgttgcagcagcgagagtcagggcaacagaaatctcacaatgaatgccacctctggtctaataaaattagcaatgaaagatgccttacaacagtttaaggatgttctgccttatcttttgttagctatattaataggttcatttatttatggttttatcccttcagagtggattgcagctcatgccggtgcagataatccattagccataccgctcagtgctgttgttggtattccgctgtatattcgtgctgaggccgtaataccacttgcatcagttctgatgactaaaggtatgggcctcggagctttaatggccttgataatcggtagtgctggagcgagtctgacagaagtaatattgcttaaatcaatgttcagaatgcccatgataatcgcatttctgacggttatcttaggtatggcaatccttatgggatatttaacgcaatttttgttttaa

SEQ ID NO: 1717 - DNA, 1002 bp, Escherichia coli SMS 3 5
atgagtagttggcttgcgatgctgcaagatgccgcagagatgtttgtgtttctcgccgtcgagctttctttgctgtttatagtgattagtgccggtgtcagcctgataagacaaaaggtgccagaccataaaatccagcagatgatgggggccagaaaagggagaggttatctcctggctgctctgttgggagccgttaccccgttctgtagttgctcgacaatccccatgttacgtggattgttatcagcgaaagccgggtttggtccgaccctcacttttttatttgtttccccattacttaatcccattatcgtcgggttaatgtgggtgacctttggctggaaagttaccttgttgtacgcgattatcgccgccggcgtctccgtacttgccagtattatcctggattccctgggatttgaacgtcatatcattgccagtaaaagctcatcagcaaattgttgtgctccagccaaaacttcgccggggacgacatatacgccaatagaagtgagttgctgtagtccaacggctaaagccattgagaaacccgtagttaactgttgcaataccaaagctgtggtaagtattaatcccataaaactagccaccaaagatgcgttgcaacagtttaaagatgtactgccatatcttttgttaggggtattaataggctcttttatttatggctttattccctcagagtggattgccgctcatgcaggggcagataatcccttcgccatcccattgagcgccgttgttggtattccgctatatatccgggcagaggcagttatccctctggcatctgttttgatgacaaaaggaatgggtctgggagcattaatggcattaatcatcggcagtgccggcgcaagcctgacggaagtgatattacttaaatcaatgttcagaataccgatgatagttgcattcctgacggttatattaggtatggctatcttgatgggctatttgactcaaatgctattttaa

SEQ ID NO: 1718 - DNA, 3441 bp, Brucella suis 1330
ttggcagagaaaccacaaaaaattcgcttcaccaagcggcagatgaaaaggatcgagcgcctcgtggctgaaagcggcgagggtatcgtatcaggttcggtgcgttctgcgcgatcgattgtttcgcgttgttctcatgcccttctatcgatctgcattctgcttgttctgctgggtggcgtggggtttgtcatcctgcgtggcggggtcaacagcgatcttctgcgagatgaagcccagaaaagcctctcccatattcttggcgaaggagcatccgcttccattggcagtgctgcgctttcacttgatcgcaacggccatgtcaccatggaagcgcgcgatgtgtcgattgttgatccgaaacagggggttgcgatcaacggtataaagtctgttcgtctggggcttgcaccgctgccgcttttaacgggaaaactgcgcgtggcgcagcttgaggtggaggggctcgcctttgatttgccggaagcgcgcggcggcggtttctggaaatccttgccttatgatgaaaagggctatgtcgatttcgatgccgcttccggtgagatatttgccgccatgcgccgcagcctggagcttttgagcgcgcaggacacgcgcgttatccgtatcgccaacagttcggtgtccttcaaggtgggcgaagaagagcaggtactcgatattgaacgcgcccgcctgaccgaagatcgcggaaagatcgccatcaccggcaccgtcgtctgcaagggcagaaagattgccctcgacggcgatatcgaacgcagggcgagcgacaaggcgcttagcgcatttcgcctgaatgtgaaggatattccggttgttatgggctccccgccacaagtcgcccccgtcatcaacggcaatcgggtgaacccggctcatttcgagcttgatgcttatgcacaattgacgctttcaggatttgcggcggatggcgataagccggaacggctggccgctgacctgacggtggatggcatcgacatgcagttgggcaaggtggataatgttcgcggcaatgtgcgcctcagcctcgaacaccgggttgggagccacaagatcgagatcaaaccgtcccgccttgtgctcggcggcttgcaggcgcagttcaacggcgccttcggcccggaacaggaggcagagagcaatacagatggcccctcctatcgctttgaggtgcttaccacttcggcgaccagtatgccccccgaatccagcgatccgccgctctcttttgcaacccgcatcgcaggccgctatatgcccgctcagcaacgcatccagtttgtcaatctggacgtacagacggaaggcgggcagctttacggtcagggcagcatgggttttggtgatggttcgccggaaatgatctttatgctgcgcattcccaagatgccggttgccgatgccaagcatctatggccgatcgacgttgcagatggcgcgcgcgaatgggtgttgaagaatctttttggcggaacactgcaagatagccgcatcgatatttcgctggctggcgggcgcttcaatggtcccggcctgccgccgcctctcacggaagaggagatcaatgccgatttcaatgtcgtggacacgcgcttcgatgtggttggggaactgcctgccgtgcgcgatgccgatggcacggtttccgtgcggggtgcctataccacgatcaagcttctcaagggtaccgcctataccccgaacaaccggaaggcgaccgtttccaacggcacgctcgttattccatgggggccgcagcggcccgttatggccgatcttgatctccatgtgtcgggcgaggctgcggccatcgcggaaatcgcgggaaacaaacccatcgatgtgctgaaaaatgttcccttcctgccgcaagatgtgacgggggatatcaatgcacaggtgaaggtgagctttgccgtgtcgaaggatccgccgcctggcacactgaaatggaatgcggatatcggattttcggagcttgatattgccaagccggttggcggctccaaaattacggatgctacaggcaatatcaaggtagaccagtctgccgctatcattacagccgatgccagactggacaatgttcctgcgaaagtcagcatgacggagcccgtggaccgctccggcccggcaaagcgcgagcagaagataaagctggaaatagacgacaagacccgcaatgcggtctttcccggcctgaatgccgttttctccgggccgatgtcggtcgatctggggatggagaatggtggcaagcgccatgtctcggctgatcttttaaaaacgcagatcgatctgccctggcttggatggcgcaaaggcgcaggcattcccgccaaggccacctttgatcttgtcgaacatagtgacaaaggtgaatttgaaatcagcaatctggtattttccggcgatgctttcggtgcgaaaggcaatctctccatcgccaagggtgactttcagtcggcggatttcagtgaaattcgacttaaccgcagcgataatctctccgtaaaggcgacaaaaagcgggaacagcttccgggtcaatgtgcgcggctcgcaattcgatgcgcgggcgctcatcaagcagatttccgatcttgaagcaaaaaagagcggaggcggtcgcgccaacagtccgcgtgtcgtggtaagtgcgcaggttgatgaggttcacggattcaacaacgaaacgcttcgcaatgttgctgtgtcttatgaaagcgcaggctcgaaagtttccggcatttccgtcaatgccgtcacctcgtcggggcagcccttcgtggccaccaataacgatcagggcgatgcgcgctccatatcgcttcagtcgaacgatgcgggtgcggtcctgcgtttctttgatttttatgacaagatgcggggcggcaagattacggtgggcctggccgctcagggaaacgggccgctgcgcggccagatcgatgcgcgcaacttttccatcgtcaatgaaccgcgtctggcgaaaatcgtttccagctcgccatcaagcggcggcgccagcctcacccaggctgtcaaacgtgatattgacgtgtcgcgggtggatgtggagcgcggcttttccctgattgaaaagggccaaggctatctcaatctgtcgaaaggtgtcgttcgtggtcctgcggtcggaacgacatttcagggcacgctctatgaccagcagggcaatatgtctatcacaggcacattcatgccggcttatggcgtgaaccgtatctttggcgaagtgccgattttcggcgcgcttttgggcaatggccgtgatcgcggcctgcttggtattacttataagctcgtgggcaatgcgaaacagccacaggtgatcgtcaacccgatttcgctcatcgcgccgggcattttccgttccatcttcgagttccaataa

SEQ ID NO: 1719 - DNA, 3633 bp, Nitrobacter winogradskyi Nb-255
atgactaaaagcacgccgacacgagatccaaatccgcacggcgatcatcatgtctcgcagggagaggtcgccggctggggcgaggacgacgacgaactccacagccgtcgcgtacgtcggttgctgtctcgatcggattcgaggtttcacagggccggcgaccgattcgtgaggttcagaaactggctggcgggagagcgctggatcaaacggctcgcggtcgcctttctggttctgtcggtcacgttcgcagggggattcggtgcgctgtggtggcggctcggtgctggtcccctcaatctcgacatgatgacgccatggcttgtcagtgcgatcgaaggaaacatcggtcacgacaacacggtggagatcggcggcactcagatcgagcgcgccggcagaattcgcatcgcggtccgtattcgtgacgtcgtcgtccgtgaccgcgaccgtgtcgtgatcgcgagcgcccccaaagccgaggttaaactgtccggtttggcgctgttgacggggcggctgcgcgcggaaagcctcgacctggtcgacgccgagctcgcggtccggattacgccggacggccaggtcactgtttccacgggcgacaacgccaagccgcttgccacgggcgtcgcgccgcccctgcgatccggcctgccatcggcggtcgtctcctcggaaacgtcgccgcccccacaagctacgcagcaactctccgactccccggccgcggcgccggcgagctcggaaagcagcggcaacgcaggcgccctgttggcgggattggaatggctcgacggcctcggcgtaaggggactggatggccagaatctcaacgagattggtctgaagaacgggaggctggtggttgatgaccagcaacgcggcaaccgttggagctttagcaacatcagcctgagccttcaccggccgagcgcgggcggagtcgcgttcactgtcagcgaaggcggcagcaaggaatggtcgcttcatgtcgcggtcgggccgcccgcgaatggcgtccgtccgattgaactccgcgccgccggaattccagcgaagaccgttctgctggctcttcgcatcaaggatctcacttacagcgccgacatgcccctcagcggagaattgaagggcgagattggtcgcgatggcctacctacgtatctccggggcaatcttttcgccggcaaaggcacgatcatcgattccgacacgccggattaccccatggcgatcgatcagatcgaaatgaacgtggaatgggattcgggacggcgcgtgcttctggtgccgttcaagatcgtgtccggcgaaaacaggatcacgctgctcgcccgtctccagcctccgaacggcaatgttccggactggcagatgggtttgagcggcggcaccatagtgctcgccggctccgatggggaagcgcctctgatcttcaaccgcattgcggtcggcctgcgtttcgacaccgggcacaggcaggccattctgacccaggccgatatcagcaacggcgagatcggcatcgcgggcaccggcagcatcgactattcggatgcgccgcgcttgaaactgggcttcgccgggacgccgatgtccgccgccgcgcttaagagcatatggccggctgtgatcgtgccggaactgcgggaatgggttatcggacgaattaaacgaggctttctcaagcgcattgaaatcggcgtgaattcgccgcttcacaatctgtcgcgtcgcggaccgcctatgccggatgacgggctttcggtcgatatcgtcgccgacaatgtgacgatctatcccgttgatgaactacccctggtccacgacgccggcctgaaggcgcgggtgacaggaagaacggcggcggtaacgatcgagcaggccgtcgccgacactccgtcgggcagaaggctcaacatttccgacgtcgttttcgaagtgcccgatatggcgcccaaaccctcgccggcaaaggtgagattcagaatagacagtccggttcccgcagccgcggaaattctcgtctcggaccgcctcaacgaattcaccgataatctgatcgatcccaactccagcaagggcaccgttgcagcccagatcgccctgggcctgccgctcacgcgacagatcaccaaggaagacaccacctattccatcaccgccgatctcacgggttttgccgccgaccggttggtcatgaatcagaaacttgaggcgagcgcgctgaaggtcaccgccaacaacgaggggtatcacgtcaagggcgacgtcaagatcaacggccagccggcatcgctggactaccgcaagccggccgatggcgatgcggacatcaagctgcaggccacgctggatgatgcgagccgcgcaaagctcggaattgatctcggcgcgggagcgaccggctcgattcccgtcaagctggccggcaagatcggccgcaacagggataataaattcgccgtcgatgccgatctcacatccctgaagctcgacaacattttgcccggctgggtcaagctgccgggcaagtcaggtcacgcgacgttcaatgtcgtgcagaaagcgcaatccacgcgcctggaggacatcatcgtcgacggcagcggcgtcacgataaagggatcactggaggtcgatcagaacggcgatctggtgaacgtgaacttcccggtttacgcgccgtcggaaggtgaccgggcttctctgaaggccgaacgcaacgctgacggcgtgttgaaagtcgtcatgcgcggcgacgtgttcgacggtcgcggctttctcaaatcggcgatctcgggcaagcaggccgacgccaggagcaagtcgaaaagcatcgatttcgacatcgacctgaagatcggagccgtcgccggattttacggcgaagccatacgcagcgcggacgtcaagatggcccagcgtaacgggtcggttcgcagcctcaccatgaccggcaagatcggacgcaacacccccctgacaggcagtctgcgcggccgtccgcagggtcgcgacgtggttctgatcgagaccgacgacgccggcgcgttcttccgctttaccgatacctacggaaagatgtttggcggtcagctcgcgctggccatggacccgccgaccgccgagcagcgggccaagcagggactgatcaatgttcgcgatttcaccatcaagggcgaatccgctctggatcgcgccgcggcgggtggcccccgaaccgctcagaacggcatttcattctcgcggctgcgcgcggaattcagccggcagaacggacaactcacggtccgcgatggcgtcgtcaagggtccgacgattggcgcgaccattgaaggacggatcgattatccagccaacgaggttcgcatgagcggcaccttcgttccgatgtacgggctcaacaacatatttggacagcttccggtcgtcggacttatccttgggggcggcagcgacgagggattgatcggcgtgacttatgaggtggtgggaacaccgggacaaccgcaactgcgcatcaacccgatctcggccatggcgccgggactggtgcgcaagatttttgagttccagacgggaagaacagccaaccagatcgagtttccggcaacgagcgggaactga

SEQ ID NO: 1720 - DNA, 3735 bp, Rhodopseudomonas palustris HaA2
atgccgccacaggagcgtatcctgcgcgtcggcgcaaaaccctccctcggcgatcaggctgcgacaaagcgcgtgcaccgagaggccatggccagcgacccatcgcaaaacgcatccgggccgcatccccaccacgacgccgatcattggcaggagagcggctgggatcccgagcacgaggaggccgggcgccatcgcgcccgcaaattgctggcgagacgggggctcggctttcaccgggtggacgattcgatgcggcgctggcagcaccgattgtcgggagccccctggttgaggcggatggcgatcgcactgctggtggtcggcttcgtgctggcggccggttttggtggtctgtggctgcggctcggtgccggaccgatcaatctcgatatggcgacgccctggctggccgacgcgatcgaagagaacatcggcaacggcaacaccgtcgaggtcggcggaacccagatcgagcgggtcggacggattcgcgtcgcggttcggatccgcgatatcgtggtgcgcgaccgcgaccatgtggttgttgccactgcgccgaaagcggaagtccggctgtcgggccgcgccctgctgatcggcaaattgcgcgcggagagtctgcgcctggtcgatgccgaactggcgatccggatcacgccggatggccaggtgacggtgtcgaccggcgacaccgagcggccgattgcgactggcgtcgcctcgactcgcaagccaccggaattcaccttgccgggccagtcgcccgccgctgccacggcgcccggacaagacggcacagtgtcgccggcgcagccgggcggtgcggcgccgcccgctgcggccgaccgggacggcgatgcgatgaagagcctgctcgccgggctcgattggctcgacagcctgagcctgacggggctcgatggccagaacctcaacgagatcggcctgaagaacggcaatctcgtcgtcgacgaccagcagcgcggcaatcgctggagcttcgagaacatcagtctcagcctgcgccgtcccagccgcggcggcgtcgcgctcagcttcggcgaggagggggcgaaggcgtggtcgctgcgggttcaggtcggtccgcctcaggatggcgtgcgcaccgtcgagttgcacgccaatcaggtgcccacgcgcaacatcctgctggcgctgcggctgaagaacctgacttacggcgccgacttcccgctcaccggcgatctcaagggtgaaatcggtcgcgacggtctgccgacctatttccgcggcaagctggtcgccggcgccggcaccgtgatcgattacgacacgcccgattatccgatggcgatcgatcaggcggaattcaatttcgaatgggatgccaaccgccgcgtgctgatggcgccgttcaagatcatcgccggcgccaaccgcgtcacgctgctggcggcgctcgagccgccgaacggcagtacaccggattggcggctcgctttgtcgggcggcaccatcgtgctgcccggcgcggaaggcgaagcgccgctgatcttcaaccgcatcgccgttcgagtcagcttcgacaccgaccatcgccgggtgctgctgacccaggccgacatcaacaacggcgagatcggcgtcgccggctccggcagcatcgactacagcggcgagccgcgactgcaactcggactggccggtacgccgatgtcggtgtcggcgctgaagcggatgtggccgatcctggtggtgccggaagttcgggaatgggtctatgagcggatcgacaagggatcgatccagagcatcgatatcgccgtcaattcaccggtgaaaaacctgtcgcggcgagggccgccgattccggacgaagggctgctggtcaatatcatcggcaccggtgcgaccatccacccggtcgacggcatgccttgggtgcgcgacgcagatatgcgggttcgcgtcaccggccgcaccgctgcggtcgcgatcgcgcaagccggcgccgatacgcccagcggccgcaagatcgcgctatcggatatcctgttcgaggtgccggacatggcgccgaagccgtcgccgtcgcggatcaagttcaagctggacgcaccggtgccggccgtcgccgaggtgctgtcgtcgggccggctcagcgacgtcagcgacgtcccgatggatcccaacaccagcaagggcgccgtcagcgcgcaggtcatgctcggcatgccgatccagcgcgaactgaccaaggccgacaccacttattcgatcaatgccgacgtcaccggcttttccgccgacaagctggtgatggggcagaagctcgaggcgaacacgctgaaggtgaacgccaacaatcagggctatcaggtcaagggcgacgtcaagatcaacgggcagcccgcgacgctcgactatcgcaagccggcgcagggcgaggccgatgtccggttgcagtcgacgctggatgacgccagtcgcgccaagttggggctcgatctcggcagcgcggtttccggcgccgtgcctgtgaagctggtcggcaagatcggcgacagcgaccacgagaccaagttcggtatcgacgcggacctcaccgccctgaagctcgacaacatcctgcccggctggaccaagccgtcgggcaagacgacccgcgcgacgttcaacgtcattcagaagccgcaggcgatccggttcgaggacattcagatcgaaggcaacggcacgctgatcaagggctcgctcgaagtcgatggcgacggcgacctgatcaacgcgaactttccggtgtattcgccctccgaaggcgacaagacgacgctgaaggccgagcgcggccaggacggcgtgctcaaggtggtgatgcgcggcgacgtgttcgacggccgcggtttcatcaagtcggcgctgtcgggcacccaggccgaaccgaaggccaagaccaagagcctcgatttcgatctcgatctcaagctcggcgctgtcgcaggctatttcggcgaggcgctgcgcagcctcgacgtcaaaatggtccgccgcaacggtgcattccgcaccttcacgctgagcggcaagctcggccgcgatacgccgatcaccgccgaattgcgcggcaagaatcgcggccgcgaggtgatcgctctcgagaccaacgacgccggcgcattcctgcgcttctccgacacctactcgaaaatgtacggcggccagcttgcgctggcggtcgagccgccgaccgcggagccccgccagaaggaagggctgatcaacgtccgcgacttcaccgtcaagggagaggccgccctcgagcgcgccgccgccggcgcgcccggcggcacgtcgacgggggtggcgttctcacggctgcgggccgagttcacccgggacaacggccagctgtcggtgcgcgacggcgtggtgaaggggccgacgatcggtgcgacgatcgagggctcgatcgactatcccgccaaccaggtccggatgagcggcaccttcgtgccgatgtatggtttgaacaacatgttcgggcagatcccgatcgtcggcctgtttctcggcggcggcagcaacgagggcctgatcggcgtgacctatgaggtcgtcgggacgccggggcagccggtgctgcgcgtcaatccgatctcggcgatggcgcccggcgtgctgcgcaagatcttcgaattcaacaccggccggcagaacagcggcgccgatttcccggcgccgccgaattga

SEQ ID NO: 1721 - DNA, 3282 bp, Jannaschia CCS1
atgggtgaggagacgacaagcggcggagggggacgcggacggcgtgtgggcgtcgtcttggcgattgtggccctcgtgatcctgctgtctctgggcgggctgtgggcacgccttgcgctggcgccgatgcatttgcccgcaggccttcaggaccggatcgaggcgcggatcaacgccgccgcacccatgggcgatatcgccgtggcggacatggttctggcgctgcccgggggcgggggcgcgcctgcgctggagtttcgcgatgtcgtcctccgcgcgccgggcggcgatgtccgtgcggcctttccggtgttgcggctcagcgtggcaccggggcccttgggtcttgggcagatgcgggtccggcgcattgtcgtggagggcgcaggcgtggccctgacgcgggatgccgatgggcgggtgggccttgatttcgctggcgccatggcgggcgatggcgtggaccgcaccgttgcacagacgctcacacggctcgatgcgatgttcgcgcacgatgccttctcgcatctggaggaggtgcgcggggtcaacatgcaggcgacgctgaccaatgccgggaccgggcgcgatatccgcctgcacagcgccgaggtgctcttgacccgcgcgtccgggcgcatcgacctgaccatcgccggcgagttggagggcagtcgcaacgcaggcctcacccttgccatcgggcgcgatgcggcgcgcggcgtcacggatgtggatgtgcggttcgacacgctggccgcccgggacctggcggcggcgtcaccggcgctcgcgtggctcgacctgatgcgcgcgcccatcgacgggcagatgacggcggtgctgaccaatgacggtgcccttggggccttcagcggttggttggagatcggaggaggggaggtgcatgtgccggggcaggacacgcccttgcccctcacggcgatggaggcgcgcctgagctacgcccccgagacccgccgcgcccatatcgaaaccctgcgcgtggatgcggagcacctggtgttctccgccgacggccacgcggatgtcagtgacgatggcgctgttttgactgggcaattcgccttgcgcgacatcatcgcccaccccgacggcctgtttgacggcccgcttctgatcgacggtgcggcgctggatctgcgcgtcagccttggtgaagctgtcacggtggaggtcggccaggcggtgatctatgacgacgatgtgcggatccgcgcctcggcccgggcggtggcggccgccgatggtctcaccctcgccgtcgatacggaggtggcagaggtcgacgtggcgaccgtcctgtcatactggccccttgatgcgatcccaaacacccgctggtgggtggcggagcggttgcttgcgggcaccgcacacggcgcgaacttcgccctgcgcatggcccccgaggcggacccgatctatgatctctcgttcgatttcaccggggcggacatcatcgccgtgcccgcaggccctccgatcctgggcgcatcggggtatctgagcctgcaaaatgacagactgtcagtggcgcttgatggtggcggcgtggcggcggacgggcagggggcggtggcgctggcaggatctgccatggccattgccgatgtgtcccggcccggcccgttggcggagtttgacctgaaccttgcgggcgctgtcccggacctgatgcatgtgttggcgggcccgccgttccgagtgctggacgccagcggctacgccccggacgacatcgggacgggtcagatcgtggcggaggcggctttgtccacccatttgatcgagcgcgcagagcctgtggcgctgacggacctcaacatcgaagcctctggcatcattacaggttacagcgccgatgcgttgatcgtggaccggcagctgacgtcggaccggatcacggtgactatgacgccagagcagttggcgattggcgggcgcggtgcgctggacagggtgccggtgacgggacagtggagcgttctgctggacccggacgcccccgcaggcagccgcgtggacgcgcgcgccaccgttgatcgggcggcccttggcacctttggagtggccttgcccgagtggttgatcgcgggccggggggcggcggatctgaccgtgttcctgcaagcgggcaacccggcgcgggtgcaagtccgctcggaccttgatgggattgcgctggcgatcccgccgctggcctggcagatgcccgccgcacgcaccggagcgttcgccgcggagatcacccttggtccccggcccgaagtgcgcagcctcaccctggacggggcggatctgtcgctggagggggcagtgacgttcaccgccgatggcgcgctcaaccggttttccgccgggcgtttccgggtcggtcaatggctggacgtgcaggggggtcttgtggggcggggggccgccgccccggcgattgaggtgacggggggtatcctggatttccgcaccatgccctcgctgtcggaaaccgggggcagcggctcgggcgatgtcgggccgttgaatatccgcctcaacacgatgcagatcgcggaagggatctctctgacggacctgcgagccgatgtggatggcgcgtcgatcagcggggatttccgcggtctggtgaacggtgcggcccagatcagcggccagttggtgccaagcgccaacggcccctcggtgcgcatgcaatccagcgatgggggcgcgattctgcgggctgcgggtatctttgacgatctgtatggtggcgcgttcgatctgatcctggccgcccgtgcggaggcgggccaatatgatggccgcctgaccatcgacaacccgcgcctgcgcgacgcgccggtcatggcggagatgttgaacctgatctccgtcgtgggtctgttggagcagctctcgggcgatggcatcaatctgggcgatatcgatgccgcctttcgcctgaccccgcaatccatcaccttgcaggaggggaccgccgtgggccccgcgatgggcttttccatggacggtgtctacgacgtcgcgtccgagcgctatgaaatgcagggcgtcgtctcgcctctttacctggtgaacggcttgattggatcccttttcgcaccgcgtcgcgaggggcttttcggcttcaattaccgcctcatcggcgatagcgaagatacgcgggtgacggtgaaccccctgtcgatcctgacgccgggcattttccgggacatcttccgcgccccaccgccggatttctcgacacagggtaactga

SEQ ID NO: 1722 - DNA, 3714 bp, Rhodopseudomonas palustris BisB18
atgccgccaaaggagcgcagcctgctcaccggcgagcgaccgtccggcggcgaacaggcatccactccgcgctcccaccgagaggcaatggccaagaatcattcgacccaggttccggagtcgcgcgctggtcacccgccgccgcattgtggtgatgaccattggcatcatgaccatgacgaggccggctggcagcgtgcgcgcgccttgctgtccgggtcgcggctcgggtttcactatgtcggcgaccgcctcggggcgatcgcgcattggattataggcgagcgctgggtgacgcgggtcctgatcaccgtcgtggtgctcggggtgatcttcaccgcctgcttcggcgggctgtggttgcggctcggcgccggaccgatcaatctggacatggcgacgccgtggctggccgcggcgatcgaagacaacatcggcaacggcaacaccgtcgaggtcggcggcacccagatcgagcgcgccgggcggattcgcgtcgcggtgcggctgcgcaacatcgtggtgcgcgaccgtgatcacgtcatcgtcgcgaccgcgccgaaggccgaggtgcggctgtccggctcggcgctgctcaccggccggctgcgcgcggaaagcctcaatttggtggacgccgagctcgcggtccgcatcacgccggacggccaggtgaccgtgtcgaccggggacaccaaccgcccgttggccaccggggtcgcttcgccgcgacgcatcggggtgccgggcgcatcggccgagccatccacgtcggcagccgggacgccggtgccgcagcccgcggctcctgccgacagccaggaggccttctccggactgctcgccggtctcgattggctcgacagcctgagcctcaccgggctcgacggtcagaacctcaacgagatcggtttgaagaacggcaacctggtggtcgacgatcagcagcgtggcaaccgctggaatttcgagaacatcacgctcagcctgcgccgcccgagcaaaggcggcgtcgccatgagcgtcggcgaagaggcggtggccggcgaggacaacgcgcgcgcctggtcgctgcgggtcgcggtcggcgcgccgtcgaatggcgtgcggtcggtggaaatccgtgccaacaacgtccccacccagaatatccttttggcgctgcggctgaaggacgtgacctacagcgccgatctgccgctcagcggcgaactgcagggcgaactcggccgcgacgggctgccgacctatttccgcggcaagatcaccgccggcgccggccatatcaccgacagcgacacgccggactatccgatggcgatcgaccagggcgagatcaatctggaatgggattccggacgacgggttctggtcgcgccgttcaaggtgatctctggagccaatcgggtgacgctgctggcgcaccttgaagcgccaaacgacaacatcccggattggcggctcggcttcagcggcggcaccatcgtgctgcccggcagcgagggcgaggcaccgctgatcttcaaccgtatcgcgatcgggctgcgcttcgataccgacaatcgccggatcattctgacccaggcggacatcagcaacggcgagatcggcgtcgccggcaccggcagcatcgattattccggagagccgcggctgaaactgggatttgccggaacgccgatgtcgctgtcggcgctgaagcggatgtggccgattctgatcgtccccgaactacgcgaatgggtgatcgagcggatcgacaagggatcgatccagcgcatcgacatcggcgtcaactcgccggtgaagaacttgtcgcgccgcggtccgccgatccccgacgacgggctcgccgtcaacatcgtggcgaccggggcgatgattcatccggtcgacgacatgccgtcgattcgcgacggcgatctcaaggcgcgcgtcaccggtcgcaccgccacggtcacgatcggccagtcggtcgccgacaccccgcaggggcgcaggctcaacctgtccgatatcgtgttcgaggtgccggatctggcgccgaagccggcgccggcgcgggtcaggttccggctcgacggaccggtcgccgcggtggcggaaattctctcctccgatcggctcagcgagttcagcgccgtgccgatcgatccgaattccagcaaagggacggtctcggcgcaagtcgcgctcggcatgccgatcaaacgcgaactcaccaaggtcgacactagctacaatatcaccgcagacctcaacggtttctccgccgacaagctggtgatgaaccagaagctcgaggccgccacgctgaaggtgattgccaacaatcaaggctaccaagtcaagggcgacgtcaagatcaacggccaagcggcggcgctcgactatcgcaagcccaatgacggcgacgcggagatcaagctgcaggcgacgctcgacgacgccggccgggcgcggctcggtttcgatctcggcaccgcggtgaccggcgcgatgccgatcaagctcagcggcaagatcggcgatccggacaaggaaaaccggctcgcgatcgatgccgatctgacggcgatgaagctcgacaacctgctgcccggctgggtcaagctttcgggcaagtccggccgtgcggtgttcaatctggttcagaagccgcagtcgacgaggctggaggatatcgttgtcgacggcagcggctccagcatcaagggctcggttgaaatcgatcagaacggcgatctgctgaatgccaattttccgagttacgcgccgtccgatggcgacaaagcctcgctgaaggccgaacgcggcgcggacggggtggtgaaggtgacgatgcgcggcgacgtgttcgatggtcgcggcttcatcaaatccgcgatgtccggcaaggagagcgatcccaagagcaagaccaaggcgatcgattacgacatcgacgtcaagctcggcgcggttgccggctatttcggtgaagccgtgcgcagcgtcgacgtcaagttgtcgcgacgcaacggcgcgatccgaactttttcgctgggcggcaagctcgggcgcgataccgcgctgaccggcgatctgcgtggccgcggccagggccgcgaagtgctctatctggaaaccaacgacgccggcgcgttcttccgcttcgccgacatctacgccaagctgttcggcggccagttgacgctggcgatggatccgccgaccgccgagccgcgcgaacgggaagggctgctcaacgtccgcgatttctcgatcaagggcgaggcggcgctcgagcgcgtcgcccccagcgggaccaacggcgcgcaatccaacgtggtgttttcgcggatgcgcgcggagttcacccggcagaacggccaacttacgatccgcgagggcgtggtcaaagggccgatggtcggcgccaccatcgaaggcagtatcgactaccccgccaaccaggtgcggatgagcggcaccttcgtgccgatgtacggcttgaacaacatgttcggccagatcccgatcgtcggcctgtttctcggcggcggcaacgagggactgatcggaatcacctacgagatcgtcggctcgccgggccagccggtgtggcggatcaacccgatctcagcgatggcgcccggcgtgctgcgcaagatcttcgaattcggcaccggcaagcagaacaacaacaacgatttcccgatgccgaacaactga

SEQ ID NO: 1723 - DNA, 3732 bp, Rhodopseudomonas palustris BisB5
atgccgccacaggagcgtatcctgcgcgtcggcgcgcaatcctccctcggcgatcaggctgcgaccgagcacgtacatcgagaggctatggccagctacccgtcgccccgcgattccgggcaagattcgcaatcagatgaacacgtagccaggaattggcaggacggcggctgggaccccgagcccgaggaagccggccgccaccgtgcccgcaaactgctgtcgcgcagcaatctcgggtttcatcgtgtcgatgaatcgatgcgccgctggcgccattggctgaccgatgagccgtggctgaagagggttgcgatcgccgccgtcgtcgtcgtcttggtgctgacggcaggcttcggcggcttatggctgcggctcggcgccgggccgatcaatctcgatatggcgactccatggctggccaacgccatcgaggagaatatcggccacggcaacaccgtcgaggtcggcggcacccagatcgaacgggagggccgaattcgcatcgcggtgcggatccgcgacatcgtggtgcgcgatcgcgaccacgtcatcgtcgcgactgcgccgaaggcggaagtccggttgtccggctgggcgctgctgatgggcaagctacgggccgaaagcctgcggctggtcgatgccgaactggcgatccggatcacccccgacggtcaggtcacggtgtcgaccggcgacaccgcgcggccgctcgccaccggcgtcgcatcggcccgcaggccgccggaatttacactgccgggccaggcgccgaacaccgcggcgccatcaggccaaggtgacgcggcattgccagcgccgctcggcaaaccggcgaccaccgatggcgacgacggcatgaagagcttgctcgccgggctcgactggctcgacagcctgagcctcaccggactcgacggccagaacctcaacgagatcggcctgaagaacggcaatctggttgtcgacgaccagcagcgcggcaatcgctggaatttcgagaatatcagcctcagcctgcgaaggccgacccgcggcggcgtcgcgctcagcgtcggcgaggagggcgccaaggcctggtcgctgcgagtcctggtcggcccggcgcaggacggcgtgcgctcggtggagctgcatgccaatcaggtgccgacccgcaacattctgctggcgttgcgggtgaagaatttgacctatggcgcggatttcccgctgaccggcgatctcaagggcgaactcggccgcgacggcctgccgacctatttccgcggcaagctggtcgccggcgcgggcaccgtgatcgactacgacacgcccgactatccgatggcgatcgatcaggcggagttcaatttcgagtgggacgccaaccgccgcgtgctggtggcgccgttgaaggtgatcgccggcgccaaccgggtcacgctgcttgcgtcggtcgagccgccgaacggcaacgcggctgattggcgactcaacctgtccggcgggaccatcgtgctgccgggcgcagcggacgaggcgccgctgatcttcaatcgcatcgcggtccgggttcgcttcgacaccgacaatcgtcgggtgcttctgacacaggccgatatcagcaacggcgagatcggtgtcgcaggctccggcagcatcgactacggcgctgagccgcggctcaagctcggctttgccggcacgccgatgtcgatttccgcactgaagcggatgtggccggtcctgattgtcccggaagtgcgggaatgggtcaatgagcggatcgacaagggctcgatccagagcatcgacattgcggtgaactcgccggtcaagaacctgtcgcgccgtggcccaccgatccctgacgaagggctgctcgtcaacatcatcggcagcggcgcgacgatccatccggtcgacggtatgccgtcggtgcgcgacgccgacatgcgggttcgtgtcaccggccgcaccgcaacggtcgcggtggcgcaggccaatgccgagagcccgagtggacgcaagatcgcattgtcggacattctgttcgaagtgccggacatggcgccgaagccgtcgccgtcgcggatcaagttcaaactcgacgggccggttcaggccgtcgctgaagtgctgtcttcgggccgcctcagcgatgtcagcaacgtgccgatggacccgaattcgagcaagggggcggtcagcgcccagatcatgctgggaatgccgatccagcgccagctgaccaaggccgataccgtctattcgatcaacgccgacgtgaacggcttttccgccgacaagctcgtgatgggccagaagctcgaagcgaacacgctgaaggtgatcgccaacaaccagggctatcaggtcaaaggcgacgtcaaaatcaacggccagccggcgacgctcgactatcgcaagccggcggagggcgaagccgacgtccggctgcaatcgacgctcgatgatgcaagccgcgccaagctcgggcttgatctcgggagcgccgtcaccggcccggtgccggtcaagctggccggcaagatcggcgatggcgatcaggagaccaagctcggcatcgacgccgatctcacggcggtcaaactcgacaatgtgcttcccggctggaccaagccgcccggaaaggcggcccgcgcctccttcaacgtgctgcagaaaggccaatcgacgcggttcgaggacatccaggtcgaaggcagcgggaccttgatcaagggcgcgctcgaagtcgatcaggacggcgacctgatcaacgccaccttcccggtgtattcgccgtcggagggtgacaagaccacgctgaaggccgatcgcggccaggacggcgtgctcaaggtggtgatgcgcggcgacgtgttcgacggccgcggcgtcatcaagtcggcattgtcgggaacgcagtcggatccgaagagcaagaccaagggcatcgatttcgacctcgacctcaagctcggcgcggtcgccggtttttacggcgaggcgctacgcagtgtcgacgtcaagctggtccgcaggaacggtgcgttccgcaccttcaacctcgccggcaagctcggccgcgacaccccgatcaccgccgagctgcgaggcaagaaccgcggccgcgaagtgatctatctcgagaccaacgacgccggctctttcttccgcttttccgacacctattccaagatatacggcggccagctcgcgctggcggtcgagccgccgactgtcgagccccgcgagaaggaagggctgatcaatgttcgggacttcacggtgaagggcgaggcggcgctcgagcgcgctgccgccggcgctcccggaggcacatcggcgggacttgcattctcgcggctgcgcgccgaattcactcggcaaaacggccagcttaccgtccgcgacggcgtcgtgaaggggccgaccatcggcgcgacgatcgagggctcgatcgactatcccgccaatcaggtcaggatgagcggcactttcgttccgatgtacggtttgaacaacatgttcgggcagatcccgatcgttggcctgttcctcggcggcggcagcaacgagggtctgatcggcgtgacctatgaggtggtcggaacccccggccaaccggtgttgcgcgtcaacccgatctccgcgatggcgccgggcgtgctgcgcaagatcttcgagttcaacaccggccgacagaacaacggcgtcgatttcccgacgccgccgaactga

SEQ ID NO: 1724 - DNA, 3768 bp, Nitrobacter hamburgensis X14
atgacgcgtaacatgatagatcgcgaatcggcggaagtgccctcacaggtgcgttcgtccgggatcggcgtgcggaccaatgacggcaactgctccggtccaggccggcaccgagaggcgatgacaaggaagacgccgatcccagctccgaatccgcgcggtggcgagccggtctcgcaaggggtggatatcgactggaataatgaggaccacgacgaggtccgaagtcgtcgcatacgccggctgctgtcgcggtcggattccagattccacaggttcggcgaccggctcgggaggttcaaaaactggctggcgggcgaacgctgggtcaggcggctcgcgatcaccgtcggcgtcctgacggttctattcgccgggggctttggcgcgctgtggtggcgcctcggcgccggtcccgtcaatctcgatatgatgacgccctggctggtcgctgcgatcgaggaaaacatcggtcacggcaacacagtggaaattggcggcacgcagatcgagcgcgccggcagaattcgtatcgcggttcgtatccgtgatatcgtcgtccgtgaccgcgatcatgcgattgtcgcgagcgcgccgaaagccgaggtgaaactgtccggcatggcgctgttgaccgggcggctccgcgccgaaagtctcaatctggtcgacgccgaactcgcggttcggattacgccggacggccaggttatcgtttcggcaggcgataatgccaagccgcttgccaccggtgtcgcatcggcggcgcggccatccgtcccgccgtcaccctccgacatcgtcccctccagcatcgcgccatcggttcaatcgacgccgcagttgcgtgaacccgcggctggcgcaacgcctgcaatctcccatgatcgtaacaacgccagcgcgctgttggcgggactggattggctcgacagtcttagcctgacagggctcgacgggcagaatctcaatgagatcggcctgaaaaacgggaaactggtggttgatgaccagcagcgcggcaaccggtggagtttcggcaatatcagcctcagtcttcgtcggccgagcggaggcggggtcgcattgagtgtcagcgaaggcggcagcaaggcgtggtcgcttcacgtcacggtcgggacacccgccgacggtgtgcgccccatcgatctccgcgccgccggaataccggcgaagaacattctgctggccctccgcatcaaggatctcacttatactgccgacatgccgctcagtggcgaactgaagggcgagattggccgcgacggtctgccgacctatcttcgcggtagtctgttcgcgggcaaaggcacgatcaccgacgctgacacgccggactatcccatggcgatcgatcagatcgagatgaacctggagtgggatgcggggcgccgcgttctggtcgcgccgttcaagatcatctccggccagaaccgcatcacgctcctcgctcatctcgagccgccgaacggcagcatcccggactggcagatgggtttaagcggcggcaccatcgtccttgccggctccgatggcgagaagcccctgatcttcaatcgcatcgcgatcggggtgcgcttcgacaccgagcacaagcaggtggtgttggcccaggccgacatcagcaacggggagatcggcgtagccggaaccggcagcatagactattccggcgaaccgcgcctgaaactgggcttcgcgggaacgccgatgtccgcggcatcactgaaaagtatgtggccgaccctgatcgtgccggaactacgcgaatgggtcatcgaccgagtcgaacggggttccctccagcgcattgagatcggcgttaattcgccgatccacaacctgtcgcggcgcggcccgccgatcccggatgatggcctttcggtcaatatcgttgccagcaatgtgacgctgcatcccgtcgatgaaatgccctcggttcgcgacgcggatctgaaggcgctggtcaccggcagaacggcaacggtgacgatcgggcaggccactgccgataccccggccggccgcaaactcaacatttccgacgtcgtattcgaggtgccggacatggcgcccaaacccgcaccggccaaggtgaagttcaggatcgacggtccggtgcccgcggccgccgaaattctcgcctcggaccgcctcagcgaattcaccggtaatctgatcgatcccaattcaagcaagggaacggtcaccgcgcaggtcgcgctcggcttgccgatcaggcgtaaaatcacccaggaagacacgacctattccatcaccgccgatctcgcgggctttgccgccgaccacctggtcatgaatcaaaagcttgaggcgaacgcgctgaaggtggtcgccaacaatcaggggtatcaggtcaagggcgacgtcaagatcaacgggcagccggcttcgctggattaccgtaagccgacggtcggcgacgccgatatcaaattgcaggccacgctggatgacgcgagccgggcgaagctcggcattgatctcggtgccggggctaccggtgcgattcccgtcaagctggtcgggaagatcggcactgacaaggacagcaaaatcggtatcgatgccgacctcacatccttgaagctcgacaacgttctgcccggctgggtcaagctgcccggaaagtcgggtcacgcgacgttcaatgtggtgcagaaggcgcagtcgacgcgcctggaggatatcgtcatcgacggcggcggcgccatgatcaaggggtcgctggagatcgatcagaacggcgacctgttgaatgcgaattttccggtttacgcgccgtcagagggtgacaaggcttcgctgaaggccgagcgcaacgcagacggcgtattgaaggtcgtcatgcgcggcgacgtgttcgatggtcgcggctttatcaaatcggcgatctccggcaagcaggccgacaccaaaggcaaggccaagagcatcgatttcgacatcgacctgaagcttggagccgtagccggattttacggcgaagccgtgcgcagcgcggacgtgaagatggcccggcgcaacgggtcgatccgcagcctcaccatgagcggaaagatcgggcgcgatacttcgctgaccggcggtctgcgcgggcgcccacagggtcgggacatcattctgatcgagaccgacgacgcgggcgcgttcttccgctttaccgatacatacggaaagatgtttggcggtgagctcgcactggccatggatccaccgaccgctgaaccccgcgccaagcaggggctgatcaacgttcgcgatttcacgatcaagggtgagacggctctggatcgcgccgcggcgggtggtccgcagggcgcgcagaatggcatttcattttcgcgtctgcgcgcggaattcacccggcagaacggacaactcacggtgcgcgagggtgtcgtcaagggaccgacgatcggtgcgaccatcgaaggccatatcgattttcccggtaatcaggttcgtatgagcggcacgttcgtgccgatgtacggtctcaacaatatcttcggacagcttccgatcgtcgggctgttcctgggcggcggtagcaatgaggggctgatcggcgtgacctacgaggtggtgggtactccggggcaaccgcaactgcgagtcaacccgatttcggccatggcgcccggcgtgctgcgcaagatcttcgaattccagaccggcaaaccggccaaccagatcgaatatccgtcacagagcggcaattga

SEQ ID NO: 1725 - DNA, 3468 bp, Ruegeria sp. TM1040
atgtcggacaaaggaaaaccatatatcgtggccgcgccgccagagcctgcgtccgaagcgggcggcaaccgggtgcaggagactggcgcgggcgcgtctgacatgggccagaacacggcacagccccggcgcaaccggtggcgccgccgcctttggaaaagcacggtctggaccctggcgcttttggcggggttgacggttgcggcctgggtgctgctcgacaagcggctggatgcgcccgagtggctgcgcagcgaggccgagcggcgcatcgagcgccatttgggcgggcttcagattgagttcggtgagatcgagctggtggtgcgccggggctggcggccgcgtctttcgctgcgcgatgtgacgctgttttatcccgacggcagcccggctgtgcatctggaggacgcgcaggcggccttggcgatgcggcccttgctgcgcgggcaactccggcccaagctgatttcgttgtcggggctgtttgcgaccctggaaacgggcagcgacggggcggtggcgctcagtttttcggatggggcggcgccgttgcggcaagcgcgcaacctgccgcaactcatcgaggcctgggaccgtcagctggaactgccgatcctgtcggcggtgacgcaggtggaaacgcaggcggtgacgctcaattatatcgaccgtcggatcgaccgcgcctggacgctggatggcggcgcggttctgttgtcgcgcaagggcgatcgtgtcagcatcgatgcgggtttctcggtgctcagcgggcgcgagtatgccagcaccgtggaggccaactaccaatccgacatcggggataccgcagcggaatttgcggtggtggtggatcaggtgcccagcagtgacatcgccagccagagcccggcctttggctggctggatgtgctgcgtgcacccatttcaggcgcgctgcgtggtgcggtcgacagcgagggcgcgttgcgtccgctcaatgcgagcctgcaggtggggcgcggtgtgatccagcccaatgaccagctcaaacccatccccctgcaatcggccgagagctatttcacctttgatcctgcgcgtcaggagctggccttttcgcgcctctcggtggagagcggctggatcagtggccagatggaaggccgcgccgagctggtgggcgtgcgcgacgggcggctgacgcagcttgtgggccagctgagcttttccgatctcaagctcaacccgctgcgcctttatcctgaacctctggcgttctccggggtgcaggccgatttccttatggagctgcaacctttccggctgcgccttggcgaggcgctggtgcagcagggcgagaccgacgtgctgttgcgtggtgatgtgcgcgcgggcgaaacaggctggcactatgatctccaaggcgcggcggatcggcttgatgtggcggtggtcaaggaaatgtggccgccctccgccccgccaaagccgcgggcgtggtttacagagaacgtgctcgccggagacatccacgacgtgcagtttgccctgcgtgggcgcgatgggcaaaagccctttgtggcgctggatcttggatttctgaacggcgaggtgcggttcaacaagttctatccgccgctgacccaagcggcggggcagctcagtatctatggccggcgcctggtggtgacggccaccgagggcggcgtggacgcggatctaggcgggcggatggatgtggcagggacttccttcatcatcccggatacgtcgctcaagggcgacaacagccttgggatcctgcgcgccgaactcgcggggcccgcgctggcggcgctgtcgcttctggaccgcgagcccctgtcgatcctgagcaaggtgaaccttccggtggcgcttggcacgggtgaggtcgacctgagcgcaaccgctgcgatgccgctcaagaaaggggtcaacgtcgcggagattgactatcactacgctggccaaatcaagcaggcccgcagtgaggtcctggtgccgggctatccgatcgagtccgaggcgttgcagatctcgggggacaatcaccatgtcacggtggcggggcccggcctttttgccggtgttccaatcgaggcgcgctggcgtcagggtatccgccccggaaatgcacccgatggcaccatcgaggccgagatcgaactctcgccgcgcaccttggcggcgctcaacatcgggctgcccgaaggcatggtgcgcgggcaggggcaggcgcaggtcgaggtggttctgccccccggcgagccggtcgcgctctcggtgcaaagcgatctacgcggcattggcctgtcgctgcccgaggtaggctggcgcaaggccgaaaacagcagcggcacactctcgtttgaaactgtactgagggacacgccatcgatcgagagttttaccctcgaggccaatggcttgcgcgcggccgggcggatcacggtaaagccggatggcgggctggatcaagcgcagttctcggccgtgtcgcttggaaactggctgtcgggggcggtgacattgcgcgggcggggcgacgccacccctgcgctgtcgatgaccgggggctggatcgaccttgagcgcgcgccctttgacagccgcgcggagggcggctctggtggcggtggcagcaatacgccgatctcgctggccattgatcggctgcaagtcaccaaggaactggcgttgacgcgctttcaggggcggtttgacacgcttggcgggttcaacggggccttcagcggcaacctcaacacgctcaccccggtcgaaggggtggtggtgccgcagtccggggggctggcgatgcggctgcgctcggcggatgcgggcggggtctttcgtgcggcgcaggtgatgcagaacggctatggcggcagtttcgagatgaccatgctgccggcttcagatcccggcgaatatgtcggccagctccgcgtgaagaacatccgtgtaaaacgcacccccgccattgcggcgctgatcaacgcgctcagtcttgtggggctctttgatgagctgtcgggccagggcatcctctttaccgcgatggaggccgatttccgccttgggtcgcgctatctcacgctggtgaagtcctcggcggtggggccgtcgatggggatttcgctcgatggggtctatgacctcagcaccagccagatgaacatgcgcggggtgctttcgccgatctatctggtcaacgccattggcagcgtgctgacgcgcaagggcgaggggttgtttggattctcattcaccctgaagggcaaggccgaggacccggtggtgtcggtgaacccgctttcgggcatcgcgccggggttcctgcgcgagatctttcgcggcgaggcgccacgggcgcccggagcggcccccttgccggaggacgagcagaaccagaccgccgaagagctgcgcgaagaacgcgagcgccgccgcgaggcccgctag

SEQ ID NO: 1726 - DNA, 3336 bp, Mesorhizobium BNC1
gtgcagttccggcgggaagaaataacccccctggggaggttcccttccgcctgcctgccaccgcccagaggttgccgcagtcgccgctcgctttttcggcgctggctggtccgtcccgcggcaatcatcgccgtgtttctcctcgtggccggcacggtcttttacgctgtgggcgtggatgccatcggcaatgagcggctgcggctgcaggccgagcaggcaatagagagattggccggcgtggatgtggatgtctcgattggcagcttacatcttggtctaggccggacaagcctctttgcgctggaggtccgtgacgcggagatcatcagggctgacgacaaaaggccgatcgccgagttcaagacgctgcgctttggattgcgggccataccgctgctcagcggccggatcgagcttgcacgcgtggcaatggctgatgcgcttctcacccccgctgagatgtcggccggaacggggccgacgctgacggagtttctcgcgcgcccgtcgcccattggtcccgaggaactgaggacggcgattttcgacgcgatcgatcgtgcattcgagatcacaaggggggctggtctctccagcattagcctttccaatgtgggccttctggccggcggccggacgattcccggccttcttctggaaagtttcgagatcacgcgcagcaacgacacggatctggcgctggagggcgccgcccggtatcgcgggcgcgatcttacatttgagggcagggcccatcgcgaccccaatacgaacaccctctcaaatgtcgaattgaagatatccgcaccggagggggaggaagcttcctcgacagaggaaggccttctgcgctccataggggcgttcgatctcgcgctttccggtaaggccccagttggaaaggagagaggtttcctgcgcatcgacgttgccgcggacggcatattgctcgatttcggcgacgatgagcttgctctggatcgcgcctcggtcggaatcgccgcgggcgcggacgacgacgttttctcggtgcttcaggcccagatccaggcaggcaggacgcgcattaatctccaaggcactttcggcccggaaaccgtgaccagcggtgccgcaggctaccgcatggacctcgtctcgcgcgattcggtgcttgcgcctgcggattcaccggaggctccgctgccctttgccatgcggctccagggacgattcgatccagcgacgatgcagttgaccgctgatccaatcgatgtgcgttcggcggagggagaattgaatgcgagcgccgagcttactcttgccgaggggaagtctcccggaatcaagctcaatcttcaagtaagcagcatgcctgccgcgcatgtgaagcagttctggccatggtttgcagcgcccggcgcgcgcaattggacgctggaaaacgtcttcggcggcaccgtgcgcgatagcgggatgacccttgaagtgccgccggggcggctcggcaatggtgtgccgctcgggccgaaggaggttttcgggcgctttgccctatccgatacccgcttcaatatcgccggcgagatccctccggtgcgggacgcggatggatatgtcgaattccacgggacggatgtgaaagtcggcctttcctcgggccgggtatatatggcaagcggccggacagtcgatgcgaaggatggcaccctcacaatcgacgcatcgaagacgcagcggcgcatcggcaatctggagataaacgtggcgggcgaggcgcccgcaatattggagttcgtctcatacaggccgattgcggcctcgcgcttctacgatctccagccggacgacctgaaaggcaagatgtcgggccatgtaagtgccgaaatcccgcttcaggcagggatcgccttggatgaactcgattggcgtgtggcgctcgactatgagaatctctccgtcgcaaagccattcgagggtcaacaggtgaccgatgccaagggcagcttgctggtcgagcccacccacgctgaatttcgcgccagcgccaagctcaatggaatccccgcggatctgcacatcgtcgagccgttcggtcatgcgcaagtggagaaggtgcgccatgtcgaacttaaaatggatgacacttcccgcgagaaacttttccccgggcttggaacgttggtctccggccctttcacccttgtctacgaccgcgagaaagacaatcgtgagaaggtcagcttgaagctggactcggcgcgcctcgatgtgccctggataggatggcgcaagggcgcgggcattcccgccatggctacgtttcacctgaagcgagatgggcaggcgaccgaactcagcgacttctcgctcgtgggggagagcttttcgctcgccggccatattcgcttgaatgggcctcacctgcaggaagcaagttttcaaaaggcgcggttcaaccgtggcgacgatttctccgcgacgatcaggcgaaacggcaatggatattccgtttctgtaaagggcgcagcctttgatgcacgcgcattgataaaacaggtctttggcaatcggcagacatcgggagccggcaacggcgacggcgacgccaccccggtgagcgtgaaagcctctctcgcacaagtcagcgggttcggcggagagaccctgagccaagtggaatttacctatgccagcgacggcaggaagccggacgagttgacgcttgggggcgcaacccggtcccacgggggcctgaaggtcagcaagacatcgcagccgggaacaatgggtatccatgcctcctccagcaatgccggcgccgtgttccgattcctcgatttctatgagcacatggaaggcggacagctcagcgttgcgttgcagggcgcgaacaacgaggccctggcggggcaaatcgacatacgcgacttctggatcgtcaacgagccgaagatgcgctcgctcgtggcggcgacgaaggagaacgggcgcgtcgacaccacgcgcgtctactttgaaagcggggcggccgcattggcaaagggcagggggagcctcaatatcgccgagggcgtggttcgcgggccggtcatcggctcgacttttcagggcatgctttatgatcccaacgacagaatggatctgaccggaacttttatgccgctttacggagtcaatcgcatcttcggcgaactgcccctgatcggccagatcctcggcaacggacgcgaccgcggcctgatcgggatcacgttccggctaagcggtgccgtcgaaaaccccagactcgaggtgaacccgctttccgcggtcgcccctggcttcctgcgcgagatcttcgagttccgctga

SEQ ID NO: 1727 - DNA, 3285 bp, Rhodobacter sphaeroides 2 4 1
atggcagagagcggcgagcggcaggcatcggagcggaaggggcggtcgcggcgcggccgggcgtcgctgtggttgctgctcagtctcgcgctggtggcggccgtcgcgtgttttgccacgctggccttcacggggcggccgctgcccttgcccggctgggcggtgaccgaggccgagacgcggatcaaccgggcgctggagcctgcgctgtcggtctcgctcggggggctcgtgctgacggtggagccgaactggatcccgcggctccggctcgacgatgtgcgcctgcggcaggccgacgggcgcacgctcgtcacgctgcccgaggcgcgggtggtgttcgaccggggcgccgcgctgcgcggcgcgctccatcccaagaccatcaccctctcgggcgcgcgcatcgcgctgcgccggctggccgacgggcgcttcgacttcgccatgggcgagcagggcggcaccttccgcctcgcaagctatgccgaactgcgcgagacggtggaccggctcttcgcccagccggtgctggcggacctccggcggatcgaggcggagggcacgacgctgacgctcgatgaccgccgcgcgggccggacgtggcaggcgggggacgggcgtctcacgctggtgaacgggcccgaccggcgcgcgctcgagatcggcctgacacttctgaattccaagggccgcgcgcccgcgcaggcgctcgtgaccttcgtcaccacgcccggcagccccgaggcgcggatctcggccacggtcgatcatgtggcggctgccgacatcgccgcgcaggccgcccccgtggcctggctcgaggtgctggatgcggcgctctcgggccgcttctcggcggcgctcgacggcgaggggcggctcacgcggctcgaggcggggctcgacagcggcgagggggcgctgcagccgcggcccgagaccagacccatcgccttcgacaaggccgggctcgccttcgcctacgatccgggacgcgagcggttgaacctcacccggctcgaggtgcagggccgctcgatccggctttcggcgcaggggcacgcctatctgccgggggtctcgcgcgggttgccgagcgagatcctggcgcagatccgggtcgaggatgccagcgccgaccccgagggcctgttcgagacgccggtccatttctcggaaggggcgctcgatctgcggatgcggctcgatccgttccgggtggacatcgggcagctcgcgctggtcgagcaggggcggcgcctgtcggggcgcggccatgcctcggccgaaccgggcggctggcgcgtggccttcgacctcgggctgaacgagatctcgcattccgacctgctcgcgctctggccgctgtcgctggtgtcgaagacccgggaatggctggaggagaatgtgcaggaggggcggctgttcgaggtcgaggccggcctgcgcatgagccccggccacgagacgcgcctgtcgctcggctacgagttccgcgacggggacgtgcgctatctcaaaaccctgccgcctatcgagaaagggtcgggctatgcctcgatcgaggatcgccgctatctgatggtgctggaggaggggcaggttacgccccccgcaggcgggccgatccgggtcacgcgctcggtcttcgaagtgccggacgtgaccgagaaaccggcgcaggcgcggatctcgctcaacagcgagagcggcgtcacggcggccctgtcgctgctggaccagccgccgttccgcttcctcgaaaaggccggccgctcggtcgatctgggagagggcgtcgcggtgatggagacggcgctctccctgccgctgaagcgcaaggtcgagcccgaggatgtcgagttctcggtccgcggcacgatcaccgacttccgctccgacacgctggtgcccggccgccgcatcgtggcgccccgccttgcgctcgaggcggagcccgagggtctgaccgtgaccggcgcgggcagcttcggccgggtgccgttcgatgcgacctaccggctggccttcggccgcgaggcggaaggacggtcgtcggtcgagggcaccgccaccctctcgcctgccgccgtcgaggagttcaagctgggtctgcccgcaggcaccgtcgagggccgcgcgcccggccgcttccgggtggagatggagaagggccgcgatccgcggctcacgctctcgtcggacctcgtagggctgcgcacgggtctggccgcgatcggctggtcgaagcccgcgaaccgcgcgggccggctcgaggtcgaggcgtcgctgggcaagccggtcacggtcggcaagctcgtgctggaggggggcgggctcgcggcctcgggccgggtcgatctgcgcgccgacggcgggctggatgccgtgcgcttcgaccgggtgcggctgaacggctggctcgatgcgccggtgacgctggtcgggcggggcgcgaaccagccgcccgaggtgcagctgcggggcgggtcggtcgatctcacgcggctgggcgatctgggcggcgggggcggcagcgggggcacgccggtgccgatcctcgtcgcgctcgaccggctgcaggtcacgtcgggcatcgcgctgaccggcgtcgaggggcgcttcggcacccgcggcgggttcaacggcgccttccgcggacgggtgaacgggcgcgccgtcgtcgaagggtcggtggtcccgatgagcgggcgcagcgccgtgcggctgagatcccgggacgcgggcggcgtgatcgcctcggcggggatctttcccgatgcgcggggcggcgatctcgacctgagcctcatgcccgagggacgcgacggctaccgcggacgggcggcggtctcgaacttccgcgtgacgaatgcgccggtgctggcggcactcctcaatgcgatttcggtggtgggccttctcgagcagctgaacggcgacgggctgctcttcgccgagggcgatgtccggttccgcgtccagccgggggcggtcgagatctccgaggcctcggcggtgggggcctcgatgggggtcacgctggaggggctctatcgcaccgccgaccggcggctcgacctgcagggggtgatctcgcccatctatctgctgaacggcatcggctcggtgctgacccggcgcggcgaggggctgttcggtttcaactattccgtgaccggatcggccgaccgcccggccgtctcggtgaacccgctctcgatcctcacgcccggcatgttccgcgagatctttcgccgaccggtgccggttctgccctga

SEQ ID NO: 1728 - DNA, 3489 bp, Maricaulis maris MCS10
atgctgcgcaagtccgccaaatggaccctgatctatctgctcgaggccgtcgctgccctgttggcgctgacgattttcgcgatcggctttgtgctttggaggttgtcgtcaggaccggtggagctggaattcctgcgtgaggacgcgcaggccatgctggccaccgcctttgagggtgaggtggttgcgctcggttcgctgcaggcgcgctttgaaccgtcaactcgtgcgattgtgctggtcgcaaccgatgtcacggtcgccgaggcctccggcgaggttgtgacccgggcaccgcgaatcgaagcgggtctcgctgccgatgccctgatcttcgggcgaatcgaaccggttgagttgaccattgatggcggctcggtctcgattgtgcggcgcgctgacggggctgtaggcgccggcctgggcggtgttgaccggatatcctcgacggcccgactgccggagcggggcggcgatgacagtgtatccctgttcgagatcctggcgtcgtccggtgcgccggcccaactggatcgcctgcggcatgtacggatttccaatgcggcagtgcgggtcgtcgacgatgtggcgggtctggcctggttcattgattccgcaggcgtgtcgctggaccgggatgacgcgcgaatcctggccgaagtggaggggcgactggccaccccatccggctttgcgcctgtcgatctgagacttcgggccggcacagggctggaaagtttgttgctcgagatgagcttcagcgatctttctccggcgggcattctgccagataccggtccggcgtctgccttgagggcgctcgacgccccgatcgcgctcgacttcgtggtcgatgcgacccgcgaaaacggcatccgcacggcctcactacagctcgatatcggggccggccagattctggtcgatggtgagaatcacgcattcgaaggggccaatctctatgccagttttgacccggtcgagcgggtcatgacgctgcatggcggtcaggccaattccgtcctgttcgccgcatcgatcgaggggcggctgaccgaaatcggcaattatgacggggcgctgccgacccgggcgcggttcgatctggcgatcggccccggcttcgttgatgtgggcccggtgttcgaacgtgcgcccgaatggggcctgttggcggcctccggagagatacggctggacgagcttgcgttgacgctggaccggctggacgtcgagatcgatacgatccgggccgagctgaccggcgggctgcagctggagcagcgcccggacggcagctggctgcccagcctgcagctggaaggtccgatcgcgggagacatccagccggaaaccgtgttggcctattggccggttgaactcgccgatggtggccgggaatgggttagcgaaggcattctgggcgggcgtttctacaatgcgcggttttttctggacctgcccggctcggccattgaggcgggtgtgctggaagatgatcgcatgcagttgagcttcgattttgaggacgcgcatgtcctgtacatctcgaccatgaccccgctgacggccgggcgcggcgcggcggtcctgcgcggcaattcctttgaggtaatgctggagcatgggtgggtcggcgaagttgagctgaccgaggccttcgtcgaccttccccgtttgaacccgaaaggggcgatggcccgctatggaggccttgcccggggcgcggcctccgacctcttggcgcttatcgatgaggagccgctgtttctggtgtctgattatggcctggatccagccctggtcgggggccagggggacatgcgatttgagatccatcgggccatgctcaccgaggtcgagccggatgacattcccttttttatcagcggccggctcaacggtgcttcgcttgacataccgggaacggatttttccctgagtgaaggcgaggtcgagttggaggccagccaggccgggcttcaggccacgggtacagcgcgcctcgtcgatgctccggtgcggatcgactggcgcgagagtttcggccttcccgatgacgtcccgtcgacccggatcggcctgcaaacggtcataaatgctcgcacgctcgacggtttcaacatgccggcccggcgttttcttgacggatcaatccgcatcgctgccgaggcggtttcggatggtctggatttccgatcggtgcagatcgaggcagaccttctcgatgccttggtggagctgccgggaaatgtctgggccaaggaggtgggcgagccgggcctggcgctgctcgatctggtccaacgtgaggacggcgggtttgatcttggaacgataaggatggaggcagacggggcgggcttgctggcgagcgcccggttgagcgaagtcggggccctggaggatctgacgctcgaccgcctgtttgtggacgggatgctggatatcgcgggcgaaatatcgcccgcaattgcgcccggccagccggtgcgggtccggctggcggggcagtatgcggatgtcagtgccttcatgcccgacctggcgtcgatgggcggtgagggcggcatcacgctgcccctgtcactgcaggcggatatcggtcggctgaccctgtccgaggagagcgtcctcgaccaattcaatcttatttggcgcagcgaagcggcaggcatccgtgccgtctcggtgtccgggaatgcgttcgacggcccattccaggcgtcgtttggcgccagcgagaccggcgggcaacgagatttccggatcgaggcgcagtcattgcaacgcatttccgccctgctcggaatggagggatatgcgcgtggcgggcaggtgtccgtcctgggcagcgcgcctccgcttggcacggatggtccgttgaccgcccgcgttgaaatccgcgatctgaccctggtgcaggttcctgtcctggcgcggatcctcgctgccggctccttccaggggttgggtgcattattgaatggcgaagggatccgctttgacgccgttgacgcggatatcgcctatgaggatggcctgctgaccattggtgacgggcgggcccagggaagcgccttgggcgtgacggctgcgggtactgtcgatttcgcggacaggcgcgcggccatcgacggaaatctggcgccgtcctacgtcatcaactcgatgttgggcggtctgccggtaattggcgaggtgctcgtctcccgcccgggcgagggcgtgatcggaattacctattcggtggaggggccctttgacagtctgaccgtcttcgccaatccgctctctgcgctggcaccgggcgtctttcggcgcatgttcgagggaactgccgccgagcgggcggctcgggagcgggccactgacgtggctgacgatggacagtcagtggatgtcgagcccactgagcctgagcggccaaatccggatcaggccgtaaccgacaccggagccaccgacggaccgccggacgacaattga

SEQ ID NO: 1729 - DNA, 3285 bp, Rhodobacter sphaeroides ATCC 17029
atggcagagagcggcgagcggcaggcatcggagcggaaggggcggtcgcggcgcggccgggcgtcgctgtggttgctgctcagtctcgcgctggtggcggccgtcgcgggttttgccacgctggccttcacggggcggccgctgcccttgcccggctgggcggtgaccgaggccgagacgcggatcaaccgggcgctggagcctgccctgtcggtctcgctcggggggctggtgctcacggtggagccgaactggatcccgcggctccggctcgacgatgtgcgcctgcggcaggccgacgggcgcacgctcgtcacgctgcccgaggcgcgggttgtgttcgaccggggcgccgcgctgcgcggcgcgctccatcccaagaccatcaccctctcgggcgcgcggatcgcgctgcgacggctggccgacgggcgcttcgacttcgccatgggcgagcagggcggcaccttccgcctcgcaagctatgccgaactgcgcgagacggtggaccggctcttcgcccagccggtgctggcggacctccggcggatcgaggccgagggcacgacgctgacgctcgacgaccgtcgcgcaggccggacctggcaggcgggggacgggcgtctcacgctggtgaacgggcccaaccggcgcgcgctcgagatcggcctgacactgctgaattccaagggccgcgcgcccgcgcaggcgctcgtgaccttcgtcaccacgcccggcagccccgaggcgcggatctcggccacggtcgatcatgtggcggccgccgacatcgccgcgcaggccgcccccgtggcctggctcgaggtgctggatgcggcgctttcggggcgcttctcggcggcgctcgacggcgaggggcggctcacgcggctcgaggcggggctcgacagcggcgagggggcgctgcagccgcggcccgagaccagacccatcgccttcgacagggccgggctcgccttcgcctacgatccgggacgcgagcggttgaacctcacccggctcgaggtgcagggccgctcgatccggctttcggcgcagggtcacgcctatctgccgggggtctcgcgcgggttgcccagcgagattctggcgcagatccgggtcgaggatgccagcgccgaccccgagggcctgttcgagacgccggtccatttctcggaaggggcgctcgatctgcggatgcggctcgatccgttccgggtcgacatcgggcagctcgcgctggtcgaggaggggcggcgcctgtcggggcgcggccatgcctcggccgagccgggcggctggcgcgtggccttcgacctcgggctgaacgagatctcgcattccgacctgctcgcgctctggccgctgtcgctggtgtcgaaaacccgggaatggctggaggagaatgtgcaggaggggcggctgttcgaggtcgaggccggcctgcgcatgagccccggccacgagacgcgcctgtcgctcggctacgagttccgcgacggggacgtgcgctatctcaagaccctgccgcccatcgagagagggtcgggctatgcctcgatcgaggatcgccgctatctgatggtgctggaagaggggcaagtgacgccccccgccggtggcccgatccgcgtcacgcgctcggtcttcgaggtgccggatgtgaccgagaaaccggcgcaggcgcggatctcgctcaacagcgagagcggcgtcacggcggccctgtctctgctggaccagccgccattccgcttcctcgaaaaggccggccgctcggtcgatctgggagagggcctcgcggtgatggagacggcgctctccctgccgctgaagcgcaaggtcgaacccgaggatgtcgagttctcggtccgcggcacgatcaccgacttccgctccgacacgctggtgcccggccgccgcatcgtggcgccccgccttgcgctcgaggcggagcccgagggtctgaccgtggccggcgcgggcagcttcggccgggtgccgttcgatgcgacctaccggctggccttcggccgcgaggcggaaggacggtcgtcggtcgagggcaccgccaccctctcgcccgccgccgtcgaggagttcaagctgggtctgcccgcaggcaccgtcgagggccgcgcgcccggccgcttccgggtccagatggagaagggccgcgatccgcggctcacgctctcgtcgaacctcgtagggctgcgcacgggtctggccgcgatcggctggtcgaagcccgcgaaccgcgcgggccggctcgaggtcgaggcgtcgctgggcaagccggtctcggtcggcaagctcgtgctggaggggggcgggctcgcggcttccggtcgggtcgatctgcgcgccgacggcgggctggatgccgtgcgcttcgaccgggtgcggctgaacggctggctcgatgcgccggtgacgctggtcgggcggggcgcgaaccagccgcccgaggtgcagctgcggggcggctcggtcgatctcacgcggctgggcgatctgggcggcgggggcggcggcgggggcacgccggtgccgatcctcgtcgcgctcgaccggctgcaggtcacgtcgggcatcgcgctgaccggcgtcgagggacgcttcggcacccgcggcgggttcaacggcgccttccgcggacgggtgaacgggcgcgccgtcgtcgaagggtcggtggtcccgatgagcgggcgcagcgccgtgcggctgagatcccgggacgcgggcggcgtgatcgcctcggcggggatctttcccgatgcgcggggcggcgatctcgacctgagcctcatgcccgagggacgcgacggctaccgcggacaggcggcggtctcgaacttccgcgtgacgaatgcgccggtgctggcggcgctcctcaatgcgatctcggtggtgggccttctcgagcagctgaacggtgacgggctgctcttcgccgagggcgatgtccggttccgggtgcagccgggcgcggtcgagatctccgaggcctcggcggtgggggcctcgatgggggtcacgctggaggggctctatcgcaccgccgaccggcggctcgacctgcagggggtgatctcgcccatctatctgctgaacggcatcggctcggtgctgacccggcgcggcgaagggctgttcggtttcaactattccgtgaccggatcggccgaccggccggccgtctcggtgaacccgctctcgatcctcacgcccggcatgttccgcgagatctttcgccgaccggtgccggttctgccctga

SEQ ID NO: 1730 - DNA, 3294 bp, Rhodobacter sphaeroides ATCC 17025
atgaccgtgggcggcgaccagcaggagccggggcggagcggacggtcgcggcgcggccgggtctcgctgtggctgctgctgagccttgcgcttctggccggggtggcaggctttgccacgctcgccctgacgggccgcccgctgcccctgccggtctgggccgtcagcgaggccgaggcgcgcatcaacagggcgctgtcgccggcgctgtcggtctcggtcggcgggatcgtcctgacggtcgagccgagctggatccctcggctccggctggatgatgtgcggctcttgcaggcggacgggcgggtgctggtcagcctgcccgaggcgcgcgtggcctttgatcgcggtgcggccctgcggggggcgcttcatccgaaggtgatcacgctgtcgggcgcgcggatcgcgctgcgccggatgagggacgggcgcttcgacctggcgatgggcgagcagggaggcggcctgcgcatcgcgagctacgccgaggcgcgggaggcggtggaccggatgttcgcgcttccgctgctggccgaccttgcgcggatcgaggccgagggcacgacgctcacgctggacgatcgccgcgcggggcggacgtggcaggcgggcgacgggcggcttgcgctggtgaacaggccggaccggcgcgcgctggaactggggctgtcgctgctcgatccgggcggcggtgccccggcgcaggcggtgatgacctttgtcaccacgcccggcagccccgaggcgcggatctcggccacggtcgatcaggtggccgcgtccgacatcgccgcgcaggccgcgccggtggcctggctcgaggtgctggacacggcgctctcgggcggcttctcggccgcgctcgacggcgaggggcggctcacgcggttcgaggccacgctcgacagcggcgagggcgcgctgcagccgcgccccgagacgaagccgatcgctttcgatcgggccgggatggccttttcctacgatcccgcgcgcgagcggctgaacctcacgcggctcgaggttcaggggcggtcgctgcggctgtcggcgcaggggcatgcctatctcccgggcgtgtccgaggggttgccgcgcgagatcctggcccagatccggttcgaggatgccagcgccgatcccgacggcctgttcgagaccccggtgcatttttccgaaggggcactggatctgaggatgcggctcgatccgttccgggtcgagatcggccagttggcgctggtcgagcagggccggcggctgatcggccgcggtcgcgcctcggccgaggagggcggctggcgcgtggccttcgatctggggctgaacgaaatctcgcacagcgaccttctcgcgctctggccgctggcgctggtgcccaagacacggagctggctcgccgagaacgtgcaggagggccggctgttcgaggtcgaggccgggctgcggacgagtccgggcgcggagacccggctctcgctcggctacgagttccgcgatggcgacgtgcggtatctgaagaccctgccacccatcgaaaagggctcgggctacgcggtgatcgaggatcgccgatacctgatggtgctggaggagggccgtgtcaccccgcccaccggcgggcccatccgcgtcacgcgctcggtcttcgaggtgccggacgtgagcgagaggcccgcccgcgcccggatctcgctcaacagcgagagcggagtgacggccgcgctctcgctgctcgaccagccgccgttccgctttctggagaaggcggggcgctcggtcgatctgggcgagggacgcgcggtcatggagaccgtgctggacctgccgttgaagcagaaggtgaggcccgacgaggtggatttctcggtccggggcacgatcagcgacttccgctcggagacgctcgtgccggggcggacgatcaccgcgccgagcctcgcgctcgaggcaatgcccgagggtcttcgcgtcagcggcgcgggccgtttcgggcgcgtgccgttcgatggggcctaccggctcgccttcgggcccgagacgggggggcgcgccacggtcgaggggacggccaccctgaccgccgccgccgccgaggaattcaacctgaacctgccgccgggcacgctggagggcgctgcgcccggacgcttccgcatcgagatggcgaagggggccgagccccgcctcacgctgtcgtcggatctggacggcttgcggatggggctggccgccatcggctggtccaagcccgccgggcggagcggccggctggaactggcggccacgctgggcaagcccgtgacggtggaaaagctggttctcgaagggggagggctctcggccacgggtcgggtgaccctgcgcgccgacggcggccttgatgcggtgcggttcgacagggtgcggctcaacggctggctcgacgcgccggtgacgctggccgggcgggggacgggccagccgatcgaggtgcaggtgcggggcgggtccgtggatctcacgaggctcggtgccgcgggaggcggaggggctggcggaagcggaggggggacgccgatgcccatcctcgtggcgctcgaccggttgcaggtgacctcgggcatcgcgctgacggatgtggagggccgcttcggcacgcggggcggcttcaacggggggttccgcggacgggtgaacgggcgcgccgccgtcgagggcacggtggtgccgatgaacggacgcagcgctgttcggctgcggtcgcgcgatgcgggcggggtgatcgcctcggccggcatcttccccgatgcccgcggcggcgatctcgatctgcatctggtgcccgagggtcgcgagggctaccgcggccgggcggtcgtctcgaacttccgcgtgacgaacgcgccggtccttgcggcgcttctgaatgcggtgtcggtcgtgggccttctcgagcagctgaacggcgacgggctgctctttgccgagggcgatgccgaattccgtatccagccgggcgcggtcgagatctcgcaggcctcggccgtgggggcctcgatgggggtcacgctcgcggggctctaccgcgccggcgaccgcaggctcgaccttcagggcgtgatctcgcccatctatctgctgaacggcatcggctcgcttctgacccggcgcggcgaggggctcttcggcttcaactattcggtgacgggctcggccgaccggcccgcggtgacggtcaacccgctctcgatcctcacccccggcatgttccgcgagatctttcgccgcccggtgccggtcctgccctga

SEQ ID NO: 1731 - DNA, 3699 bp, Bradyrhizobium BTAi1
atggcaagacagacatccccccaccggccccatctgcaggcggacacccagggccaacagtgggatgacgccgattgggatacggctcacccccacgacgcggatgcagcgcatgacgagatcgccggccaacgcgtccgcaggctgctgtcgcgcgacgattcgggctcggctgccctgtcgggccggtccggcaaggcgcgcaagggcggcctggcgcggcgcatcggcattgcgctggtcgctctggtcctgatcctggcgatcgggttcggcggcttgtggctgcggctcggcgccggcccgatcagcctcgaccttgcgacgccttggctcgccgcggcgatcgcggacaatatcggtcacggcaatacggtcgaggtcggcggcacgcagatcgagcgcgccggccgcatccggatcgcggtccggattcgcgacattgtcgttcgcgatcaggagcaggcgatcgtggccagcgcgcccaaggccgaggtgcggctgtccggcgctgcccttttgatgggtcagctccgggccgaaagcctgaagctggtcgatgccgagctcgcgatccgcatcaccccggacggcaccgtcacggtctccaccggtgagaccagcaagccgcttgccaccggcgttgcctccaagcgtgatgcaggcctgccgccgaccttcccgcggccgggccagcccgtcacgccgccgaccgcgcccgaggcggcgacccagcaagctgcgcccgcgaacccggctgccgcagggaccgcggtgccggcgagcgcccagagcggcctgctggccggtctcgactggctcgacagcctcagcctgaccggcctcgatggccagaacctcaacgagatcggcttgaagaacggcgtgctgatcgtcgacgaccagcagcgcggcaacaaatggacattcgaaaatatcagcctcagcctgcgccgtccctccggcggcggcgtcgcgctgagcctgggcgaggagggcgccaagccgtggctgctgcgggttttggtcggaccgccctccaacggcgtgcgctcgatcgacatcaaggccgacaaggtctccaccagcaacatccttctggcgctgcgcctgaaggacctgacctacatggccgacctgccgctgaccggcgagatcaagggcgagctcgcccgtgacgggctgccgacctatctgcgcggcaagatcaatatcggcgccggcaacatcatcgataccgatacgccggattatccgatggcgatcgactccgccgagatgagtatggaatgggatgccggccgccgcgtgctggtcgcaccgttcaaggtcatctcgggcgccaaccggatcacgctgaacgccaatctggagccacccaacgacgcggtcaatgattggcggctcggactgagcggcggcaccatcctgctcggcgcgatcgagaacgaggcgccgctgatcttcaaccggatctcgatcaacttccgcttcgacaccgagggcaagcgcgtggtgctcacgcaggccgaagtgtccaacggcgagatcggtgtcgccgggaccggcagcgtcgaatatgccggcgagccgcggctgaagctcggctttgccgccacgccgatgccggcactggcgttgaagcggatctggccggcgctgatcgtgccggaggtgcgggcctggatcatcgaacggatcgagcgcggcaacgtgcagcgcgtcgacgtcgcggtgaactcgccgacccgcaacctgccgcgcaagggaccgccgatccccgatgacggactggacgtcaacatcttggcgaccaatgtcacggtgcatcccgtcgacggcctgccgtcggtgcgcgatgccgacatgaaggcgcatgtcacggggcgcaccgccacggtgaccatcgggcagggcgtggccgacacgcccgcggggcgcaagctgaacttctccgacgtcgtgttcgaagtgccggacatggcgccgaagccgtcgccgtcgcgtctgcgcatgcgcgtcgacgggcaggtcgccgcggcagcggagattctcgcctctgatcggctcaacgacctctcgtcggtgccgatcgatccgaaccagaccaagggcacgttccaggccaatgtcacgctcgcgatgccggtcaagggggagctgaccaaggccgacaccaattatacggtcactgcggacctcagcggcttcgccgccgaaaagctggtgatgaaccagaagctcgaggccaatacgctgaagatcgtcgccaacactgcgggttatcaggtcaagggcgacgtcaagatcaacggccaaccggcgacgctcgactatcgcaagccgaccgagggcgacgccgacatcaagatgcaggccgtgctcgacgatgccagccgtgcgcggctcggcatggatcttggcacggccgtgaccggtgacgtgccgctcaagctgaacggcaagatcgccggctctcccgatcgcgacagccggctcggcgtcgaagcggatctgaccaagctgaagctcgacaatctgctgccgggttgggtcaagaatccgggcaaggcgggcaaggcgaccttcaacgtggtcgccaagcagcaatcgacccgcttcgaagacatcaacgtcgaaggcggcggggtcgcgatcaaaggctcgcttgaggtcgaccagaacggcgacctgatgaacgccaacttcccgacctattcgccatcggagggcgacaagacgcagctgaaggccgagcgcggccaggacggcgttttgaagctgtcgatgcgcggcgacgtgttcgacggtcgcggcttcctgaaatcggcgatctcgggcaccaacaaggatgccgagaagaacaaggcgcgttccaatctcgatttcgatgccgaggtcaagctcggagccgtcgccggcttcaatggcgaggcgctgcgcagcgtcgatgtcaagctctccaggcgcggcggcgccttcaagagcttcaatctcagcggcaaggtcgggcgcgatacgccggtcaccgcggatattcgggtcggccgcgaggcgccgagctccgatccgcgcgcccgccggcagggacgcgaggtgatctatctcgtgaccaatgatgccggcgcgctgctgcgctttgccgatacctatacgaagatggcgggtggcgagctggagctcgcgatggagccgccgacggccgacagcagcccgaaggaggggctggcgatcgttcgcaatttcaccgtcaggggcgagcaggcgctcgatcgcgccgcgtccggcgcggtgcagggcgcctcgcaaggcatcgccttcacgatgttgcgcgcggagttcacacggcagaacgggctgctctcggttcgtgacggcgtcgtcaagggaccgacgctcggcctcaccctcgaaggcagcatcgactacaacgtcaaccaggtccgcgcctccggcacgatcgtgccgctgtatgggctgaacaacatgttcaaccagattccgatcgtcggtctgttcctcggcggcagcaatgagggtctgtttggcgtgacctacgaggtcgtgggaacgccgagccagccggtggtgcgcatcaatccgatctcggcgatgctgccgggcgtgacgcgcaagatcatggatttcaacacgggcaagcagcaatacccgccgggtgagctgccgccgaacaattga

SEQ ID NO: 1732 - DNA, 3441 bp, Brucella ovis
ttggcagagaaaccacaaaaaattcgcttcaccaagcggcagatgaaaaggatcgagcgcctcgtggctgaaagcggcgagggtatcgtatcaggttcggtgcgttctgcgcgatcgattgtttcgcgttgttctcatgcccttctatcgatctgcattctgcttgttctgctgggtggcgtggggtttgtcatcctgcgtggcggggtcaacagcgatcttctgcgagatgaagcccagaaaagcctctcccatattcttggtgaaggagcatccgcttccattggcagtgctgcgctttcacttgatcgcaacggccatgtcgccatggaagcgcgcgatgtgtcgattgttgatccgaaacagggggttgcgatcaatggtataaagtctgttcgtctggggcttgcaccgctgccgcttttaacgggaaaactgcgcgtggcgcagcttgaggtggaggggctcgcctttgatttgccggaagcgcgcggcggcggtttctggaaatccttgccttatgatgaaaagggctatgtcgatttcgatgccgcttccggtgagatatttgccgccatgcgccgcagcctggagcttttgagcgcgcaggatacgcgcgttatccgtatcgccaacagttcggtgtccttcaaggtgggcgaagaagagcaggtactcgatattgaacgcgcccgcctgaccgaagatcgcggaaagatcgccatcaccggcaccgtcgtctggaagggcagaaagattgccctcgacggcgatatcgaacgcaaggcgagcgacaaggcgcttagcgcatttcgcctgaatgtgaaggatattccggttgttatgggctccccgccacaagtcgcccccgtcatcaacggcaatcgggtgaacccggctcatttcgagcttgatgcttatgcacaattgacgctttcaggatttgcggcggatggcgataagccggaacggctggccgctgacctgacggtggatggcatcgacatgcagttgggcaaggtggataatgttcgcggcaatgtgcgcctcagcctcgaacaccgggttgggagccacaagatcgagatcaaaccgtcccgccttgtgcttggcggcttgcaggcgcagttcaacggcgccttcggcccggaacaggaggcagagagcaatacagatggcccctcctatcgctttgaggtgcttaccacttcggcgaccagtatgccccccgaatccagcgatccgccgctctcttttgcaacccgcatcgcaggccgctatatgcccgctcagcaacgcatccagtttgtcaatctggacgtacagacggaaggcgggcagctttacggtcagggcagcatgggttttggtgatagttcgccggaaatgatctttatgctgcgcattcccaagatgccggttgccgatgccaagcatctatggccgatcgacgttgcagatggcgcgcgcgaatgggtgttgaagaatctttttggcggaacactgcaagatagccgcatcgatatttcgctggctggcgggcgcttcaatggtcccggcctgccgccgcctctcacggaagaggagatcaatgccgatttcaatgtcgtggacacgcgcttcgatgtggttggggaactgcctgccgtgcgcgatgccgatggcacggtttctgtgcggggtgcctataccacgatcaagcttctcaagggtaccgcctataccccgaacaaccggaaggcgaccgtttccaacggcacgctcgttattccatgggggccgcagcggcccgttatggccgatcttgatctccatgtgtcgggcgaggctgcggccatcgcggaaatcgcgggaaacaaacccatcgatgtgctgaaaaatgttcccttcctgccgcaagatgtgacgggggatatcaatgcacaggtgaaggtgagctttgccgtgtcgaaggatccgccgcctggcacactgaaatggaatgcggatatcggattttcggagcttgatattgccaagccggttggcggctccaaaattacggatgctacaggcaatatcaaggtagaccagtctgccgctatcattacagccgatgccagactggacaatgttcctgcgaaagtcagcatgacggagcccgtggaccgctccggcccggcaaagcgcgagcagaagataaagctggaaatagacgacaagacccgcaatgcggtctttcccggcctgaatgccgttttctccgggccgatgtcggtcgatctggggatggagaatggtggcaagcgccatgtctcggctgatcttttaaaaacgcagatcgatctgccctggcttggatggcgcaaaggcgcaggcattcccgccaaggccacctttgatcttgtcgaacatagtgacaaaggtgaatttgaaatcagcaatctggtattttccggcgatgctttcggtgcgaaaggcaatctgtccatcgccaagggtgactttcagtcggcggatttcagtgaaattcgacttaaccgcagcgataatctctccgtaaaggcgacaaaaagcgggaacagcttccgggtcaatgtgcgcggctcgcaattcgatgcgcgggcgctcatcaagcagatttccgatcttgaagcaaaaaagagcggaggcggtcgcgccaacagtccgcgtgtcgtggtaagtgcgcaggttgatgaggttcacggattcaacaacgaaacgcttcgcaatgttgctgtgtcttatgaaagcgcaggctcgaaagtttccggcatttccgtcaatgccgtcacctcgtcggggcagcccttcgtggccaccaataacgatcagggcgatgcgcgctccatatcgcttcagtcgaacgatgcgggtgcggtcctgcgtttctttgatttttatgacaagatgcggggcggcaagattacggtgggcctggccgctcagggaaacgggccgctgcgcggccagatcgatgcgcgcaacttttccatcgtcaatgaaccgcgtctggcgaaaatcgtttccagctcgccatcaagcggcggcgccagcctcacccaggctgtcaaacgtgatattgacgtgtcgcgggtggatgtggagcgcggcttttccctgattgaaaagggccaaggctatctcaatctgtcgaaaggtgtcgttcgtggtcctgcggtcggaacgacatttcagggcacgctctatgaccagcagggcaatatgtctatcacaggcacattcatgccggcttatggcgtgaaccgtatctttggcgaagtgccgattttcggcgcgcttttgggcaatggccgtgatcgcggcctgcttggtattacttataagctcgtgggcaatgcgaaacagccacaggtgatcgtcaacccgatttcgctcatcgcgccgggcattttccgttccatcttcgagttccaataa

SEQ ID NO: 1733 - DNA, 3387 bp, Sinorhizobium medicae WSM419
atgagtgacatccgcggcgaaagagtggactttcgcagggaagacatcgtcgcgctgcacgctttgccctcggctcaagctcacgacccggtcatcgtgcacacgccgcggcctggcggtgcctggcgcctgtgcggaaggattctgctctgctgctcgctgctcgtcttcatcgccgttgcttcgcttatcgccataatagaaagcggaattgtagacgggccgctgaatgccagggccaggacggcgctcaacaccgcactcggacaggattatagcgccgatgtcgagagcacggtgatccggctgaccggcggcggcgcacttgcgctcaaggcgcggggcgtgacgctgaaggagcgcggatccggccggcatctcgccaagctcggtgcaatttcgatcgccctcgatccatttgccctggcgaccggccgcatcaatgtctcgaggcttgaagcggagggtggcgagctcgacaccgggctcctgccgcgcggcgagcccatcgatcttacagccatccgcatagcggacgtaggcactgccctcgaagaattgttcgcacagggcgatcggatgtcgcgcttgaccgccggacggtcgacccagaccgtcgtcctctctgacttcagcctaacggtcagcggcacgcgtgggcgggccgttcccgtcgaaatcaagacactgcaattcagtcacgaccccgacagttcgatgcgagttgagggcacgattgcggttgacggcatcgaatctcagcttacggcaaaggctctcggcgacagggggcgcatcgccgccttcgaggccgggctcgacgcgctgccgctttcgccgttcctccatcacggcaagtcgggcaatgaggaggccttcggcatcgaagccaccgccaatgtgacgctcaaagccgcccgcgctgcggatggcacgaagccggcactcacggcggccgtgaagacgtccaggggctccttccacgccggcggcctcgcctccaaactcaactccgcggaactgaacgtctcctacgatttcgagcgagcctcggtcgagatattgtcgtcgatggtcaggatcggccggtcgagcttccccttcacgggagccctgatcgatctcgacaagattgccggcgcagaccggaaaggattcgcggtcgatctcctgttcaagaacgccagctccgaccctgaggacatgcaggcgcccccgcttgccttcgatgccaaggcaagcgggcgtttcgagtccgacacccaccggctgatcttcgatcaactcgcgatatcgagtccgcttggctccatggcgggttcgctttcggtcgccttcggcaagacgtcgccgcgcatcagtttcgctgcggtcagcgacaggatgcactccagcgccgtcaagcagctgtggccctggtggctggcgaagggggctcgtcgctgggcgttaggaaacctcttcggaggcatggtaagcgacgcacgcatcgaggtctcgattccggaggggcgtattgccagtagcggcggagaattgaggctcaacgaaaaggagctcaacatcaactttgccgtcgacgagacgcgcatcaacatcgcgggagagataccgccgttgcgtgacacggccggacgcttcagcctgagcggcgagcggatgtccgtcgccgtcgagaagggcgccgccttcttcccgtccggtcgctccgtcgccttgaatggcggggatttcatcattgccgacgtctataaaaagccgctgatggcggaaatgaagatcaaggtcgcgggcgaggcggacgcgatagccgagctcgtccgctacaaaccgatagaggcgcttcggaagacgcctttcactcccgaggattttaccggcccgatgacggcgctggtgggtgcgcggtttggtctcatttccgaccagaagccgccacgtccactgtggcaggtggaaatggagcttgaggacgtgacgataaagcggcccgttgcaggacgttcgatcgccgatctcgacgggacgatgaggatcgacaacgagcgtgcagtgctccaggcgaacgccctaatcgacggtgcgaagatgcgcgtcgcgctcaccgagccggttggcacctcggccaatgtggcgagaacgcgcgaaatctccggaacgctcgacgacgcggcgcgggcgaaaatcgctccggccctgtccggaatcgtcagcgggcccgtgggcatagacgtttcgcttgcggaagacggcagccagtcggtcaaggttgacctcggaaaggccgtgctgtcgcttccctggattggctggagcaagggctcgggcatcccagcaaaggcgcaattcacaattcgggcggccggtggcatcacggagataaacgacctgcggctcaccggagaaggttttggcggcaatggcgaattgcgcgtagacgaatccggccttgcagcggcgcggctgagcggcgtgcgcctggcaagcggcgacgatttttccgtcacagtgggacgcagcaagggaggctattcggtaaacctaaccggcaccgcagcggatatccgaccggcgctcgctcgcgtcaagggcggcgcgagttcaaaggatggcggcaatgtgaagatcaaggcgcggctcgaccgggtcaccggtttcaacggcgaagtcctgtcgaatgttgatctcacctattcgagccgcggccagcagatcgacgatgtcaacctttcagcgataacggcaagcggccaggcagtcgttgccaggttggtcaaggccggtgcggacaacacgctggaactgacgacaagcgatgccggagcctttgcacgcttcatcgacatctaccgcaatatgcggggcggactcctcaatttgcgcctgcgtgatcgcggtgccaactcgtggcgcggaaccgtggacatccgcaagttctcgctggtcggcgaacaaaggctgcaatcgatggtctcgacccgggcgggccaggacggtcgcagtctcaacgaagcggttcgacgcgatatcgacgtgagcacggctcagttcgagcgtggcttcgcgcaactcctgctggatcagggcgcaattcgggtcggcagcggagtggtccgcggtatcgatgtgggcgcgaccttccagggaactgtccgcgacgccaatggtcgtatggacatgacgggtacgttcatgccggcttacggattaaaccggctcttcggggaattgccgctgatcggtgtcctgctcggaaatgggcgcgaccggggcctgttggggatcacgttcaaactcgccggaccgttcagccagccaagtctgacgatcaacccgctgtcgatcatagcgccgggcgtcttccgcaatatcttcgagtttcaatga

SEQ ID NO: 1734 - DNA, 3399 bp, Ochrobactrum anthropi ATCC 49188
atgaaaagaatcgagcgtctcgccgctgacggcgagggtggctttttgcccggcccggcccgtccgagccgttcttttttatcgcgctgttcccatgcgattttgtcgatctgtatccttctggttctcatagtcggtgccggttttgtcatccttcgcagcggtgtcgatagcaatcttctgcgtgacgaagcacagaaaagcctgatgcatattctcggtgaaggtgcgtccgcctccatcgggagtgcggcgctatcgctggatcaggatagtcacgttgcgctcgaagcccgtgacgtatcgatcgctgatccgaagcagggcgtcgaaatcagcggaatcaaatctgtgcgcctggggctggcgccgttgccgcttttgaccggcaaggtacgtgttgctcagctcgaggtggatggcgtttcctttgaaatgccagaaacgaaaggtccgggattctggaagtccttgccttacgacgaacatggcattgtcgatttcgatgcggtttcgggtgagcttttcgccgccatgcgccgcagtctggagcttttgcgtgcgcaagacacgcatgtcataggcattttcaacagcaccgttgcattcaaggttggcgatgaacagcaggttctggatatcgagcaggcccgtctcatcgaaaatggtgggaagatcgacatcgccggcagcgtcatctggaaaggcaagaaaattgcactggatggcaagatcgaccggcatgcaggtgacaacagtctggccggcttcgagctgaatgtccgcgatattcccgttgcattgggttccccgccagaagtttctcccgtcataaatggcaatcgtgtcaatccggcccatttcgaactggaagcatcggcacgcttgtccttgacaggatcggctgccgatggcgatcggccggaacgtcttgcaacagaactcgctgtcgacggcatagatatgcagctcggcaaggttgaagacgtgcgtggtggtattcgccttaatcttgaacatacggtaggaagccgcaagatcgagatcaagtcgtcccggctgcagcttggcgggatgcaggcacagttcaatggggcatttggtccggaaccggaagctgaaaacaatacgggcggtccgacatatcgcttcgaggttctgaccacttcggcgacgagtatgccatcggaatcgaccgatccgccgctatccttcgcaacacggatagctgggcgctatatggccgaccagcaacgcatccagtttgccaatctcgacgtacagacggaaaccgggcaactctttggccagggaagcatgggcttcggtgccggttcgccggagatgatcttcctgctgcgcattcctcaaatgccggttgcagacgccaagcacctatggcccatcgatgttgcggatggtgcacgcgaatgggtgcttaaaaacctctttggcggaactctcaaagacagccgcatcgatatttcgctggcaggtggtcgttttaacgggcccggccttcctccaccgctgacgggcgatgaaatcaaagctgatttcaaggttttcgatacacgttttgatgtcgttggagaactgccgcccgtgcgcgatgccgatggtgagatatcggttcgtggcgcctatacgaccatcaagcttttgaaaggcgtggcctacacgccaaacaaccgtaaagttgatgtgtctgacggcacgctcatcattccatgggggccacaacggccggttatcgcggaactggatctcggtgtttccggtgaggcatcggcaatcgctgaaattgccggaaacaagcctatcgacgttttgaagaatgtgccgtttctgcccggcgacgtgaccggtgatgtgaagtcgcgcgtcaaggtgaactttgccgtttccaaggatccgccgcccggcacgcttcgctggaacgctgacattggcttcaccggtctcgacatttcgaagccgatagccggatcgtccgtcagtgatgcgacaggcagtatcaaagtagatcagtcggcggccattattactgccgatgcaaaactggatggtgttcctgcaaaaatcagcatggtcgagcccgtcaatcgctcgggaccggtcaagcgcgagcagaaggtcaagctggatatcgacgacaagacccgtgacgcagtctttcccggtttgaattccatcttctccggccccatgtctgttgatcttggcatggatgatggcggcaagcgccatgtttcagctgatctcggcaagacgcagatcgatctgccatggctcggatggcgcaaaggggcaggcataccggcgaaggcaaccttcgatctggtccagagcgcggacgacaagagcaagatggacatcaataatcttgtcttctctggcgatgcctttggagcgaagggggatctttccattgcgaaaggcgattttcaatcggcgaatttcagcgagatacgcctgaaccgaaacgataatcttgcagtcaaagcggccaaaagcgggggcggctatcgggttaatgtgcgtggttcgcagttcgacgcgcgggccctgatcaagcaggtttccgaccttggcgagaagggcagcggcggcggtaaaagcaataatccgcgcgtggtcgtgagcgctcagatcgatgcagtcagcggctttaacggtgaagctttaagcaatgtcgctgtctcctacgagagcgcgggcagcaaagtatcgggcgtatcggtcaatgctgtaacgtcgtctggcgaatcctttgtggcaacgaacaatgatcagggcgatgcgcgctccatttcgctgcaatccaatgatgcaggagcggttcttcgtttcttcgatttctacgacaaaatgcgcggtggcaaaatcacggttggtctcgccgcacagggcaacggtccgttgcgtggtcagatcgatgcgcgcaattttgcgatcatcaacgaaccgcgtcttgcgaaaatcgtttccagttcgccatcgagcggcggcacaagtctcaatcaggcagtaaaacgggatatcgacgtttcgcgcgttgatatcgagcgcggtttttcgttgattgagaagggcaacggttatctgaacctgtccaagggtgtcgttcgcggtccgaccgtcggcacgaccttccagggaacgctctatgacaagcagggcaatatgtcgatcaccggcacattcatgcccgcctatggtgtcaatcggctgttcggcgagctacccatctttggtgcgctgctcggaaatggtcgcgatcgcggcttgatcggaatcacttacaagcttactggcagcgccaagcagccgcaggtgatcgtcaatccgatctccgtcatcgcgccgggcatattccgctcaatctttgagttttga

SEQ ID NO: 1735 - DNA, 3510 bp, Parvibaculum lavamentivorans DS-1
ttgatccgccggaccagtaagatcgcgttggaggttattggggctgccgtcgcggtgacggcggtgcttcttggcgttcttgcatggcgtctatcgtccgggccggtttccgtctcgattctcaatcagatgattgaagacgcagccaatccctccctccagggcgggtctctcggcattggcgacacggtgctcatctggtcggcggaggagcgggaactgtccttgcggctcgcgaatgtccggctcaccggggcggatggcaacgcgatcgcagatatcccgcagcttgccttcgatttgagcgtcccggccgctttccggggcatgttggcgccgacggcaattgatctatacggagtgagcgcaacaattcttcgccgtcccgggaccggcatcacacttgcgctcgccccggctggcgcggaacagccggaccccgacgtgtcctttatcggccccatgctcgaagcgctggtcgacgacaacgacaaatccacgccgctcggctacctcgatagtgtcggcatccggcaggccagacttcgcttcgtcgacgaagtgaacggcgtgagtttcgacgcgccttccgcaagcctcacgatatcccgcggcgaagaaggcctggccggcgtgctgagcgcggaagtcgtcaccggcgatgccaccgtccatctcgaaatggatggcgttctgccaatgggggacgatacggcgcgcatagacgcccgggtaagggacttgagaccagccgctctggcgcacatgtctcccgtcttcgcggattatgccgtcttcgacgcgccgataactgccgagggcagtttgcggatcggaagagatggtgctcttcactctgcccgtctttcactggaggcgggcgaggggcaaatcgatctgcctgatccctgggccacaaagattccgttggagcaggcccagggtgaaatcacccttgatggtattgcgcgtcgcatcgagcttcaggaattgacattcaaggccggtctgcacgaggcgcggttgaaaggcgccgttgactatcggatgggcgaggggctgaacatcgcttccgctctcgtcgatctgacggcggaacggtttcataccgaagtgcccgagttttttgcaggcccggtcgatctggatacggcgcagctgaaagcggaaatcgatttcgatgccttgcgcgcagatatcgaagagcttttcctcgctgctggcgggggtggcgtaaggctttccggcagcattgcggatgccgagcgctcaccggccataagggttgaaggtgtcatcgagccaatgccgtttgaagcgttgacagcgctttggcctcttcctcttgcgaagggcgcccgcgagtgggtggccgctaacctgtacggcggcaacgttaccggcgcttccttcgacatcgatctggcaggcggcatgatcgcggatatggaagcacacaagccgataccggcggaaagcctgcgcttcgaattcgccgtcaacggagcgacgatgaaatatcttggcgcgatgccgccgatgttgaacgtcgatgctcgaggattgatcgagggcatccgtttcgatgcatgggtttcctcggctgttatccggcaggaggggattggcgagatagcgatcagcgaaggtcatttttatgatgaagagatacatatcaaaggcgcgcccggacatatcgccttcaccgccagcggcgcaacggccgatattctcagccttctcgatcatgaacctctgactctcatcagtgatttcggtctcgatccgcgaagcgttgccggtaccggcacattgcggggacaaattaccttgccgctcgtgaagagtgtcacgatggagcaagtcgaagtttccggtaaggcgcatgtggaaaacgtcgccattccggaaatccaaaagggtctctccatcacatcgggcgttctcgatgtcgacgttacgcgagcaggcctttcggcgaagggtcctatcggcatcaacaacgccgcctttctcgatatcgaatggcaggagaaattcagccgcgaggcaagcccgacatcggtctatcggttgcgcggcgatatcgatgatctcgggcgggcagctcttggattgcgtctcgatgaattcctcgccggatcggcggatatagatgcgacgttgatgggagatggacggagcgtcaatcgcggatccatcaaggctgaccttacagacagcatcgtgaagcttgattatgccggctggtggaagaaggccggcgccccggccataacgtcattcgatctggcttttctggaagatggcggataccggatttccaatttctcgcttaccggggaaggtattgaggcagagggacaagttacattgggcgatgatgggcgcatgatcgctgccaacttccccgtcgtgaagctcggctctcacaatgattttgcctttatcgcgcatggaagcgaagacgcggcgctggcgatggatgtgacgggcgcgcgtttcgacgcgcggggaattcttggcaacctgttctctggagaggaaccgggagaagatcagggcgcccaggcggcattgcccctactgaccgaagcggaggctgccgacccccttcgcaggaccgagctcaaggcctatgtgacgcaggtaaccgggcacaacgacacgagcttctccaacgcgcgcgtgagtatggtgcaggtggacggccgcacatggtcgctcgatgtcgaagcggccgatgaggagggcacgccgctctctgtgcgggtcggcccggatggcaacggtgttcgcactcttgccgtatcgtcgagcaacgccggcaatattttcagatctctcgatttcacggagagcgttcggggaggcgctctgtctgcgtcgggtcgctacgacgatacgaaacctggatcgcctcttgccggcgtagtgacgatcggcaaatttcgtattgtcgaagcgccggtattggccaacatcctgacgctcggttctctcaccgggatcggggacacgttgcgcggtgagggcattctgttcgaccatctggaattaccattcaccgtcaccgaaaaccgaattcgcatcaaggatgcgcgcatgtcgggcccggcaattggtctcacaatgaatggccagatagaccgtgccgcggacctagtggacatggagggaaccctcgttcctgcctacacaatcaactcgtttctgggacaagtgccggtgctgggccccctgattgtgggccgtgaaggcgaaggcattttcgcaattacctatggcgttcgcggcaagacggatgaaccgaccgtggtcgtgaacccgctctccgcactcgcaccaggtttccttcgccggctattcgagttcggaagcacattgccgcctgaatccgcctcgtcttcggaaaacacaccctcggaacagagggccacaccacccgatgcctcttccgaagccgaaccggacctcgctccgccagaacctcctgcagcgcaaaactga

SEQ ID NO: 1736 - DNA, 3534 bp, Xanthobacter autotrophicus Py2
atggaggatagggtgcgcaagccggagccggtgcggcgtcagccgcggcgctcccgcttccacggcatcatgggggcgctgacgccgcgcagccgcgcggcgcgcgtgttcaccatggtgtgcctgctgctcatcgccctcggcggcctggctgcgctcaccctttatgtcctcattgccaatggcttcgtcacagccaacctcgcgaccccctatatcgagcgggcgctggaagagcgcatcggcggcgggcacaaggtggccattggttccaccaccatggagaccgtgcgaagcggcgccaccgttgtggtggtgcacgacatccgcgtcaccggtcccgacggccagctggtggccagtgcccccagcgccgaggtggagctggaaggctcgctgctctccctgatgcccaaggcgcgccgcatcgacctcgtcggcgcggagatgaccgtccgcatcgccgcctccggccatctggcggttgccaccggcaagggggcaaaggcgatctcggcgccgatttcgacggccgcccgtacgccatcgcagcctgctccagtcgcacccgcgctcgccggggctggcgcacccgccgcgaccccacagccggccgccaccgaccctgctgccgcttcggccggctccagcgccctcgataccgatccgctgaagcctgtggccctggcccgctggatcaatgaactggaatcggccggcttcgacggcggcgctctggcagacgtgggcctcaaggacggcaccctcgtcgtggagaacgagagcgccggccggcgcatcgtcttccagcacatcagcgtgcgccttgcccggccgcaggccggcggcgcccagctcaccttcaccatccagtcgccgcagggcatcgccaccgccacggcgcgcatcggcccggcgcaggacggcgagcggaccatcgagcttgcgatccgcaacctctccacccgcgacctgctgcaggccttcatccaggaccagcgccgcttctacatggacacgccgctgaacgcgtccttcaccgcgcgcctgtccgtggagggcgaggtgaaggccggtgaggcgagcctcgacttcggcgccggcgcgctgggcaacggcgaggacccggaagaacgctttgtcatcgatcacgcccgcatcggcctcaccctcgacgtggcccgccgggtcatcgtggtcgcgcccatcgaggcggtgaagaccgaaaacatcatctcgctggcgggcgagatcaaggtgccggcgaccctgggcgcgccctggccgttccagatggggccgaagcaggtgctgctcgccggcaaggagatgcccgagcccgccctggtggtcgacaaggttgaggtggccggccggttcgatccgcccagccggcggatcatcgtcgatactggctttctgggctcggcggcgggcagcttcaccttcaccgctttgttcgacttcggcgtggacgtgccctacctgaagttcgacggtaccgcctcgcccatgccggtcgccaccatcaagcgcttctggccggtgaacatcgccccgccggcgcggcagttcgccatcgaaaacgtctccggcggcacggcggacggcatcaccgtggcggtcaagctgcccctcgacctgatcggccagaagcaggtgccgctgccggacgacggggtgcgcttcaccatcaatggcaagggcgtctggctccggccggtgaagggcctgccgcccattaccaatgcgagccttgccatcctcgtcaccggtcgctcggtgcgcatcaccctgccggagggcaccgcggtgacgccgcagaaccgcaagatcgcggtgagcgacggcgtgatgctgatgccggactatttcccccgcgagcccacctcccagatcaaggtgaagttcgacggcccggccgacggcgccatcgaggtgctgggcatggagccgctgaaggggcccaccggcaccgccttcgatccctccaccacgcggggcaagttctcggccctgctgcaggtgaacatcaccttccgcaaggtgccgcggccggaggacttcgactattcgctcgaagccaccctgaccgatttcggcgtggacaaggtgttccgtggcctcaggctcgaaagcgcgaccgtgaaggccttcgcttccccggccggcgtggtgctgcgcggcgacggcaagatcgccggcgcgccgatggcgttcgaatacgagaagcgcaaggacgtggccgatgccgacatccgggtcagcgcgagcctggacgatgccgcccgcggcaagctgggcgtggacctgcccggcgtgtcggggacggtgggggtgcgcctcatcggcacgacgaacaacaaggacacgcgggcgaccatcgaggctgatcttgtcaatgctcgcatcgccgatctcatccccggcctcagcaaaccggcgggcaagccgctgaaggcgaagttcgccctcaacgacaagggcaacagcgtccgcctcgacgacatggtcatcgacggctcgggcacgctgctgaagggctccatggagctgtccgacagtggcgacctggtcggcgccaacttccccaccttccagctgtccgacggcgacaaggcctccgccaaggccgagcgggcgggagatgtgctgaaggtccgcattaccggggatgtcatggacgcccggggcatcatgaagagcctcgtgtccgcccccaccggccagcggcgcgcccagaagatgccggacgtggacgtggaggcgcgcatcggcgccctcaccggcaacaatggcgaggtattgcgccagttcgagctctcggtctcgcgccggggcgtggagacgcgggatttcacgctcaccgccaaggccggccgcgatggcacggtggcgggcgagatgcgtaactggcagggccggcagaaggcgttgctggttaccacatccgacgccggcgccatgctgcgcttcctcgacatctatcccaaggtgcagggcggcgaggcttggctggtggtggacccgccgcgcagcgacaccacgccccaggaaggcgtgatccatgtgcgcgacttcgccatcaagggcgagccgggcctccagcagctctccagcgcggcgcgcgattcgtccggcaagatcgaggacggcaccgccgccttccagaaggcgcaggcccaattctcccgcaccactggcaagatcgtgttcaaggaaggcgccatctggggctcgtcggttggcgccaccttcgacggcacgctggacttcgccgtcgaccgcatctccgtgcgcggcacattcgtgccggcctacgccctcaacaacatcttctccaagctgccggtcatcggcctgttgcttggcggcggacctaacgaaggcctggtgggcgtgaccttcgagatcgtcggccccctcagcggcgggcccaccctgcgcatcaaccccatctcggcggtggcgccgggcttcctgcgcaagatcttcgaattccgcgattccagcgacgcccccccgacccgctga

SEQ ID NO: 1737 - DNA, 3318 bp, Dinoroseobacter shibae DFL 12
gtgtccgacccgaccgtccccgacccggagacgcagcatacccccgcgcaggacagccgtccgcggtcggggcttgtggtgctcatggccgcggcactcctgctggcggggatcggcgggttggcggccttcgcgctgcgcggcagcgtcgcggtgccggagccgctggtccagcgggcgcaggcggttctgtcccgggcgctggacggacgcggcgatgcggatctcggcgggatcgagctctacctgaccgaggagggcaggccgcgggtttcgctcaccgggctgaccctgcgcgccgccgacagtgtcgacagcgtgaccttgccgcgccttgacgtggtgctggcacgccgggcgctgctgcgcggggaggtgcggcccgaaagcgtgcgtctcgagggtgcgcgcctgcggctcagccgcgacgccgacgggctgctcagcctggcgttccagtcgggcggggcgttgacgcgggtgccctccctgccggcgctgattgccgagatcgaggcggtgttcgacatccccgccctgcaggatctgcgccgcgtcaccctgagcgatctgaccctggatctggccgacagccgcctgcggcaggtggtgaccctgtcgggcggcgaggcggtgctggatgtcagcgagaccgccctgtcgctcgcgctcgcgctcgacctgccgggcatcgggaccggggcctccctgcggttcacgacgcgcaagggcgatcccgaaacccgcgtcagcctgcggatggatgcggtcccggcccaggtgctggctcggcaatcgccggtgcttgcaccgctgggggtgttcgcaggcccggtctcggcccggtttgcgggcgggctgcgcccggacgggcggctctccgcgctcgaagggcagctggcgcttggcgtgggcgcgctggctttggggggcaaggccgcgccgctggcggtgtcggaggccaccgcgacctggcgctatgccccggaccagcgccgcatgtttatcgaggatatcgtgctcgacaccgaccggctgcgcctgacggggtccgcccatggcgacatcgccgacggggccgcctccggcagcgcccctggcgggtttcccgatctgctgctccatgcggacctgtcggagatctgggtcgaccccggcgcccgcctgccggggcccaccacgctcgcccgggtgatgctcgatgcccgctggcggaccgccgcgcggcggctggagattggccagctttacgccgaggacgccgtgaccgaggcccggctgcacggggcaggacggttggagctacccgcgggcgcgccgcctttcctgcagcttgaagtgcagaccaccggcctgccatcggcccgcgtgctcgacttctggccggtctccgggcggggcgagaaggcgggcgcctggctgcgcgagaacctgaccggcggcattctcgacaacgtcaccgccacgctcatggccaccccgggggagcggccgaagctcgccgcgagcttcgatctccgcgacgcggcggcccgggtgctgccgcagtttccgacgctcatggcgggtagcgcccatggcacgctcttcgagcacgaattcaacatccgggtcagcgagggcgagatggtcgtgcccgaccgtggccccgtggatctcgcgggcagcagcttccagatcctcgacacccgcatccgcggcggcgacgcgcggctgcatctcagcgcccgcggcgccgtgcccacggccctcgccctgctcgacagcccgccgatctccctgctggaccgggtcgcgctgccccctgaccggctcagcggcacggtcgccgcccgggccgggctgaccgtgcccctgcgcaaggggcgcaaggtcgatctcgacacgctctgggtcgatgcgagcctgtcggacctgcgctttgccgaggtcgcgccgggacgagatttcgccgcgcccgacctggacctgacgatcaccgaccggaccgtgaccctggccgggacgggggccttgcaggacgtgccgctggaggtggtgctggcccgcgccttcgacacgcccgcaggggacgggaccgagatttccggcaccgcgcaactgaccgcccaagggctcgccgccctgggggtcgtgctgcctgaaggcacggtgagcgggcagggcgcggtcgactaccgcctgcgcctgcgccccgacgcgcccccgcgactggagctgaccggcgatctcgccgggctcggcctcagcatcccggcgctcaactggcgcaaaccggcctcggccccgggcacgctgatcgccagcctccgtctcggcccggtgccggcggtcgatgcgttccgcctctccgccgcggggctggaggccgaaggtcgcatcaccctgcgcgagggcggcggcgggctggaccggatggagctggaccggctcagtgtcggggattggctcacgggccaggcggtgctgaccgggcaggggccgggcgtggcgcccaccgtggcgctcacgggcgggcggctggatttgcgcaacttgccgcgcggcgacgcagggggcgacggggcccgggcaccgctgcagatcgcgctcgacaccgtgcaagtcaccgacgatctgcgcctgacaggcgtgcgcggggccgtgggccgaagcggcggcgtgatcggcggcaccctggccgcgcaggtcaatggcggcgcgccggtctcgctcaccctggcccgagcggcctccgggcggcaagcggtgcaagtgcaggccagcgatgccggggcggtcctgcgcgacgcgggcgtgttgcgtaccctgcgcggcggcaccctggacatgcggctcgaagtgctggacgacccacgcatcctcgaaggacaggttcgcatcaccgacggcaacatcgtcgaaacccccggcgcggtgcagcttctgtcggccatcagcatcgttggcctgctggaccagatggccgatggcggcattgctttttccgagattgccaccggtctcgcaatctcgcccggcggcatcaccctgcgcgaggggcgcgccacgggaccgtccctgggcatcaccttcgaaggggtggtcatgcccgcccgcgaccggatcgacctgcaaggggtggtctcgcccttctatgcgctcaacgcgctgccagggtcgctgttcgcgcgccggggcgaggggctcgtgggcgtcagctaccggctcgccggctccccctcggccccgcaggtgcaggtcaatccgctctcgctcttgacaccgggcctctttcgcgaccttttccgccgcgacccccccgatctgacgcagtag

SEQ ID NO: 1738 - DNA, 3528 bp, Methylobacterium extorquens PA1
ttgaatcctgaggaaagccgccgcggcaaacggaccttcgcccgaacctacgggtgtagcagcgaacgagtgatggatcaggaaacggccaggaccctgctccagcaggcggtcgaggcgcctgcgccgcgcaaagcgcgccgtcgtcgccggcggccggtgctctggtgcgcgctgctcgtcgtcttcctgctcggtctcggcggcgggctcgtcgccctgcggctgtcgcagggaccgctgcgcatcgacggcctgacgcatcaggtcgccgaggcggtggcgggccgcttcggtccgggctggcgcgtggctttgcgcgactccgcgctcgaactcgacagcgagtcctcgctggcactccgggtcggcgggctcgacatcttcaacccggagggcgcgctggtggtgcgcgccccgctcgcggtggtcagcctcgatacgtggagcctgctgcgcctctcggtccagccacgctccatcgaattccgcgacatcgagatgaccgccctcgtccatgacgacgggtccatcgccttcgccgcctcgtcaccaacgcagggggatggggcaggggaggcggccaagccgcacaccctgccgagtgtggacgccgcccgcggcaccgtctcgccggtctcggcggcggtcgcctcgatcttcggcgtggtgctcgatccggccggcgtcatcggcgccctcgaccgggcgcggatcaccaacggacgcctgaccctcgtcgacgacgcccggcatcaggccaccttcgaacgggtgaacggcctgttccgccgcggcaccagcgacgattcgcgggtgttcgagctgcgcatcgacgggccccacggcgagtggcgcttcggcggccgcgtccacgaggcgggggaggggcggcgcgcgggcgtcatcaccctggacgacctgcccatcaccgatctgcttctgctgtccggccattcgaagatgccggtggagaccgacctcaagctctcagcccgagccgacgtggcgctgtcggggggccgcatcgagacgatgaaggccgaggtgaagaccggcggcggcacgctcctcatcgacgagaaggacttcaacccggtcgtcatcgacgagctgcgcgccgaggcgagctgggacgaagcgcggcgcgcgctcgccatctccgccatcgactacaagggcggcggcaacgacgcccacctgaccggcgccttcgccatcggtccgcccgatgccgtggacgcctggacgctcgatttcgccggcaaggatgcgctgctgcgcggcgccgcccgcagcgacccgtccttccgcatcggcgagatcagcgggcggatcaccggccgggccggtggggtgaacatcgaatcgatcgcgctggcgggcgacggcctgcgcggccgcctgagcgggacggtcggcacgcgggccgacgacgagggcatcaccctgcacatcgtcgccagcaacaccgacggccgcaaggccatgcggctctggcccgagaacatcgcgcccggcgtgcgcaactacctcgtggacgagctgcgcggtggacggctcgatcaggccgacatccagatcgacatgagcggaccggaactcgctgcggcgacccgtggcgacccgatgccggatgccgcgctcaacgtggccttcgcggtctcggatgccggactgaccatctctcaggacgcgccgcccctgagccacggccgggtcaccggcacgatcaccggccgcaccacgacgatccagaacgcgaccgccgagatccgtctctccgacacgcgggccctggcgatctcggacgcgtccttcctgatccgcgatccgcagccggacaagatcatcgcccagctcggcctgcggctgtccggctccgtcgattcgctggccgcactcctcgaaaccccgatgttcaagggaatcacgggcgccgacatcgatccggccacgctgaagggcaaggcggacctgcgcctcgacgtgccgatcaacctcaagcacgtgcccgatctcgccgagatgccggtgactctcaccggctcgatcaccgagttcagcatggacagggcggtcggcaaggaccgcttcgaggcgggccgcttcaccctctccttcgaccgcagcggctttgccctcaagggcgacgggcggctgctcggcgccgccgtcgccatcgacctgaagcagcccaagcccggcgcccccggcgaggcggtggtgagccttaacctcgacgacgccttccgggccaagcgcggcctgccgaccgcgccgcagctcggcggcgtcatcccggcccgcgtcgtgttgccggtggggcgccccgcctctgccggcaagccgccggcccgggtcgaggcggatctgacccgcgcctcgatcaacggtctgatgcccggctggagcaagcccgcaggcaaggccggacgtctcggcttcaccctggtggaggcggcgggcggcggcatggagctgcgcgacatcaccctcgacgccgcccccgcgctcgcccgcggcagcgccacgatctcggccgaaggcaatctcgaacgggcggacctgactgcgctcaagctctcgccgggcgacgacatgcgggtcagcctcgaccgggccggctcgacctacaaggtcgcggtgaagggcgccgtcgtcgatgcgcggcccttcctcaagggcatgacgagcggcgacgacaagggcggcaaggagcccggcaaggacatcgaggcggatgtcgccgccaacatcgtctccggcttcaacggcgagtcgctcaccaacgcgacactgaaggcgagcttcaagggcggtgatctgcgcgccgcccaattcaagggccgtttcggcggttccccgctcagtgccgtggtccggagcgagcgcggcgcaccgctgctgacccttgattccgccgattccggcgcgacgctgcgcttcctcgacatctacaagcggatgtatggcgggcggctcgcgctcaacgtctatctcaatgacggcccgcaggccggcgtggtccagatcaaggactttgccctgcgcaacgagccggccctgtcgagcatcgtcgcccaggccccgccgccctcggacggacggcgcgccgccccgaacgccaacgatgtcggcttcgacaagatgcgcgcgaacttcacccgcagcggcccgcgggtgagcttttccgacgcggcgatctcgaacgcggcgatgggcttcaccgcaaccggctggctcgacacggccaaggagcgcacgcagatcgacggcaccttcgtgccgctctacgggctcaacaacgtggtggcgcaggtgccgttgttcgggccgctgctggcgggcggcagcaacgaaggcctgttcgcggtgaacttcaacgtctcgggaccgatcgccaaaccgacggtcaacgtgaacccgctctcggcggtcgcccccggctttctgcgaaaacttttcggcgccggaagcggcgacaccttcgccaacggcgccgggccgggcgggcccgagcggtag

SEQ ID NO: 1739 - DNA, 3450 bp, Methylobacterium radiotolerans JCM 2831
atggcggacgagacaacgccggcatgcaggcctcgggggaaggcgcgacgcgtcggcggcgtctgcctcgtgagcgccctcgcgctggtgctgctcgtcggcgccggtgtcggcctcgtggccctgcgcctgtcgaacgggccgctgcagatcgacggcctgtcgcgccgcgtcgccgccgccgtggccgagcggatcggacccggctggagcatcgggctgcgcggcagcagcctggagctcgaccgcgagaacgcgctgagcctgcgcttctccggcctcgacatccgcaacccgcagggtgacctcgtggtgcgcgcgcccctggcgctcgtcagcctcgacctctggagtctcctgcggctcaacctgcagccgcgctcgatcgagttccgcgagacgcagaccaccgcgctgctgcaccgggacggctccatcgccttcgcggcctcggaggccaaccacccggtcgacgtcgcgccgcacacgccgccgagcgtggacggggtgcgcggcaccgtgtcgccgctctcggccgcgatcgcgtcgatcttcggggtcgtcctcgatacgggcggcgtggtcggcgccctcgaccgcgcccgcgtcaccgacgcgcggctgcggctgatcgacgaggacgggcacgagcgcgcggtcttcgcgcgggtcaacggcctgttcgggcgcgacccggtcaacgggacccggaacttcgaattgcggctcgacgggccgcacggcgagtggcgcttcggcggcacgctgcgcgacggcgcggacgggcaggagcgctcgggcgtcatcaccctcgacgacctgccggtcaccgatctcctgctgctctcgggccagtccggcctgccgctgaccaccgacctgaagctctcggcccgcgccgacgtcagcctgacggccggccgcatccggaccatgaacgccaagctccacaccggcgacggcacgttcctgatcgaggagaaggacttcaacccggtcacggtcgagagcctcgacgcctcgctggactgggacgaggccaaccgcgtgatgtcgctcaccggcctggactatcgcggggccggcaacgccgtgcacctcacggggacgtggaagggcggcccgcccgacgcgagcacggcctggaccgcgacgctggcgagccgcgacgccaccttacgcggtgcgaccccgcaggacgcgccggtgaagatcgacgccctcgacgcgcagctctcgggccgcgacggcggcatcgccatcgacgcgctgaccctgtcggggcccggcgtgaagggcgccatcaccggcacgatcggcaccagcgccgacgacggcggcctgaccctgcacctcgccggccacgacggcgaggtccgcaccgggctgcggctctggccggagcacatcgccccgccggcccggacctacctggtggaccagctccgccgcggccgcgtcgattccgtcgacatcaaggtgaagatgtccggctcggtcctggccgccgcgacccggggcgacccggccccggacgacgccgtccacatcgacttccacgtctcggacgcggccatcgacgtcaccgccgacgcgccgcccgtgaccaagggcaacgtcgtcggcgtgatcaccgggcgctcgaccacggtgcgcaacgtgaccgccgaggtccacgggccggacgggcgcgggctcgccatctcggacggcagcttcgtcatcccgcagatcacccccgaccgggtcgtggcccagatcgggatgcggctctccggcggcgccgacggcatggcctccgtgctccaggccaagctgttcaagagcgtgatgagcgtcgacctcgaccccgccacgatcaagggcagcgccgacctgcgggtcgacttccccctcgacctcaagcacatccccgacctgccggacctgccggtgacgctgaccggcgcgctggccgacctctcggtcgacaaggtgatgggccgggaccggctcgagtcgggccggttcaacctcgtctacgaccggggcgccttcacgctgaagggcgacggacgggtcgcgggcgcgcccatgtcggtcgacctgcgccagccgaaggtcgggcagcccggcgaggcggtggtcaacgtgtcgctcgacgaggcggtccgcggccgcaagggcctgccgaccgcgccgcagctcaccggcaccatcccggtccgcgcggtggtgcagatcggccggccgggatccggcaagccgccgatccgggtcgaggcggatctggcgaaggccgggatcgacgggctgatcccggggctgaccaagcccccgggcaagccggggcggctcaccttcaccctcgtcgacggcggccagaccttcgagctgcgcgacttcgccctcgacgcggccccggcgagcgcgcgcggcaccgtctcgatcacccaggagggcggcctcgagcgggcggacctgagcagcgtcaagctctcccccggcgacgatctgcgcgtgagcctcgaccgcaccggcggcggctacaaggtcgtggtccggggggcggtggccgacgcccggccgttcctgaaatccctgggcggccccgactccaagggcggccgggaggcgaaggacgcgaatccgaaggatatcgacgccgacatccaggtgcccatcgtcaccggcttcaacgaggaggcgctgaccggcgccaccctgaagctcgccctgcacgggaagaccctgcgggccgccaacatcaccgggcgcttccgcgccgcgcccttcgccgccacggtcacccgcggcgagcgcggcgtgccgaccctggcggtggaatcggccgatgccggcgcgacgctgcggttcgtcgacgtgtaccggcggatgtatggcggccggctgacggccgggatcggcctcaacgacggcccgcaatccggcgtcgtccagatccgcgacttcatcctgcgcaacgagcccgcgctgtcgagcatcatggcgcagggcccggagccgaccgacgcggagacggcccgcggccgccgggtcgccccgggccggggggcgggcgacgtcaccttcgaccgcatgcgcgccaatttcgtgcgcaccggtacccgcgtcgacttcaccgacgcggcgatctcgaacgccgccatggggttcaccctgtcgggctggctcgataccggccgcgagcgcaccgacatgaccggcaccttcgtgccgctctacggcctgaacaacgtggcctcgcagctgccgctgctcgggccgctgctcggcggcggccacaacgagggcctgttcgcggtcaatttccgcgtctccggcaagctcgcctcgccggacgtgagcgtgaacccgctctcggcgatcgccccgggcttcctgcgcaagctgttcagcgccggcggcggccccttcgcggacgggatgccgggcgtcccgcagcaatag

SEQ ID NO: 1740 - DNA, 3723 bp, Beijerinckia indica ATCC 9039
ttggtcgatcatttcgaggacatgccaaaacggcacgcgagtcagatcgcccaaaggtcccaggggcttccttttcatggggcctctccagggtccgaccaggaggccgcgcgggaaccttgccatgatgccgtttctccggccgttcccttgacccatgccgttcccccggcccatggcgcacgcaaacgacgcttcgggcgcaaaagcttattcggccgcagaggtttggcgcgccgggccgtgaccctctgcggcgttctcacgggtctcgccttcatcactatactcgttggtggtctattctatctgcggatcggacaaagacccgttctgatcgaaagcctgggaccgcggatcgccagcgccctcgacgatcgttttggtcatggctaccgattcttcctcggtcccacgaccttgacccggcatggtttgcggccgaccttgagcctggacggtttctccctgcgcgaggccacgggcgataaggaggacgggcacgatgagagccgggaaacctccggcaatcttcttctgagcgcgccgcgcgccgaggtgtcgatcgattcctggccattgctgctcggcaaggtcgttcccaaaagactcgaaatcttcgacgttgtcctgcacctttcggtgacacccgaagggacgcttgctctcgcctcggagacgcatccggacgcccccgtcgtgataactccgacggcgcccccgtccaccgccgatgtaaagaatgttccgccgcaatcgggaaccgccggcgcggcggcgcgtcccgtcctcgtcaaacaaatgggatcggccatcaggcttctggtcgatacattgaccaatccggaaagcccgatcgcggcgatcgacaaggttggcatcaccaatggaaggctgatcgttgacgaccggacgagcaatcagacgctgactttcgagaatgtgacccttgccttcaacaagaagggggaaaagaccacgttcgaactctcggtcgaggggccgaatgggcgctggagcgcgggaggcgtggcgagcggcacgccgaatgcgccccgccggctcgaattccaactcgatcatctgtctctcgacgagatcctccttgccactggcgtgcggttgatcggcgccgatttcgatacgccaattgcggcgggctttacgcttgccctcggcgccgatgataaattgctcgaagcctcaggccatgtcgatctgagccccggtttcgtgcggctcgatgatcccgatgccgagcccatgctggtcgaccggctcgatagccgttttcactgggaccagacgacacggcgcgtgctcattgacgaggcgcgccttgatgccggcccctcgcatttctcgttcggtggcgccatggccttgccgcgcatcgaaagcgagccctggacgctttttctcaaaaatctcgcaccggtcatctacgggcctgaacgtccgaaggaacagccgatcgtcctcgacgacgcgcaattcaccggccggctgatgccgtcagaaaagaaattcattctcgatcgtttcgccatcaacagcgccaacaatggtggcctcgccatggccggcaccctcgattggatcgatggaccccatctgcgtctcggcgcttccatcaacccgacgccggtgcatacggccttgcggctctggccgtccttcatcacggcgccgatccgtgcctggtctctcgcccatatgaccgaaggcaccgtgcagtcggggacgatgcaactcgattatgacgcggacacgctgaaggccttgcgggcggaacagcccattcccgacagcgcggctttgctcgatttcacgatcaccaaggccgccatggaatttttgccgggcgttcccgccctgcgcaatatcgagggaaccggccatattaccgggcgcacggcgctgatcacgctcggcggtggcttcatcgagacggccaacggccagcgtcttctcgtcagtgatggcagtttcaaggtcgaggatttcgccatcaagcctgtcccggcggtggtcgccgccaaaatctcgggtccggccgaggtggtcggtgacctcctgtcgcgcgaggctctcaaggcctatgccactttgccgctcgatccgacgacgatcagaggccagatcgacggcaagatgcagctcgacatgaagatcggaccggagaccgggccgggcgataccgtcctccacgtcaatgcgatggtcaataatttctccgtcgaccgcctgctcggcaaggaaaagctcgagaatgccacgctcgccgttatcgttgagccggaggggctcaaggccaccggccagggccatctctttggggctcaggcgactctcgacatgacgagggcccccggcaagccagccgaaatcaatgccagtctcgcccttgacgaagccgcgcgtgccaagatgggcatgagcatgcaaggcctcacgggcactatcggggcgcatctggccacgacgctcgccaatggagaaaaactgaagggccaagtcgaactcgatctcacgaaagccggcatcgatggcctcctccccggtgtctcgaaaccgctcggcaagcctgcgaagatcaatcttctcgccatcatcaacgacgaaggtctcaccctcgatcagatcgttgtcgatgccggtcccttgcaggcgaaggggagcatcgacctcaatgccgacatgggcctcatcggcggcaagttcgggctcctgcgggtctcgccgggtgatgacatgaaggccgaattgctgcggaccggcgacacactcaaggtgatcatgcgcgcaacgacgctcgacgcccggccgtttttgaaaaatatcgtctcctcgcccccggaatccggtcctctggccgccccttctttgtcccacgatgccgccaaggacatgagcgcatcaatcaagacggtcgatatcgatctgaaggcggatgtcttgaccggctacaacaagcaggtgttgagcggtgctgatctgcatctcgtcaaacagggcgatgacctgaagcaattttcctgcgccgggcggtttgggcgcgatacgatcgccggcaatctcacgcccggcaatgccaaccctggttcaggcgcgccgcagctttcgctctcgacccagaatgccggtgcgctcctgtccttcatcgatctctacaaacatatggagcgcggccggttgggcgtgaccttacgtttcaatggcgagacgctggccggtgccttgatgatcgacaatttcctgctgcgcgacgagcccgccatgcgccgcctcgtgagcgaggcggttgatcaggaaaagggcgccaatcaacgcaatatcgacgcgaatgcggtctccttccacaagctccaggtgcgtttccagcgctccggcacgcgtctcgatctccaggaagggacgatgtatggcgatgcgatcggcctgaccgtcgatggctggctggattatgtccatgatcgcgtggacatgcatggcacattcgtgccggccttcgcggtgaataatctgttctcgcagattccggtgttcggcattctgctcggcggcggcgcgaatgaaggcctgttcggcatcaattaccgtatcagcggcgcggccagcgccccgaccttgagtgtcaatccgctctccgccatagcgcccggcttcctgcggcagatgttcggtgtcggcgatcagatgccggccatcggtcagccataa

SEQ ID NO: 1741 - DNA, 3450 bp, Methylobacterium populi BJ001
atggatcaggaaacggccaggaccctgctccaggaagccgtcgagcctcctgcgccgcgcaaagcgcgtcgcgcggtgcgccgtcgtcggcggccggtgctctggtgcacgctgcttctcatgttcctgatcgggctcggcagcggtctcgtcgtcctgcggctgtcgcaggggccgctgcgcatcgatggcttgacgcatcaggtcgcggaggcggtggcgggccgcttcgggccgggatggcgcgtggccctgcgcgacagcgcgctcgaactcgacagcgaatcctcactggcgctcagggtcggcgggctcgacatcttcaatccggagggcgcgctggtggtccgcgcgccgctcgcggtggtcagcctcgacacgtggagcctgctgcgcctttcggtccagccccgctccatcgagttccgcgacatcgagatgacggccctcgtccacgacgacggctccatcgccttcgcggcgtcggcgccggcgcaaggggaggcggccaagccccacacccttccgagcgtggacgccgcccgcggcaccgtctcgccggtctcggcggcggtcgcctcgatcttcggcgtcgtgctcgacccggccggcgtcatcggcgccctcgaccgggcgcggatcaccaacggacgcctgaccctggtcgacgacgcccggcatcaggcgaccttcgagcgggtgaacggcctgttccgccgtggcaccagcgacgattcgcgggtgttcgagctgcgcatcgacggcccgcacggcgagtggcgcttcggcgggcgtgtccacgaggtgggggaggggcggcgcgcgggcgtcatcaccctcgacgacctgcccgtcaccgacctgctgctcctgtccggccactcgaagatgccggtcgataccgacctcaagctctcggccaaggccgacgtggccctgtcgggcgggcgcatcgacacgatgaaggccgaggtcaggaccggcggcggcacgctcctcgtcgacgagaaggacttcaacccggtcgtcatcgacgagctgcgcgccgaggcggcctgggacgaggcgcggcgcgccctcgcgatctcggccatcgactacaagggtggcggcaacgacgcgcacctgaccggcgccttcgccatcggcccgcccggcgccgaggatgcctggaccctggacttcgccggcaaggacgccctgctgcgtggcgcggcccgcagcgatccctccttccgcatcggcgagatcaccggccggctcaccggccgggccgggggcgtgaacatcgaatcgatcgcgattgcgggtgacggcctgcacggccgcctgagcggcacggtcggcacccgcgccgacgacgacggcctcaccctgcacatcgtcgccagcgacaccgacggccgcaaggcactgcggctctggcccgagaacatcgcccccggcgtgcgcaactacctcgtggacgagctgcgcggcggccggctcgatcaggccgatatccaggtcgacatgagcggcccggaactcgccgccgcgacccacggcgatccgatgccggatcacgccctcaacgtcaccttcgcgatctcggatgccgggcttacggtctcgccggacgcgccgccgctgagccgcgggcgcgtcgccggcacgatcaccggccgcagcacgacgatccagaacgccaccgccgatatccggctctccgacacccgggcgctgacgatctcggacgcctccttcctgatccgcgatcccgcgccggacaagatcgtcgcccagctcggcctgcgcctgtccggatcggccgattccctggccgcgctgctcgaaaccccgatgttcaaggggctcaccggcgccgacatcgatccgtccacgatcaagggcaaggcggacctgcgcctcgacgttccgatcaacctcaagcacatgcccgatctggccgacatgccggtgacgctcacgggcacgctcgccgatttcagcatggacaaggcggtcggaaaggaccgcttcgaggggggccgcttcacggtctcgtacgaccgcagcggcttcgcccttaaaggcgacggaaagctgctcggcgcggcggtggccatcgacctgaagcagcccaagcccggcagccccggcgaggcggtggtgagcctcgccctcgacgacgccttccgggccaagcgcggcctgccgaccgcgccgcagctcggcggcgtcatcccggcccgcgtcgtcataccggtgggacgtccggcttccgccggcaagccgccggcccgggtcgaggccgacctgacccgcgcctcgatcaacggcctgctgccgggctggagcaagcccgcgggcaaagcgggccgcctcggcttcaccctggtggagggcgcgggcggcgggatggagctgcgcgacatcaccctcgacgccgccccggcgctcgcccgcggcagtgccgcgatttcggccgagggcaacctggagcgggcggacctgaccgcgctcaagatctcgccgggcgacgacatgcgcgtcagcctcgaccgggccggctcgacctacaaggtggcggtgaagggcgcggtcatcgatgcgcggcccttcctcaagggcatgacggacgacgccaagggcagcaaggatcccggcaaggacatcgaggcggatgtcgccgccagcatcgtctccggcttcaacggcgaatcgctcaccaacgcgacgctcaaggcgaacttcaagggcggcgacctgcgcgccgcccagttcaagggccgcttcggcgcggccccgctcagcgccgtggtccggagcgagcgcggggcgccgctgctcaccctcgattccgtcgattccggcgcaacgctccgcttcctcgacatctacaagcggatgtatggcgggcggctcgcgctcaacgtctacctcaacgacgggccgcaggccggcgtggtccagatcaaggatttcgccctgcgcaacgagccggccctgtcgagcatcgtcgcgcaggcgccgccgcccgcggacgggcggcgggcggcctccagcgccaacgacgtcaacttcgacagaatgcgggcgaacttcacccgcaacggttcgaaggtcagcttcaccgatgcggcgatctccaacccggcgatgggattcacggcccagggctggctcgacaccgccaaggagcgcacggagatcacgggcgccttcgtgccactctacgggctcaacaacgtcgtgtcgcaggtaccgctgatcggacctctgctcggcggcggcagcaacgagggcctgttcgcggtcaatttcgccgtctcaggcccgatcgccaagccgacggtcagcgtgaacccgctctcggcggtcgcccccggcttcctgcgcaagctcttcggcgccggcggcggcgatgcgtttgccaatggcgcgcaaccgagtggaccggagcaataa

SEQ ID NO: 1742 - DNA, 3723 bp, Rhodopseudomonas palustris TIE 1
atgccgccacaggagcgcatcctgcgcgacggcgcgcacccctcccgcgaagaaccggctcctgacgcgcgcgtgcaacgagaggcaatggccaaacatccgacgccggaccagtccgacccgcacgctggccatgactgcaacgatccccattggcacgagggtcattgggatcgcgagcacgaggaagatgcgcggcatcgtgcgcgtaagctgctgaagcgccgtaacctcggtctgcatcgcatcgacgactggccgagccgtcgcaccccgggtgcgccatggctgaagcggacgctgctgaccatcgcggtggtcggcgccgtgctgattgcgggattcgccggactatggctgcggctcggcgtcggaccgatcaatgtcgacatggtgacgccgtggcttgcggacgcaatcgaagagaacatcggtcagggcaacaccgttgagatcggcggcacgcaaatcgagcgggccggccggattcgtgtcgcgctgcggattcgcgacatcgtggtgcgcgaccgcgatcacgtcgtggtcgcctctgcgcccaaggccgaggtgcggctgtccggcggggcgctgctgaccggcaagctgcgcgccgaaagcctgcggctggtcggagccgagctcgcgatccggatcgatccagacggccaggtgacggtgtcggccggttcgaccgatcggccgctcgccaccggcatcgcgcccagcggccgtgcggctgaattcaagctgccgacccagccagcgcccccggatgctggggcggttgcgcccggtgccacggcgccttcgggatccgccaccacaccgccgccggccaccgatacgtcggacacgatgaagggggtgctggccgggctcgaatggctcgacagcctgagcctgagcgggctcgacgggcagaacctcaatgagatcggactgaagaacggcaacctggtggtcgacgaccagcagcgtggcaaccgttggaccttcgagaacatctcgctcagcttgcgtcgccccagcaccggtggcgtcgcgctcagcgtcggcgaggagggcgggctcaaggcctggtcgctccgcgtccaggtcggtccggcgcatgacggcgtccgctcggtcgaactccacgccaaccaggtgccgacccggaccttgctgctggcgctgcggctgaagaacctgacctacagcgccgacttcccgctgaccggtgatctgaagggcgaagtcggccgcgacggcgtgccgacctatttccgtggcaagctgaccgccggcgccggcaccgtgatcgattccgacacgcccgactacccgatggcgatcgaccagatcgaaacctcgttcgagtgggatgccaaccgccgtgtgctgatcgcgccgttcaaggtgctggccggcccgaaccgggtgacgctgctggcctcactcgagccgccgaacggcagcgtcaacgattggcggctcggattgtccggcggcaccatcgttctgccgggcgcgcagaacgagagtccgctgatcttcaaccggattgcggtccgggtccggttcgacagcgctaaccgccgtgtcctgctgacccaggccgacgtcagcaacggcgaaatcggcgtcgccgggtccggcagcatcgattactccggcgagccccggctgacgctgggccttgccggaacgccgatgtcggtctcggcgctgaaacggatgtggccggcgctgatcgtgccggagctgcgcgagtgggtgaacgacagaattctcgccggctcgatccagaccatcgatatcgcgatcaattcgccgatgaaaaatctgtcgcgccgcggtccgccgatcccggacgaaggtctcttggtcaacatcctcggcaacggagcggcgatccgtccggtcgatggcatgccggtggtgaaggatggcgatatgcgggtgcgggtcacgggccgcaccgcgacggtcgcgatcaatcaggccaatgccgacaccgatggcggccgcaaggtggcgctgtcggacattctgtttgaggtgccggatctggcgccgaagccggcaccggcacggatcaagttcaagctcgaaggcccggtacctgccgtcgccgaagtgctggcctctggccgcctcagcgacgctgcggcgcttccgatcgatccgaacaccagcaagggcaacgtgtcggctcaggtcgcgctcggcatgccgatccagcgtgagctgaccaagcaggacaccagctactcgatcaccgccgacctgaatggcttctccgccgacaagctggcgatggggcagaagctcgaagctaatacgctgaaggtgatcgccaacaatcagggctaccaggtcaagggcgacgtcaagatcaatggccaggcggcggcgctggactatcgcaagccggtcgatggcgatgctgacgtcaagttgcaggcgacactcgacgatgccagccgcgcacggctcggcgtcgatctcggcagtggtctcagcggcccgctcggcgtcaagctgacaggcaagatcggcgacaacgaacaggattccaagttcggcatcgaagccgatctcacccccgtgaaggtcgacaatctgctgccgggctggagcaagcagccgggcaagcccggcaaggcgaccttcaacgtgacgcgcaagcctcagtcgacgcggcttgatgatgtcaccctcgaaggtggcggcacgctgatcaagggctctcttgaagtcgaccccgacggcgacctgatcaacgtcaacttcccggtgtactcgccgtccgagggcgacaaggcgatgctgaaggccgaccgaggttccgacggcgtgctgaaggcagtgatgcgcggcgacgtgttcgacggccgcggcttcattcgctcggcgctgtcgggcagctccactgaagccaagggcaagagcatcgatttcgatctcgacctgaagttcggcgcggtcgccggcttttccggcgaggcgctacgcagcctcgacatcaagaccacgcgccgcaacggcagcatccgcagcttcaccatgaacggcaagctcggccgagacacgccgatcaccgccgatctgcgaggccgcaatcagggccgtgaagtgatctatctcgagaccaacgacgccggcgcgttcttccgcttcaccgacagctactcgaaaatgtatggcggccagctctcgctggcggtggagcctcccggcggcgagccgcgcgagaaggagggcctgatcaacgtccgcgacttcaccgtaaagggcgaagccgcgctcgaccgtgtcgccgccggtgcgccgggcggaccgccgcagggactggcattctcgcgcctgcgcgccgagttcagccggcagaacggcacgctcaccattcgcgacggtgtggtgaaggggccgacgatcggcgccaccatcgaaggctcgatcgattacggcgccaaccaggtgcggatgagcggcaccttcgtgccgatgtacgggctgaacaacatgttcgggcagatcccgatcgtcggcctgttcctaggcggcggcagcaacgagggcctgatcggcgtcacctacgaagtggtgggtacgccgggcaagccggtgctgcgggtcaacccgatctcggcgatggcgccgggcgtgctgcgcaagatctttgaattcaacaccggccgacaaaataacggcgccgatttcccggcgccgcccaactaa

SEQ ID NO: 1743 - DNA, 3426 bp, Methylobacterium sp. 4-46
atggatcaggcttcctccccccgccccgctccctgtccggtccggcgatcggccctgagccgctgcgtccggggcgtgctgatcctcaagctcgggctggcgctcctgctcgggctggcgagcggcctcgcctatctgcgcctgtcgagcgggccgatgagcttcgcgtggctggagccgcgcctcggcgaggcgatcgccgcgcggctcggccccggctggcgggtcgagatgcgcgacagcgccgtggagatcgaccgcgagggcgcgctggccctgcgcaccacgggcctggagatccgcaacccgcagggcgcgctcgtggtgcgcgcgcccctcgccctggtcagcatcgacctcacctcgctcctcggcctgtcgatccagccgcgctcggtggagttccgcgacctgcaattgcgggcggtggtgcaccgggacggctcgatcgccgcctcggcggacccgtcgaacgccgccccgccgacgcccccggtggtcgaggcggcccgcggcagcgtctccccgctctcggccacggtcgcatcgatcctcggcctggtcctcgatccgggcggggtgatcggcagcctcgaccgggcccggctcaccaacgcgcgcctgaccctgacggacgatgccggcgtggagcgcgccgtctttccccgggtcgacgggctgttcagccgcgacgcggtgcgcgaggcccgcgtcttcgagatgcggatcatgggcccgcacgggccctggcgcttcggcggcgacgtcgagcaggcggccggagacctgcggcggggcgtcctcaccctcgacgacctgccggccaccgacctgctgctcctctccgggcagtcccggctgcccgtcaccaccgacgtgaagctctccgggcgcgccacggtggcgatgcacggggcgcggctcgacacgatgaccctcggcctgcggtcgagcgagggcaccgtcctgatcgaggagaaggacttcaacccggtgacggtcgaggccgtcacggtcgaggcgacctgggacgaggcgcgccgcgccctcagcctcacctccctcgactatcgcggcgccggcaacgcggtccggctctcgggcgagtgggtcgccggggccgagggggcggagacggcctggaccgccaccctctcggggcgcgacgcggtgctgcggggcgccgtcgagagcgacgcgccggtgcggatcgacagcctcgaagccaagctcgccggccgcgacgagggcgtcgtcatcgagcgcttcgccctgaccgggccgaccgcgagcggcacgatcgcgggcacgctcggcacccgcgcggacgagggcggcctcaccctgcacatcctggtcgaccgggccgagggccgcaccgccctgcggctctggcccgagcacatcgcgccgccgatccgcagctacctcgtcgacaacctgcacgccggcaaggtcgacagcctcgacatcaccgtcgacatgacgcgcgaggaattcgccgccgcgacgaggggcgacccgatgcccgaccaggcggtgcggatcgccttcgcggtgagcgagggcaacctgcagatctcgcccgaggcgccgccgctcagccgcggccgggtcgccgggctggtcaccgggcgcaacaccacgatccggggcgccaccgcggagatccgcgtggcggacgggcgggtgctcgccatccaggacggctccttcgtcatcaaggacgcggtgccgcacgacgtgaaggcgcagatcgggctgcgcctcagcggcggcaccgacgcgctcgcggcgctgcttcaggcaaagctcttccgggggctcaccaccaccgagatcgaccccgccgcgacccgcggccaggcggatctgcggatcgacttccccctgagcctggaggcggtgcccgacatcgcggacctgccggtgacgatgaccggcagcctcgcggaggtctcggtggaccggatcgtcggcaaggaccggctggagaacggccgcttcgccgtcacctacgaccgcaccggcttctcgctcaagggcgagggcaagctctcgggcgcgccgatgagcgtcgacctgcgccagccccgggcgggggccccgggcgaggcggtggtggcgctcaccctcgacgacgcgatgcgggcgcgccgcggcctgcccgctgccccgtccctcgccgggccggtgccggcgcggttcgtggtgccgatcgggcgcccaggccgcaccagcacgcgggtcgaggccgacctctcccgggcctcgatcgacgggctgctgccgggctggagcaaggccgcgggcaagcccggccggctcaccttcgcgctcagcgaggccgggagcggctccgaattgcgcgacatcgtgctcgaatccggcagcgtgtcggtgaagggcagcgcggtggtctcggccgagggcggactcgaacgggcggagctcacgagcctcaaactctctccgggcgacgacgtgcgcgggcaggtcgagcgcagcggcggcgcctaccgggtcaacctgaggggcagcgtggcggatgcgcgccccttcctgcgcgcgctcaccggcccgggcaggaagggcgggggatcccgggagggcggcaaggacgtcgacgcggatctctccttcgccatcctcacgggcttcaacgaggaggccctgaccaacgccaccctgaagctctccctgcggggggacgacctgcggcaggcccgcatccagggccgcctgcgcggggcctcggtgcgggtcgaggtggcgcgcggggagcgcgccggcccgccgatcctgagcgcggactcgaccgatgcgggggcggtgctgcgcttcctcgacatctaccgccgcatgcagggcgggcggctgtccctgcagagcaccctgaacgacgggccgcaatcgggcgccctgcagatccgctccttcaccctgcgcgacgagccggccctgggccggatcatggcgcagggcgagccgcccgaggagggcgtgcgcgggacggggcagcggcggccggtgaacgatgtcggcttcgacaggctgaccgccgagttcgtgcgcagcggcacgcggatcgacatcgcggacgcggcgatctcgggcccggcgatgggcttcaccctcggcggctccctcgacacgggccgcaacaccaccgacatccgcggcaccttcgtgccgctctacgggctgaacaacgtcttctcgcaggtgccgatcgtgggcccgctgctcggcggcggccacaatgaggggctgttcggcatcaacttctcggtgacggggccgatgagcgcgccgaacgtggcggtcaacccgctctcggcgatcgccccgggcttcctgcgcaagctgttcggcgccggcggcggcgatccctccgccgcggccgcgccgcggcctgagcgctga

SEQ ID NO: 1744 - DNA, 3402 bp, Rhizobium leguminosarum bv  trifolii WSM2304
atgtcagccatccgcggcgaaaaggtcacgtttcgcaagaaggatatcgttgcgctggaccgcttgccgtccgcccaggccgaggatccgatcatcgtctattgcccgccgccgcgttcgcctatgcggcgcactgcgaagctgacggccggatttctgggggtgattctgcttatcctcgccgcaatagtcttcaccgtcgagagcggcatgttcgacaagccgctgtcgcagcaggcgcaggcggccttgaacggcgtggccggaccgcgctaccgcgccgaggtcggctccaccgtcatccgcttcacctcggatttccggctggcgctggaagcgcgcaacgtcaacatgatcgacgagcagagcggccagcacctgtcgacgacgggttcggtgcggctggggctcgatccgctgcagcttttccgcggccgcatcgccgtcacagacatcgaagccgacgatatcgcgctcgataccgcgctgctgccctccggcaatcctttgacgctcgacgatctgcgcatcgacgccatgccggcagcgatggagaagatcttctcgcagttcgacatgttcgacagtgtcgtcacgcgcggctcgaccagttccgtgcgcatctccggcatcaacatcaagcttgccgacaccgccaacggtccgctgtcgctggtcgtcgacgatctcgtctttgcccatgccggcccatcctcgctgcaattgaccggcgaagtggcgctgaacggcgaggtggccgagctcgaggtgctggccgagaaggaagccggccacgtgtcgaaggtggtggcgacgctcaagcatgccgacctcacgccctttgcgctgaaacgcaacgatcagggcgcgatccggcaggggctcagcgcctttgccgatttgacggtatcggccaccagggaacgcgatggcgtgcagccggcgcttgcggcgaccgtcgacatcgatccgggccagatctatgccgacggcgatccgcaggaactgtcgggcgggcagatcaacctcgtttatgatttcgccaagctgacgctcgaaatcgcccggtcgaacgcccgcttcggcgcgaccatggttccgatcaacggcgcgctgatcgatctcgacaagctcgacccgcaggccggcaagggcttcggcatcgatcttctggtcagcggcggctcggcagcgcccggcggctccggcgagcagccgctttctttcgacatccaggcgacgggccgctacctggtcgccgggcgggaatttttgtttcccaacatgaccgtctccagcccgctcggcgcgctatatggggcactgcacgtcaagctcgggagcaaatcaccggagatcagctttgccggccagtcggcacagttgcagacgacggcgatcaagcagctctggccgttctggatggcgcccaaggtgcgcacctgggtgcacggcaacctcttcggcggcaccgtcaccaacggcgccatctcggtcttcattcccttcggcaggctggacgaggcggccggcggcaagggattgaagctcgacgccaaccagattcgcatcggcttcgacatcgcggatgcgcggatgaacatcgccggcgacattccgccggttcgcgacatggcggcccatttcgacctgaccggcccggttgcgacgatcgcgatcaagagcggcacgtcgtttttcccctccggccggtctgtcggcctcgggcaggggacgttcactctacccgccacctacgacaagccgctgatggccgatatcgatctggcgatctccgggacagccgatgccgtcggcgagcttctgacctaccggccgatccgggtgttgcagcgcgccggctttacgcccgacgatctcaaagggcggatcgaggcgaatgtgaaggcgcatttcggcctgctctcctcgcagaacccgccgccggccgaatggacggcggcgatgaagctcaccgatatcgatcttgccaagccgttttccggccgcacgatcagcaatctcgacggaacgctgaacggcaatccgaaacagatcacgctggatgccaaggcccagatcgacggcgtcccggccgatatcgatcttgccgaaccggtcgaggcctccgatggcgcgaagcggacgcgggtgatcaccgcgacgctttccgaggagcagcgcaacaagctgatacccggcctttccggcatcatcggcggcagcgtcaagatggtgctgacgcggatcgacgacgaccggcaggatgtgcagctcgacctcaccaagtcgcagctcgacctgccgtggatcggctggtcgaagggcagcggcattgcagcttcggccgaattcgaaacatcaggccccgccgacaatacccagatcaagaatttccggctgaagggcgacggtttcggcgccaacggctcgatgaacatcggcaaaggcgggctgatctcggccgatttcgacagcgtcaaactctcctcgcttgacgattttgccctctcggtgaagcgcagcaagggcaatttcgacgtctcggtctccggcgacagcgccgatgcgcggcctgtcatcgcgcggttgaaatccggctcgggcgatggcaatgatgaaggggatgccggcgacaccggtgtatcggtgcgcgccaagctgaaaaatgtcatcggtttcaacgacgagaagatcggcaatttccaggcgcaggtgtcactgcgcggcgacaagctggaggcgctgaacttttccgccgtgaccgacagcggcgaggcggtggtcagccagatgaaggatggcggcgtcatcaacatcaccagcggcgatgccggcgcggtgtcgcgtttcgccgatctctaccagcacatgcagggcggcctgctcaatctggcgatccggctttcggcacagggcggctgggacggctcgctcgacgtgcgccgtttctcgatcgtcaacgaacaacggctgcgctcgatcgtctcgacgccggttggaaatgagcagcgcagcctcaacgaagccgtcaagcgcgacatcgatacctcttcgcaacgcttccagcgcggctttgcccgcgtcgtctcgcgaggtggcatggtcggcatcgagaatggcgtgctgcgcggcgaccagatcggcgcgacattccaaggcgtcgtgcgcgaccgcaagggcaatatggacatgaccggcaccttcatgccggcctacggtctcaatcggctgtttgccgaactgccgctgatcggcgtcatcctcggaaacggcagcgaccgcggcctgatcggcatcaccttcaaactcaccggcaagttcgaccagccgaacctgcagatcaatccgctgtcgatcatcgcgccgggtgtcttccggcagatcttcgaattccagtga

SEQ ID NO: 1745 - DNA, 3594 bp, Methylocella silvestris BL2
atgaaaggccgcgagcggttggtcgaacagcgtgaggactcgccagagcgcgccgtcccggacaagccggcagagttcccggccggcgtcgatctgcctcggctgaaaatgcgcggccggttgcccgtgtttgcgcgctcctgcgcttatgtcgccgcctccctgctcgccatcttcgtcaccgcgggcgtgttcctgaccgtccggcttgcgcaggggcccatggcgatcgacgcgctgggctccagcatcgcgcaggcgctcgatcagcgttttggtcacggctatgattttgccttcggccagacgtccatgctgcagcgcggctatgcgccgacgctcggcgtcgaccggctcgtcgtcaaggaccagtcgggacggacgctgctcagcgcgccgcgcgccgaggtctcggtcgatctcctgtcgctcgtcgccggcaaggtcgcgcccaaaaggctcgaaattttcgatgtcgaagtacggctggccctgctgccggacggctcgatcgcgcagctcgccggcgccgggtcggacgacgccattgcaatcaccccgccgctcgccgaatcgctgcggcgggaggcgatcccggccgccgcggcgccagaaccggcggtccccggcggggcgcccgccgccgagccgcccgcgcagccaaagccgcgcgcgctgctcgtcaagcagctgtcctcggccatgcgtctcgtcattgacgctttgaccagtccggacagccagatcgccgccgttgatcgtgtggggatcacgcgcgggcgcatcgtcgtcgacgaccgcacctccaatcagaagatgaccttcgacggcgtcaatctcgccttcgacaagaccgacgctggcacacgtttcaccctgtcggtcgacggcccgaatgggcgctggtcggcgagcgggctcgccagcggacagccaggcgccgaccgtcggctgacgttctccttggagaatctgtcgatcgacgaaattttgctcgcgaccggcgtgcgttcgattggggcggatttcgatatgcccctgtcggcgcatgtgaatgtggggctgcgcgccgacggcgtgctgtcggaggcggtcgcgactttcggccttggctccggctatctgcgcttcgacgatccgaacgatgagccgatgctcgtcgatgagatcaagggcggcgtccattgggacggcggccagcggcgcatcgtggtcgatccggtgcggctggtcgccggacaatcgcatggcgcggtctccggcttcatcgcgctgccgcagcgcgagggcgacgcctggaccttcgaactcggcgcgccggagcctctggtcgctgcgcccgagcgtccgggtcaacagccggtcgtcctcgatcttgccgctctgacggcgcgcctcttcctcgccgacaagaaattcatcatcgacaaattcgttctcggcggcccgcaggcgggcttctccatgaccggcgatgtcgactggaccaatgggccgcgagtgcgcctcggcgcctcgatcgatccgacgcctgtttcggtcgtcactcgcctctggccgtccttcatggccgcgccgatccgcaattacctgctcgatcatgtcaaggcgggcgtcattcggcagggctcgatgcggcttgacttcaacgccgccgacatcgagtcgatgcgcaacgagcattcgccgccggacgaggctctgctggttgatttcaccgtgtccgggggaagcgtcgaattcctgaacggcgcgccgcccttgaccggggtcgacggcgtcggacatgtcaccggccgcagttcgacttttacgacgacaaacgccggcgtcgtcgaggcgggcgccggccgcatcttgacggttgcgccgggcgggtccttccatattcccgattcggagcaaagacctgttccggcggcgatcgtcgccaatatctcaggcgccgtcgaggcggtcagcgaactcttgtcgcgggacgcgctaaaaccatacgccagcctgccgctcgatccggcgaccttgcgcggacaggtcgacggccggctcgaggtcgatctgcggctcggcccaaaaatgggaccggccgacaccagcctgaaaatcaacgccaccgcctccaatttcaccgccgaaaatattctcggcaaagagccgctcgatgcagccaccttgagcatcatcgttgactcgacggggctgaaggcgagcgggcagggcaagatgtttggcgcgccggcgaccgtcgagcttgcgcagcccgccggcaagccggctttcgccaatgtgcatgtccttgtcgacgacgccgcccgcgctcggcagggacttggcggcgttccgggcgtgaccggcgtgatcgccgccgcgatcagcgcgccgctcggcgcgggtcccaacatcaaagcggaggtcgatctcgatttgagccgcgcggcgatcgactggccgggcgcctcgaagcctttggggcggccaggcaaggctaaattcgcgctgatcgtgacggatgggcaaagcgtgctcgaccagatcgctttcgacgcggggacgatccaggcgcgcggccagatcgagcttggcgccgatcagtcgatccagtcggcgaaatttcctcaagtgaaattttcgaccggcgacgacgccaggatggaggccttgaaggtcggcgaaacgctcaaggtcgtcgtgcgcgcccagtcgatcgacgcgcggccgttcctcaagactctgctcgcctcgtcggccgattcaacgcccgcccccggcgccgcgggaggattgccggccgccggcgcgtccgcctcggcgatcaaggaaatcgatctcgatgtgaaatcctcgctgctcaccggctacaacaagcaggtcttgagcgggcttgagctgcgcatgctgaaacgaggcgatcagttcaagcagttatccttcgccggccgtttcggccgcgataccgtctcgggcaatcttgccgggccctcgagcgcttcgcagctgacgatgctgtccgacgacgctggatcattgcttctattcaccgatctctaccggcatatggagcgggggcgcctgcaggccgatatgcagcttggcccggcgatgtcgggcacgctcgtcatcaattccttcgtgctgcgggacgagccggccctgcgccgtctcgtcgccgaaagcgctcccgcgggcgacgccgccgacaagttgcgcaacatcgacgccggcgcgatggcgttcaatcgtctgcaggtgcggttcgatcgcgccggcaccaggctgcagctccatgacggcgtcatcaatggcgaggcgatcgggctcacggttgacggctggctcgatttcgcgcgcgactcggtcgatatgaaaggcaccttcgtgccggcctatgcggtcaataatctgttctcgaaaattcccgtcgtcggcctcattctcggcggcggcgccaacgaagggctgatcggcgtcaattttcgcgtcgagggcagcatcagcgcgcctacgctcagcatcaatccgctatcggccatcgcgcccggaattttccggcagattttcggagtcgggcagcatataccgggcccggggcagtaa

SEQ ID NO: 1746 - DNA, 3456 bp, Methylobacterium chloromethanicum CM4
atggatcaggaaacggccaggaccctgctccaggaggcggtcgaggcgcgtgcgccgcgcaaagcgcgccgccgtcggcggcggccggtgctctggtgcgcgctgctcctcgtcttcctgctcggtctcggtggcgggctcgtcgccctgcggctgtcgcagggaccgctgcgcatcgacggcctgacgcatcaggtcgccgaggcggtggcgggccgcttcggtccgggctggcgcgtggcgctgcgcgactctgcgctcgaactcgacagcgagtcctcgctggcactgcgggtcggcgggctcgacatcttcaacccggagggcgcgctggtggtgcgcgccccgctcgcggtggtcagcctcgatacgtggagcctgctgcgcctctcggtccagccgcgctccatcgaattccgcgacatcgagatgaccgccctcgtccatgacgacgggtccatcgctttcgccgcctcgtcaccgacgcaaggggatggagcaggggaggcggccaagccccataccctgccgagcgtggacgccgcccgcggcaccgtctcgccggtctcggcggcggtcgcctcgatcttcggcgtggtgctcgatccggccggggtcatcggcgccctcgaccgggcgcggatcaccaacggacgcctgaccctcgtcgacgacgcccggcaccaagccaccttcgaacgggtgaacggcctgttccgccgcggcaccagcgacgattcgcgggtgttcgagctgcgcatcgacgggccccacggcgagtggcgcttcggcgggcgcgtccacgaggcgggggaggggcggcgcgcgggcgtcatcaccctggacgacctgcccatcaccgatctgctgctgctgtccggccactcgaagatgccggtggagaccgacctcaagctctcggcccgagccgatgtggcgctgtcgggcggccgcatcgatacgatgaaggccgaggtgaagaccggcggcggcacgctcctcatcgacgagaaggacttcaacccggtcgtcatcgacgagctgcgcgccgaggcgagctgggacgaagcgcgacgcgcgctcgccatctccgccatcgactacaagggcggcggcaacgacgcccacctgaccggcgccttcgccatcggcccgcccgatgccgtggacgcctggacgctcgatttcaccggcaaggatgcgctgctgcgcggcgccgcccgcagcgacccgtccttccgcatcggcgagatcagcgggcggatcaccggccgggccgggggcgtgaacatcgagtcgatcgcgctggcgggcgacggcctgcacggccgcctgagcgggacggtcggcacgcgggccgacgacgagggcatcaccctgcacatcgtcgccagcaacaccgacggccgcaaggccatgcggctctggcccgagaacatcgcgccgggcgtgcgcaactacctcgtggacgagttgcgcggtggacgcctcgatcaggccgacatccagatcgacatgagcggaccggaactcgctgcggcgacccgtggcgacccgatgccggatgccgcgctcaacgtggccttcgcggtctcggatgccggcctgaccatctctcaggacgcgccgcccctgagccacggccgggtcaccggaacgatcaccggccgaagcacgacgatccagaacgccaccgccgagatccgcctttccgacacgcgggccctgacgatctcggacgcgtccttcctgatccgcgatccgcagccggataagatcatcgcccagctcggcctgcggctgtccggctccgtcgattcgctggccgcactcctcgaaaccccgatgttcaagggaatcacgggcgctgacatcgatccggccacgctgaagggcaaggcggacctgcgcctcgacgtgccgatcaacctcaagcacgtacctgatctcgccgagatgccggtgacgctcaccggctcgatcaccgagttcagcatggacaaggcggtcggcaaggaccgcttcgaggcgggccgcttcaccctctccttcgaccgcagcggcttcgccctcaagggcgatgggcggctgctcggcgcccccgtcgccatcgacctgaagcagcccaagcccggcgcccccggcgaggcggtggtgagcctgaacctcgacgacgccttccgggccaagcgcggcctgccgaccgcgccgcagctcggcggcgtcatcccggcccgcgtcgtgttgccggtggggcgccccgcctctgccggcaagccgccggcccgcgtcgaggcggacctgacccgcgcttcgatcaacggtctgatgcccggctggagcaagcccgcgggcaaggccgggcgcctcggcttcaccctggtggaggcggcgggcggcggcatggagctgcgcgacatcaccctcgacgcggcgcccgcgctcgcccgcggcagcgccacgatctcggccgagggcaatctcgaacgggcggacctgaccgcgctcaagctctcgccgggcgacgatatgcgggtcagcctcgaccgggccggctcgacctacaaggtcgcggtgaagggcgccgtcgtcgatgcgcggcccttccttaagggcatgacgagcggcgacgacaaggccggcaaggagcccggcaaggacatcgaggcggatgtcgccgccaacatcgtctccggcttcaacggcgaatcgctcaccaacgcgacgctgaaggcgagcttcaagggcggtgatctgcgcgccgcccagttcaagggccgtttcggcggttccccgctcagcgccgtggtccggagcgagcgcggcgcaccactgctgacccttgattccgccgattccggcgcgacgctgcgcttcctcgacatctacaagcggatgtatggcgggcggctcgcactcaacgtctatctcaatgacggcccgcaggccggcgtggtccagatcaaggactttgccctgcgcaacgagcccgccctgtcgagtatcgtcgcccaggctccgccgccctcggacggacggcgcgcggccccgaacgccaacgatgtcggcttcgacaagatgcgcgcgaactttacccgcagcggcccgcgggtgagcttttccgacgcggcgatctcgaacgcggcgatgggcttcaccgcaaccggctggctcgacacggccaaggagcgcacgcagatcgacggcaccttcgtgccgctctacgggctcaacaacgtggtggcgcaggtgccattgttcgggccgctgctggcgggcggcagcaacgagggcctgttcgcggtgaacttcaacgtctcgggaccgatcgccaaaccgaccgtcaacgtgaacccgctctcggcagtcgcccccggcttcctgcgaaaactgttcggcgccggaagcagcgacaccttcgccaacggcgccgggccgggcgggcccgagcggtag

SEQ ID NO: 1747 - DNA, 3579 bp, Methylobacterium nodulans ORS 2060
gtggaggcgcacagcgtccgaggcgggctgccacgggacgtccggcatgcggacacacgattaatcgcaggtaaccggacggagaagacactgggcggacaagtcccgcaggcccctctcccggcgatgacaggcatggatcaggctcctccccctcgccgcgcaccgctgcgcgtggcgcccggcccggcccggcggcgatcggtcgtgcagcgatgcgtgcggggggtgctcctcctgaagctcgccgtcgcgctgctgctcggcctcggctgcggcctcgcttacctgcgcctgtcgagcgggccgatgagcttcgcctggctggagccccgcctcgccgccgccatcgccgggcggctcggcccgggctggaccgtcgacctgcgcgacagcgccatcgagatcgaccgcgagggggcgctcgcgctgcgcaccaccgggctcgacatccgcaacccggaaggcgcgctcgtcgtgcgcgcgccgctcgccctggtcagcatcgatctcgccccgctgctcggcctgacgatccagccgcgctcggtggagttccgcgacctgcaattgcgggccgtcgtccatcgggacggctccatcgcggcctcggcggatccctcggatgcgcagccgaccaccccgcccggcgtggacgccgcccgcggcaccgtctcgccgctctcggccacgatggcctcgatcctgagcctcgtcctcgatccggccggcgtgatcggctccctcgaccgtgcccgcctgaccaatgcccgcctcaccctgacggacgacagcggcaccgagcgcgcggtgtttccccgcgtcgacgggatcttcacccgcgacgcggtgcgcgacgccaaggtgttcgagatgcgcatcatgggaccgcacggcccctggcgcttcggcggggatgtggaacgggcggcgggaaacatccggcgcggcgttctcaccctcgatgacctcccggtcaccgacctgctgctcctctccggccagtcgcgcctgccgctgaccaccgacgtgaagctgtcgggccgggccgcggtggcgatgcacggcgcgcgcctcgacaccatgtccctctcgctgacctcgagcgagggcaccctcctcatcgaggagaaggacttcaatccggtgaccatcgagggcgtctcggtcgaagcgagctgggacgaggcccggcgcgcgctcaagctcgacgcgctggactaccgcggcgccggcaacgccgtgcggctcgcgggcgagtgggtcgccggagcggcgggggccgatccggcctggacggcaacgctcgcgggccgcgacgcggtgctgcggggcgccgtcgacggcgacgccccgatccggatcgacagcatcgaggcgacgctctcgggccgggacgacggcgtcgccatcgagcgcttcgccctgtcgggaccgacggcgagcggcaccatcaccgggacattgggcacccacgccgacgagggcggcctcaccctgcacatcctggccgaccgggccgaggggcgcaccgccctgcggctctggcccgagcacatcgcgccgccgatccgcacctacctggtcgacaacctgcgcggcgggcatctcgacagcctcgacatcaccgtcgacatgacgcaggcggaattcgccgcggccacccgcggcgacccggtgccggacaaggcggtgcggatcgccttcgcggtcagcgacgggagcctggtgatctcgccggaggcgccaccgctcacccgcgggcgcgtctccgggctggtgaccgggcgcaacaccacgatccgcggcgccacggccgagatccggatgccggacgggcgggcgctcaccctccaggacggatccttcgtcatcaaggatgcggtgcccagggacgtgacggcccagatcggcctgcgcctgaccggcggcacggacgcgctcgcctcgctcctccaggcgaagctgttccgcggcctcaccggcgccgagatcgatccggccacgacccgcggccaggcggatctgcggatcgactttccgttgagcctcaacgcggtgccggagatcgcggacctgccggtggtgatgtccggcagcttcagcgacgtctcggtggaccggctcgtcggcaaggaccggctggagaacggccgcttcagcctcgcctacgaccgtagcggcttctcgatgaagggcgaggccaggctctcgggcgcgccgatgagcgtcgacctgcatcagccgaagccgggcgcgccgggcgaggccgtggtggcgctcaccctggacgaggcggcccgggcgcgccggggcctgcccgtcgcgccggcgctcgccggcccggtgccggcgcgcttcgtggtgccgatcggccgccccggcaagacgaccgcccgggtcgaggccgacctcacccgggcctcgatcgacgggctcgtgcccggctggaccaaggctgcgggcaagcccggccggctcaccttcgcgctcaccgatacgggcaacggcacggaactgaaggacctcgccctcgaggcgggcagcgtggcggccaagggcagcgccgtgatctcggccgagggcggcctggagcgcgcggagttcacgagcctcaagctctcgcccggcgacgacgtgcgcggccagctggagcgcagcggcggcgtctacaaggtgatgctgaagggcggggtcgcggatgcgcggcccttcctgcgcgcgctctccgcccccgccaggaagggcggcaaggaggcggcctcccgggacgtcgatgcggatctgagcttcgccatcctcacgggcttcaacgacgaggcgctgacgaacgcgactctcaagctctccttacgcggcgacgacctgcggcaggcccgcatccagggacgcctgcggggggcctcggtccgcgtcgaggtgggacggggcgagcggggcggcacgccggtcctcacggccgagtccaccgatgcgggcgcggtgctgcgcttcctcgacatctaccggcgcatgcagggcggccggctctctctccaaaccaccatgaatgacgggccgcaggcgggcgccgtgcagatccgctccttcaccctgcgcgacgagccggcgctcggccgcatcatggcgcagggcgagcccgccccggaggaccggggcggccgctcgcccgggcggcggccggaggcgaacgacgtgggcttcgaccggctcaccgcggaattcgtgcgcacgggcacccggatcgacttctcggacgcggccatctcgggtccggccatgggcttcacgctgggcggctggctcgataccggccgcaacgccaccgacatccgcggcaccttcgtgccgctctacgggctcaacaacgtcttctcgcaggtgccgatcgtcggcccgctgctcggcggcggccacaacgagggcctgttcggcatcaacttctcggtgacgggcccgatgagcgcgccgaacgtcgccgtgaacccgctctcggccatcgcgccgggcttcctgcgcaagctgttcggggcgggcggcgatccctccgcggcggccgcgccgcggctcaatccctga

SEQ ID NO: 1748 - DNA, 3426 bp, Agrobacterium vitis S4
atgggagaaatccggggcgagaaaatccgttttcgcaaaggcgacattgttgccctcgagaccttgccgtcctcgcaggtcgatgatcccttgattgtgcactgcccgcgccgacgtggccctctgaccagattgatgcggtttggggcctatatcgtgctgtcgctgatggccatgctgggggcggcggccattgcgattgaaaccggtacgctggaccaggccctgtcgaccggtgcgcgcgctgcttttcaatctgcgattggcgacgacctgaaagccgatatcgaccagacctccatccgtctttccaagaatttgcatctggcggtcgccgcgcagaatgtcaccctgaccgatccgaagacccagcaggtggtctccaaagccggcgacgtcaaactggtcatcgatccgatctcgctgctgatggggcgggtttccgtgaccgaaatcgacgtgactggcatcgatttcgatagttcacggctgttgcagggcggcgatctggatcttgccacgctgcggatcgacaagtttccggcgttcatggagacgatgttcggcaatctcgacgatgtacatggcttcattgtccggggaggtctggatcggctgcgccttgggggtattaccttgcctgccaaaaatggaattggtcagccggttgatgtgcaggtcaacgatctgacattgacacgcaggaaggacgattcgcttgccatccagggtgagacgtctatcaacggcaaggtcagcatgatctccgccgaggcgatgactgacggagcccgcaccacgtcgttgactgcaacggtgacggatctgatcgccacgcccttcctgatcaagcgcacgcccacaggggtctggcgggacggggccgataccagcatcaatatcgatttctatgccttgcggcaatcacaaagccagaaaccggctctctcggcgcgattgcggacggaaaacggcatcctctacgttgatggcgacaagcaggacctgacgcgggccgacatcaatctcgcctatgattttgacaagctgacggcggaaatccggccctctgaggtggatttcggcccgacccatgtcccgttctccggcgggttcatcgatcttgatcggttgcagtcagtgccgggcgatgcccggggtatcggcatcgacctgctggtcgatcagggcacggcttcggtggaatcgtcgggagagcagccgtttccgttttctctcaaggcctttggacaattcattcccagccagcgtcatttgacattcagcgagttggcggtgtcgacgccacatggcagcatgcaagccacgctcaatgttcagtttggcaacgcctcgccggaaatccgtttcaacggcaaactgttcgagatgcgcaccgccatggtcaagcagctctggccctattggatggccatgaagccacgcacctgggtccaggccaatctgttcggcggcacgatcagcaatgcctcgattgatgtgctcattcctgccgggcggatgaaacctataccccaacctctggatctggggcctgacgagctgaaaatcgctttcgatatcagcggtgcgcgaatgaacgtcactggcgatctgccgccgattcgtgatcttgccggacattttgacctcacagggccggatctggaagtgcgcatcgatggcggcacgtcctatttcccttcgggacgcaaggtcaagttggacaaaggcacatttgcgatcgccaatacctacaagaagccgttgatggccaatatcgccgtttccgtcagcggcccggctgacgccatggcggaacttgcaaccttcaagcccatgcaagccttgcaacgcacggaattcgtgccggaggattttgcaggcgagatcaaggccgatgttcagctctatggcggcatcatcgccgatcagaaacctccaccggaagtgtggaaggcctctctggatatgaagggggtcgatctcaagcggccctatatggacaagaagatcaccggcttcgatggcacgctggtcgtggatccgcaaaatgctgtactgcaaggggacgcccagatcgatggcgtgccggtggagatcgacttctcccagccggtcgaccgcggttccaatagagcgcctagctggacggtgaaaggacagctgaacgacagccagcgcgccaagctcgtgccgggccttggcgacattgttggtggcaccatcgatctggaagtgtcgcgcctcgatgacaatcgccaactggtgaaaagcgacctgtcgcgcgcgactttgaacgtcccggttattggctggaccaagggttccggcattcccgccaaggtgtcgatggaattgcaggacaagtccggcctgttcatgctcgacaagttcaatctcgacggcgacgggttcggggcgactggcaagcttgtggtatccaaaaccaatgggctggttggggcggatctcgaccatgtcaaactggcctccgccgatgatttcggcctttcggttcaggtcaacaagggtgtcatcaacgcaaaggtcagtggtagcagtgttgatggccgtgttttgctgaagaagctgaaatccggcagctcttccaatggtgcgactggcgacggtcgatcgtcaagcaattcgaccgatgtcgatataagtgtcgatgtcgataagctgattggcttcaatgacgaagccctttccggcgtcaggctggtctatggttcccgatcgggggcagtaacggcgctgaaaatgagtgccgtgaccgacaccggccaagcggtcgttgtccagtcggccaaggctggaaatggcaatgagatatcgctgatttccagcgatgcaggcacgttggtgcggttcgtcgatctctatagccatatgcgcggcggcatgctggatgtgaaaatccgtggcgatctgaacaagaactggatgggcaatgttgatctgcgcaatttccgggtcgagaatgaggatcggttacagaaaatcgtcacgaccccggcaaccgatgatgggcgtagcctgaatacggcggtcaaacgtgacctggatgtcagctcggaaaaattccagcgggccttcgcccggctgatctatcaggacggcgtgctcaggaccgataacggcattgtccggggcgaacaggtcggcgcatcgttccagggcaccatcaaggataccaggggccagatggaaatgaccgggacattcatgcccgcctatggtctcaatcggctgtttgcggaagtgccgattatcggtgccatccttggcaatggccgggaccgtggccttttgggcattaccttcaagctaaaaggcccggtcgatgccccgcatctggtggtgaacccgctatcgattatcgcccccggcatgttccgccagatcttcgaattccaatag

SEQ ID NO: 1749 - DNA, 3399 bp, Rhizobium leguminosarum bv  trifolii WSM1325
atgtcagccatccgcggcgaaaaggtcacgtttcgcaagaaggatatcgttgcgctggaccgcttgccgtccgcccaggccgaggatccgatcatcgttcattgcccgccgccgcgttcgccgatgcgccgcacggcgaagctgacctgcggatttctggggctgatcctcgttattctcgctggcatcgttttcaccgtcgagagcggcatgttcgacaagccgctgtcgcagcaggcgcaggcggcgctgaacggggtagccggaccgcgctatcgcgccgaggtcggttccaccgtcatccgcttcacctcggatttccggctggcgctggaagcgcgcaacgtcaacatgatcgaccaggagagcggccagcacctgtcgacgacgggttcggtgcgcctggggctcgatccgctgcagcttttccgcggccgcatcgccgtcgcggacatcgaagcggaggatattgcgctcgataccgcgcttctgccctccggcaatgccgtcaagctcgacgatctgcgcatcgacgccatgccggcggcgatggaaaagatcttctcgcagttcgacatgttcgacagcatcgtgacgcgcggctcgaccaattcggtgcgcatctccggcctcgacatcaagcttgccgataccgccaacggtccgctgtcgctcgtcatcgacaatctcgtctttgcccatgccggcccgtcctcgctgcaattgaccggcgaagtcgcgctcaacggcgaagtggcggagctcgacgtgcgggccgagaaagacgacggccacgtgtccaaagtcgtggcgacgctcagacatgccgacctcacccccttcgcgctgaaacgcaacgatcagggcatgatccggcaaggactgagcgcctttgccgatctgacagtgtcggccacccgggcgcgcgatggcgcgcagccggcgctgacggcgacggtcgacatcgatcccggccaaatctatgcggacggcgatccgcagcagctctcgggcgggcaaatcaatctcgtctacgatttcgccaagcagaagctcgagattgcccgatcgaacgcccggttcggcgcgactacgcttcccatcaatggcgcgctgattgatctcgacaagctcgacccgcaggcgggcaaaggcttcggcatcgacctgctcgtcagtggcggcacggctgcccccggcggctccggcgaggagccactctccttcgacatccaggcgaccgggcgctacatggtcgccggccgtgagttccagtttcccaacataaccgtttccagcccgctcggcgcgctctacggatcactgcacgtcaaactcggcgacaaatcgccggagatcagcttcgccggccagtcggcgcagttgcagacgattgcgatcaagcagctctggccgttctggatggcgcccaaggtgcgcacctgggtgcacggcaatctcttcggaggcaccgtcaccgacgcttccatttccgtcttcattcccttcggcaggctggacgaggcagccggcggaaaaggattgaagctcgacgccaaccagatccgcatcggcttcgacatcacgggcgcgcggatgaacgtcgccggcgacattccgccgatccgcgacacgtcagcgcatttcgacctgacaggcccggttgcgacgatcgcgatcaagagcggcacctcctatttcccctccggtcggtcggtcggtctcgggcaggggacgttcatcctgcccgccacctacgataaaccgctgatggccgatatcgatctcgcggtctccggagccgcggacgccgtcggcgagcttctgacctaccggccgatccgggtgctgcagcgcgccggctttacgcccgacgatctcaagggccggatcgaggcgaatgtgaaggcccatttcggtctgctttcctcgcaaaacccgccgccggccgaatggtcggcggcaatgaagctcaccaatatcgatcttgccaagccgttttccggcaggatgatcagcaatctcgacggaacgctgaacggcaatcctaaaagaatcacgcttgacgccaaagcccagatcgacggcgtcccggccgatatcgatcttaccgaaccggtcgaggcatccgacgcggcggccaaacaacgggtgatcaccgcgaccctttccgaggaccagcgcaacaagctgatacccggcctttccggaatcgtcggcggcagcgtgaagatggtgctgacgcggatcgacgacgaccggcaggacgtccagctcgacctcaccaagtcgctgctcgaactgccctggatcggctgggcgaagggcagcggcattgccgccacggccgaattcgaaacatccgggccggccgacaatacccagatcaagaacttccgactgaagggcgacggttttggcgccaatggatcgttgaacatcggcaagggtgggctgatctcggccgatttcgacagcgtcaagctctcctcgctcgacgatttcgccctgtcggtgaagcgcagcaaaggcaatttcgacgtctcggtctccggtgacagcgccgatgcgcgaccggtcatccagcggttgaaatcgggctcggacggcgatggtgacggggatggcggcgacaccggcgtctcggtgcgcgccaggctgaaaaacgtcatcggtttcaacgacgagaaggtcggcaatttccaggcgcaaatatcactgcgcggcgacaagctgcaggcgctcaatttttccgccgttaccgacagtggcgaggccgtggtcagccagatgaaggacggcggcgtcatcaacatcaccagcggcgatgccggcgcggtatcgcgtttcgccgatctctaccagcacatgcagggcggcctgctcaacctggcgatccggctaggggcggagggcggctgggacggctcgctcgacgtgcgccgcttcgcgatcgtcaacgaacaacggctgcgctcgatcgtctcgacaccggtcggaaatgagcagcgcagcctcaacgaagccgtcaagcgggacatcgatacctcgtcgcagcgcttccagcgcggctttgcccgtgtcgtatcgcgcaatggcatggtcggcatcgagaacggcgtgctgcgcggcgatcagatcggcgcgaccttccagggcatcgtgcgcgaccgcaagggcaacatggacatgaccggcaccttcatgcccgcctacggcctcaaccgcctcttcgccgaactgccgctgatcggggtcatcctcggcaatggcagcgaccgcggcctgatcggtatcaccttcaagctgacaggcaagttcgaccagccgaacctgcagatcaatccgctgtcgatcatcgcgccgggcgtcttccggcagatttttgaattccagtga

SEQ ID NO: 1750 - DNA, 786 bp, Thermobifida fusca YX
atggcaaccgccaagcgcaagccgctgattgcgggtaactggaagctgaacaacaaccacctcgaggccatcgcgctggtgcagaagatggccttcgccctcaacgacgccgactacgacgccgcagacatcgcggttctgccgccgttcaccgcgatccgcagcgtgcagaccctggtggaaggggacaaactgcggatcacctacggtgcccaggacatctcccagcacgagaagggcgcctacaccggtgaagtgtccggcccgatgctggccaaactcaactgcacgtacgcgctggccgggcactcggagcggcgcgaataccaccacgaggacgacgcggtcgtcaacgcgaaagtcaaagcggccttcgccagcggcatcacgcccatcctgtgcctgggtgaagggttggaggtccgcaaggcgggacgccacgtcgagcacaccctcgcccagttggaaggcgcgctcaagggcgtgaccgaggagcaagtccgcaccctggtcgtggcctacgagccggtgtgggcgatcggtaccggcgaagtcgccacgcccgaggacgcccaggaggtgtgcgcggcgctgcgcaagcggattggtgaactgtactcccctgaggccgcacagcagacccgcatcctctacggcgggtcggtgaagagcggcaacgtcgcagcgatcatggcgcaagcagacgttgacggcgcgctggtcggcggtgcgagcctggacgctgacgagttcgtcaagctgatccgcgccgcggtccagggctga

SEQ ID NO: 1751 - DNA, 927 bp, Frankia CcI3
atggccctgctgggccggggaagatctgagcgaggttccgacaggggatccgggaagaacaggggatccgggaaggacgaggacggcgtgggcaaggacaggtcggtgaagggcgctgccggttcaaagggcgccgccggcgtcaagggcaccggccgacggacgctggtagccggcaactggaagatgaacctcaatcacctcgaggcgatcgcgctggtgcagaagatcgccttcgatctcaagcccgccgagctggagaccgtcgaggtcgtcgttctcccgccgttcaccgatctgcgcagcgtgcagaccctggtggacggggacaagctcgccatcgcctacggcgggcaggacctctccccctacgcgtcgggtgcgcacaccggtgacatcagcggggcgatgctggccaagctcggctgcgactacgtcgtcgtcgggcactccgagcgccgggccgaccaccacgaggacgacgcgctggtggcggccaaggcgaaggcggccttctccgtggggctcacccctatcctgtgcgtgggggagcccgaggagatccgggccgccggcacccaggtcgagcacgtgctgcgtcagctcgagcggtcgctggctggcatcaccgccgagcaggccgcgacgatcgtcatcgcctacgagccggtgtgggcgatcggcactggccgcaccgcctccgcgcaggacgcccaggacatgtgcgcggcggtccgcggccagctggccagtcagtacggcgatgagatcgccgcggggatccgtgtcctctacggcggctcggtgaaggcagcgaacgccggcgagctgttcaccatgccggacgtggacggcgggctggtcggcggggcgagcctggtcgccgaggagttcgtcggcatcgtgcgcagcgggccgccggcctga

SEQ ID NO: 1752 - DNA, 786 bp, Mycobacterium MCS
atggcccgtaagccgctgatcgccggcaactggaagatgaacctcaaccacttcgaggccatcgcgctggtgcagaagatcgccttctcgctgccggacaagtacttcgacaaggtcgacgtgacggtcatcccgccgttcaccgacctgcgcagcgtgcagacgctcgtcgacggggacaaactgcgcctgagctacggcgcgcaggacgtttcgcagcacgattccggtgcctacaccggcgagatcagcggcgcgttcctggccaagctgggctgttcgttcgccgtcgtggggcactcggagcgccgcacctaccaccacgaggacgacgcgctggtggccgccaaggccgccgcggcgttccggcacggcatcaccccgatcgtctgcatcggtgagcacctgaaggtgcgtgaggcgggcaaccacgtcgagcacaacgtcgagcagttgcgtggttcgctggcggggctgacgtccgagcagatcggtcaggccgtcatcgcctacgaacccgtgtgggcgatcggcaccggccgggtggccggcgccgccgacgcgcaggaggtgtgcaaggccatccgcgacgagctcgggaagctctcctcaccgcagctggcggccgggatcagggtgctctacggcgggtcggtgaacgccaagaacgtcggggagatcgtggcccaggaagacgtcgacggtgcgctggtcggtggggcctccctggacggtgagcagttcgccacgctgtcggcgatcgccgccggcgggcccctgccctga

SEQ ID NO: 1753 - DNA, 771 bp, Rubrobacter xylanophilus DSM 9941
atggcgggggagaggaggccgctcatggcggccaactggaagatgaacaagaccgtgcgggaggcgcaggactacatggccgcgctcctgccgcgggtggccgacctcgccggggaggtggacgtggctgtcttcgccccgttcacctgcctctcagaggtcgcccggatggcggagggctcgggcgtcctcgccggggcgcagaacttcttctacgaggactcgggggcctacaccggcgaggtctccgccccgatgctcctggacgtgggggcgcgggcctccatcgtcggccactcggagcggcgggagctgttctgcgagaccgacgagtcggtggcgagaaaggcccgccgcgccgtggaggccgggctcctgcccgtcgtctgcgtcggggagaccgaggaggagcgcgacgcgggccggatgtgggagaaggtctccggtcaggtgcgggcggtggtcgaggggctcggggacgcctccggggggcgggtggtcttcgcctacgagcccatctgggccataggcaccggaaagaccgcctcccccgaggacgcccaggacgccatcggtcgcatccgggggctgctccgcgagctgaggggggaggggttcgccgaggaagcgcgcctcctctacggcggctccataaagccggagaacatctccgagatcatggcgcaaaaagacgtcgacggcggcctggtcggcggggcgagcctggaggtgggctcctttctgcagctcgtcgaggcggcgcgggggtga

SEQ ID NO: 1754 - DNA, 816 bp, Arthrobacter FB24
gtgactacgtcaacgaatggcaagttcgaccgcacgcccctcattgccggcaactggaagatgaacatggaccacgtccagggcatcacgctgctgcagaaactggcctggaccctgtccgacgccaagcatgattacagccgggccgaggtagctgtcttcccgcctttcaccgaccttcgcggcgtccagaccctcgtccagggcgacgaactggaaatcgtttacggcggccaggacctttcgcagttcgattccggtgcctacacgggtgacatctccggccagttcctgaacaagctgggctgcaagtacgtcctggtcggccacagcgaacggcgcaccatccacaacgagaccgacgaggtcctcaacgccaaagtgaaggccgcctaccgccacggaatcaccacggtgctctgcgtcggtgaaggcctcgagatccggcaggccggcacgcacgtccagcacacccttggccagctccgtgccgacgtcgaaggcctcagcgccgacgaagcagccgaacttgtggtcgcgtacgagcccgtctgggccatcggcaccggtgaagtagcaggtccggaggatgcacaggagatgtgcgccgccatccgcgccgagctcaccaccctgttcggcgacgaggttgccgccaaggtccgtctgctttacggcggttcggtcaaggccaacaatgcggccgccatcctgaacgaacgcgacgtcgacggcgtgttggtgggcggcgccagcctcgatcccgccgagtttgctaatattgtcaggttcgagagtcacctgctgacggattag

SEQ ID NO: 1755 - DNA, 795 bp, Nocardioides JS614
atggcaacgagtcgcaccccgctgatggcgggcaactggaagatgaacctcaaccaccaagaggcggtggtgctggtccagaagctcgcgtggacgctcgctgacaagaagcacgactatgcgcgtgccgaggtcgtcgtcgtcccgccgttcaccgacctgcgctccgtgcagaccctggtggacggcgaccggctgctcgtgaagtacggcgcccaggacgtctcgacacacgacggcggcgccttcacgggcgagatctcggccggcatgctcgccaagctcggctgctcctacgtcgtggtggggcacagcgagcgccgcgagtaccacaccgaggacgaccaggaggtcaacgccaaggcgcaccaggccctgggcgcgggcatggtcccgatcgtgtgcgtgggcgaaggtctcgacgtgcgccaggccgggggacaggtggcccactgcctggcccaggtcgacggctcgctcgccgggttcaccgccgaacagatcgccggcctcgtgatcgcctacgagccgatctgggcgatcggcaccggcgaggtcgcgaccccggacgacgcccaggaggtctgcgcggcgatccgcgagcggatccgcgaggtgcacggcgacgaggccgcggacggcgtgcgcgtcctctacggcggctcggtcaaggccgcgaacgtggccggcatcatggccaaggacgacgtcgacggctgtctggtcggtggcgccagcctccaggcggacgagttcggcggcatctgccggttctacgacatgccggtcatctga

SEQ ID NO: 1756 - DNA, 786 bp, Mycobacterium KMS; identical to SEQ ID NO: 1752

SEQ ID NO: 1757 - DNA, 786 bp, Mycobacterium vanbaalenii PYR-1
ttgtcccgtaagccgctgatcgccggcaactggaagatgaacctgaaccacttcgaggcgatcgcgctggttcagaagatcgcattctcgttgccggacaagtacttcgacaaggtcgatgtcacggtcatcccgccgttcaccgatctgcgcagcgttcagacactggtcgacggcgacaagctgcggctcacctacggtgcgcaggacgtgtcgcagcacgactccggggcctacaccggcgagatcagcggcgcgttcctcgccaagctcggctgcacgttcgccgtcgtcgggcactccgagcggcggacctatcacaacgaggacgacgcgctggtggcggcgaaggcggccgcggcgttcaagcacgggctgaccccgatcatctgcatcggtgagcacctcgacgtccgcgaggccggcaaccacgtcgagtacaacgtcaaccagctgcgcggctcactggccggactgagtgccgagcagatcggtcaggctgttatcgcctacgagccggtgtgggcgatcggcaccggccgggtggccagcgccgccgatgcccaagaagtctgtaaagcgatccgggacgagctgggcaacctggcctcaccggagctcgccgccggtgtgcgggtgctctacggcggttcggtgaacgcgaagaacgtcggtgagatcgtcggccaggccgatgtcgacggtgcgctggtcggtggcgcgtcgctggacggcgagcagttctcgatgctgtcggcaatcgccgcaggcgggcctcttccctga

SEQ ID NO: 1758 - DNA, 786 bp, Mycobacterium JLS; identical to SEQ ID NO: 1752

SEQ ID NO: 1759 - DNA, 786 bp, Mycobacterium gilvum PYR-GCK
ttgacccgtaagccgctgatcgccggcaactggaagatgaacctgaaccacttcgaggcgatcgcgctggttcagaaaatcgcattctcgttgccggacaagtacttcgaccgggtggacgtcacggtgatcccgccgttcaccgatctgcgcagcgtgcagacgctcgtcgacggcgacaagctgcgactcacctacggcgcccaggacgtgtcccagcacgattcgggcgcctacaccggcgagatcagcggcgcgttcctggcgaagctgggctgcacgttcgccgtcgtcgggcactccgaacgccgcacctaccacggtgagaccgacgagctggtcgccgcgaaggccactgcggcgctcaagcacggtctgaccccgatcgtgtgcatcggcgaacaactcgaggtgcgcgaggccggcaaccacgtcgagttcaacgtgaactcgctgcgcggctcgctggccgggctctccgccgagcagatcgcccagacggtcatcgcctacgagccggtgtgggcgatcggcaccggccgggtggccagtgccgccgacgcgcaggaagtgtgcaaggccatccgcgacgaattgggcaacctcgcgtcggccgacgtcgccgcaggtgtccgggttctctacggcggatcggtcaacgccaagaacgtcggcgagatcgtcggccagggcgacgtcgacggcgcactggtcggcggggcgtcgctggacggtgagcagttcgccacgttgtcggcgatcgccgcgggcggcccgctgccctga

SEQ ID NO: 1760 - DNA, 792 bp, Salinispora tropica CNB-440
atggccaaccccacccgccggccactgatggccggcaactggaagatgaacctcaaccacctcgaggcgaatctgctggtgcagaagctcgccgcgagtctcaccgcgaagcagctcaccgatgtcgagacggtggtgctaccgccgttcaccgacctacggacggtgcagaccgccgttgacggggacaagctgctggtcggctacggcgcgcaggacctctcgccgcacgcgtcgggggcacacaccggtgacatcgccgggccgatgctgacgaagctgggctgcacgtacgtggtggtcggccactccgagcggcgggcggaccaccacgaggacgacacgatcgtcaacgcgaaggtgcaggcggccctcacccacggcctcaccccgatcctctgcgtgggggaggggctggagatccgggaactgggcaaccaggtcgcgcactgcagcgaccagctcgacgccgctctcaaggggctctcctccgagcaggtggcccaggtcgtcgtcgcgtacgagccggtctgggcgatcggcaccggcaagacggccaccccccaggacgcccaggaggtctgcggggcgctccgtcagcggctcgccgggaacgtcggtccggagacggccgaccaggttcggatcctctacggcgggtcggtcaagtcgtcgaacgtggccgccatcatggctcagccggacgtggacggcgcccttgtcggcggtgccagcctggacgctgaggagttcgcgaagatctgccggttcccggagcacaccaccggctga

SEQ ID NO: 1761 - DNA, 813 bp, Frankia EAN1pec
gtggcgaagggggcacccgcccgcgggtcggccggaaccggccggcggacgctggtcgccggcaactggaagatgaacctcaaccacctcgaggccatcgcgctggtgcagaaggtcgccttcgacctcaagcccgccgagctcgagcgggtcgaggtcgtcttcctgccgccgttcaccgacctgcgcagcgtccagacgctgatcgacggcgacaagctcgccgtcggctacggcggccaggatctctccccgcacggctcgggcgcctacaccggcgacatcagcgggccgatgctggccaggctcggctgctcgtacgtcgtcgtcgggcactccgagcggcgcacgtaccaccacgaggacgacgcgctggtcgcctcgaaggtcctggcggcctacaaacacggcatcacgccgatcctgtgtgtcggcgagcacgaggacatccgcgccgcgggaacccatgtcgagcacgtcctggcgcagctcgagggctcgctggccggcgtgagcgcggagcaggcggccacgctcgtcgtcgcctacgagccggtctgggcgatcggtaccgggcgcaccgcatccgcccaggacgcgcaggacatgtgcgccgccgtccgcggccagctgacgaagctgtacgacgagccgatcgcggccggcatccgggtcctctacggcggctcggtgaaggccgccaacgcggccgagctgttcaccatgcccgacgtggacggcggtctggtcggcggtgcgagcctggtcgccgaggagttcgtcggcatcatccgcagcggtccggcggcgtag

SEQ ID NO: 1762 - DNA, 792 bp, Salinispora arenicola CNS-205
atggccaaccccacccgccggccgctgatggccggcaactggaagatgaacctcaaccacctcgaggcgaacctgctggtgcagaaactcgccgcgagtctgaccgccaagcagctcaccgatgtcgaagcggtggtgctaccgccgttcaccgacctgcggacggtgcagaccgccgtcgacggggacaagctgctggtcggctacggcgcgcaggacctttccccacacgcgtcgggggcgcacaccggcgacatcgccgggccgatgctggcgaagctgggctgcacgtacgtggtggtcggccactccgagcggcgggcggaccaccacgaggatgacgcggtcgtcaacgtgaaggtgcaggcggccctcacccacggtctcaccccgatcctctgcgtgggggaggggctggacatccgggagcagggcagccaggtggcgtactgcaacgaccagctcgacgccgccctcaaggggctctccgccgagcaggtggcccaggtcgtcgtcgcgtacgagccggtctgggcgatcggcaccggcaagacggccaccccggaggacgcccaggaggtgtgcggggcgctccgtcagcggctggccgggcacttcggccaggacacggccgaccaggttcggatcctgtacggcgggtccgtcaagtcgtccaacgtggcggccatcatggcccagacggacgtggacggggctcttgtcggcggtgccagcctcgacgccgaggagttcgcgaagatctgccggttcccggagcacactgccggctga

SEQ ID NO: 1763 - DNA, 804 bp, Bifidobacterium longum DJO10A
atggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaa

SEQ ID NO: 1764 - DNA, 816 bp, Arthrobacter chlorophenolicus A6
gtgacaacgtctaccaacggcgccttcgaccgtaagcccttcatcgccggcaactggaagatgaacatggaccacgtgcagggcatcacgctcctgcagaagctggcctggacgctttcggacgccaagcacgactacagccgcgtcgaagttgcggtcttcccgcccttcacggacctccgcggcgtccagaccctcgtccagggtgacgacctggacgtggcctacggcggccaggacctttcccaatttgactccggcgcttacaccggcgacatctccggccagttcctgagcaagctgggctgcaagtacgtgctggtgggccacagcgaacgccgcaccatccacaacgaatcggacgacgtcctgaacgccaagaccaaggcggcattcaggcacggcgtcaccccggtcctctgcgtcggtgagggcctggagatccgcaaggccggcacgcacgtcaaccacaccctggaccagcttcgcgccggcgtggcgggcctgaccgatgaccaggccgcagaactcgtcgttgcctacgaacccgtatgggccattgggacgggcgaggttgccggaccggaggacgcacaggagatgtgcgccgccatccgggccgagctggagaagctgttcggggcggacgttgctgccaagacgcggctgctgtacggcggctcagtcaaagccaacaacgctgcagccatcctgaaggagcgcgacgttgacggcgtgctcgtgggtggcgccagcctggacccggccgagtttgctaatattgtcaggttcgagagtcacctggtgacggactag

SEQ ID NO: 1765 - DNA, 828 bp, Acidimicrobium ferrooxidans DSM 10331
atgagtcggcgggctcccgagcccgagccccaggcgggatccggacgggtgcgtctcgtcgtcgccaactggaagctgcaccacacgcacctcgaagccatcgcgttcttggagcggctgtggcacctgttggatgtcgaggactaccggcgcgcggagatcgcgatctgccctgcattcacggcgctgcggtcggcgcagctgacgatcgagaccgatggcatgccctatcggctcggtgcccaagacgtcttctgggaaccctcgggggcctacacgggggaggtgagcgtccccatgctcgccaagctggacgtcaagtacgtgatcgtggggcactctgagcgccggcgcttgttcggcgagaccgacgacgtggtcgccaagaaggcggcggcggtcgcgtccggtgggttggtaccgatcgtgtgcgtgggtgaggtcgccgaagagcgcgctgggggtaccacggaggccgtgctcgagcgccaactcgacacggtgctcacgacgtatccggtcgaggcgctcggagagctcgtgatcgcctacgaacccgtctgggcgatcggttcgggaacgcccgcgacgcccgaagacgccgagcacgtcgctcgcttcctccgggaccgcctcgcgcgccgggcgagcgaggcggtggctgctcgcgtccgcatcctctacggtggctccgtcgacgtgggcaatgcggtcgcgttcctcgcgcaggccgacatcgatggtctcctcgtcgggggtgcctcgctcgatccggagcgtttcgcgcagctgctcggcggccgaccccgcatcgcgtcgacgtcctag

SEQ ID NO: 1766 - DNA, 786 bp, Actinosynnema mirum DSM 43827
gtggcgcgcactccgctgatcgcgggcaactggaagatgaatctgaaccacctggaggccatcgccctggtgcagaagatcgccttcgcgctgcccgagaagtactacgccaaggtcgaggtggcggtgctcccgccgttcaccgacatccgcagcgtgcagaccctcgtcgacggcgacaagctcctgctcaagtacggcgcgcaggacctgtccccgcacgactcgggcgcctacaccggcgacatctcgggcgtgatgctcgcgaagctcggctgctcctacgtcaccgtgggccactccgagcggcgcgactaccacggcgaggacgacgcgaccgtcaacaagaaggtcaaggccgccctcaagcacgggatcaccccgatcttctgcctcggcgagaaggtcgacgtgcgggagaagggcgagcacgtcgccttctgcaccgaccagctcgtcgccggcctcaagggcctgaccgccgagcaggtgcgcggcgtcgtcatcgcctacgagcccgtgtgggccatcggcaccggcaaggtcgccagcgcggccgacgcgcaggaggtctgctcggcgctgcgggtcaagctggccgaggcgtacggcgaggacgtcgcgtccgaggtccgggtgctctacggcggctcggtgaagtccggcagcgtcggcgagctgatcgcgcagaaggacgtcgacggcgccctcgtgggcggcgcgagcctggacggcgacgagttcagcaagctctgcgcgctcgccgcgggtggtcccctaccctga

SEQ ID NO: 1767 - DNA, 798 bp, Beutenbergia cavernae DSM 12333
atggccagcacccgtaccccgctgatggcgggcaactggaagatgaacctcgaccaccaccaggcgacgcacctcgtgcagaagctcgcgtggacgctcggggacgccaagcacgactacaccggcgtggaggtcgtcgtcgcgccgtcgttcacgaacctgcggtccgtgcagacgctcgtcgacgccgaccggctgggcatccgttacgcctcccaggacgtctcggcgcacgcctccggcgcgtacaccggtgaggtgtcggcctcccagctggcgaagctcggcgtcacctacgcgatcatcgggcactccgagcggcgccagttccacgcggaggacgacgccgtcgtcaacgcgaagtcgaaggcggcgctcggcgagggcatcgtcccgctggtgtgcgtcggcgaagggctcgacgtgcggcaggccggcgagcaggtgccgtacacgctcgctcaggtcgacggcgcgttcgacgggatctccgccgacgacgccgcgacgatcgtcgtcgcgtacgagcccgtctgggccatcgggaccggcgaggtcgcgacacccgaggacgcgcaggaggtctgcgcggcgatccgcgtccgcctcagcgagttgtactcaccggaggtggcaggcgccgtccgcgtcctctacggcggctccgtgaagtccgggaacgtcgcggccatcatggccaagcccgacgtcgacggcgcgctcgtcggcggggcgagcctcgacgccgacgagttcgcggccatcgtccgctaccagcagcacgccgtcggcctctag

SEQ ID NO: 1768 - DNA, 777 bp, Brachybacterium faecium DSM 4810
atgaccaccccccgcaccccgctgatggcgggcaactggaagatgaacctcgactggaagcagggcctcgccctggtcgaggagctcggcgagcacctcaaggaggtcgacacctcgctggtcgagaccgtcgtgctgccgcccttcgtggacctgcgcagcgtccaggtcgcggtcgacgccggcaagctgccgatcgcgtacggcgcgcaggacatctccgcccacgagtccggtgcgtacaccggcgaggtctccggcccgatgctgaagaccctcggctgctcctacgccgcggtcggccactccgagcgccgccagtaccacggcgaggacgaggaggtcacgaatgcgaaggtgaaggccgccttcgccgcggacatcaccccgatcctgtgcgtcggcgagccgctcgaggagcgtcaggccggcaagcacgtcgagtacaccctcgcccagctcgagggaggcatcgagggactggacgccgcgcaggcgaagcggatcgtcatcgcctacgagcccgtctgggccatcggcaccggcgaggtcgccaccccggacgacgcccaggaggtgtgcgccgcgatccgtgaggcgctgcgtgcgatgcacggcgacgaggtcgccgacgccgtccgcgtcctgtacggcggcagcgtgaagtccgccaacgtggccgagctcatggagaaggccgacgtcgacggcgcgctcgtcggcggcgcctcgctcaaggccgaggagttcgccaagatcgcgggcttccagggctga

SEQ ID NO: 1769 - DNA, 792 bp, Micrococcus luteus NCTC 2665
atggcggagcagaccacacgcgtgccgctgatcgcgggcaactggaagatgaacctggaccacctcgaggccgtcaccctggtgcagcgcctcacgtggctcctctcggacgcggaccatgaccaggaggccgtggaggtcgcggtgttcccgcccttcacgggcctgcggtccgtgcagacgctcgtcaccggcgaccgcctggacctcgtctacggcgcgcaggacctctcgcccgaggatgccggcgcctacacgggcgacgtctccggcgcgttcctggccgcgctggggtgccgttacgcgatcgtgggccactccgagcgccgcaccctccacggggaggacgacgccctcgtcgcgcgcaaggccgccgcggccctgcgccacggcctcaccccggtgatctgcgtgggcgagggcctggaggtgcgccaggccggccggcacgtcgagcacacgctcgcccagctggagggctccatcgcgggcctgtcggcgcaggacgtggccggcgtcgtcgtcgcctacgagcccgtgtgggcgatcggcacgggcgaggtcgccggccccgaggatgcgcagcagatgtgtgcggccctgcgcgcccgcgtggccgcactgcacggcgacgacgtcgccgccgggctgcggatcctctacggcggctccgtgaagtcctccagcgcgccggcgctgctggcacagcctgacgtggacggcgccctcgtgggcggcgccagcctcgacgcggacgagtttgctaagatcgtccggttcgaccaggcctga

SEQ ID NO: 1770 - DNA, 792 bp, Kytococcus sedentarius DSM 20547
atgaccgagcgcctcccgctgatcgcgggcaactggaagatgaacctcgaccacctgcaagccacccacctggtgcagaagctcgactgggtgctgcgggacgcctcgcacagcttcgatgcggtggaggtggcagtcttcccgccgttcacgcacctgcgcagcgtcgagacgctgatcatggccgacaagctcgacatcaagctcggggcccaggacctctcggagcacgcctccggcgcgcacaccggagacatctccggcggcatgctggccaagctcggctgcgagttcgtcatcgtgggccactccgagcgccgcgagcaccacgcggagaccgatgcggtggtgcacctgaaggtcaaggccgccctggcggccgggctggcccccatcgtctgcgtgggggagtcctccgagacgcgtgcggccggcgagcacctggccttcgtcacccggcaggtcgccgcggccctggagggcctgtccgccgaggagctcgcccacgccgtcatcgcctacgagcccgtctgggcgatcggcaccggcgaggtggcctccagcgccgacgcgcaggaggtctgtgcagcgatccgcgagcaggtcgcgcacacccacggggcggagctggccgcggggatgcgcgtgctctacggcgggtcggtcaagccgacgaacatcgccgagatcatggacgaggccgacgtggacggcgccctggtcggcggcgcctcgctcaccgccgaggagttcgcctcgatcgtccgcttccggtcccaccacggccgctga

SEQ ID NO: 1771 - DNA, 792 bp, Catenulispora acidiphila DSM 44928
atgactgaccgcaagccgttgatggctggcaactggaagatgaacctcaaccacttcgaggccatgaagcacgtccaggagttggcgttctcgctgacggacaaggacttcgacgccgtcgacgtggcggttctggtgcccttcaccgacctccgctcggtccagaccctggtgcagggcgacaagctgcgcatccagtacggcgcgcaggacgtctcccagcacccctcgggcgcctacaccggcgacatctccgcgccgatgctggccaagctggactgccactacgtgatcgtcggccactccgagcgccgccagtaccacggcgagaccgacgcgctggtcgcggccaaggccgtcgccgcgcgcaagcacgggatcacgccgatcgtctgcgtcggggagcacctgcaggtccgcaaggacggcgcgcacgtcgcgcactgtgtcgagcagacccgcggctcgctcgccgggctcagcgccgagcaggtccaggcctcggtcatcgcctacgagccggtctgggcgatcggcaccggcgaggtcgcgacgccggaggacgcccaggaggtgtgcgccgcgatccggaccgagctggccacgctgttcgacgagagcgtcgcggcgaacacccggattctctacggcggctcggtgaagggcgccaacgccgccgagctgatggcgcagcccgacgtcgacggcgcgctggtcggcggggcgtcgctggacgccgcggacttcacgcggatcgtgcgtttcagggattctgctgtcgccgctggctga

SEQ ID NO: 1772 - DNA, 786 bp, Saccharomonospora viridis DSM 43017
atggcccgcaagccgctgatcgcaggcaactggaagatgaatctgaaccacctcgaggccatcgccctggttcagaagatcgccttctcgttgccggagaagtactacgagaaggtcgatgtgacggtgcttccgccgttcaccgacatccgtagcgtgcagacactggtcgacggggacaagctcctgctcacctacggggctcaggacgtgtcgccgcacgactccggtgcctacaccggcgacatctccgctccgatgctcgccaagctgggctgcacctatgtcgtggtcggccactccgagcggcgcgagtaccacggcgagaccgacgagctcgtgaacaagaaggtccgtgccgcgctcaagcacgggctgtcgccgatcgtgtgtgtcggcgagcagttggaggttcgggaagccggcggtcacatcgagcacaccacgtctcagctcatcgcggcgctgaaggggctcaagaccgaacaggtgaacaacgtggtggtggcctatgaacccgtgtgggccatcggcacgggccgtgtcgccaccccttccgacgccgaagaggtgtgtgccgcgttgcggacggcgctggccgacaagtacggtgccgacctcgcccagcgggtgcgggtgctctacggtggctcggtgaagtcgagcaacgtggccgacctcgtcaagtgtgacaacgtcgacggagctctcgtgggtggtgccagcctcgacggtgaggagttcacgaaactgtgtgctctcgcggcgggtggcccactaccgtga

SEQ ID NO: 1773 - DNA, 783 bp, Jonesia denitrificans DSM 20603
gtgaccaacgcacgtaccccgctcattgctggtaactggaaaatgaacctcgaccacaacgaggcgattcacacagtccaaaagctcgcatgggcgttgaaagatgcacaacacgactacaacgctgttgaggcgacagttttggtgcccttcaccgacattcgttccgtccagacacttgttgactccgacaaactgggcatcacctacggtgcgcaggacctctccgcacaggtttctggtgcgtataccggtgaaatttcaccagtgttcctctcacgtcttggcgtgaagtatgtggctgtggggcactctgagcgccgccagtaccacggtgaagacgacgcccttgtgaacgcaaagaccaaaaacgcacttgcgcacgacattgcaccaatcgtgtgtgtgggggagcctcttgaggttcgcaaagccggtgaccaagtgccgttcacacttgcacaggtcgatggtgcatttgctgacatctcagctgaggacgccgtcaaggttgttgttgcctacgaacctgtgtgggcaatcggaactggcgaggttgcaacaccagcagatgcacaagaagtcgcccaggctattcgtgctcggctggcggaactgtactcacaagacgtcgctgacgctgtccgcgtcctgtacggcggttctgtgaagtcatcgtcaatcaaggaactcatgaacgaagctgacgtcgatggggcccttgttggtggcgcttcgcttgacccagaagagttcgccaagattgtccactaccaggactga

SEQ ID NO: 1774 - DNA, 768 bp, Atopobium parvulum DSM 20469
atgcgtaatcgtatgattgcaggtaactggaagatgaatgagaccttcgctgagggcattgagcttgctcagggaatcgtcgatcagcttgcttccggtaccggaaacgttgacgttgttgttgctccacctcttgtagaccttaagggtgtctccgaggttcttactcaggcaaactcttctgttgctctttctgcacaaaatgtgtattgggaggagtctggcgcatttactggtgaaacctctccagcaatgctgacttctgttggtgcaacatactgcatcattggtcactctgagcgtcgcggttactttggtgagaccgacgaggacattaaccgcaaggcaaaggcactgatggctcatgacatcgttcctatttcttgctgcggtgagtctcttgaggtccgtaatgctggcactcacgttcagtttgttgttgatcagattaaggcagacaccaagggtcttgagattaccgatccttccaagtacgtaattgcttatgagccaatctgggcaattggtactggtatgactgcaactgctgatgacgcacaggaagtttgcggcgcaatccgtaagaccctggtagagatctttggcgcagaaattgcagagggcatccgtattctttacggtggctctgcaaagccagagaacgttggtggcttcctcgagaaagaggacgtcgacggcgcacttgttggtggcgcatctcttaaggctgattcttttgttgcaatggtaaagagcgctatgaactaa

SEQ ID NO: 1775 - DNA, 786 bp, Nakamurella multipartita DSM 44233
atggctacccgtaccccgctcatcgccggcaactggaagatgaacctgactcatctggagggcatcgccctggtccagaagatctcgttcaccctgccggagaagtacctcaagcacgtcgaggtggcggtcttcccgccgttcaccgcgctgcgctcggtgcagaccctgatcgaggccgacaagatcgacttcaagtacggcgcccaggacgtctcggcgcacgactcgggcgcctacaccggcgagatctccggcatccagctgtccaagctcggctgcacctatgtgctggtcgggcactcggagcggcgtgagtaccaccacgagaccgacgagcaactggccaagaaggtcaacgccgcctacaagcacgggctgatcccgatgttgtgcgtcggcgagggcctggagatccgggaagccggcaaccaggtcgcgtactcggtcaaccagctgctggccgggattgccgacgtcacccctgagcaggccgaatccctcgtgctggcctacgagccggtgtgggccatcggcaccggccgggtggccaccccggccgacgcccaggaggtctgtgccgcgctgcgggtcgcgctggccggcaagtacgggcaggagaccgcggacaagatccgcatcctgtacggcggatcggtcaagtccggcaacgtcgcggagatctgcgcgcagaccgacgtggacggtgccctggtcggcggcgcgtcgctggacgggaccgaattcgccacgctggccgcgaacgcggtcggggtcctgccctga

SEQ ID NO: 1776 - DNA, 2352 bp, Brucella suis 1330
ttggcacgccgtttttccaaatccgataccggacgatccgcacggaccgagcggcgtgcagccacagcccaatcgaaagattccgcagcctttttgccgacacgggaagaggtcctcaaatatatcgaggaaaatcccgatcgcgcgggcaagcgggaactcgccaaggctttcaacatcgagggcgatgcacgggtctatctgaaagacctgttgcgtgagcttgccgatgaaggtctcgtcgaaaagcgcgcgcgcaagctttcgcgtcccggctcgctgccatcggttgcggttctcgatattacgggccgggatgaggatggaggcctgcttgcccgcccggctgaatgggttgaggcgagccacggcaagccgccagtggtcctgctgcggcgaacccggcttaacaagacgtcagaaagtggccctgtcgtcggcgttggcgaccgcgttctggcgaaaatcttccgcaatgaagatcacgcagggccggatttttccgcccgcgtgatgaagcggctggaacatcacgccaatgccgttctgggcgtggtgcgcaaacttggcaatggcgaatggcggctggagccggtcaatcgcaaacagggcgaagtgcagcttgatcccgccatgctggaaaatgccgaaagcggcgatctggtggaagtagaactgctttccgcgcgccgttacggcctgccgcgcggcaaggtccgtcaggtggttggctccatcgatagtgaaaaggcgctgtcgatgatcgccattcacgaacatgaaatcccgcatgtttttcctgacgaagtgctgcgcgaggctgaaaccgcaggccctgccacgctggaaggccgcgaagactggcgcgaaatcccgctcatcaccatcgatccggccgacgccaaggaccatgacgatgcggtctatgccgaaccggatacggacccggaaaatcccggcgggcaagtcgtcatcgtcgccatcaccgatgtcgccgcctatgtgcggcccggctcagcccttgatcgcgaagcgcagaaacgcggcaattccgtctattttcccgaccgcgttgtaccgatgctgcccgaacgcatctccaatgatctttgctccctgcgcgagatggaagaccggccggcgctgacggtccgtatgattttcagtgccgacgggcgcaagaaatcacacaagttccaccgcatcatgatgcgctcggccgccaaggttgcctatggccaggcgcaagccgccatagacggcgcccccgatgacaagaccgggccgattcttgataccgttctaaagccgctctggagcgcctatgcggttctcaagcgcgggcgtgacgcacgcgagccgctggaactcgatctgccggaaaagaaaatcctactgacgccggaaggcaaggtggacaaagtcatcgtgccggaacgcctcgatgcgcataagctcatcgaagaattcatgattcaggccaatgtgtctgccgccgaaacgctcgaaggacggcaccagccgcttattttccgcattcacggtgaaccggcgctggccaagcaggaaaccctgcgtgagttcctgcgtacgctggatctcaatcttgccaagggtgcgcaactgcagcccgcgcagttcaatcgcattctggcggcggtcgatggcacagaccatcaggaactcgtcaatcaggtcgtgctgcgcacccagagccaggccgaatacagccccgacaatatcggccattttggcctgcatctgcgccgttatgcgcatttcacctcaccaatccgccgttatgctgatctgatcgtgcaccgcgcgctcatcaaggcgctggggcttggcacggacgggttgacgagcgcggaagaagcgcagcttgaagagatttcggccctgatttcggccaccgaacgccgcgccatgctggctgagcgtgaaaccgtggatcggctgatcgcgcatttcctcgcctcgcatctcggcgacgaatatgaggggcgcgttaccggcgtcacgcgcgccggtctattcgtcaatcttgcgacatatggcgcagacggactggtgcccatttcaactttgggccatgaatattatctatatgacgaagcaaaccacgcaatcgcgggcgaacgaagcggcaggggctttcgtctgggcgatacggtaacggtgaggcttgtggaagcactccccgttgcgggtgcgcttcgttttgaaatggtttccgaaccgcaccccttgcccatgtcgacgcgctcgcatcataaggcgagccgggcaatgcggggccggaaaggcaagccggcgggtattccccgccacaagaggagaggtcactga

SEQ ID NO: 1777 - DNA, 2349 bp, Nitrobacter winogradskyi Nb-255
gtgagcaaaccgcgcgccaggaattttccggatcgcgaggccatcgtcgctttcatccgcgcgcatcccggccgggctggcacacgcgagatcgctcatgagttcggcttgaagaacgccgatcgcgccgaactcaagcatatccttcgcgcgctcgcggatgacggaacaatcgtgaaacggagccgcaagctgcggaagccggaaacgctgccgccaacgctggtagccgatattacggggcgagatcgcgacggcgaactgatcgccacgccgaccgaatgggacgatgaagcaacgcccgcgccgaggattctcattcatgtgccgcgtcgggcgaagcccggcaccgtggcaggcgtcggcgatcgtgcgctgctgcgcatcgagacaatcgagtccgacgaaaccgcaagctatcgcgctcgcgtcatcagggtcatcgatcgcacccgcgcgcgtatgctcggcatctatcgcgcgtcgcctcagggcggcggacgccttgtgccggtggacaagaagcaggccgggcgcgagctgaacatcgcgaaagccgacagcgcgggcgcggaggacggcgatctcgtgagtgtcgaactggtgcggacccgcggtttcggacttgcttctggcaaggtgaaggagcggcttggctcgctcgcgaccgaaaaggccgtcagcctgatcgcgatccacgcccatgacattccgcaggagtttacgccggccgccttgcgcgaagccgccgctgcgaagccttccgccttgcaaggtcgcgaagactggcgcgcggtgccgctcatcaccatcgatccccccgatgcgaaggatcacgacgacgcggttcacgccgcgccggacgatgatcccaacaacacgggcggcgccatcgtcaccgtcgccatcgctgacgtcgcctattatgtgcggcctgaatcggcgctggatcgtgaagctctggagcgcggcaattcggtctatttcccggatcgcgtggtcccgatgctgcccgagcgcatttcaaacgatctctgctcacttgttccgggcgaagcacgcggggctctcgccgtgcgcatggtgatcgacgccgacggacgcaagcgttcgcacacctttcatcgcatcctgatgcgctcggcagcgaagcttgcttactcgcaggtgcaggccgcgatcgacggcaacccggatgacgcgaccgcccccctgctcgaaccgatcctgaaaccgctctacgcggcctttgctctggtgaagcgcgcgcgcgacgagcgcgatccgctcgatcttgaattacccgaacgcaagattctgctgaagaaggacggaacggtcgatcgtgtgatcgttccggatcggctcgatgcgcatcggctgatcgaggaattcatgatccttgcaaacgtcgccgcggccgagatgctggaaaagaaagggctgccgctgatctatcgcgtgcacgacgagccgacggtcgagaaggttcacaacctgcgcgagttcctgaaaactctcgatatgtccttcgccagaagcggcgcgctgaggccggagttgttcaatcgcgtgctggatcaggtcaggggccatgattccgaatcgctggtgaacgaggtggttcttcgttcgcaggcacaggctgagtattcggcggagaactatggccactttggtctcaacctgcggcgctacgcgcatttcacatcgccgatcaggcgatatgcagatctcgtcgtgcaccgcgccctgctccgtgcgctcggtcttggcgacggcgcgctgccggattccgacaacgccgaaacgctcgccgaaatagccgcgcgcatttccgtcaccgagcggcgcgccatgaaggccgaacgcgagacggccgatcgcctgatcgcgcattttctcgccgaccgcatcggcaacatcttcgaggcgcgtatttccggtgtcacccgcgcagggcttttcgtgaagctggccgacaccggcgccgacgggctgatcccgattcgctcgctggggaccgaatatttcaagtacgacgagacccggcatgccctggtggggtcccgcagcggttccatgcacaagctgggtgacgtggtggaggttcgtctggtagaagctgtacccttggctggcgctctgcggttcgaactcttatccggagccgaggtgaggccgcgctccccccgcgcgcggggtggagggaaaataaagacgccgcgtggtcggaacgcgggtcatcctgatgttcattcgaaagcccatccgggccgtaaaccgcgcgggacatcgcgcaagccgggcaggagcaaggccggcaaaccgaagaagggcaaatcatga

SEQ ID NO: 1778 - DNA, 2352 bp, Rhodopseudomonas palustris HaA2
gtgagcaagacgcgcgacgacaagttcccggacaaggccacgctcctcgcctttatccgcgcgcatcccggcaaggtcggcacccgcgagatcgcccgcgagttcggcctgaagaatgccgatcgtgccgaactgaagcgccgtctcaaggaactgtccgacgacggcgcgatccgcaagagcggccgccgcaaggtcgccgagccggccaccctgcccccgacgctgttggcggatatcaccgcgcgcgatagcgacggcgaactgatcgccaccccgtctgaatgggacgagcaggacggcgagccgccgaagatccgcatccacaccccgcgccggcccaagcccggcaccgccgccggcctcggcgaccgcgcgctgctgcatgtcgagccggccgaggcgcccgagcaaggtcccgcttatgtcggccgcgtcattcgcgtgctcgatcgcggcaagccgcgcattctggggatttttcgcgccacgccgcagggcggcggccggcttgtcccggtcgacaagaagcaggccgggcgcgaactcaacatcgcgccgcacgatgccggcggcgcgcaggacggcgacctcgtcagcgtcgacctgatccgcagccgcggctatggcctgtcgtccggccgcgtcaaggaacggctcggctcgctcgcgaccgaaaaagccgtcagcctgatcgcaatccactcccacgacatcccgcaggaattctcgacgaccgcgttgcgcgaatccgaagccgccgagccggcgacgctgaagggccgcgaggactggcgcgagctgccgctggtgacgatcgatccgcccgacgccaaggaccacgacgacgcggtccacgccgagccggatcccgaccccaacaacaaaggcggcgtgatcctgcacgtcgcgatcgccgacgtcgcctactacgtgcggccggactcggcgctcgatcgcgacgcgctacggcgcggcaattcggtgtacttccccgaccgcgtcgtgccgatgctgccggagcggatttccaacgatctgtgctcgctgaagcccggcgagccccgcggcgctctcgcggtccgcatggtgatcggcgccgacggccgcaagcgctcgcattcgtttcatcgcgtgctgatgcgctcggccgcgaagctgaactacgcgcaggcccaggccgcgatcgacggccggcccgacgacaccaccggcccgctgctcgacacgattttgaagccgctctacgacgcctatgcgatcgtcaagcgcggccgcgacgagcgcgatccgctcgatctcgatctgcccgagcgcaagatcatcctgaagcccgacggcaccgtcgaccgcgtcatcgttccggagcggctcgacgcgcataaattgatcgaggaattcatgatcctcgccaacgtcgccgcggccgagatgctcgaaaagaaagcgctgccgctgatctatcgggtgcacgacgaaccgagcgtggagaaggtccacaacctcgtcgacttcctgaagacgctggatctgtccttcgccaagggcggagcgctgaagccggcgcagttcaaccgcatcctggcgatggtcaaaggcgaagacgccgagccgctggtcaacgaagtggtgctgcgctcgcaggcgcaggccgaatatgcctccgagaattacggccatttcggcctgaacctgcgccgctacgcgcatttcacctcgccgatccgccgctacgccgatctcgtggtgcaccgcgcgctgatccgcgcgctcaacctcggcgacggcgcgctgccgcagaccgagacggtggaaacgctggccgaagtcgcagcccagatctcactgaccgaacgccgcgcgatgaaggccgagcgcgagacggtcgaccggctgatcgcgcatcacctcgccgaccgcatcggcgcgaccttccagggccgcgtctccggcgtcaccaaggccggcctgttcgtcaagctgagcgacaccggcgccgacggactgattccgatccgcacgctcggcgacgagtattacaactacgacgaaacccgccacgcgctgatcggctcgcgcagcggtgccatgcatcggctgggggacgtcgtcgacgtccgtctggtagaagcagcccctgtggctggcgcgttgcggttcgagctattaagtgaatcgcgaagcgtcgcgcgcgggccacgcaagggagcgtacaagggtcgcgccaaggcggtggaaccggcaaagggcggcgccaaaatcgggcgcagcgcgcgaagcaaggccggcaagccgaaggctgcgaagccgtcgaagcgcaaggcgaacaagcccggaaagggaacgcgatga

SEQ ID NO: 1779 - DNA, 2373 bp, Rhodopseudomonas palustris BisB18
gtgagcacgaaaaagcgcgacaccagctttcccgatcgcgacgcgctcgtcgccttcatccgcgcccagccgggcaaggtcggcactcgcgaaatcgcccgcgcgttcggcctcaagaacgaggatcgcgtcgaactgaagcgggtgctgcgcgacctcgccgacgccggcaccatcaagcgccgcggcaagatcgtggccgaacccgaggcgctgccgccgacgttgatggccgatatcaccgcgcgcgacgatgatggcgaactgatcgccacgccgaccgagtgggacgagcagagcggcgagccaccgaagatccgcatccatgtgccgcgccgcgcggcgcccggcaccgcggccggcatcggcgaccgtgcgttgctgcgcgtcgagccgggtgcggaggcctatcgcgcccgcgtcatcaaagtcgtcgatcagaccaagacgcgcatccttgggatcttccgcgcgctgcccggcggcggcggacggctgattcctgtcgacaagaaacaggtcggccgcgaattcaacatcgccgccacggacgccggcggcgcgcaggacggcgatctggtcagcgtcgatccgatccgcacccgcggctatggtcttgcgtccggcaaggtgaaagagcgcttgggatcgctcgccaccgaaaaggcggtcagcctgatcgcgatccactcccacgaaatcccgcaggaattctccgctgaagccattcgcgaggccgacgccgccaagcccgcgagcctgaaaggccgcgaggactggcgcgaattgccgctcgtcaccatcgatccgcccgacgccaaggatcacgacgacgcggtgcacgccgagcccgaccccgatccgaacaacaagggcggctacatcctccacgtcgcgatcgccgacgtcgcctactacgtgcggccgcaatcggcgctcgatcgcgacgcgctcacccgcggcaattcggtgtacttccccgaccgcgtggtgccgatgctgccggagcggatctccaacgatctgtgttcgctgaagccgggcgaagcgcgcggcgccctcgccgtccgcatcgtgatcggcccggacggccgcaagcactcgcactcgttccaccgcatcctgatgcgctcggcggcgaaactgagctacgcgcaggcgcaggccgcgatcgacggacatcccgacgatacgaccggcccgttgctcaagccgatcctgcagccgctgtacgacgcctacgcggtggtgaagcgcggccgcgacgagcgcgatccgctcgatctcgacctgccggagcgcaagatcctgttgaagcccgacggcaccgtcgaccgcgtcatcgtcccggagcggctcgacgcgcataagttgatcgaggaattcatgatcctcgccaacgtcgccgccgccgagatgctggagaagaaggcgctgccgctgatctatcgcgtgcacgacgagcccagcgtcgaaaaggtgcacaacctggtcgaattcctcaagacgctggatctgtcgttcgccaagcagggcgcgctgcggccctcgctgttcaaccgcgtgctggcacaggtcaaaggccacgacgccgaacccttggtcaacgaagtggtgctgcgctcgcaggcgcaggccgaatacgcctcgcagaattacggccatttcggcttgaacctgcgccgctacgcgcatttcacctcgccgatccgccgctacgccgacctcgtggtgcatcgcgccttgatccgcgcgctcaatctcggcgacggcgcgctgcccgacaccgagaccgtggagacgctcgccgaagtcgcggcgcagatctcggtcaccgaacgccgcgccatgaaggccgagcgcgaaaccaccgaccggctgatcgcgcatttcctcgccgaccgcatcggcgcctcgttccaggggcggatttccggcgtcacccgcgccgggctgttcgtcaaactcgccgacaccggcgccgacggactgatcccgatccgcaccatcggcagcgagtacttcaactacgacgaaacccgccacgcgctgatcggaacccgttccggtaccatctatcggctcggcgacgtggtcgacgtgcggctggtggaggccactcccgtggccggcgcgctgcgctttgaactgttgggcgacggcggcgttgttgcgggcggccgtccgcgtccccatattcgtagccgtggggcggcgtcgtcggagccccgcagcaaggcccaccccggacgcaatccgagcaaagccaagaaagacaagaagtccaagccgccgaagcgcgaccgcaagagcaagatcaagaaagccaacaaggccaaaggcggaacacccggcaagccgaagaagggctga

SEQ ID NO: 1780 - DNA, 2346 bp, Rhodopseudomonas palustris BisB5
gtgagcaagacgcgcgacgcaactttcccggacaaggccacgctcgtcgccttcatccgcgcgcatccaggcaaggtcggcacccgcgagatcgcgcgggagttcggcctgaagaatgctgaccgcgccgaactcaagcggatgatccgcgaattgtccgacgacggcacgatccgcaaaagcggccggcgcaagatcgcggagcccgctgccctgcccccgaccttgctggcggacatcaccgcgcgcgacagcgatggcgaactgatcgccacgccggcggaatgggacgagcaggatggcgatccgcccaggatccgcatccacgttccgcgccgcgccaagccgggcaccgcagccggcctcggcgatcgtgcgcttctgcatgtcgagccggcggaagcgtccgacaacggaccggcctatgtcggccgcgtcatccgtgtgctcgaccgcggcaagccgcggattctcggcattttccgcgtccagccgcagggcggtggccggctggtgccggtcgacaagaaacaggccgggcgcgaactcaacatcgccgcgcacgatgccggcggcgcgcaggatggcgatctcgtcagcgtcgaactgatccgcgcccgcggctacggattgtcgtccggccgggtgaaggaacggctcggctcgctcgcgaccgaaaaggcggtcagcctgatcgcgatccactcccacgacattccacaggaattcgcccccgcggcgctgcgcgaatccgaagccgcagagcccgcgacgctgaaaggccgcgaagactggcgcagcctgccgctggtgacgatcgatccgcccgacgccaaggaccacgacgacgcggtccacgccgagcccgaccccgatcccgccaacaaaggcggcgtgatccttcatgtcgcgatcgccgacgtcgcctattacgtgcggccggagtcagcgctcgatcacgacgcgttgcggcgcggcaattcggtgtacttccccgaccgcgtcgtaccgatgctgccggaacggatctccaacgatctgtgctcgttgaagcccggcgagccgcgcggcgcgctcgcggtgcggatggtgatggacgccgatggccgcaagcgctcgcactcgttccaccgcgtgctgatgcgctcggcggcgaagctgaactacgcgcaggcgcaggccgcgatcgacggccaccccgacgacgtcaccggcccgctgctggagacgatcctcaagccgctgtacgacgcctatgcgatcgtcaagcgcggccgcgacgaacgcgaccctctcgatctcgatctgcccgagcgcaagatcctgctgaagcccgacggcacggtcgatcgcgtcatcgtgcccgagcggctcgacgcgcacagattgatcgaggaattcatgatcctcgccaatgtcgctgcggcggaaatgctggagaagaaggcgctgccgctgatctatcgggtgcacgacgaaccgaccgttgagaaggtccataacctcgtcgacttcctgaagacgctcgatctgtccttcgccaaaggcggcgcaatgcgaccggcgcagttcaatcgcatcctggcgatggtgaagggtcacgacgccgaactgctcgtcaacgaagtcgtgctgcgctcgcaggcgcaggcggaatacgcctcggagaattacggtcatttcggcctgaacctgcgccgctacgcgcatttcacctcgccgatccgccgctacgccgatctcgtggtccaccgcgcgctgatccgcgcgctcgatctcggcgacggcgcgttgccacaaaccgaaacggtggaaacgctcgccgaagtcgcggcgcagatttcggtgacggaacgccgcgccatgaaggcggaacgcgagaccgtcgaccggctgatcgcgcatcacctcgccgaccggatcggcgcgaccttccagggccggatttccggggtcaccaaggccggtttgttcgtcaagctgagcgacaccggcgccgacgggctgatcccgatccggacgctcggcgacgaatactacaactatgacgagacccgccacgcgctgatcggctcgcgcagtggtgccatgcatcggctgggggatgtcgtcgacgtccgtctggtcgaagctgcaccggtggccggcgcgctgcggttcgaactgctcagtgaatcacgcagcgtcgtgcgcgggcagcgcaaaggcccacacaagaccaaagggaaggaacaggcgacgagcaaagccgccatcgggcgcagctcgcgcggcaaggcccgcaaggcgaaggtcgccaagccgccgaagcgcaagccgaacaagcccggaaagggaaagcgatga

SEQ ID NO: 1781 - DNA, 2373 bp, Nitrobacter hamburgensis X14
gtgctggcaagaacggctgacgtgagcaaactgcgcgacaagcgttttccagaccgcgagaccatcgtcgccttcattcgcgcccatccgggccaagccggaacacgcgagatcgcccgcgagttcggcctgaagaatgcggatcgcatcgcactcaagcaaatcctgcgcgatctcgcggacgacggcacgatcgtcaaacgaggccgcaagctgcagcaggcggaaacgctgccgccgacgctgatggccgatatcaccggacgcgatagcgacggcgaacttctcgcgacgcccaccgaatgggacgaggaagcaggcccccctccaaaaatccgcatccatgtgccgcgccgcatcaagcccggcaccgcggccggcgtcggcgaccgcgcgctgctgcgcatcgaagcgatggagcccgacgaatccgcacgcttccgtgctcgcgtcatcaaggtgatcgatcacacccgcgcgcgtatcctcggcatttatcgcgccttgcctcagggcggcggccgcctggtgccggtcgacaagaaacaggccggccgcgagttgaacatcgcgaaagccgacaacgccggcgcggaggacggtgatctcgtcagcgtcgaacttgtgcgtacccgcagtttcggtcttgcgtcgggcaaggtgaaggagcggctcggctcgctctcgaccgaaaaggccgtcagcctgatcgcgatccacgcccatgacattccgcaggcgtttgcgccggctgccttgcgtgaggccgaggctgcgaagcccgcgaccctgcggcaccgcgaagactggcgcgcgttgccgctcgtgaccatcgacccgcccgatgccaaggatcacgacgacgcggttcacgccgcgccagacgacgatccaaacaacaaggacggcgccattgtcaccgtcgccatcgccgacgtcgcctattacgtgcggcctggatcgtcactcgatcatgatgcgctgacgcgcggcaactcggtctatttccccgatcgtgtggtcccgatgctgccggagcgcatctccaacgatctctgctcgctggtgcccggcgaagcgcgcggcgccctggccgtgcgcatggtgatcggtcccgacggccgcaagcgttcgcatacgtttcatcgcatcctgatgcgctcggcggcgaagctgaactacgcgcaggcgcaggccgcgatcgacggcaaccccgatgatgccaccggccccctgctcgaaccgatcctgaaaccgctttatgcggcctatacgctggtgaagcgtgcgcgcgacgagcgcgatccgctcgatctcgagctgcccgagcgcaagattctcctgaagacggacggcacggttgaccgcgtcgtcgtgccggagcgtctcgacgctcaccgcctgatcgaggagttcatgatcctcgccaacgtcgccgccgcggagatgctggagaagaagggcctgccgctgatctatcgggtccatgacgagccgacggtggagaaagtccacaaccttcgggagttcctgaaaacgctcgacatgtccttcgccaagagcggcgcgctgaggcccgagttgttcaatcgcgtcctcgatcaggtcaagggctacgactccgagtcgctggtgaacgaggtggtgctgcggtcgcaggcgcaggctgaatattctgcggagaactacggccacttcggcctcaacctgcggcgctacgcgcatttcacctctccgatcaggcggtacgcggacctgatcgtgcaccgcgccctgatccgggcgctcggccttggcgacggcgcgctgccggacgccgagacccccgagacgctggctgaaatcgccgcgcagatttccgtcaccgaacgccgcgccatgaaggcggaacgcgagaccgccgaccgcctgatcgcgcatttcctcgccgaccgcatcggcaatatcttcgagggccggatttcgggggtgacccgcgcgggcctgttcgtaaaactgaccgataccggcgcagacgggttgatcccgatccggtccctgggcacggaatatttcaactacgacgaggcccgccacgcgctggtcggctcgcgcagcggttccatgcacaagcttggtgacgtggtcgaggttcgtctggtagaagctttacccttggctggcgccctgcgtttcgaactcctatctgggggacatgccgggccacgcgatcaccgcgcgcgcggcggccggaacacgaaggggcagcgcggtccgcaggacacgcggcatcccggcgtccattcaaaggcccatccgggccgcaaaccgcgcaaggcatcgcgcaagccgggcaagagcaaggccggcaaaccgaagaagggcaaatcatga

SEQ ID NO: 1782 - DNA, 2298 bp, Mesorhizobium BNC1
ttggcgcgcaagaactcgaaagcggcaggaggggaaggtgcttccgccaatcctcacctgccttcgcgcgaagagatcctgcgcttcgtcagcgaaaatcccgaccaggccggaaagcgcgagatcgccaaggcattttcgctgaagggcggcgaccgcatctggctaaaggagatgctgagggacatgcaaaatgacgggcttctgaaacagaagcgccgtcggctctcccggccgggctcccttcccccgatggtcgtcctcgacattttctcgcgggatgcggaaggagggctcctggcgcggccggctgaactggaggatgaggacggtcccatcccgctcgtttccatccgcccgcagcggggcggccgctcccccgcagccggcgtgggcgaccgtgtgctcgcccgcgtgtttgcgagcaaggaggaaggcggcccggcctataccggccgggtggtcaagcttttcgaaaagcgccggcgggcagtgctcggggtcttccgtgaaatgcctgatggtaccctccgcatagagccggtggagcgccgccagcccgagctggtcgtggatgaggcttcccgcaagggcgcgaaaagtggcgatctcgtagaggtggagccgctatcgcaagggcgctacggcctgccgcgcgcgagggtgctggaggtggtggggtcaatcacgacggaaaaggcggtctcgatgatcgccatccatgcccacgagatcccccacatttttccggaaagcgtggtgaaagaggccgaaagcgtcaagccggccacgcttgaaggacgtgaggattggcgcaagctgccgcttgtgaccatcgatccggccgacgccaaggaccatgacgatgcggtctatgccgaggccgacacggatgagaagaatccgggcggcgtggtggtaaccgtcgcgatcgccgacgttgcctgctatgtgcggcccgactccgcgctcgaccgcgaggcgcttaacaggggaaattcggtttatttccccgaccgcgtcgtgccgatgctgcccgagcgcatatcgaacgacctgtgctcgctgcgcgaaggggaagccaggcccgcgcttgccgtgcgcatgcgctttacctcgggcggccgcaagatcgggcactcttttcatcgtgtcatgatgcgctccgcggcgcgcctttcctacgaacaggcccaggcggcgatcgacggacggccggatgacaagacagggccgctgcttgaaccggtgcttcgcccgctctggaatgcctattcggtgctcaagcgcggcagggaagcgcgcgagccgctggaactggacctgcctgaacggaaaatcatcctgaagcccgatggcacggtggatcgcgtggtggtgccgccgcgcctcgatgcgcacaagctcatcgaagagttcatgatccaggcgaatgtggcggcggctgaaacactggaatcggtccgccagccgctcgtctaccgcgttcacgacgccccttcccttgcaaagcaggaatcgctgcgcgagttccttggctccctggaaatctcgctggcgcatggagcggcgttgaggccggcgcagttcaaccgcatcctcgcgcatgtggcgggcactgagcaggagcagctcgtcaacgaggtggtgctgcgctcgcaaagccaggcgatctatgcccgcgagaatatcggccatttcgggctcaacctgcgccgctatgcgcatttcacctcgccgatccgccgttacgcggacctcatcgtgcatcgggctttgatcacggcgatgaatttcgggccggacggcttgagggaggcggacgaggagcggctggaggaagtttccgctctcatctcggcgaccgaacgacgcgccatggcagccgagcgggagacggtggaccgccttatcgccgagcatctggcgggccgcatcaacgaggaattttccgcgcggatttcgggcgtcaccaaggccgggctcttcgtgctcctgcctcaatacggcgcggacggcttcgttcccgtttcgtcgctgggggacgactactatatctttgacgaggtgcgccatgcgctcgtcgggcagcgcagtgggtgcggctatcagctcggcgacagcgtggatgttcgtctgctagaagtagcaccgcttgcgggtgccatgcgctttgaagtcctgaccagccccacccgcctgcccggttcctccaaatctttccataaggcgagacgcggatcggcccggaaccagaaacgcccaagccgctccacggttaggggcaggagacgatga

SEQ ID NO: 1783 - DNA, 2379 bp, Bradyrhizobium BTAi1
atgatcaaaaagagcgacatcggcctccctccgcgggaggccatcgtcgccttcatccgcgccaatccgggcaaggttggcaccaaggacatcgcccgcgcgttcggcctgaagaacgccgatcgcgccgcgctcaagcagttgctgcgcgaactcgtcgccgacggcaccgtcaagaagagcggccgcaagaagatcgtcgagcctgcgaccttgccggcgacgctggtggcggacattaccggccgcgacagcgatggcgagctgatcgccaagcccgccgaatgggacgaggcggagcaatccgagccgccgcgcatccgcatccacacgccgcgccatgcgcggcccggcgcgacggccggtgtcggcgaccgcgcgcttgttcgcgtggagccgatcaacgacgccgagggcatcgcctatcgcggccgcgtgctgaaggtgctcgatcaggcgcgcaaccgcgtgctcggcatcttcaaaagcaatccaggcggcggtggccgcctgatcccggtcgacaagaagcaggcgggacgcgagctctcgatcgcccccgatgacaccaaggacgccaaggacggcgacctcatcagcgtcgacctgctgcgcgggcgcggctatggcctgcccgcaggtcgggtgaaggagcgcttcggctcggtcgcgaccgagaaggcgatcagcctgatcgcgatccatgcccacgagatcccgatggacttctcggccgcggcgatcgccgaggccgaggccgcgcagcccgcgaccctgaagggccgtgaggactggcgcgagctgccgctcatcaccatcgatccgcgcgacgccaaggatcacgacgacgcggttcatgccgagccggatgccgatccgagcaatgccggcggcgtcatcgtccatgtcgcgatcgccgacgtcgcctactatgtgcggccgggctcggcgctcgatcgcgacgcgctgatccgcggcaattcggtgtacttccccgaccgcgtcgtgccgatgctgccggaacgcatctccaacaatctgtgctcgctggtgccgggcgagccgcgcggcgcgctcgccgtgcgcatggtgatcggtgccgacggccgcaagcgctcgcactcgttccaccgcgtgctgatgcgctcggcggcaagactgtcctacgcgcaagcccaggccgcgatcgacggcaagccggacgacatcaccggtcccctgctcgagccgatcctgaagccgctctacgcggcctacgaggtcgccaagcgcggccgcgacgcgcgcgatccgctcgacctcgacattcccgagcgcaagatcctgctcaagaaggacggcacggtcgaccgcgtcgtcgtgcccgagcggctggacgcccacagactgatcgaggagttcatgatctcggccaacgtggccgcggccgaactgctggagaagaaggcgctccccttgatctaccgcgtgcacgacgagccgacggtggagaagatccatgcgctgcaggaatttctcaagacgctcgacgtacccttcgccaagagcggagcgctcaggccgtcgctgttcaaccgcgtgctgacgctcgtcgcgggccaggactatgaacatctcgtcaacgaggtcgtgctgcgctcgcaggcgcaagcggaatactccacggacaattacgggcatttcggcctcaatctgcgccgctacgcccatttcacctcgccgatccgccgctatgccgacctcgtcgtgcatcgcggcctgttgcgcgcgctgaatctcggcgacggcgccctgcccgacagcgagacgccggatcatctcgccgaggttgcggcgcagatctcggtcaccgagcggcgcgcgatgaaggcagagcgcgagaccgccgaccgcctgatcgcgcatcacctcgcggaccgcgtcggcgccaccttccagggccgcatctccggcgtcacccgcgccggtctcttcatcaagctcgacgacaccggcgccgacggcctggttccgatccgcaccctcggcacggaatatttcgactatgacgaaacccggcatgcgctgatcggccagcgcagcggtgccatgcatcggctgggtgacgtcgtcgacgtgcgtctggtagaagctcaaccggtggccggcgcgctgcgcttcgaattgctgacacaggccgatgtcctggtgtcgcggcatccgcgtggcgcaggccccaggcgcaagagtaccgccaagaggaataccaagacgaaagccaaggcgacccaagccgacgctcgtccgcggcacaaggaaaaaagccgcaagaaaaaccaaaaggcaggcgcaaaacgcaagcccggcacatcgaagaaaggcagatcatggacgccatga

SEQ ID NO: 1784 - DNA, 2352 bp, Brucella ovis
ttggcacgccgtttttccaaatccgataccggacgatccgcacggaccgagcggcgtgcagccacagcccaatcgaaagattccgcagcctttttgccgacacgggaagaggtcctcaaatatatcgaggaaaatcccgatcgcgcgggcaagcgggaactcgccaagactttcaacatcaagggcgatgcacgggtctatctgaaagacctgttgcgtgagcttgccgatgaacgtctcgtcgaaaagcgcgcgcgcaagctttcgcgtcccggctcgctgccatcggttgcggttctcgatattacgggccgggatgaggatggaggcctgcttgcccgcccggctgaatgggatgaggcgagccacggcaagccgccagtggtcctgctgcggcgaacccggcttaacaagacgtcagaaagtggccctgtcgtcggcgttggcgaccgcgttctggcgaaaatcttccgcaatgaagatcacgcagggccggatttttccgcccgcgtgatgaagcggctggaacatcacgccaatgccgttctgggcgtggtgcgcaaacttggcaatggcgaatggcggctggagccggtcaatcgcaaacagggcgaagtgcagcttgatcccgccatgctggaaaatgccgaaagcggcgatctggtggaagtagaactgctttccgcgcgccgttacggcctgccgcgcggcaaggtccgtcaggtggttggctccatcgatagtgaaaaggcgctgtcgatgatcgccattcacgaacatgaaatcccgcatgtttttcctgacgaagtgctgcgcgaggctgaaaccgcaggccctgccacgctggaaggccgcgaagactggcgcgaaatcccgctcatcaccatcgatccggccgacgccaaggaccatgacgatgcggtctatgccgaaccggatacggacccggaaaatcccggcgggcaagtcgtcatcgtcgccatcgccgatgtcgccgcctatgtgcggcccggctcagcccttgatcgcgaagcgcagaaacgcggcaattccgtctattttcccgaccgcgttgtaccgatgctgcccgaacgcatctccaatgatctttgctccctgcgcgagatggaagaccggccggcgctggcggtccgtatgattttcagtgccgacgggcgcaagaaatcacacaagttccaccgcatcatgatgcgctcggccgccaaggttgcctatggccaggcgcaagccgccatagacggcgcccccgatgacaagaccgggccgattcttgataccgttctaaagccgctctggaacgcctatgcggttctcaagcgcgggcgtgacgcacgcgagccgctggaactcgatctgccggaaaagaaaatcctactgacgccggaaggcaaggtggacaaagtcatcgtgccggaacgcctcgatgcgcataagctcatcgaagaattcatgattcaggccaatgtgtctgccgccgaaacgctcgaaggacggcaccagccgcttattttccgcattcacggtgaaccggcgctggccaagcaggaaaccctgcgtgagttcctgcgtacgctggatctcaatcttgccaagggtgcgcaactgcagcccgcgcagttcaatcgcattctggcggcggtcgatggcacagaccatcaggaactcgtcaatcaggtcgtgctgcgcacccagagccaggccgaatacagccccgacaatatcggccattttggcctgcatctgcgccgttatgcgcatttcacctcaccaatccgccgttatgctgatctgatcgtgcaccgcgcgctcatcaaggcgctggggcttggcacggacgggttgacgagcgcggaagaagcgcagcttgaagagatttcggccctgatttcggccaccgaacgccgcgccatgctggctgagcgtgaaaccgtggatcggctgatcgcgcatttcctcgcctcgcatctcggcgacgaatatgaggggcgcgttaccggcgtcacgcgcgccggtctgttcgtcaatcttgcgacatatggcgcagacggactggtgcccatttcaactttgggccatgaatattatctatatgacgaagcaaaccacgcaatcgcgggcgaacgaagcggcaggggctttcgtctgggcgatacggtaacggtgaggcttgtggaagcactccccgttgcgggtgcgcttcgttttgaaatggtttccgaaccgcaccccttgcccatgtcgacgcgctcgcatcataaggcgagccgggcaatgcggggccggaaaggcaagccggcgggtattccccgccacaagaggagaggtcactga

SEQ ID NO: 1785 - DNA, 2370 bp, Sinorhizobium medicae WSM419
ttgaccaggattccgcgcgacccgaccgatacgcccgcaaagggtgcaggcaagaaaaacggccgcgcggcgaggacggcaccggccggggagaaggagacgatcgtccagggcgccgttccttcccgcgaggtgctgatgcgcttcatcgcggagaacccgcagcacgcctcaaagcgcgatatcgccaaggcattcggcctcaagggcgaggcacgggtggagctcaagacgctgcttcgttcactcgaggcagacgggctcgtggagaagaagcgaaagtcgttgatccgccccggcgggctgccgccagtcaccgttctggacattaccattcgcgacatcgacggcgatctgatcggccggccggccgaatggcttgacgatgacggggtcgcgcctgcggtcctgatcaagcagtcaagcatcgccagggccaagggcaaaacgccggtcggtggcctgggcgaccgggtgctcgcgaagattttcccctctaaggagcgcgggggccctgcctataccgcgcgtatcatcaaggtgctcgacaagcgaaaagatgcggtgctcggcgttttccgtgcgacgccgggtggcggcggccggctgatgcccatcgacaagcgcggcgaggaactgctcatcgatccggagtttacgggcgacgccaaggaaggcgatctcgtcgaggcgcatctttcgcgcatcggtcgctacggcctgccccgcgcccaggtgcagaacgtcatcggctcggtagcgtccgaaaaagcaatctcgatgatcgcgatccacgcgcatggaatccctcacgtctttccggagcgggttttgcaggaggcggacgcagcacagcccgcaaccatgtcgcatcgcgaggactggcgctcccttccgctcatcaccatcgacccggccgatgccaaggatcacgacgacgctgtctatgcggagcccgacccgtcgccggacaatcccggcggcgtcatcgtcacagtcgcgatcgccgacgtctcctggtacgtcagggcaaggtcggcactcgatctcgaggcgttgaaacgcgggaactccgtctatttcccggatcgggtcgtgccaatgctccccgaacgtatctcaaacgacctctgctccctgaaggaggacgtcgaccgaccggcgcttgcggtccggatgcgcttttcaaaggaaggccgcaaggccggtcataccttccaccgcatcatgatgcgaagcgcggccaagctctcctaccagcaggcgcagaccgcgattgacggtgcgccggacgaaaagaccgggcccattctggaaacgatcctcaagccgctgtgggaagcctatcgcattctcacgcgcgggcgggagcggcgccagccgctcgaactcgacgtgccggaacgcaagatcatcctgaagccggacggaacggtcgatcgtgtgttcgtgccggaccgccttgacgcgcacaagctcatcgaagagatgatgatccaggcgaatgtggccgcggccgagacgctggaacagaaacgccaggttctgatctaccgagtccacgatcaaccgtcgctcgccaagcaggagagcctgcgtgaattcctggccacgctcgatatctcgctcgccaagggcggcaacatgcgggcgaaccacttcaacggcattctcgccaaggcggacggaaagcccttcgagacgattgtcaaccagatggtgctgcgctcgcaaagccaggcgatctacagcccggaaaatatcggccatttcggcttgaacctgctgcgctatgcgcacttcacctcgccgatccggcgttatgccgacctgatcgtgcatcgcgcgctcgtctcctcgctcgggctcggcgaagggggcataacgcccgaagaagaaggcaccctcgacgatatcgccgccgaaatttcgacctttgaacggcgcgcaatggccgccgagcgcgataccaccgatcggctgatcgctcatcatctgaatggccgcgtcggcgaggagttcgaaggacgtgtttccggcgtcacaaaggcgggactttttgtcaccctcccctcctatggcgccgacgggttcatccctatatctacgctcggacgcgactatttcatctatgatgaagcgcaccaggccctctccggcgagaaaacgggactgggctaccgcctcggggacccggtgcaggtcaaacttgtcgaagcggtgccgctggccggcgcactccgtttcgagatgctgagcgaggggcgaaaaatgccgacggcaatgcgctcgttccacaagtcgggccggcgcgatcgaactggtgcgcgcaaacggcccgggacacgagcgcctcgcggcaggcaatga

SEQ ID NO: 1786 - DNA, 2364 bp, Ochrobactrum anthropi ATCC 49188
ttggcacgccgtttttccaaatccgataccggtcgatccgcacggaccgaacggcgtgcagccaaagcaaaatctgccgatgggaacagcgatcccaatgcgtttctgccaacccgcgaagaggttctcaaatatattgaagagaatcctgaccgggcaggcaagcgcgaactggcaaaagcattcaacatcaagggcgatgcgcgggtttatctgaaagatcttctacgcgaactttctgatgagggtctggttgaaaaacgcgcccgcaaactgtctcgccctggcgcactacctgccgttactgtgcttgatattacaggacgcgacgaggatggcagcttgctcgcacgtccgtcggaatgggacgaggccggttacggcaaaccacctattgtcctgatccgccgcacccgattgaataaagcttcggaaggcggtcccgcagtgggcgtcggggatcgcgttctggcgaaaatattccgcagtgaagatcgcgacggaccggattataccgcccgcgtcatgaagcgtctcgagcaccgcacgaacgcggtgctgggtattgttcgcaagctcggcaacggtgaatggcggttggacccggtaaacagaaaacagcctgaggtgcagctcgatccggcacagctggaaaatgctgaagccggtgatcttgttgaagtggacctgatttcctcgcgtcgtcagggattgccgcgcggcaaagttcgacaggtggttgggtctatcgatagcgaaaaagccctgtcgatgattgccatccatgagcatgaaattccgcatgttttcccggctgaagcgctgagcgaagcagaagccgcccagcctgcgacgatggacggtcgggaagactggcgcgacattccgcttctcaccattgatccggctgacgccaaagatcatgacgacgccgtttacgccgagccggacaaggatcctgagaatccgggcggccagattgtcatcgtggctatcgctgacgtcgccgcctatgtccgtccagattccgcgcttgatcgtgaagcacagaagcgcggtaactcggtctatttcccggacagggtcgtgccgatgcttcccgaacggatttcaaacaatctttgctcgctgcgcgaactggaagatcgccctgcccttgcggtccgtatgatctttgcggctgacgggcgcaagaaatcgcacaagttccatcgcatcatgatgaaatcggcggttaagcttgcctattcgcaagcccaggctgccattgacggcgcgccggatgacaagaccacgcccattctcgacggcatactaaaaccgctgtggggcgcctatgctgtgctgaagcgtgggcgcgatgctcgcgaaccgctggaactcgatttaccggaaaagaaaatcctgctcacgcccgatggcaaggtagacaaggttatcgttcctgaacggctcgatgcacacaagcttatcgaagagttcatgattcaggcgaatgtcgctgctgcagaaacattggaagcgcaccgtcagccgttgattttccgcattcatgatgctccggctcttgccaaacaggaaaccctacgtgaattcctgcgtacgcttgatctgagtcttgccaaaggcgcggagctgcaacccgcgcagttcaaccggattcttgaagccgttgaaggctcggatcatcaagaactggtcaatcaggtcgtgctgcgcacacaaagccaagcggaatataaccctgataatatcggacatttcggcctgcatttgagccgctatgcgcatttcacctcgccgatccgccgttatgccgatctcatcgttcaccgcgctctgatcaaggccctgaaccttggaagtgacggactaacgacagaggaggaagcgcatctcgaagaaatctccgcgctcatctcctcgaccgaacgtcgcgccatgctggccgagcgtgaaactgttgaccgtctcattgcacattttctcgccgcacatcttggagacgaatatgaagggcgcgtgacgggcgtaacgcgggccggtcttttcgtgaaccttgcgacatatggcgcggatgggctggtacccatttcaactttaggtcatgaatactatttatatgacgaagcgaaccatgcgattgccggtgaacggagcggtaaaggcttccggcttggtgatacagtgacggttcggcttgtagaagcgctccccgttgcgggcgcgcttcgctttgagatggtttcggaaccgcatcccctgccgatggcgacccgctcgcatcataaggcaagccggacgatgcgtgggcgaaggggtaaacccgcgggtattccgcgtcagaagagaagaggtcgctga

SEQ ID NO: 1787 - DNA, 2349 bp, Parvibaculum lavamentivorans DS-1
ttgccctcacgcaagcccccgaaaaagaccggcgccgcgaaaaaagacaccggctcgaaaaagaaagcccggggccttccctcgcgtgaggaggtgcttgccttcctcgccgacaatcccggcaagaccggcaagcgcgagatcggccgcgccttcggcgtgaagggcgacgaccgcatcggcctgaagcagatgctgaaggccatgtcggacgaaggtctgatcgcgaaggatgagacgaagagcctccgccgcgtcggcgaaatgccgccggtaacggtcatcgaaatcacccacaccgataccgatggcgaattgatcgcccgccccgtctcctggcccggcgaagacctgccccctctcatcgtcgtcacgcccgatacgcggcgcggcaagcgcgatgtcgacgagccgcctgccggtgtcggcgaccgcgtcctcgctcgcgtcgcgaagtcggaagacgaaacctacccctatgaagcgcaggtcatccgccgcgtcggcaaaggcgcggagcgtgtgctcggcctcttccgtctcacgcccaaagccaaaaccgcacgcctcatccccgtcgacaagaagatgcgcgtcgaattcgagatcgccatcgaagatattggcgacgcggaagacggcagcctcgtcctcgccgaaaccattcccggcaagcgttacggcgtcccccgcgcccgtgtccgcgaagtcttcggcgatatcgcagacccgcgctcgatcagcctcatcgccatccacacccacggcatcccggattcctttccggatgccgtcatcgccgaagccgaagccgccaggcatcagggcctcaagggccgcacggatctccgcgacatccccctcatcaccatcgaccccgccgatgcgcgcgaccatgacgacgcggtctgggccgcccccgacaccgatccgaaaaacgaaggcggcatcgtcgccatcgtcgccatcgccgatgtcgcggcctatgtccgtcccaattccgcgatggaccgcgaggcgctgaagcgcggcaactccacctacttcccggaccgcgtcgtgccgatgttgcccgagcgcatctcgaacgacctctgctcgctgatcgaaaaggaagaccgcgcctgcctcgccgtccgcatggtcttcgaccgcaacggcaacaagcgcggtcatgagttcatccgtggcctgatgaaatccgccgccagcctcagctaccgccaggtccagcaggcaatcgacggaaacccggacgatgccaccggcccccttctcgaacccgtgctgaaacctctatgggacgcctaccgcatcctcgcgaaggcccgcgaggcgcgcggcccgctcgatctcgatctccccgaatacaagatcgacatcgacgagaaaggcggcgtcggcggcatccgtatcggcgagaaattcgaatccatgaaactcatcgaggagttcatgattcaggcgaacgtctgcgccgccgaaaccgccgaggcgcagcatcgtcccgtcatctatcgcatccacgacgccccctcgcgcgagaagctcgtggcgctggccgaattccttgccacgctgaacctgagcttcgccaagggcgagaacatccgcccggcaaacttcaaccgcatcctgaaagccgtggacggcaccgagcatgatcagatggtgtcggatgtcgtgctgcgctctcaggcgcaggccgtctatgcgccggacaatatcggccatttcggcctcaatcttcgccgctacgcgcatttcacctcgcccatccgccgctatgccgacctcacggtccaccgtgcgctgatcgccggcctcggcctcggaaaagacggccagacggaggacgaaacatcctccctcaccgaaatcgccgaacacatctcgacaaccgagcgccgctccatgctcgccgaacgcgactcgaaggaccgcttcatcgccgcattccttgaggcccgcatcggcgccgagttccgcggccgcatcgccggcgtcacgcgcttcggcctcttcgtgaagctgaacgacaccggcgccgatggtttcgtcccgatctcgacgcttggcggcgatttctaccaccacgacgaaatcctccacgccctcaccggcgagcgcaccggcaagacctaccgcctcggtgatggcgtcctcgtccgcctggaagaatgcgtccccgtcaccggcggcatgcgcttcacgctcctcgaaggtggcagcgagggcaaacccgccgggccccgcccccgttccggccgccgccccactggcaagggcggctcccgccagggcgagaagaaccggaagccgaaatcctcccctcgaaagcgccgctga

SEQ ID NO: 1788 - DNA, 2331 bp, Xanthobacter autotrophicus Py2
atgcccacgaaagagcaggtgctggccttcatcgccacccagagcggcgaagtgggcaagcgcgagatcgcccgcgccttcggcctcaacgcggcgcagaagatcgagctgaagagcctgctgcgcgacctcgccgacaccggaacggtggagcgcagccgccgccggctgcacgtgcccggcgccctgcccggcgtggtgctggccgacatcgtctcccgcgatggcgacggcgagctgatcgccgtgccggtggagtgggataccgagacccagggcgacgcgccgcccatccttgtccaggtgccgcgccgcgccgtgggccccgcccccggcctggccgaccgggtgctgctgcgcatcgtggaaggctccatcgagcatggcgttgcccatgtgggccgcgtcatcaaggtgctggagaaggcgcgcaggcagaccatcggcatcttccgtgccgcccccggcggggaaggcggcgggcgcatcatccccatcgacaagaagcagctcggccgcgagcttcaggtgcccccaggcgccgagcacgaggccagggatggcgacctcgtcaccgtcgaattgatgcgccagcgggtgttcggcctgcccaccgcgcgggtgaaggaaaagctgggttcgctgagctccgagaaggcggtgagcctgatcgcgctgcacgcccacgccatcccccacgtcttccccgaggcggtgctgaaggaggccgaggcggcaaaacccgtcaccccgcgcggccgcgaggactggcgcgatgtgcccctcgtcaccatcgacccacccgacgccaaggaccatgacgatgccgtccacgccgtggccgacgacgatccggccaacgacggcggcttcatcgtcacggtcgctatcgccgatgtgtcggcctatgtgcgtcccggctcgccgctggaccgcgaggcgctgatccgcggcaattcggtgtatttcccggaccgcgtggtgcccatgctgccggagcgcatctccaacgacctgtgctcgctgcgcccgaaggaggaccgcccggcgctggcggtgcgcatgatcatcggcgcggacggcaggaagcgccaccacaccttccaccgcatcctcatgcgctcggcgggcaagctcgcctatgcccaggcccagaacgccatcgagggccgcaccgacgacaccaccgacccgctgctcaacggcgtgctgaagccgctctacgccgcctatgactgcgtgaagaaagcccgcgacgcccgccagcccctcgacctcgacctgcccgagcgcaagatcgtgctgaaggaagacggcaccgtggaccgcgtggtggtgccggagcggctcgacgcccaccggctcatcgaggagttcatgatcctcgccaatgtggccgccgccgagacgctggaggagaagaagacccccctcatctaccgcgtccatgacggcccctcgctggagaagctctccaacctgcgggaattcctgaagaccctggacatcgccctggccaagatcgaccaggtgcggccctcccacttcaaccgcatcctggcgcaggtgaaggacaccgacgcggcgccgttggtcaaccaggtgatcctgcgcagccagagccaggcggaatatgcctcggagaattacgggcatttcggcctgaacctgcgccgctacgcccatttcacctcgccgatccgccgctatgcggatctggtggtgcatcgcggcctggtgcgggccatggatttcggctccgacggcctgcctcccgacgcgaccaccgcgacgctgggcgaagtggcagccgccatctccgtcaccgagcgccgcgccatggcggccgaacgggagaccgtggaccggctcatcgcccatcatctggccgaccagatcggcgccaccttcaacgcccgcatcaccggggccaccaaggcgggactcttcgtcgcgctcgacattaccggggcagatggcttcattccggcctcaacgctggggcaggattattatcgctacgacgaaacccggcaggccctggtgggcgagcggagcggcgaaatgcaccgcatcggcgaccgggtggaggtcaagctggtggaggcggcgccggtggccggcgccctgcggtttgagcttctgacggaaggctcctatgtaaaggggccgcgcgggcgtcccggcccgctccggcggggcggtgccaagggtggcgcgccaaagggcggctttccgaaaggcggcgcccggcagggtccggccggacggcatgccggcagcggtcatccgggcaaaggcccgcagggaaagggacggtcgcgcccgtaa

SEQ ID NO: 1789 - DNA, 2367 bp, Methylobacterium extorquens PA1
ttggccagacgcatcaatccgacggcgggcacccccgttctcccctcccgcgagcagatcctcgccttcgtcgccgagacgcccggaaaggtcggcaagcgcgaaatcgccaaggccttcggcatctcgggcgccgacaagatcggcctcaaggcgatcctgaaggagatcgaggccgagggcgcgctcgagcgtgaccgcggcggcttgcggaaaagcggcagcctaccgccggtcgtgctcgccgacatcgtgtcgcgcgaccgcgacggtgacctgatcgcccgcccggcgcagtgggacggggagggcgaggcgcccaagatcgccgtcgagaccccgcgtgccggccgcaagggcaaccgccccgcccccggcatcggtgatcgggcgctggtccgcgtcgcgccggacccggaagtgcccggccgctacaccggccgcgtcatcaaggtgatcggcaagaaccgctccgaggtgatcggcgtctatcgcgcgggccgcgacggcgggcgcctgcttcccgtcgagaagaaatcgcagggtaaggagatcgcgatcccgccgggcgaggaaggtgaggcccgggatggcgacctcgtcagcgtcgcggtggagcgcgagacccgcttcggcctgccccgtgggcgcgtcaccgagcggctcggcgcgctcggctccgagaaggcggtgagcctgatcgcgctgcacatccacaacatcccgcatgtcttccccgccgccgtgctggcagaggcggatgcagccaagcgcgcgaccaagcgcggtcgcgaggattggcgcgaggcgccgctggtcaccatcgacccgcccgacgccaaggaccacgacgacgcggtgatggctgaggccgatcccgatccggccaatgcgggcggcttcatcgtcaccgtcgcgatcgcggatgtggccgcctatatccggccggattcggccctcgaccgcgaggcgctgctgcggggcaattcggtctacttccccgaccgggtggtgccgatgctgcccgagcgcatctcgaacgatctctgctcgctgcgcgagggcgaggaccgcccggcgctcgccgtgcggatgatcatcggcgcggacggggtgaagcgcagccacagcttccaccgcatcctgatgcgctcgcacgccaagctcgcctatgcgcaggcgcaggccgcgatcgacggccggccggatgagaagtcgggaccggtgctggagacggcgctgcgcccgctctacgcggcctacgaggcgatgaagcgggcccgcgacgcccgcggcccgctcgccctcgacctgccggagcgcaaggtgctgctcgacgcggaaggcggcgtcgatcgggtgatcgtgccggagcgtcttgaggcgcatcggctgatcgaggagttcatgatccaggccaacgtcgcggcggccgagacgctggagaaggcgggctcgccgctgatctaccgggtccacgacgaaccggccctggagaagatgcgcgcgctcggcgaggtgctcgcctcggtcggcgtcaagatgaccaaggccggtgcgctgaggccggacctgttcaaccgcatcctcgcccaggtggccgagagcgagcacgccccattcatcaacgaggtggtgctgcgttcgcaggcacaggcgatctacgctgcacagaatttaggccatttcggcctcaacctgcgccgctacgcccacttcacctcacccatccgtcgctacgcggatctcatcgtccaccgtgctctcgtgcgtgcctgcggattgggcaaggacggcctgccggacgacaccacaccgggtatgctcgacgcggtctccgagcagatttcggcggccgagcgccgggcgatggcggccgagcgcgagaccatcgaccggctcatcgccggctatctcgccgaccgcgtcggcgcgactttcaccggccggatttccggggtgacgcgctcggggctgttcgtgaagctcgccgagaccggggccgacgggttcgtgcccgtctccaccatcggccacgaatattatcgccacgacgaggccctgcatgccctcgtcggcgaccgcagcggcgagacctaccgcctcggcgacacggtcgaggtccgcctcgtcgaggcggcggcggtggccggcgccttgcgtttcgagatcctgtcggaggggcgcagccgctccggcgccaaaggcggtgggatcaagcgcagcgggtccaaggcgaatccgggcaaggcgaagttgggcaaggccaagttcggtgcgaagccaccgaagggcaagacgcgccccggcaaggcggcggcctccgagagcgatacggcgcggcgccatcgcggctcgcgtcgctga

SEQ ID NO: 1790 - DNA, 2322 bp, Methylobacterium radiotolerans JCM 2831
ttggcacgacgcaccaccgccccggcggccgagcccgccgctccgcagcccttccccacccgtgagcagatcctcgccttcgtggccgagtcgaaggagcgcgtcggcaagcgggagatcgccaaggccttcggcatcaagggggccgccaagatcgacctgaagcgcgtcctgaaggagatcgaagaggacggcgccctcgaccgcggccgcggcggcctcgccccggcgggccacctaccgccggtcgtgctggccgacatccgctcccgcgaccgccacggcgacttcctggcgatcccggtggagtggaccgggaccggcaagccgcccgccatcgttctggtgcagccgcgcggcccccggaagggcaaccgtccggccccgggcatcggcgaccgcgccctgatccgggtcgagcgcgacgcggaaggcggctacgccggccgggtcgtcaaggtcatcgggaagaacaaggccgagatcatcggcgtctaccgggccggcgcgcagggcggccggatcgtgcccgtcgagaagcgcgcgcagggccgcgagatcctgatcccgcccggcgaggaggggcaggcccgcgacggcgacctcgtcagcgtctcgctggagcgcgagacgcggttcggcctgccgaaggggcgtgtgcgcgagcgattgggctcgctcggttccgagaaggcggtgagcctgatcgcgctgcacctccacaacatcccgcacgtcttcgccgacgcgaccctggcggaggccgacgccgccaggcccgccacgctgaagggccgcgaggactggcgcgaccggcccctcctgaccatcgacccgccggacgccaaggaccacgacgatgccgtcatggccgaggccgatcccgacccggccaatcccggcggcttcatcctcaccgtcgccatcgcggacgtggccgcctatgtccggccgggctccagcctcgaccgcgaggccctggaacggggcaactcggtctacttccccgaccgggtcgtgccgatgctgcccgagcggatctcgaacgacctctgctccctccgcgagggcgaggaccggccggcgctggcggtgcggatggtcatcgccgccgacggcgagaagcgccgccacggcttccaccgggtgatgatacgctcccgcgcgaagctcgcctacgcgcaggcgcaggccgccatcgacgggcgcccggacgatgcgaccgggccgcttctggagacggcccttcgccccctctgggcggcctacgcggccctgcgcgcggcccgcgaccgccgggggccgctggccctcgacctgcccgagcgcaaggtcctgctctcgcccgagggcgcggtcgaccgggtgatcgtgccggagcgcctcgacgcccaccggctgatcgaggagttcatgatccaggcgaacgtcgccgccgccgagacgctggagcaggcccgacagcccctgatctaccgcgtccacgacgagcccgccctggagaagatgcgggcgctcggcgaggtcctggcctcggtgggcatcaagctgcccaaggaaggggcgctgcgccccgccctgttcaaccggatcctcgccacggcggccgagaccgagcacggcgtcttcctcaacgaggtgatcctgcgcagccaggcccaggccgtctacgcccccgagaatctcgggcatttcggcctgaacctgcgccgctacgcgcacttcacctcgccgatccggcgctacgccgacctgatcgtgcaccgggcgctgatcaccgcctgccggctcggatcggacgggctcgcgagcgacgtctccctcggcgagctggcgcagatcggcgagcagatctcggcggccgagcgccgcgccatggcggccgagcgcgagacgatcgaccggctcatcgcccaccacctcgccgaccaggtcggcgcgaccttcgcgggtcagatcgccggcgtcacccgggccggcctgttcatcaagctcgacgagaccggcgcggacggcttcgtgccggtctcgcagctcggcgccgactatttccgccacgaggagggccgccacgccctggtgggcgagcgcaccggggagacgttccgcctcggcgaccgggtcgaagtgcggctcgtggaggccgcaccggtggccggggcgttgcgcttcgagctgctcagcgagggccggacccgctccggtggccggactgccgggcccggcaagaaggccggcggccgggccttcaaggccgcgccgcccggccgcccccccggcatccgcaacaccgggtcgcgccaccgcggctcgcgccactga

SEQ ID NO: 1791 - DNA, 2388 bp, Methylobacterium populi BJ001
ttggccagacgcatcaatccgaaggcggttgcccccgctcttccctcccgcgagcagatcctcgccttcatcgccgagacgcccggaaaggttggcaagcgcgagatcgccaaagccttcggcatctcgggcgccgacaagatcggcctcaaggcgatcctgaaggcgatcgaggccgacggcctgctcgaccgcgaccgcggcggcttccgcaaaagcggcagcctgcccgacgtcgtcctcgccgacatcgtctcccgcgatcgcgacggcgacctgatcgcccgaccggcccagtgggacggcgagggcgaggcgccgaagatcgccgtcgaggtgccgcgtgccggccgcaagggcaaccgcccggcgcccggcctcggcgaccgggcgctgatccgcgtcgcgcccgaccccgaggcgccgggccgctataccggccgcgtcatcaaggtgatcggcaagaaccgcacggacgtgatcggcgtctaccgcgccggccgcgacggcggacgcctgcttcccgtcgagaagaagtcgcagggcaaggagatcgcgatccctgcgggcgaggagggcgaggcccgggacggtgacctcgtcagcgtcgcggtcgagcgcgagacccgcttcggcctgccccgcgggcgcgtgaccgagcgcctcggcaccctcggctccgagaaggcggtgagcctgatcgcgctgcacctccataacatcccccacgtcttccctccggctgtgctggcggaggcggatgcggccaagcccgcgaccaagcgcggccgcgaggattggcgtcaggcgccgctggtcaccatcgacccgcccgacgccaaggaccacgacgacgcggtgatggcgcaacccgatcccgatccggccaatgcgggcggcttcatcgtcaccgtcgcgatcgccgacgtggcggcctatgtgcgcccggactcggctctcgaccgggaggcgctgctgcgcggcaactcggtctacttcccggaccgggtggtgccgatgctgcccgagcgcatctcgaacgacctctgctccctgcgcgagggcgaggaccgcccggcgctcgccgtgcggatgaccatcggcgccgacggggtgaagcggagccacagcttccaccgcatcctgatgcgctcgcacgccaagcttgcctatgctcaggctcaggctgccatcgacggtcggccggacgagacgtcgggccccgtcctggagacggcgctgcgcccgctctacgccgcctacgaggcgatgaagcgggcccgcgacgcccgcggtccgctcgccctcgacctgcccgagcgcaaggtgctgctcaacgcggaaggcggcgtcgatcgggtgatcgtgccggagcgtctggaggcgcatcggctgatcgaggaattcatgatccaggccaacgtcgcggcggcggagaccctggagaaggcgggctcgccgctgatctaccgggtacacgacgagccggccctggagaagatgcgcgcgctcggagaggtgctcgcctccgtcggcgtcaagatgaccaaggccggggcgctgcgacccgacctgttcaaccgcatcctggcccaggtggccgagaccgagcacgctcccttcatcaacgaggtggtgctgcgttcgcaggcacaggcgatctatgctgcacagaatttaggccatttcggcctgaacctgcgccgctacgcccacttcacctcgcccatccgccgctacgcggacctgatcgttcaccgcgccctggtgcgtgcctgcggattgggcaaggacggcttggccggcgacaccacgccgggcgccctcgacgccgtgtccgagcagatctccgcggccgagcgccgggcgatggcggcggagcgcgagaccatcgaccggctcatcgccggctacctcgccgaccgggtcggcgccaccttctcggggcggatctccggggtgacgcgatctgggctgttcgtgaagctcgacgagaccggcgccgacggcttcgtgccggtctcgaccatcggccacgaatattaccgccacgacgaggccctgcacgcgctcgtcggcgaccgcagcggcgagacctaccgcctcggcgatacggtcgaggtccgcctcgtcgaggcggcggcggtggccggggcgctgcgcttcgagatcctgtcggaggggcgcagccgttccggggcgaagggcgacgggctcaagcggaccggattcaaggccggcgtgaaggcgaaggccaaggcgcgcatcggcaaaggtgcgggcaagggttcgggcaagggttcgggcaagggagcaggcaaagggccgggcaacggatcggcgtccgagggcgagtccgcgcggcgccatcgcggctcgcgccgctga

SEQ ID NO: 1792 - DNA, 2346 bp, Rhodopseudomonas palustris TIE 1
gtgagcaagccgcgcgacgcgaagtttccggacaaggccactctcctcgccttcatccgcgcccaccccggcaaagtcgggacccgggagatcgcgcgcgaatacggcctgaagaatgccgatcgcgccgaactgaagcggatgctgcgcgaactcgccgacggcggcagtattcgcaagagcggccgccgcaaagtgtcggagccggccacgctgccgccgaccctgctggcggacatcgtctcgcgcgatgccgacggcgagctgatcgccactccgtccgagtgggacgagcaggacggcgacgcccctaagatcctcattcatacgccacgccggatcaagcccggcaccgcagccggcgtcggtgatcgcgcgctgctgcatgtcgaagccgcagactcacgcgaggccggccccgcttatgtcggccgggtcatccgtgtgctcgaacgcggcaaggcgcgtatccttggtatcttccgcgcgctgccgcagggcggcggccggatggtgccagtcgacaagaagcaggccgggcgtgaactcaacatcgcggcgcatgatgccggaggggcccaggacggcgatctcgtcagcgtcgatctgatccgcacccgcagcttcggcctcgcctccggccgggtgaaggaacggctcggctcgctcgccagcgaaaaggcgatcagcctgatcgcgatccacacccacgacattccgcaggatttctcctcggctgcaatcagcgagtcggaagctgcacagccggcgacgctatccggccgcgaagactggcgcgagctaccgctggtgacgatcgatccgccggacgccaaggaccacgacgacgccgtccatgccgcgcctgatcctgatccgaacaacaaaggcggcgtgatcctgcacgtcgcgatcgccgacgtcgcctactacgtgcgccccggctcggcgctcgatcgcgacgcgctgcgccgcggcaattcggtgtactttcccgaccgcgtcgttccgatgctgccggaacggatctccaacgatctgtgttcgctgaaaccaggtcagccccgcggcgccctcgccgtccgcatggtgatcgacgcgcaagggcgcaagcgctcgcattcattccaccgcgtgctgatgcgttcggccgcgaagctgagctacgcgcaggcccaggccgcgatcgacggcaagcccgacgacgtcaccggcccgctgctcgagaccatcctgaagccgctgtacgacgcctatgcggtggtcaaacgcggccgcgacgagcgtgatccgctcgacctcgatctacccgagcgcaagatcatcctgaagccggacggtaccgtcgaccgcgtcatcgtgccggaacggctcgatgcgcaccggttgatcgaggagttcatgatcctcgccaacgtggccgccgccgagatgctggagaagaaggcgctgccgctgatctaccgggtacacgacgagcctagcgtcgagaaggtccacaacctcgtcgacttcctgaagacgctcgatctgtcgttcgccaaaggcggcgcgctgcggccggcgcagttcaaccgcatcctggcgatggtcaaaggcgaagactccgagccgctggtgaacgaggtggtgttgcgctcgcaggcgcaagccgaatacagctccgagaactacggccatttcggcctcaatctgcggcgctacgcgcacttcacctcgccgatccgccgctacgccgacctcgttgtgcaccgcgcactgatccgcgcgctcgatcttggcgacggcgcgctgccgccgagcgagaccaccgagactctggcagaggttgcggcgcagatctcgctcaccgagcggcgcgcgatgaaggccgagcgcgagaccgtcgaccggctgatcgcgcatcatctcgccgaccggatcggcgcaacgttccagggccgcgtctcgggcgtcaccaaggccggcctgttcgtcaagctgagcgacaccggcgccgacgggctgatcccgatccgctcgctcggcgacgagtattacaactacgacgaaacccgtcacgcgctcatcggctcgcgcagcggggccatgcaccggctgggggatgtcgtcgacgtcaagctggtggaagctgcacccgtcgccggcgcgcttcggttcgaactgatcggcaatgccaacgttgaattcacgcaccgcaagactgcacgcaagaccaaggggacgagcaaggccaagctgaaaaccgagagcggcaagtcggcgcgcgccaagcccggacgggcgaaggcgcggaaagcggcgaagccgaaacaaaaaaccaagtccgggagaggaaaacgctga

SEQ ID NO: 1793 - DNA, 2289 bp, Methylobacterium sp. 4-46
ttggccaaacgctcctccccgccctccgaccacgccgccctgccctcccgcgaggcggtgctggccttcatcgcggaggcgaccaccaaggtcggcaagcgcgagatcgccaaggccttcggcctcaagggcgccgacaaggtcgaactcaagcggatgctcgccgagctgaaggacgagggcgcggtcgagaaggaccgggcgggcctgcgcaaggccggccgcctgccgccggtcctcgtcgccgaaatcgacgcccgcgaccgcgacggcgagctcctcgcccgccccgcccagtgggacccggaagccggcccggccccgaagatcctcgtgatggcgccgcgcggccggcggaccggcagcctgcccgcgcccgggatcggcgaccgggcgctcctgcgcgtcgagcccgaccgcgaggcgccgggccgctatctcggccgcgtcgtcaaggtgatcggccgcaacaaggcggagatgctcgggatctaccgcgccctggagaagggcggcgggcgcgtcctcccggtcgagaagcgcgcccagggccgcgagatcgagatcccgcccggcgaggagggcgaggcccgcgacggcgacctcgtcagcgtcgccctcacccgcgacagccgcctcggcctgccccgggggcgggtcaaggagcgcctcggcgccgtcgcctccgagaaggccgtgagcctgatcgccctccacgcccacggcatcccgcacgtcttcccccccgcggtgctggacgaggccgcgcgggcgcggccggccgggatggaggaccgcgaggattggcgcgacgcccccctcctcaccatcgacccgcccgacgccaaggaccacgacgacgccgtgatggcgctgcccgacccggaccccgccaacgcgggcggcttcgtggtcacggtcgcgatcgcggacgtcgccgcctatgtccggcccggcagcgccctcgaccgcgaggcgctgctgcgcggcaactcggtctacttccccgaccgggtcgtgccgatgctgcccgagcgcatctcgaacgacctctgctccctgcgccccggcgaggaccgcccggccctcgccatccgcctcgtcatcggcgcggacggccgcaagaggcgccacagcgtccaccgggtgatgatgcgctcggccgccaagctcgcctacgcgcaggcccaggccgcgatcgacgggcagccggacgccgtcacgcagcccctcctcgaccccgtcctgcgcccgctctgggcggcctaccgggtgctcgccgcggcccgggacgcccgcggccccctcgccctcgacctgcccgagcgcaaggtcgtcctcgacgccgagggtcgggtcgaccgggtggtggtgcccgagcgcctggaggcgcaccgcctgatcgaggaattcatgatccaggcgaacgtcgccgccgccgagaccctggaggagaaggcgcaggccctgatctaccgggtccacgacgagccctcgctcgacaagatgcgggcgctcggcgaggtgctggcctcgatcggcatcaagctgccgaaggagggcgtgctccggccctccctgttcaaccgcatcctcggcatggtccagggcaccgagcaccagaccttcctgcacgaggtgatcctgcgcgcgcaggcccaggcggtctacgcgccggagaatgccgggcatttcgggctcgccctgcgccgctacgcgcatttcacctcgccgatccggcgctacgccgacctcgtcgtccaccgcgccctgatccgggcgctgcggctcgggccggacgggctgcccgacatgggcgcggccgagctcgccgagatcggccagcagatctccaacgccgagcgccgggccatggcggccgagcgcgagaccatcgaccggctcatcgcccagcacctcgcggaccgggtcggcgccagcttcgcgggccagatctcgggcgtgaccaagtcggggctgttcgtgaagctcaccgagaccggggcggacggcttcgtgccggtctcgacgctcggggccgactatttccgctacgaggagggccgccacgccctggtgggcgagcgcagcggcgagaccttccggctcggcgaccgcgtcaccgtgcgcctggtcgaggccgcgcccgtggcgggcgccctgcgcttcgacgtggtatcggaggggacgcggtcgagcccggcgccgcggcgcggcggcccgcgcaagggccgcccggcggccgagcgccgcgagggcctcaccaagcggagggggaagcgggcgtga

SEQ ID NO: 1794 - DNA, 2373 bp, Rhizobium leguminosarum bv  trifolii WSM2304
gtgagcagaataccgcgcgacagaacgaaccctgcgggcaagcgcccgggcaagatcggccgtgccggcaaggatgctcccgccgtcgagccgctgaacatcgtccacggcgcgctgccgtcgcgggaggtgatcctgcgcttcatcgccgatcatccgcagaaagcgtccaagcgggaactcgccaaggctttcggcctgaagggcgacagccgcgtcgagctcaagcacctgctgcaggagctcgagcaggaaggcatgctgcagaagaaccgcaaatcgctgatccgccccggcgcgctgccgccggtcaccgttctcgatatcaccacgcgtgacaaggatggcgacctgatcggccggccggcggaatggcccgaggatcagggtgtcgcgcccgccgtcgccatccgccagcaatcgcccgcaggccgccagggcaaaggcaaggcaccggtcgccggcctcggcgaccgcattctggcgaagatcttcccggccgtcgatcgtgccgggccggcctatacggcgcggatcatcaaggtgatcgacaagcgccgcggcgcctcgatgggcgttttccgcacgacgcctggcggcggcggccggctgctgccgatcgagcgacgcggcgaggagatggtcatcgatccagacttcaccggcggcgccaaagacggcgacctggtcgagatcgaagtcgcccgtctcgggcgcttcggcctgccgcgcgccaaggtgctttcggtcgttggctccgtcggctcggaaaaggcgatctcgatgattgccatccatgcgcacggcattccgcatgtcttcccacccgccgttatcgctgaggccgaggatgcaaaacccgcgacgatgtcgcatcgcgaggactggcgcgacgtgccgctgatcaccatcgatccggccgatgccaaggaccatgacgacgccgtctatgccgaactcgacccctcgcccgacaatcccggcggcgtcatcgtcaccgtggcgattgccgacgtctcctggtatgtccgcccgaagtcgccgctcgaccgcgaggcgctgaagcgcggcaactcggtctatttcccggatcgcgtcgtaccgatgctgccggagcgcatttccaacgatctctgctcgctgaaggaaggcgtcgaccgcccggcgcttgccgtgcgcatgagcttttccggggaaggccgcaagatcggccacacgtttcatcgcgtcatgatgaagagcgcggccaaactctcctaccagcaggcgcaggcggcgatcgacggcgcgccggacgataggaccggaccgatgctcgagccgatcctgaagccgctctggcacgcctatgcggtgatgaagcgcggacgcgatcggcgccagccgctggaactcgacatgccggagcgcaagatcctgctgaagcccgacggcaccgtcgaccgggtccacgtgccgccgcggctcgacgctcacaagctgatcgaagagatgatgatccaggcgaacgtctcggccgccgagacgctggaaaagaaacgccagccgctgatctaccgcatccatgacggcccgacgcttgccaagcaggaaatcctgcgcgagttcctggcgacgctcggcatcccgcttgccaagggcggcaatatgcgcgccaacaacttcaacggcattctggcgaaggcggacggcacgccgcaccagaccatggtcaacgagatggtgctgcgctcgcagagccaggcgatctacggcccggaaaatatcggccatttcggcctcaacctgatgaaatacgcgcatttcacctcgccgatccgccgttacgccgatctcatcgtgcatcgcgccctcgtcggctcgctcggcttcggcgaaggcggcatcacgacagaggaagaggcaggcctcgacgatatcgccgcggaaatttcgaccttcgagcgacgggccatggcggccgagcgtgagacggtcgaccggctgatcgcgcatcatctgagcggccgcgtcggcgaggaatttgccgggcgggtctcgggtgttacgaaatccgggctgtttgtcgccctgccggagtatggtgccgatggtttcgtccccatatcgacgctcggcagcgactatttcatctatgacgaggcgcatcaggcgctctcgggtgaacggacggggctcggctatcgccttggcgacaacgtcacggtgaagcttgccgaatcaatcccgcttgccggcgcgctgcgcttcgagatggtcagcgaagggcgcgagatgccgacggcggtgcgctccttccacaaagccggccgccgcgaccggggccaggttcgcaagaagccgggaacgaggccaccgcgcgggcggcattga

SEQ ID NO: 1795 - DNA, 2367 bp, Methylobacterium chloromethanicum CM4
ttggccagacgcatcaatccgacggcgggcacccccgttctcccctcccgcgagcagatcctcgccttcgtcgccgagacgcccggaaaggtcggtaagcgcgaaatcgccaaggccttcggcatctccggcgccgacaagatcggcctcaaggcgatcctgaaggagatcgaggccgagggcgcgctcgagcgcgaccgcggcggtttgcggaaaggcggcagcctgccgccggtcgtgctcgccgacatcgtgtcgcgcgatcgcgacggcgacctgatcgcccgcccggcgcagtgggacggggagggcgaggcgcccaagatcgccgtcgagaccccgcgtgccggccgcaagggcaaccgccccgcccccggcatcggcgaccgggcgctggtccgcgtcgcacccgacccggaagcgcccggccgctacagcggccgcgtcatcaaggtgatcggcaagaaccgctccgaagtgatcggcgtctatcgcgccggccgcgacggcgggcgcctgcttcctgtcgagaagaaatcgcagggtaaggaaatcgcgatcccgccgggcgaggagggcgaggcccgggatggcgacctcgtcagcgtcgcggtggagcgcgagacccgcttcggcctgccccgcgggcgcgtcaccgagcggctcggcgcgctcggctccgagaaggcggtgagcctgatcgcgctgcacatccacaatatcccgcacgtcttccccgccgccgtgctggcggaggcagacgcggccaagcgcgcgaccaagcgcggccgcgaggattggcgcgaggcgccgctggtcaccatcgacccgcccgacgccaaggaccacgacgacgcggtgatggctgaggccgatcccgatccggccaatgcgggcggcttcatcctcaccgtcgcgatcgcggatgtggccgcctatatccggccggattcagccctcgaccgcgaggcgctgctgcggggcaactcggtctacttccccgaccgggtggtaccgatgctgcccgagcgcatttcgaacgatctctgctcgctgcgcgaaggggaggaccgcccggcgctcgccgtgcggatgatcatcggcgccgacggggtgaagcgcagccacagcttccaccgcatcctgatgcgctcgcacgccaagctcgcctatgcgcaggcgcaggccgcgatcgacggccggccggacgagaaatcgcgaccggtgctggagaccgcgctccgcccgctctacgcggcctacgaggcgatgaagcgggcccgcgatgcccgcggcccgctcgccctcgatctgccggagcgcaaggtgctgctcgacgcggagggcggcgtcgatcgggtgatcgtgccggagcgtctggaggcgcatcggctgatcgaggagttcatgatccaggccaacgtcgcggcggccgagaccctcgagaaggcgggctcgccgctgatttaccgggttcacgatgagccggccctggagaagatgcgcgcgctcggcgaggtgctcgcctcggtcggcgtcaagatgaccaaggccggggcgctgcggccggacctgttcaatcgcatcctcgcccaggtggccgagagtgagcacgctccgttcatcaacgaagtcgtgctgcgttcgcaggcacaggcgatctacgctgcacagaatttaggccatttcggcctcaacctgcgccgctacgcccacttcacctcgcctatccgccgctacgcggatctcatcgtccaccgtgctctcgtgcgtgcctgcggattgggcaaggatggcctgccggacgacactacgccgggtatgctcgacgcggtctccgagcagatctcggcggccgagcgccgggcgatggcggccgagcgcgagaccatcgaccggctcatcgccggctacctcgccgaccgggtcggcgcgactttcaccggccggatctccggggtgacgcgctcggggctgttcgtgaagctcgccgagaccggggccgacgggttcgtgcccgtctccaccatcggccacgaatattaccgccacgacgaggccctgcacgcgctcgtcggcgaccgcagcggcgagacctaccgcctcggcgacacggtcgaggtccgcctcgtcgaggcggcggcggtggccggcgctctgcgcttcgagattctttcggaggggcgcagccgttccggcgccaaaggcggcgggttcaagcgcagcgggtccaaggcgagtccgggcaaggcgaagttgggcaaggccaagttcggtgcaaagtcgcccaagggcaagccgcgccccggcaagacggcggcgtccgagagcgatgcggcgcggcgccatcgcggctcgcgtcgctga

SEQ ID NO: 1796 - DNA, 2289 bp, Methylobacterium nodulans ORS 2060
ttggccaaacgcactgccccgaaagccgaccacggcgcccttccgtcccgcgaggccgtcctcgccttcatcgcggaggcgaccaccaaggtcggcaagcgcgagatcgccaaggccttcggcctcaagggggccgacaggctcgagctcaagcgcatgctcgccgagctcaaggaggagggaatcgtcgaaaaggaccgttccggcctgcgcaaggccgggcgcctgccgccagtcctcgtcgccgatatcgatgcgcgcgaccgcgacggcgagttgctggcgagccccgcccagtgggatccggaggccggccctgccccgaagattctcgtcatgatgccccgcgggcggcgctccggcgcgctgcccgcgcccggcatcggcgaccgcgcgctgctgcgcgtcgagcccgaccgggaggcccccggccgctatatcggccgcgtcgtcaaggtcatcggccgcaacaaggccgaggtgctcggcgtctaccgcgccctggagaagggcggcggacgcgtcctgcccgtcgacaagcgcgcgcaaggccgcgagatcgcgattccggccggccaggagggcgaggcgcgcgacggcgacctcgtcagcgtggcgctcgcccgcgaggggcgcctcggcctgccgcagggccgcgtgaaggagcggctcggcgcgatcagttccgagaaggccgtcagcctcatcgcgctccacgctcacggcatcccgcatgtcttcccccgggaggtgctggccgaggccgagcgcgcggcgtcggccgggatggagaatcgcgaggattggcgtgacgagcccctcgtcaccatcgatccgccggacgccaaggaccacgacgacgcggtcagggcggtgccggacccggatccggccaatgccggcggcttcctcgttacggtcgccatcgcggatgtcgccgcctatgtgcggccgggcagccccctcgaccgcgaggcgctcgcgcgcggcaactcggtctatttccccgaccgggtcgtgccgatgctgccggagcggatctcgaacgacctctgctccctgcgccccggcgaggaccggccggccctggcggttcgcctcgtcatcggcgcggatgggcgcaagaagcgccacagcttccaccgggtgatgatgcgctcggcggcgaagctcgcctatgcgcaggcgcaagcggcgatcgaggggcagccggatgcggtcaccctcccgctcctggagccgagcttacgcccgctctgggcggcgtatcggctgatggcgagggcgcgcgacgcccgcggccccctcgccctcgacctgcccgagcgcaaggtgatcctcgatgccgaaggcggcgtcgaccgggtcgtcgtgcccgagcggctggaggcacatcgcctcatcgaggagttcatgatccaggccaacgtcgccgccgcggagacgctggaggagaaggcccaggcgctgatctaccgcgtgcacgacgagccctcgctcgagaagatgcgggcgctcggcgaggtcctggcctcgatcggcatcaagctgcccaaggaaggggtgctgcgcccctccctgttcaaccgcatcctcggcctcgtcgacggcaccgagcatcaggtcttcatcaacgaggtcatcctccggtcgcaggcccaagcggtctatgcgccggagaatgtcggacatttcgggctggcgttgcgccgctacgcccatttcacctcgccgatccggcgctatgccgacctcgtcgtgcaccgggcgctgatccgggcgctccgcctcggcccggacgggctgcccgacatggggacgggcgaactcgccgagatcggccagcagatctccatggccgagcgccgcgccatggcggcggagcgcgagaccatcgaccggctgatcgcccagcacctcgccgaccgcgtcggggccaccttcgcgggccagatctccggcgccacccgcgccgggctgttcgtgaagctcgacgagaccggcgccgacggcttcgtgccggtctcgagtctcggggcggattacttccgcctcgaggaggggcggcacgccctcgtcggcgagcgcacgggcgagaccttccggctcggcgaccggatcacggtgcggctcgtggaagcagcccccgttgcaggcgccttgcgcttcgaagtggtatcggagggtgcacgcggcgcgccggcgccgcgccggggtggcctgcgcaaggggcgcgcgctgccggagcgtcgcgagggcctggccaagcgaagggggaagcgggcatga

SEQ ID NO: 1797 - DNA, 2379 bp, Agrobacterium vitis S4
ctgaccttgagcaaatccccgcgacccgacacccgcagcctcaccaacagaacgcggaaggcggagcttgcggcgaaaaaggcagcggacaagaatgaaacggtgatcattcacggggcggtgccgccccgtgaaatcctgatgcagttcatcaccgacaaccccgaccgggcatccaagcgcgaaatcgccaaggcttttggcctgaagggcgaagcccgtattgaattgaaggaagccctgcgggctttggaagaagacgggctggtcaacaagaaccgcaagtcgctgagccgacctggggcattgccgcccgtgaccgttctcgacatcaccacccgtgacaaggatggcgacctgatcgggcgtcccgccgaatggccggatgaactgggcgctgcccctgccgtttccatccgccagtccagcgcggaccgcgccaagggcaagacgccggttggcggactaggcgaccgggttttggcaaagattttcccctccaaggaccatatcggtcccgcctataccgcccggatcatcaaagtgatcgacaagcggcgcggcgcgcttttgggcgtctaccgtgaaatggccggtgataccggcggcaggctgatgccgatcgagcggcgcggcgaggaaatggtcatcgaggccgccgatgtcggcgacgcccgcgacggcgatctggtcgaggtggaagtcgggcggctctccagccgtctgggtcttgcccgcgccaaggttctgtcggtgattggctcggtggcatcagaaaaagccatctcgatgatcgccatccatgcccatggcattccacatatcttcccgcaatcggtgctagacgaggccgatgccgccaaaccggccagcatggcgcatcgggaggactggcgcagcttgccgctggtcacgatcgacccgcatgacgccaaggaccatgacgacgctgttcatgccgagccggacccctcgcccgataatccgggcggcgtgatcgtcaccgtggcgattgccgacgtctcctattatatccgcagtaagtcggcgctggaccgcgaggcgctgaagcgcggcaattcggtctatttccccgaccgggtcgtgccgatgctgccggagcggatttccaacgatctctgctcgctgcgcgagggcgttgaccggccggcgctggccgtgcgcatggtgttttcccatgaaggccgtaaggccagccatacctttcatcgcatcatgatgaagagtgcggccaaactgtcctaccaacaggcacaggccgctattgacggcaacccggatgacaaggctgggccgctgctggagccgatcctgaagccgctttgggccgcctatgcgatcctgaagcgtggccgcgaccgccgtcagccactggaactggacatgccggagcgcaaaatcatccttaaagccgatggcacagtggatcgggtctttgtaccagaacggctggacgcccataagctgatcgaggaaatgatgatccaggccaatgtggccgccgccgagacgctggagaagaaaaaacagccgctggtctaccgcatccacgatacgccaacattggccaagcaggaagtgctgcgcgagttcctggccaccatcggcttttcactggccaagggcggcaatctgcgctccaattcgttcaatggtatcctcgccaaggcgcaggacacgccgcatcagaccatcgtcaacgaaatggtgctgcgctcgcagagtcaggcggtctatagccccgagaatatcggccatttcggcttgaaccttttgaaatacgcgcatttcacctcccccatccgccgctacgccgacctgatcgtgcatcgggcgctggttggcacgctagggcttggcgaaggcggcattacatccgatgaagaagcggcgctggccgatgtcgccgccgaaatttccaccttcgagcgccgcgccatggcagccgagcgcgacacgatcaaccggctgatcgctcaccatctggcaacacggatcggcgacgaattcgacgggcaggtctcaggcgtcaccaaatccggcctgttcatctccctgccgcaatatggcgctgatggcttcattccggtctcaacgcttggccgcgactatttcatctacgatgaggcacatcaggcactgaccggcgaaaagaccgggcttggctatcaattgggggatagcgtcagcgtcaagctggtggaagccgtgccgctggccggtgccttgcggtttgaaatcctcagcgaaggcaagaaaatgccgaccggcatccgttccttccacaaggcgacgcggcgcggacggcctggtcccggcaagacaccgggaacaagaccaccgcgtggaaggcgttga

SEQ ID NO: 1798 - DNA, 2373 bp, Rhizobium leguminosarum bv  trifolii WSM1325
gtgagcaggataccgcgcgaaagaacaaatcccgcgggcaagcgcccgggcaagaccggacacgccagcaaggatgctcccgccgtcgagccgctgaacatcgtccacggcgcgctgccttcacgcgaggtgattctgcgcttcatcgccgatcatccgcagaaagcgtccaagcgtgaactcgccaaagctttcggcctgaaaggcgatagccgcgtcgagctcaagcagatgctgcaggagctcgagcaggaagggatgctgcagaagaaccgcaagtcgctgatccgtcccggtgcgctgccgcctgtcaccgttctcgatatcaccacacgcgacaaggacggcgatctgatcggccggccggcggaatggcctgaggatcagggcgtagcgccggctgtcgccatccgccagcaatcgcccgcaggccgccagggcaagggcaagacgcccgtcgccgggctcggagaccgtatcctggcaaaaatcttcccggccgtcgatcgcggcgggccggcctatacggcgcggatcatcaaggtgatcgacaggcgccgcggcgcgtcgatgggcgttttccgcactgcacctgatggtggcggccggctgctgccgatcgaacggcgcggcgaagagatggtgatcgctcccgacttcaccggcggcgctaccgacggcgatctggtggaagtcgagatcgcccgtctcggccgtttcggcctgccgcgcgccaaggtactttccgtcgtcggttccgtcggttcggaaaaagcgctctcgatgatcgcgatccatgcccacggcattccgcatgtcttcccgccggccgtcatcgccgaagcggaagctgcaaggcccgccacgatgtcgcatcgcgaggattggcgcgacgtaccgctgatcaccatcgacccggccgatgccaaggaccatgacgacgctgtttatgccgagctcgatccctcgcccgacaatcccggcggcgtcattgtgaccgtcgcgattgccgacgtctcctggtatgttcgccccaattcgccgctcgatcgcgaggcgctgaaacgcggcaactccgtctatttccccgatcgcgtcgtgccgatgctgcccgagcgcatctccaacgatctctgctcgttgaagcaaggtgtcgaccgcccggcgctcgccgtgcgcatgagcttttccggggaaggccgcaagatcggccacatctttcatcgcatcatgatgaagagtgccgccaagctctcctaccagcaggcgcaggcggcgatcgacggaaggccggacgatcagaccggcccgatgctcgaaccgatcctgaagccgctctggcacgcctatgaggtgatgaagcgcggacgcgaccggcgccagccgctggaactcgacatgccggagcgcaagatcctcctgaagtccgacggcacggtcgaccgggtggtcgtgccgccacggctcgatgcgcataagctgatcgaagagatgatgatccaggcgaatgtctgcgcggccgagacgctcgaaaagaagcgtcagccgctgatctaccgcatccatgacggcccgacgcttgccaagcaggagatcctgcgcgagttcctggccacgctcggcatctcgcttgccaagggcggcaacatgcgcgccaacaacttcaacggcattctggcgaaggcggacggcacgccgcatcagaccatggtgagcgagatggtgctgcgttcgcagagccaggcgatctatggcccggagaatatcggccatttcggcctcaacctgatgaaatacgcccacttcacctcgccgatccgccgttatgccgacctcatcgtgcatcgcgccctcgtcggctcgctcggcttcggcgaaggcggcatcacgcccgaagaagaggccgcgctcgacgatatcgctgccgaaatctcgaccttcgaacgccgggccatggcagccgagcgcgagaccgtcgaccggctgatcgcgcatcacctcagcggtcgcgtcggcgaggaatttgccgggcgggtttcgggcgtgacgaaatcgggagtttttatcgccctgccggactatggcgccgatggtttcgtccctatatctacgctcggcagcgattatttcatctatgacgaggcgcatcaggcactctccggtgaaaagaccgggcttggttatcgcctgggcgacagcgtcaccgtcaaacttgccgaagcgatcccgcttgccggtgcactgcgtttcgagatgatcagcgagggccgtgagatgccggcggcggtgcgctccttccataaagcggggcgccgcgacaggggccagattcgcaagaagcccggaacgaggccgccgcgcggacggcactaa

SEQ ID NO: 1799 - DNA, 1089 bp, Trichodesmium erythraeum IMS101
atgaaaaaaagtattaaacttatttccaatcgtgccttattttacttggccattctacctgtaagctgtggtgtttttgcttggcagggttggagttggtggagttgggtaagtagacctgtagtttcaccaacatcctctactcagtcttcacaagctaatgctataagaattaaaattcctgtgggaacttatggtcaacaaataggtgagtatttagaagatgctggtattattcgctctgcaacagcttggaatttatgggtaaaatggttgagtctacaaaatcccaatcttgagtttaaagctggaacttataatttattgcctacagaaccactaagcgcgatcgcagataaaattctacagggagatgtagttaaactcagctatgtcattcgtgaaggatggtcaattcaacaaatggctgcatatttggatgatgaaggtttttttccagctgctgattttattgcagcaacaaaaaatattccctatgataagtttccatggttaccaactaatatacctcatctagagggttatttattcccagatacttataaaatagtagcggataatattactccagaagctattatcaatcaaatgataggacagtttgaacaagtagctttgccagtttatcagaaaaaccagaacaatacaacaaaattgagtcttcatgaatgggtaagtttagcaagtattgtagaaaaggaagctgtagttgcacaagaacgtggtttaatttcgggggtgtttaataaccgtttggaacagggtatgaggttagcagcagacccaacagtagaatatggtcttggtattcgtcaaacgaaagataagcctcttacttatagtcagattgaaactccttcaccttataatacttatatgaatactgggttaccaccaactcctatttctagtccaggtaaggccagtttggaagcaactcttaatccagaagatacagaatatttgtattttatggctcgctatgatggtacccatatttttagtcgtactgctagagaacatgaggctgctattgcagaggtagagagattgttatcatctcagtaa

SEQ ID NO: 1800 - DNA, 1020 bp, Dictyoglomus turgidum DSM 6724
atcaataatttttctttatatttcctactaattttctctctcttagtttttataggctttttagtatatttatatctatcttcgcctaaaagtaaaatagagagggagatagaagtatatattccggaaggttcttctgcatataaagttgcagacattcttttggataatagtttgataaagtctaaagaagtatttatagcaactcttaaattaatggggaaagataaagggcttaagagtggatattacatattatctccctcattttctatgtttgatataattgatatacttacccaggggaaggggttaagagtaaaaataacaattcctgaaggtagcagtctaaaagatatggctcatttattttcagaaaagttagctctttctaaagaaaagtttataactttatgcaaagatgaaaattttattgacagtgtaatgaaggattataaaaattattttagctcatataaatctttaaaaaccttagagggatatttgtatccttcaacttactatttcaacaaaggaataaaagaagaagacataataaaattccttataaaagagttttttaatcagataaatgttcatatacctgaatacaaagagaggttgaagagtttgaatttatctttcaatgattggattattcttgcatcaatcgtagagaaggaggctaaagttgatcaggagagacctcttattgcaggtgtatttttaaatcgtttaaagaaaggatataaacttcagtcttgcgcaacagtagaatacgtttatgattttaaaaagtcggtgcttttatataaagatttagagattgattctccttataatacctacatatattatggtcttccaccatctcctatttgttctccatctttaaattctttgaaggcagtgctctatcctcaaggggattatcttttctttgtggcaaaaggagatgggactcatatctttaccaaaacttatgaagaacatttaaaagctcaggaatttaaaaaatga

SEQ ID NO: 1801 - DNA, 1056 bp, Cyanothece PCC 7425
gtgaactggaatctcggctggcgcagtggggcggcgatcgcagcaggactgcttttgctgggaagctggcaatggtggagttgggccacggctccttcccaatccaagggaaattctctaccatcgcccctgcaggttcagattgcccctggtacccctgcagatcaggtgggagaagacctttaccagaaaggcttaattcgttctgccctggcctggaaactatgggtgcgttggcaaagctggcgatcgccccaggcgggtgtacaggctggcacctatgagttgtccccaacacagtccttgccgacgatcgccacccgtctctggcagggggatgtgatccagactcgctttacgatcccagagggctggtcgatccggcagatgagtcgctacctggagcagcttggtctttttccggctgcagattttgagcaagcgactcgccgcattcccagggacgagtttgcctggcttccagctaatttaacctccctggaaggcttcctttttccagatacttatcaaatacccaccgggaccattaccccagaggaggtgatccgggtgatgctccagcgctttagcgaaatagctctgcccctctatcgccaggctccctctgctcaactcaccctggcccagtgggttaccctcagtagtattgttgaaaaagaagctgttgttccccaggagcgcaccttaattgctggagtctttctcaaccgtctccgcctgaatatgcccctcggagctgatcccactgtggagtatgccctgggaattcagcagacccccgatcgccccctcaccctgactcaggtgcaaactccctccccctacaacacctatttaaatgctggtttgcctcctggagcaattgccagccccggtcgagccagtttagaagctgttctcacccctgcccggacggactacttatatttcgtggcacgatatgatggaactcatatctttagccgcaccctggcagaacacgaaattgcccaggcccgcatccacgaccagcggcagtccggttcccgtctttaa

SEQ ID NO: 1802 - DNA, 1158 bp, Eggerthella lenta DSM 2243
atgccccagcacaggaagcaagtcacctattctcagcgtccgaaccatgcagctcgctcggctcatgcccggggcgagcgccagttccgtacgtacgataccagctatatccgcccgaagaaaagcaaggctcctgctatagtcgccgccgttttggccgttcttgtcgtcggaggtttggcgtggggcgcgctcaccctgttcaacagctgttccgcgcaatcggtcgagcttctggccgagggtcaggaggccacgatcacggtggccgaaggtgctggtgccaaggtcgtcggagagcagcttgcggaagcccgtctggtttccaatgcgggagacttcacgaagcgcgtcaacgagatgggcgttgattcccagctcaagcccggtacctacacattcgcgggcggtatgtcgctcgacgccatcatcaaccagctgacggccggtccggtggcgaacgcgctcaccatccccgaaggaagcacgctcgaggccgttgcccagagcgtggcaaccttcaccgagaatcgcatcacggcggacgcgttcacggccgctgcgtcggatgccagctcatacgcggccgactacgacttcctggccgacgcgggcacgaacagcctggaaggcttcctgttcccgaaaacgtacgagatcggcgacgatgccacggccgagtcggtagtgcgcatgatgctcgaccagttcaagaccgagacgtcggggctcgattggtcctacccgcaaagccagggcctcaccatctacgatgccgtgaagctggcttccatcgttgagcgcgagtcgtcgggcgacgagcagatccgcgcccaggtggcctcggtgttctacaaccgcctgaacaacttcggcgatccgaactacggcttcctgcaaagcgatgcgaccacggcttacgagctgggtcacgaccccacccccgaggatatcaagaatccaacaccgttcaacacctacacgaacacgggtctgcctcccacgcccatctgctcgccgggtctcgattgcctgcaagccgtgtgcaaccctgcgcagacgaactacttcttcttctacttcgcgcctgatgaaagcggtacgatgcagtactacttcagcgaaacgtacgaagagcatcagcagacgttctcctag

SEQ ID NO: 1803 - DNA, 1212 bp, Cryptobacterium curtum DSM 15641
atggccctgcatcgccaggttacgtattcatctcgtcccaatcgtgctgctcgtatggcacacgctaaaggcgagcgccagttccgcacctatgacacgtcgctgattcagccacgccattcgcgcggacgactgattgttgtggctcttgcggcgcttctattggtcgcccttattggttttggtattcattcctgcctgaaggcacctgaagttgagcttattgacgagtccacatcggttaccttcacgattcctgaaggagcaagtaccgccgatatcgcgcgtatcctgcaggagaaccgcttggttgcgcgcgcttctgatttttcggacgcggtcaaggcacggggtgttgcttcttcactcaagcccggtacctacacactgacgggcggccttgatgtgtctgatattgtcgatacgcttgtttcagggccgaattcatcgacgcttaccattcctgaaggctatacgctcgcccgtacagcagcagctgttgaaacggcaaccgatggacgtatcagtgctgctgaatttactgcagccgcaagtgacgccacggcgttttccgatcagtttccctttgtggctgaggcctacaatgggtcgcttgaaggatttttgtttcctaagacctatgaagtgcttataagcgatacggccgattcgcttattcgtaagatgctttcacaataccaatccgaaacggcgactcttgactattcatatgcgtctgcggcgggtctttcttcctacgatgtgctgaagttggcaagcatggtggaacgcgaggccgatgataccaatcgttcgcgtgttgccggggtattctacaatcgccttgcggcaaatatggccctgcagagtgatgcaaccattgcctatcttgttggcggcgatccaacacacgacgatttgtcgattgcaagcccttacaacacctatttgaataaggggctgccagctggccctatttgttcacctggtcttgatgcactttcggcggcgtgtcagcctgaacagaacgattacctgtatttttacttcgtgaagaatagcgatggttcgatgagctatttctttagtcgcacgtacgaagaacatcaacaggcaattgctcaaacgcagggcagcgatagcgatcagacgcaagaagagagcgattccagtggggaagcgcgtgattcttcctcatctgatgaatcatag

SEQ ID NO: 1804 - DNA, 1170 bp, Slackia heliotrinireducens DSM 20476
atgccgcgcaaacagatcacctacagcagcaggccaaatcatcgtgcccgtatggtgcatgcccaaggtgagaaacagttcagaacctacgacacctcccatatccgtccgcgccgcagcaaggtgccggtcatcgtggccgccgtcatcggcgtccttatcctggttctggcgggtttgcttctgacgaatttcgtgaagggctgttcttcggatgccaatgaaaacatcggcgagacggtcatcgtttccgaaggcacccaggtcaccatccccgaaggtgcgaccgcaaaagacgtcgccgcagttctcgccgatgcgggtctgatcgacgaccagaaggccttcgtcaagcgcgccgccgcattgggtgcggacgcccagttccaggccggcacatacaccttctccgaaggcatgaccatggaccaggtcatcaacgccatcgccacgggcgacaccggggtgctcacccttacggtgcccgagggctggaccaatgcgcgcatcgccactgccgtggaggagtcgagcaagggtgccattaccgccgaagacttcgcagcccaggcgcttgcttccaactatgtggaggactatcccttcgtcgagggcgcctacgaggattccctggaagggttcctgttcccgaagacctataacatcgagcctggcgacacggccgatacgcttatccgcaagatgctcgaccagtacgccgcagaggtcgaggtgctggattacacctatcctgaaagccaggggctgaccgcctatgacgtgctcattctggcttccatcatcgagaaagaggcgctgcctggcgaagacttccccacggaacgcgaggacgttgcttcggtcttctacaaccgcatggccgaggagatgccgcttcagtccgacgcaaccatgggctatgtcaccggtggtgaagtgaccgccgccgacctggagacggaaagcccgtacaacacgtacctgaacgacggtctgtgccccggtcccatctgcaatccttccatcgcgtcgctgcaggctgcctgcaatccctcgaccaccgattacctgtacttcttcatcgtagatgaggacgggtacgtggaccacaccttctcgacgacactcgaagatcatcaggctgccatcgaccgctacaccaacaggtag

SEQ ID NO: 1805 - DNA, 1356 bp, Atopobium parvulum DSM 20469
atgcccactccatctaatgattcttctccgcgtcgtcagggcgcacatttttcttcttctgtatcagagggacaggcccaggaagaacagatacaggaaaaacaaactcaacaagactcagcgcactataacgctggttcgcaagaggcgcttcagcagcctcctgttgaagctacgggatcgctgcctgcacttactggcggtaagctttcatcaagaagtgctcaagttacgcataaggcaaaaaataagcaggtcaagcatagagacaggaaggcttcaaagtgctctcgtatttttgcaacgcttatcgcttttgttatggttgcagctcttggcatttttgtgtggaaagttgcacttccagagctttctcgcactaactctgatacacaagaaattaccgctggtcagcaagttactgttaccattccagatggtgctggtgcgcaggaagttgcaaagattctttttgagaacaagattattgctactaagagcgagttcttagatcaggtaaagcgccaggatgctgagcagaaaatcaagagtggtagttatgttattaccactggtaccaagccagcagacatcgtacaccttcttgtttctggtccaaatgcccctggcagtggcttcgtcgtaccagaaggctataccgtttctcaagttgctgatttggctcagaactactttggcatttctcgcgatgatttcttaaatcaggcaaaagcatccaattatgttgctgactatccgttccttgccggtgcggtagatgctaacgattctcttgaaggttatttgttccctaagacgtatacctttacggaaagcaacgtaaccgctgatactgtcattcgtgccatgcttgatcaatttaaggcagagacggccaatcttaacttggacgctgctcgtattacgctcaacaaacgttacaacttgaatcttactaacgagcaaatcattaccatggcatcaattattgagcgagaagctctgactgatgaggatcgtcctaaggttgcgtctgttttctacaaccgcctgtatgatgatatgtatctacaaagtgatgcaactcttgcatattccttgggtagagaagctactgctgaagagttaagctcaatgacaagcgatccgtataatacctacgcgttcaagggcttgacccctacgcctatttgctctccaggttatgcctctattaaggcggcaatggatccagcagcaaccaattattactacttctggattacctcagatgaacatgtattctctgagacttatgacgagcatcaacaggctattgaaaacgcacgcgagcgtgaagccgcaagcaaacagtaa

SEQ ID NO: 1806 - DNA, 2211 bp, Moorella thermoacetica ATCC 39073
atggaagtgattgtggctgattacgcgggattttgcttcggcgtcaagagggccgtagaaaaggccagagaagcccccaaaccggtggcttccctgggcatgctcatccataaccggcaggtggtggatcagcttgcccgggagggagtccggccggtggcttccctggatgaagtcaactgcggccggatcctgatccgttcccacgggacaacaccggagaccttggtccgggcccgggataaagggctggagataattgatgctacttgcccctatgtaaaaagggcccagcatctggcccaaaaaatggccgccgaaggttaccaggtgattatcgtcggcgatgccgcccaccctgaggtccagggaatgctgggatgggccggaccgggggcggtggtagttcctgataaaaaagcggctgcagccttgcccttccatccccggcgggcggtcttagcccaaaccactcagcccgaatccaggttggaagaagtcgcagcagctttacgttccaatacggatactctggtagtacacaataccgtttgccaggccacccaccagcgtcaggaagcggcagtcaggttggcgcgccaggtagacgtaatggtcgtcgtcggtggtaaggaaagcgccaatacgcggcatttagccgaactttgccgggctaccgggacgcctacttaccatgtggaaagggccggggagttgtgtcgccagtggttcataaatacccggagggtcggggtcacaggtggcgcttcgaccccagcgtggattattgaggaggtagttggaatgttgactggagaggaaaaaattatggttccggaagaagaaaaggagccggtaaccactcaagaaccggtggcctccgggcaaccggtagccccggctgagccggaaggtaacccggcaattaccggacctgaaggcggggcagaacccccggcggctgaggccgcgaagtccggcgcgttcggggggcaggagggacccggggtagccccaggggagactggaacccctgaagagcaaagaaatgagatgcagcagataaccgcaaggatgccagaactacgccgcggcaacgtcgttgcgggtacggtcgtccagatcaccgataacgaagtgatggtagatgtagggggcaaatccgaaggcgttatccccctgaacgagctctcccatcgtaacgtaaccgacccgcatgaggtggtagccgttggcgatacgataaacgtcatggttttacggccggagaacgaagagggacaccccgtactttccaagaggcgtgccgatcgccgggtagcctgggaaaaattggaggaacacctggccagcggggaagagatccagggtgaggtaatcgaggtcgtcaagggcggcctgctggtagacgtgggcgtcaggggctttttgccggcttccctggtggaacggggttatgtggaagacctcaatgcctacctggggcaaaccctgcgcctgcgggtaatcgagctcgatcgcagcaagaataaggtcgtcctttcccggaaagccatcctggaagaagaatatgaaaagcagcgccaggctacctggaacagcctggaggtgggccaggtacgcaagggtattgtccggaggttgaccaacttcggtgcctttgttgacctgggcggtgtcgatggcctgctccatgtatccgaaatctcctggggtcgggtggaacacccgcgggacgccctgagcgaaggccaggagatcgaggtcaagatcctgggcatcgaccgcgaagaaggcaaggtttccctgggccgcaagcaactcctacccaatccctgggatacggcggccgagcgctacccggtagggaccattgtcgagggtaagattttgcgactggctcccttcggtgcctttgtggaagttgaaccgggtattgaaggcctggtccacatctcccagctggccgaccgccatgtcgataaaccggaagatgtcgtcagtatcggcgatatcatcccggtcaaggtcctgggggtggaccagcaggcccagcggatgagcctcagcctgcgccaggccatccgggagaagaacagaaaacaggccaaaccggccgaaaagcccgccgagaatcagaacgagagcggggttaagttaggcgatctctttggcgatctctttgaggcgaatcaatctacaaaccaatga

SEQ ID NO: 1807 - DNA, 2064 bp, Syntrophomonas wolfei Goettingen
ttgtatgtactacttgctcgaaatgcaggattttgtgcgggggtaagaaaagccgtaaaaattgcggaagaagccgcagaagaacctgataagtggtttagtttaggaccgctggttcataatgacgaagtcgtaaattacttccggcaaaaaggcatagagccagtggatatgttagaaagaattggggaacaaccggccgggataataatccgctcccacggaacttcccctgaagtgataaaacaagcccaggaactcggcttggaggttagggatgctacctgtgttctggtaaaaaagattcatgaaatagtaacccggttaagaggtgaagattatgatatagttgtttttggggacgccaggcaccctgaagtcgaaggaatattggggtggtgtggccagagagctagtgtagttgccagtgctgatgaagttggttatttacctgttatgccaaaagtagcactgatttcccaaaccaccagggatgaaaaggaatttcaaaaggtagcgggagctttaagtaataaatgccgggaactaaaggttttcaatactatatgctcagccaccaggagccgacaggaagcggcccgggaattatgccggaaagtagatttaatgctggtaatcggtgacctaaaaagttcaaacacccgcactctgagtaaggagtgtcaaaacaccggagtcaggacttttcaaatacaaaaggcttctgaaatcaaaccggaatggttggatggggtatcaaagatcggaattaccgcaggagcttcgactccggactggataattaaggaggtattggataggatgacgttgtacgaggaagaaaagatgctggatgagaaccaggaaacaaatcaggaaaccagccaggaaactcaggaaactcaggagatccaggagccagaggttaaggaagaagtatctgccaatgaagagtcatttgccaagctggaagccgaaatggccgattttactactcccaataaaggagatgtaataaagggcaaggttattcaggtgttggatgatgaagtaatggtggatgtgggtggcaaatctgaaggaattatccccctgcgggagatgtccttacaagatatagattccgccaaggaactggttgaagttggtgacgagatcgaagtaatggtattaaaatgggatgatgatggtaccatcctgctttccaaaaagaaagttgatgccaaaatacttctggatgagttagaggaaagctttaaagaaggaaaagtaattacaggtacggttaccggcagcgttaaaggcggtttattggttgatgttggaatcgtagcctttttacccgcttctcatgttgaagatggatatgttaagaatttggatgaatacattaaccgggaactgtcttttaaaataattgaattcaatcgcaacaagagaagaggttctcaagtagtgctttcccgcaaagaactggtagctgaagaaaaagccaaacagaaaaaacagttctgggaggagatcgaagagggacaggttcgcaaaggcaggataaaacggctggtagattacggcgcttttattgacctgggtggttatgagggcctattacatgtttccgagattgcgcataccagaattgatcaaccttccgatgtcttacaggaaggagaagaaatagatgtttacatcctggctctggatagagagaaggagagagtatccctgagccgcaagaaattacttaagagcccctgggagatagtgatggagaaattccaggaaggggatattattgaaggtacagtagtacggattgctccattcggagcttttgttgaaatcgaagccggagttgatgggttggttcatatctcccaactggccaaccatcgggtggagaaacctgaagatgtggttcaagttaatgagaagattaaaataaaaatacttagcattgaccccgaagaaaagagaataggtctttccctgaaggaagctctgaatgagatggaaaatcaggaagtacaagactatatggaaaaacaagaagagaacgaataa

SEQ ID NO: 1808 - DNA, 2085 bp, Clostridium thermocellum ATCC 27405
ttggagataatagttgctaaatcagccggtttttgtttcggggtaagtaacgcagttaaaaccgtcaataatcttctggaaaatcaaaaagagcccatatacacatacggtcctattattcacaatgcgcaagtagtagatctttttacttccaaaggtgttaaaaaaattgatgatattgacgaagcagagcccaacggtcatattgtaatcagggctcatggtgttacaccggacatttataaaaaaatttcagacaaggggttgattttggaagatgctacatgtccatacgtaaaaaaaattcacaaccttgtaaaggagaaaagtgaggaaggctacaagataataattgtaggcgacaggaatcatcctgaagttatagggataaatggatggtgtaacaaccaggcatatatagttgacagtgttgacgatgtagaaaaatttcccacaagcgacgaaaaagtttgcgtagttgcacaaacaacgataacaaacgaaaagtggctcgaggtaaacacggcattaaaaaagaaattcaaaaatattttaaaatttgatacaatatgtagtgcaaccagcagaagacaaaacgaagcagaagaaatagcaaaaaatgttgatatgatgattattatcgggggaaaaaacagttcaaacacccaaaagctttatgacatatgtaaaaagcattgcaatctgacgtataaaattgagacttccggtgatttgccaccggtagacataaaaaaaataaaaaaagtaggtatttctgccggagcttctacgccggactgggtaattgaggaggttattaaaaaaatgagtgaattaaacaaacaaggaatggtcgatattttagaaaatgatggtgaaatagatttcgccaatgcttttgagaattcgtttgtcagaatacatgcaggagacactgtaaagggaaaaataattggctttaacagcaatgaggttttcgttgacttgggttacaaggctgacggcataattcctctcgaagagtacactgacgaccctaacttcaatattgaaaaggaagtaaagattggagaagaagtcgaagttctcgttgaaatggtcaatgacggcgaaggcaacgtaagactctcaaagaggaaagtggatgccataaaatcttgggatgacatagttaaagcctatgaaaacaagactcctgtaaacgcttatgttgttgaagttgtaaaggggggcgtaattgccagctacaagggcgtaagaatattcgttcctgcttcacaggtaagcgatagatatgtaaaggatttgaacgaattcctgaagagaagcataactgtcagaattttagagcttaatgaaaaaagacgtaaagtggtaggttccgcaagggtgattatcgaagaggaaaaggaagctcttgccaacaggacatggaacagcatggaagttggaaaagtattcaaaggtactgtaaaaagtcttactgatttcggtgcttttgttgatataggcggagttgacggacttatccatatttcagaactttcatggacaagagtcaaacatccgtctgaagtattaaaagtcggagatgaagttgaagtaacagttttggagtttgacaaagaaaagaaaaaagtatctttgggatatagaaagatggaagacaatccatggtataaaatagaagaaaaatacaaagttggtgatgttgtcaaggtaaccgttctccgttttgctccctttggtgcttttgttgagctggaaaaaggtgtggacggattggttcacatatcccagatatcttcaaagagactggcaaaagttgaagatgctcttgagattggtatgaaagttgacgcaaaaataattgaagtagacggcgaaaacaagaaaatcagccttagtattaaagaggttatgccgatagatcctccttcatcaaagagtgaatccaaagcaaaggacggatccgaagcaaaagaaacctctgccaatactgaagaggaagctgaaccgacagagcatagggaagacatgaacgtaacagttgaagatttggtatcaaaaacaacgcaatcttaa

SEQ ID NO: 1809 - DNA, 2019 bp, Desulfotomaculum reducens MI-1
ttgcggattaaattagctagcaaggctgggttttgttatggcgtaaaaagagccattgatttagctttatccactgccaaagaaaaggcaggaaacatttataccctaggccccttaatccataatccccaagtggttcaaaatttagcggaaaatggcatatgtgaaataaacgatattggtgaagttaaagaagggaccgttattattcgttcccatggtgtaggaccagaaattatacaagctgccagggaaaaagggcttaaggtattggatgcaacttgtccctttgtagcaagggcccagaaatatgcacatgaaatggctgcacagggaattcctgtatatattttgggagatccgggacatcctgaagttcagggtattctaggttggactgagggcaaagggagcgttatagataatccaagtgaaataactcgggtggaacaccctaaggtaggggtcgtggcacaaactacacagccattgagtaactttcaggcattattagaagctctacaaaatcagggagtagaagtggatgccagaaatacaatctgccatgccactggcgaacgccaacgggcagcaatggaattggccagagaagtggatgtcatggttgtggtagggggtaagaatagtgccaatacaaaaaaactggccaagatatgtcaggaaaccgggacaccaacctatcatgtggaatccgcaagggaattacgtaaggaatggttcctagggcatgaaatagttggtctgacagcgggcgcttcaacacctgacgcaattatagaggaggttaaaaagaggatgaatgaaatggaccagatgaccaatggtgaagaaggaatgagcgaagctatggaggtgaaatctccacaggctggtgagcttgttaaaggtattgttgttcaagttggtatggatgaggtgttagttgatattcgagctaaatccgaaggtgtgatacctcgaaaagaaatggccttttatggtgtggataatctccaagaaattgtaaaagttggagatgaaatagagtgtgttgttatcaaagctgaggataatgaaggaaaaattattttatccaaagaacgtgcagatgcagaaaaggcttgggatggtttagaagaagccatggaacaaggtacaattattaaaggtgttgtacgtgaagttgtcaaaggtggcatgttggtggatgttggcgttcgtgcatttttaccagcttccttggtagaacgtggttatgttgaggacctttcgaaatacttaaatcaagagtttgaagtgcgtgttattgaaatgaataaacaacgtaaaaaagtagttgtatcacgtaaagctgttttagaagaacaaaatgcacgcaagcgtgaagaattacttgcttcgcttcaagaaggacaaattgtaaaaggcattgttcgccgtattaccaattttggtgcctttgtggatcttggtggattggacggtttactgcatatctcagaaatgagttggcatcgtattaatcatcctcaggaagtagttaaagttggggatgaactggaagttatggtattaaaggttgatacccaaaatgagaagatatctttaggtctgaagcaagttttaccaaatccatgggataatgttgaagaaaagtatcccgttggcaatatatttaatgccaaggtggtacgtttggctccctttggcgcttttgtacaattagaacctggtgttgaaggacttgttcatatttctcatttagctgaccgccatgttgaaaagccagaggatgtagtaaaagagggggaggaagtccaggttaaagtcctcagtatggatccctctgaaaaacgtgttcgcctttccattcgtgaggtcaatggtgaaagacggtccgcccgggaagcacgcccccggaaacaagaggaggttcaggaacagaatgtaatgaatgaaactcctgaagagaaaataacccttggggatgtatttggggatatgtttaaagaaaaataa

SEQ ID NO: 1810 - DNA, 2034 bp, Candidatus Desulforudis audaxviator MP104C
atggaagtgagattggccacaaaggcgggtttttgtttcggggtgcaccgggccattgatctggcgctgaagacggtccgcgaaacagcccctcccatctacagcctgggacccttgattcataacccccaggtggtggcctatctcgccgagcaaggaatcgaggttgtcgaggagattgaacgggtgccgcgcggaacattgattattcgttcccacggcgtggagcccaagctgttggagaagacccgggagttgggattcacggtggtggacgcgacctgccccttcgtgaagcgtgcgcaacggctggcctgtgatttgaacgactccggacaccaggtgatcgtggttggtgaccggaagcacccggaggtaagggggattgtgggctggacgaacggccaggccgtagtggtggaagaccgggtggaagcgagtgctctgcccttctatccgcgggtcggggtggtggcccagactacgcagccgcacgcgaacctggaggcggtggtggaggagctgaagtccaggatgggggaggtattggtgtgcgacaccatctgcaacgcggtggtggagcgccagaacgccgccctcacgctggcccggcaggtggacgtgatggtggttgtcgggggcatcgacagtgccaacacccgcaagcttactggtctgtgccgcctgagcggcactccgacctaccacatcgaaaccggagaccagttgcagtcggaatggttccggggttgcacggtcgccggcctgacggcgggagcgtcaacacctgattggattattgaggaggttaagaggcgaatggaagaattgtcggagaaggaagaggttgtcggtccagaggaagaggtgaacccggaacaagaggtcgcgaacccggaggaagaggttgtgagcccggaggaagaattgcagaccacaccggtgaggtccctcaggagcggggatatcgtcaggggcgtgattgttcaggtcggtcaggacgaggttctggtggatgtcggggcgaagtcggagggtgttgtgccgttacgtgagctgtcttgctatgatgttagctcccccgacgaggtagttcaggtgggagacgagatagatgtttgggtagtcaaggccgaggacaacgagggccggatcatcctttccaaaggcagggccgacgcggtcaaggcctgggatacgttggacaaggcctttcacggcggggaaaccgtcaggggtgtcgtccgtgaagtggttaaaggcggactgcttgtggacctgggtgtgcgttcgttcttaccggcgtcacaggtggagagaggctacgtggaggacttgagccaatatgtgggccgggaaatatccgcccggattatcgagctcaacaaggcccgtaagaaagtgatcctatcccggaaagtactgctggaggaagagtactcacggaaacggaaggaaacgttggaaaccacccaggagggcgatgtcgtgaagggggttgtccggcggctgacccagtttggtgcctttgtggacatcggcggcctagacggtttgctgcacatttccgagatttcctggcaccgcattaaccacccgtccgaagtgctcaaggtgggggacgaactggaagtccaggtgctgcggatcgaccgggagaatgagaaagtgtcgctgagcttgaaacaagtgctgcctaatccctgggagcaggtcgtggagaactaccccgtcgggagcgtggtcagcgcccgggtggtccgactggtgccgttcggggctttcgttgaattggaacccggggttgagggcctggtgcacatctcccacctggccgactggcacgtggccaagccggaggatgtcattgcggagggccagcagataaatgtgaaggtgctgagcgtggacgacgagaacaagcggatccggctctccttgcgggaagtggtcaaggacaaggattatcacaacgaccaggggagcgaggtaaccatcggagacgttttcggggacctgctccataagaattag

SEQ ID NO: 1811 - DNA, 2118 bp, Natranaerobius thermophilus JW NM WN LF
ttggaaatattggttgcaaaaggtgctggtttctgtagcggtgttaatagagccttagataagacaatccaagctgtacaaactgatacatcacgggacattcaagtttttacccttggccccattgtacataataaagaggttatacaaaacttaacagaaaaaggaataggtattatcgaaaatttaacccagctccaatcgaagaaatgtttaagtgaagaaactaataattatgtcgttattagaagtcatggagttggaccggaaacttttaagatgctgaataatttaagtaatacggatgtgattgacgctacttgtccttttgttaggaaggtacaacagaaagcaagtaaattatatcaagatgggtatcaaattttcatagtaggtgatcctaatcatccggaagtgaaaggaattaaagaatggactgataataatgccattgtgattgaaaaacctgaacaagttaatgatatagaaatatctaataaaactgctgtagttgctcaaactacattaagagaagaaaaatttaatgaaattgtggaaaaaatacttgatagaaacccaaatacaatagttcataacactatatgtgatgccactcaaaaacgacaaactgccactaaagagttagcagggcaagtggatgtcatgattgtcgttggaggatataacagctcaaataccaaaaaactaaaagagttagctgtcaaggaaggtgtacctacttatcatattgagacagctaaggaactaaaaacagattggtttttgggctgtaaaaagataggtgtgacggcaggggcctcgacacctgattggactataaaggaggtagttggtaaaatgagagaatttgaagagcaaaatgaaaaccttaatactaattcagatgagtcaactcaagaaagccaagatgaattaatgaaagcaacagaagattcggctgacaaacttgacaggggacaagtcgttaaaggaaaggtagttaaagtaacagaagatgaagcaatgattgatgtaggttataaatttgaaggctcagtaccagttaacgaaatgccaataaaggaaggagaatctctagaggatttactttctgagggagacgaaattgatgttaaagtggtgaaagttgatgacgaagaaggacaattaatactttctaaaaaatgggctgacaaagataaacaatgggagcaattggaacagcttatggaaaatgatgaagaaatcaaagcacaagtgacagaggaagtcaaaggtggtttggtcgttgatttaggtcaattacaagggtttataccagcctcccacgtagacatacattatgtacccgatttaagcaagtatgtgggagaagaattgagactgaaacccatagaattggatcgttctagaaataagatagtactaagccagaaaaatattttagaacaggaacaggaagaaaagaaaaataaaaccatggaaactattacagaaggtgatatcgtcgacggaaccgttaaaaggttaaccgattttggagccttcatcgatatcggtggaattgatggtttatgtcatatttctcaaatttcacatagtagaattgaccatcctgaaagtgaattagaaactggggaaaatgttaaggtaaaagtattaagcttagatcctgaaaatgaacgtatatcattaagtattaaagaagcacagcctgatccctttgaaacttttatgaaacagtataaatctggagatatcgttcaaggcaaggttgttagaactgttaattttggtgcatttattgaaatcacaccaggtgttgaaggactttgtcatatttctcaattatccgatgatcatgttgctaaaacccaagatgtagttaatgagggtgatcaagttaccgtcaaaatattaagtatagatgatcagcagaaaaaggttagtttaagtatcaaagaagctcagggaaaaagcaaaaaagaacaagaacaagaagagtttgcaaaatatcaggatagtcaagaggaagaagaaggtgtgaaattaggagatatgtttggtgatgtactagaggaaataaaggaagatgataaggatgataaatcgaagtga

SEQ ID NO: 1812 - DNA, 1200 bp, Elusimicrobium minutum Pei191
atgaccaacgcagaagaaaataaaattgattcaaagcaagaagcaattcaagttgaggcggcgcccgagcaggaaatgacgatggaccagctttttgccgagcaggaagaattagtaaacaaacttaataaaagggaaatagtgcaagttaccgtagtgcaggttggtaaggatagcgtgctcgttgacacgggcgacaagaaggaaggatacattcctttatctgattttgagggaaaagccgttcctgaagcgggggaaaaggtttccgcggtattagttaaaaaaggttctgatgaaagacacgctgttttatctttcaaaaaagcccaggaatatttgggttgggaaatagccaaaaaagcttttgataataaagaaagagtgcgcggtacaatagtgtcttgcgtaaagggcggttatattgttgacgttttcggcgttagcggttttatgcctttatctctttcagaacttcatacggcctacaagcattatcttcccgcaggcgccaaggtaaaatgcgttgtggttgaattttccaaagaaaaaaacaaacttatagtttcacgcaaacaggttttggaagaagatgaagccgtaagaagagacggcgttttagcccaggtaaaagagggtgaagttttaagagttgttgtcgccaaagccgataaagacaaactttatttacgcttccacggcattgaaggcgttgttactttagataacgtagcctggcaagacactgaaaaagcgattacttcttttagaagagggcaaagacttaaagctaaattacttaaaattgataaagaaacaggtaaacttgaatttggcttaaaacagcttttcttaaacccggctgacgctttaagaaggaaattcccttataaaagcacaacaaaaggcaaaattgttgctattaccgaagaaggcgttgaagtttctttaggtaaaaataatacaaaaggttttataagccaatttgaaatgggcagagattttgatggtaatgttgacgacgttattaacgttatggttatcggcattaatccggatgactgcagcgtcaacttatcagttaaaaagtatgaccaggttcaaaacaaaaaatttgttgcccagtatatgaagcaagcccccagacccactttgggacagcttttgcaagactcgttggaagaatctgaaaataaataa

SEQ ID NO: 1813 - DNA, 1986 bp, Desulfitobacterium hafniense DCB 2
ttgaaaatcatccgggcagaaaaagccggattttgctttggtgttaaacgagctttggatatggcggagcgaacagttcaatcttcaagtaccgcttctttgggtcccttaattcataaccaacaggttgtggaaaaaatggagaaacaaggggttcgtgtcgtcggggaagtgaaggagactcaagccggggacaccttgattatccgctcccacggagtgcctccggatatctatgaggaagcccggcgctgtcaagtcaaggtggtggatgctacctgcccctttgtgcaaaaggctcagcggctggcggcagaatcttcccagtccggtcaggtcgtggtggtgggggatcggcagcacccggaagtccaggggattttaggctgggccggcggcaatgccattgctattgagacccttgaggaagccagggaactccccttttatgagcagctctccgtgcttgctcaaacaacccagccggctgctaatttccacgggattgtggatgagttaaaaacccatactcacgcgctcaaggtacataatacgatttgtaatgccactgaagagcggcagaccgtggcccgtgaattggccggcaaagttgatgtgatgattgtggttgggggcaaaaacagtgccaacaccagaaaactggcggggatttgctctgaacgaactcagacctatctcatcgaaaccgccgacgaattggaagataactggttcacaggggtggtcaccgtaggattaacggcgggagcctcgacaccagattggattattgaggaggtttataggaagatgtcaacaatggaaaacaaggaaactcatgaaatgatgaatatggaggactgggccgaaggaatgcaaaatttgcaccggggagctctggtcacaggaactgtggtgaaaatcaatcacgatgaagtatttgtcgatttaggttggaaatcggagggcgttatcgctttgaaagagcttaccgtagcttccgatctgcagaccagcgatattgtagccatcggcgatcaaatcagcgccgttgttctccgtgtggagaatgaagaagggaacccggtgctctctaaacgccgggctgatgaaatggctgccgtggataagctgaaagaattagcggagagtaaagaagagattcaaggaaaagtggccgatgtggtcaaaggcgggctgattgttgatgtaggtatgcgcggctttgttcctgcctctcaaattcaaccgggttacgtggaggatttgaaccaatttaaaggccaaaccctccgtctcagagtgatcgagtttgatccggctaagcggcgcgtggtcctttcccagaaagaaatcctccaagaagagcaagcggctaagaaagagcatctcctggcgacccttcaggaaggggatgtggtcagcggtgtagtgaagaggctggctcagttcggtgcttttgtggatatcggcggagtggatggactgcttcatgtttccgatatagcctatacccggattaagcatccttctgaatatgtcaatgtgggggatgaagtagaagtccaaatcctcaaagtggataaagagcagggcaaaatttctctgggtctgaaacaattaaaacccagcccctgggaaagtgctcctgaaaaatatgccttaggctctttggttactggaaaagtagtgcgcatcgcccccttcggagcctttgtccaactggaggatggcatcgatgctctgattcatatttcccagctttccgaaaagcgggtcaataaagttgaagatgtagtgaaagtcggtgacatggttcaggctaaggtcattgaatgcaagccggaagagaagcggattagcttaagtatccgtgaagccgctgccgaagcacaggctacggaagatgcagaactcttggccagtcagcctgaagcacctcaggttaccatcggtgatgtggttcaatctgaatcagaatcctaa

SEQ ID NO: 1814 - DNA, 1164 bp, Geobacillus WCH70
atggcagaggatatgaatttagaagtgaatgtatataaggtaggtgatatcgtccgaggcaaagtggtaaagctagaagataaacaagtgcttgtcgatattgaaggaagcaaacaaagcgggattattccaattagtgaattatctagtttgcatattgaaaaaacaagtgatgctgtctctgtcggcgatgaagtgacggcgaaagtcaaaaaagtagaagaaggcgaaaacgaagaggatggactgttaattttatcaaaaaaagcggtagacgcagaccgcgcttgggaagagttagagagaaaatttgccagcggagaaacgtttgatgtcgtcgtaaaagacatcgtcaaaggcgggcttgttgctgatgtaggagtgcgtggatttatacctgcctcccttgtcgaacctcactatgttgaagacttttctgattataaagggaagacgcttgcagtaaaagtggtagagcttaaccgtgaaaaaaatcgcatcattttatcacatcgtgctgttgtggaagaagagcaagaacgcaagcacaaggaggcgcttagccgtttagagccaggacaagtgcttgagggaaccgtacgccgtgtcaccgactttggcgtgtttgttgatgttggcggctttgatggacttgtacatatttcgcagctttcccatacacgtgtcgcccatccgtctgaagtcgtaaaagaaggagaaaccgtaaaagtaaaagtgcttgcggttgacgaagaaaatggccgcgtctccctttcgatcaaagaagcaatgccgggcccttgggaagggattgctgaaaaagtcgcccctggcgatatcgtcactggcaaggtaaaacggcttgtaccgtttggcgcgttcgttgaaattttcccaggcgtcgaaggccttgtccacatttcacaaatctctaataagcgcatcggcacccctcatgaagtgctaaaagaaggagaagaagtaaaagcgaaagtgcttgatgtaaacgaagcggagcgccgcatttcgttaagtatgcgcgagctgatcgaagaagaaacagcacctgaagaagattatagccaatatacaaagccgtcaaatgaagtaagaggttttcaaattggcgaagtcctcggggaacagctgaaaaaattaaaataa

SEQ ID NO: 1815 - DNA, 2061 bp, Anaerococcus prevotii DSM 20548
atggaaataattattgcaaattattcaggattttgcggtggtgtaagaaggtctgtggagcttgccgaagaagctataaagaatgaaggcgagcgctactgtgtaggacctttgatacataatccgcaattagtcgagaaattagaaaatgaaggactagaagttgttgataaaaaagaagctctaaagataaaagattctacagttcttataagggcgcacggagaaagtgccgactttaaagaaagacttttagcaaacggtaacgaagtagtggatgctacttgtccagtactaaacaatatatacaaaaagattatagaaaaagaaaatgatggataccaggtggttattgttggagataaaacgcatcccgaaataattgctatggaatctttcctaaacaatggtataatagtttcagatgagactgaagcaaaaaatataaaatgtaataacaagctttatgttgttagtcaaactacaaataggcttgattatttttatgatattgctaacaagttaaaagaaaataatgatagtgtagtaatagaaaacacaatatgtaaagcaactgaaaataggcaagaagcagccaaatccttagctaaggaagttgattgcatgattgtagctggtggttttaatagttctaatacaaataagctatatcaagtagctaatctgtattgtaaaaatgtttttaggattgaaactgttaaagatctacctttgcaaaagctctctaaatttaaaaaagttggtataatcgcaggtgcctctacacctgatgagattatcgaggaggtagtaagtagtatggatgaattcacaaaagaagaatttatgaacagtctagaggatagtttaaagaagatttacccaaaggaaatcgtaaagggtacagttattgatgttaaggatgatgaagtattcgttgacattcaatttagagctgacggaattatcaaactagacgaaatgacagaagaagaagcaaaagatccaaaaaacagttttaacgtaggtgatgagattgacgtattcgttatcaaattagatgacggtgaaggcaatgtttcactttctacaagaagagttgaaggtatgaaggtatggaaagacctagcagaaaaggctgaaaatgatgagttagttcacggagtagtaagtggattcaacaagggtggtcttactgttaatgttgaaggaataaatggatttgttccagcaagccaaatcgcaacatactttgttaaaaacttcaagaaattcgttggagaagagtgggatctaaaaatcatcagcatcgatgaaagaaaaaatagactagttctttctagaaaagaagtagttgaagatgaacttgacggactatgggaagaacttgaagaaggacaagtagtaactggaaaagttgcaaggcttacagacttcggtgctttcgttgaagtaaatggtcttgatggactcctacacgtatcagacatcgcttggagcagagttgaacacccatctgatgtactaaacgttggtgatgaaatcgaagttaaaattctaaaattaaatcaagaaaagaacagaatttctcttggacgtaaacaacttctagaaaaaccatttgaagcattcgttaaccaacacgaagttggtgatgttgtaactggtaaggttgttaacctacttgactttggtgctttcgttgaagtagcagacggagttgaaggactagttcacgtttcagaaatttcatgggaacatgttgaaaagccatctgatgagcttaacgttggtgatgaaatcgaagttaagatcataagcatcgatacagatgaagaaaaagttggcctaagcattaaagctcttaaggaagctccagaaagaccagaaagaagagctaagagagctccaagaaacaatgatagaccaagaagaagaccagaaagagataattctgcttcatttggtgatgacgatctaaataacaatttaggtaacctactagaacaagcattatctgaacaaggtagtgaaggattactagaaggcgaagacgaataa

SEQ ID NO: 1816 - DNA, 2031 bp, Desulfotomaculum acetoxidans DSM 771
atgaagattattgttgcggataaagcaggtttttgttttggagtaaaaagagctatagatatggccaatgatgtggtgcgtaaacgggacggacctatttactcgctgggtccgctgattcataacccgcaggttgttgataaattggcgcaagaaggcatcatagctattgatgatttaaaagaaatacatgcaggtaccgtaattattcgttctcacggagtgggaccggaaattctatcagaggtctatgaaagaggtttaaatcttattaatgcaacctgtccttttgtaagccgagcccaacaaattgccagagatctttatacagaaggcaggcaagtgatagttgtaggagacaaggatcatcctgaggttcaaggtatagtgggttgggctaacggtcaagccctggtagttcagaattctctggaagctgaggcactgggggcaatatccaatgcaggtgtcctggcacaaacgactcaaccactggtaaattttcagcaagtggtagatgtcttaaaacaaaaaactgagcagcttaaagaatgcaataccatttgtcatgctaccggtgaaaggcagcaagcggcacttgaactggcacgcaatgtggatgtaatggtagtagtgggtggagcaaacagcgccaatacagggaaactagctaatttgtgccgctctaccggaacaccggcttaccaaattgaaactgccggagagttacgtgtcgggtggtttgcctgtgttgaaaaagttgggcttacagcaggtgcatcaacacctgactggattatagaggaggttaaaaaacgcatgaatgaattaggcgaaatgaatggtatagaagaaagtaaagagcaactggaagaaataaactctgctgaagagggtatgcaggattcagtagaagttaaagcgctgcacaatggagatatagtaaaaggggttgtagtgcaaataggccaggacgaggttctggtagatgttgggtcaaagtcggaaggttttatatctgctaaggaattatcaagctttaacattaattccccggatgaagtggtcaagattggggatgaaatagatgtatttgttataagtgcggaggataacgaaggtaggataaaattatcaaaaaccagagcagatgccgaaaatgcatgggctaaattggagagcctattggaaagcagtgaaaagatagaaggaacagtgagagaggttgttaaaggaggtttgctggtagatgtaggagtaagggcctttttgcctgcttcattggtagataagggttatgtggaagacctctctaaatatgtaggggaaaatataactgctcaggtgattgagattaaccggatcaggagaaaagttgtactttccagaaaggctatcttagaagaggaatatgctaatcgcaaggaagagctgctgaattccttacaggagggccaaacagtaagtggtatagttagaagaattactaatttcggcgcttttgttgatatcggaggtgttgacggtcttttacacatatctgaaatggcctggtacagggttactcatccttcagaaattgttcaggtaggtgatgaagtaactgttatggtattaaagattgaccgcaatgcagataagatttcactgggattgaaacaagttttagccaatccctgggaaaatgttgattccaagtaccctgtgggagcgattgtagcggcaaaagttgttcgtttagcaccctttggcgcctttgttcaattagaaccaggtgtagaaggtttggtacacatttcccacttggcagatcatcatgttgaaaaacctgaggatgttgtgagtgagggtgaagaagttaatgtgaaggttttaagcgttgacacacaggaaaagcgtattcgtctctccattaaagaagtgaccaagaaagttaaagaagaaaaaccggtacaaaactatgaaagcaatagccaaggttcaggagaaatcactattggtgaaattttaggagccagtctaaaaaaataa

SEQ ID NO: 1817 - DNA, 1158 bp, Alicyclobacillus acidocaldarius DSM 446
atgtcagaggatttgcgtgaaatgttgaccgatgcggcggttcgcgagggggacgtggtgaccggcgaagtgaccgccgtggacgatcacggggtgaccgtcgcgctgcctcacggttatgaggggcatatatcgccgcaggaactgtcggcggtgccgggaacgcatccgagtgatgtcgtgagcgtgggcagcacggtgacggcgcaagtgctgaaggtcgacatggaatccggccatgtgacgctttcaaagcggcgcgctgaacaggcgtctgcgtgggagcgcatgcagcaattgctggagagcggagaacccatcgaggtggagattcgagacgtcgtcaagggcggtctggtggcggatgtcggcgtccgcgcgtttatcccggcatctttggtggatcgccatttcgtcgagaacctcgagcaatttaagggacagaagctccgcgccaaggtgattgaggtcgatccgcagaagaacaagctgattctctctcggcgcgcggtgttggaggaagagagcgaggcgcgggcgcggaagctgttcgaggagttgaagccgggcgacgtcatcgagggaacggtgcagcggctgaccgatttcggggcgtttgtcgatgtagggggcgccgacgggctggtgcacatctccgaattgtcgttttcccacgtcaaccatccatccgaggtggtgcgcgagggcgatcgcgtcaaggtccgcgtgctccgcgttgaccctgaggccggtcggatttcgctgtccattaaagcggcgctgccggagccttgggagacctatgcccacgagtttcaacctggggatgtcgtccagggcgtggtgcgccgggtggtggacttcggtgcgtttgtcgagcttcgccctgggttggaggggctggttcacgtgtctcagatctcgaacgagcacgtcgataagccgtccgacgtccttcagcctggacaagaggtcacggtccgcgtgctgagcgtggatccggagcgcaagcgcatctcgctgtccatgcgggattcatctcagccgcgaggcgggcaagggcgagggggccggcgagatcgcaggccgactgagcctcgcaacgaaggcgcctctgggccaacgctcggcgatctgtttggcgatttgttcaagtga

SEQ ID NO: 1818 - DNA, 1152 bp, Desulfovibrio desulfuricans G20
atgactgaacccgcaaagcgggaagattccgggctgcctgaggccgttactgccatacggccagaggtggcggcattcaaaccatacgcgcccggcctttccattgatgaaatcaaggaacgctacggactttcccaggtcgtgaaaatggccagcaacgaaaatccgctgggcacctcgccgctggttcagcagacactgcgtacccatgcagaccttgccttccggtatgtccagtccggcaatccccggctggtcagcgccattgcccggtctttcggcgttgctgccgaaagcgtggtcaccggcaacggctctgacgaggtgatagaccttatcatacgggtcaaggcccgccccggaaagcacaacattgtcgcattcaatccctgcttcagcatgtacgagctgcagacgcgcttctgcggtgtagagttccggcaggtaccgctgcgtgccgacttcagtttcgactacgacgcttttgtcggcgccgctgatgccgacacggccgtcgcattcatcaccacgcccgacaacccgtccggctactgccccccggtcgaagaaataatcgatcttgcgcggcgtcttccttcatcatgtctgctggtagtggacgaagcctacatggattttgccgatgaccctgccgcccactctgttctgccgcacctgacagaatttcccaatgtggcagtgctgcgtactttttcaaaaagttacgggctggccggtctgcgtctgggtttcggcgttatgcatcccgcccttgctgactatgtaaaaagggtgcggctgcctttcagcatcaacatactggcagagtacgcaggcatagcggcactgcaggacaccacattccacgcgcagaccctgcgtgtaacccgcgaaggcagaacctatctgaccggcgcgctgaccgaggccggatgcacggtgtacccttccgcagccaacttcatcatgttcgcgctgccggaaaactgcccgcacgatgcgcgcgcggtattcgaggcactgctgcgccgcggtatcatcatacgtccgctaagcagctacaacctgccgcagtgtctgcgggtcagcataggcaacaggcacgaaaacgagctgttcatagctcagttcaaggagcttctccgtggctga

SEQ ID NO: 1819 - DNA, 1167 bp, Syntrophobacter fumaroxidans MPOB
atgaaggaaagaggaccgtggcccccggacggaccggccacgcggcaaccgaacaaaatgaagccttctgtacccgaacatatcgcttcgctggtcccatacccgccgggcaaaccgatcgaagaactcgaacgcgagtacgggatcaccgattccatcaagctggccagtaacgagaaccctctcggtccatccccgaaggcgatgcaagccgtcacgggagccctgtcccgattgcatcgctatccggacggaagcggatactatctcaggaagcggttgagtggaaaatatgcgctcccattcgacggcatcgtcctcggaaacgggtccaacgagatcatcgagctcgctattcgcgctttcctggttcccgacgacgaagtcatcatgcccgccccctcctttctggtttacaagctcgcagtccagaccatgggaggcaaggcgatccacattccgctgaagcgcttcgccattgacctcgaaaaaaccgccggagccgtcacgccccggacgaagatgatatttgtcaacaatcccaacaatccgaccggtactctcatttcgaaacgggatttcgacgtctttctggaccgcatccctcccgaaatcgtcgtcgtcctcgacgaagcttacatcgaattcgcccgggaccccgataccccgaacggttttgactacatcgaccgccaggggccgttcgtcattgttttgagaaccttttccaaggcatacggactggccggcctgcgcatcggtttcggagcgatgaaccctttccttgccgattatctgcaccgcgtgcggcagcccttcaacacaggaactctggcgcaaatcgccgcgttggcggcactggacgatgaggatttcctgcacaggacccagagggtggtctgggacggcttgcaatatctctaccgggaagtggaacggctgcggttgaactatcttccgacggaggccaattttttcctcatcgaggtcccgggacccgccaagtggttctacgaggcgatgctgcggcagggcgtgatcgtccgcgccatgagctcctacggcatggacaatcatattcgaatcaatgcgggtcttcccgaggaaaatgagcgcttcataagaacgttgagcgacacgctggttcagtttagggcatctctttga

SEQ ID NO: 1820 - DNA, 1122 bp, Desulfovibrio vulgaris DP4
atgaccgcaccaagcatgagcaggccggacgatgtgcggccagaagtgctcgacttcaagccctacgttccgggcttgtccatcgacgagatacgcgaccgcttcggactcgccgacgtggtgaagctggcaagcaacgaaaaccccctcggcacttcgcccgtcgtgcagcgtaccctcaagaccaaggccgacctcgccttccgctacgcgcagtcgggcaacccccgcctcacgcgtgccattgccgcccatcatggtgtcgcgccggaacgtgtcgtggcgggcaacggttcagacgagatcatcgacctgctcatccgcgtgcgcgccacccccggcaagcacaacatcgtggcctttcgcccgtgcttcagcatctacgagcttcaggcgaagttctgcggtctggaattccggcaggccgacctgcgacccgatttcaccttcgactgggacgccttcctcgccgccacggatgagaacaccgccatcgccttcgtgaccacccccgacaacccctccggctggtgtccgccggtgtctgaacttgaacacgtcgcccgcacactgcccccgtcgtgcctcttcgtcatcgatgaggcgtacatggatttctgcggcgacgaagccgcgcattcgctgctttctcggcttgacgccttccccaacatcgcggtgctacgcaccttttccaagagcttcgggcttgcgggacttcgcctcggctacggcatcctcccggaacgtctggctgactacctgcaccgggtacgactgccgttcagcgtgaacatcctcgccgaagaagcgggacttgccgcccttgaggatactgtgttcagaagcgagacccttcgcgtcaccgccgaaggccgtgcatacatcgccgaaggactgacggcactggggtgcgaggtcctgccttcgtgggccaacttcatcatgttccgaccgcccacggatgcaaccgacctcttcgaggcgcttctgcggcgcggcatcatcatcagacccctcaaaagctatggcctgccccaacacctgcgggtgagcatgggcaacgccgacgagaacagacgtttcatagcagcctgcaaggagattctgcctcatgcctga

SEQ ID NO: 1821 - DNA, 1095 bp, Anaeromyxobacter sp. Fw109-5
atgcctctcgtcccgccccacgtcgcctcgctgactccgtacgtccccggcaagcccatcgaggaggtggagcgggagtacggcgtctcgaacgtcgcgaagctcgcctcgaacgagaacgcgctcggtccctcgcccctcgcgctggccgcggcgcgagaggcctgcgccaaggtccacctctaccccgacggctcggcctacctcctccggaacgcgatcgccgcgaagctcggcgtcccgcccgaggaggtgatggtcgggaacggctcgaacgagctcatcgagctgctcgtccggacgttcgtgctcgacggcgaggaggtcctgacgagcgcgcagagcttcgtcgcctacaagctcgccgcgcacgagcacggccgcacgctcgtcgaggcgccgatgaaggggcgcttccactacgacctcgacgcgctccgcaagctgctctcgcgccgcaccaagctcgtgttcctcgcgaacccggacaacccgacgggcacctggttcaccgaggcggagctcaccccattcctcgacgcggtgccgaaggacacgctcgtcgtgctcgacgaggcctacgtcgagtacgtggacgcgccggggttccaggacgggctcgcgctgcgccggaagtacccgaacgtcgtggtgctccggaccttctccaagatctacggcctcgccggcatgcgcctcggctacgggctggcgcggccggaggtggtggagtacgtcgaccgggtgcgcccgcccttcaacacgaacctcgtcgcccaggcggccggcgccgccgcgctcggggactccgcccacgtcgcgaagagccgcgcgctcgtcctcgaggagcggccgttcctcgcgaaggggctcgccgcgctcggcgcgatcgtcgtcccgtcacaggggaacttcgtcctggccgacttccccggccggaccgggaaggatctcttcgaggcgctgctgcgcgagggcgtcatcgcccgtcccgtggcgggctacgggttcccgagcgcgctcaggatcaccgtggggctccggcgtgagaacgagcggtgcctcgcggcgctcgggaggatcctcggcgcgtga

SEQ ID NO: 1822 - DNA, 1089 bp, Candidatus Desulfococcus oleovorans Hxd3
atgaagatatcgccgccggactatattttatcaatcaagccctatgtgccgggaaagcccattgaagagctggagcgggaatacggcatctcgggatctatcaagctggcctccaatgaaaaccccctggggccgtcccccctggccctggccgccattgaaaaagcactttccgggctgcaccgctaccccgacggcagcgggtattacctggtctcaaaacttgcgcaaaaactgggggtggccccggagtccattgtcctgggcaacggttccgacgacatcatcggcatgctcacccgggccctgctgctgcccggcgacgaggtgatcatgaccgatccctcatttgccatgtatgatatcaccacctgcatggtcaacgcgcggtcggtctatgtgccgctgatcgaccgggcactgcctcttgacaccgtggccggtgccgttacgtcaaaaacaaagatggtgtttctcaccaaccccaacaacccgaccggcacggttttttccggaaaggcgtttgaacggtttctggaggcggtgccctccgatgtggtgattgtggtggatgaggcctacatcgagtttgttcaggacccggagtgtgcccgggcctttgattttcttgacaacagccgtcctctcgtggcgttgcgcaccttttcaaaggcctatggcctggccggcattcgggtgggatacggcgtcatgccgccgtatctggcggcgattctaaaccgcattcgccagccctttaatgtcaactccctggctcaggtggcggctattgcggctctggatgatgaggcctttttaaaacaaaccctggccgtggtgcatgacgggctggcctggctttatgccgagctggagaaaatgggccttcgctgttttccctcccaggccaatttttttcttgtcgatgtaaaaaaagatgccgccgctgtttttgaagagatgttaaagcagggcgtgatcattcgctccatggtctcctacggatatccttcctatatccgggtaaccgttggtctgccggaggaaaacgcccggtttgtggcggcgttaaaggcggtgctgaaatga

SEQ ID NO: 1823 - DNA, 1164 bp, Desulfovibrio vulgaris  Miyazaki F
atgtgtgccgacaaaacagccagcgcaggggcccccacggggcttccgctggcctcgcccagcgccgtgcgtcccgaggtgtgcgggttcaagccgtacacccccggcctgtccatcgacgaaatccgcgacaggtacggccttgcccacgtcatcaagctggccagcaacgaaaatccgctgggcacctcgcccgtggtgcagcatgccctgcgccacaaggcggacctggccttccgctatgcccagtcgggcaacccgcgcctgacggcggccatcgccgcgcatcacggcgtgcctgcggaacgcgtggtggcgggcaacggctcggacgagatcatcgacctcatcgtgcgggtgcgggccgtgccgggcgtgcacaacgtggtggcgttcaacccgtgcttcagcatctatgaactgcaaacccggctggcgggggtggagttccggcaggcgccgctggcggcggacttttccttcgactgggacggcctgatggcgctggtggacgatgccaccgccgtggtcttcgtgaccacgccggacaacccctccggcttctgcccgcccgtggccgacctggagcggctggcccacgccctgcccgccggctgcctgttggtggtggacgaggcgtacatggacttctgcggcgacgagtcggcccactcgctgctggcccgcgtcgacgaattccccaacctggccgtgctgcgcaccttttccaaaagcttcgggctggccgggttgcgccttggctacggcatcctgcccgtgcaactggccgactacctgcgccgggtgcggctgccgttcagcgtgaacatcctggccgaagaggcgggcctggccgcgctggcggacgacgtgttccgcaccgaaaccctgcgggtgatcagcgagggacgcgctgcgctgacggaggggctgaccgcgctgggctgtcacgtgtaccccagcaaggccaacttcgtgatgttccgcccggccccgacctgcaagagcgcggcgcacctgttcgaggaactgctgcggcgcggcatcatcatccgcccgctgaaaagctatggcctgcccgacctgttgcgcgtcagcgtgggcagcccggacgagaacgcggcgttcctgaaggctgccggggagatcatggcccatgcctga

SEQ ID NO: 1824 - DNA, 1161 bp, Desulfovibrio desulfuricans ATCC 27774
atgtttcagatcagcgtgcggcaggaaattcttgccctcaaggcctatgttcccggcctgtccattgctgaaatccagcaaaaatacggccttgcccaggtcatcaaaatggccagcaacgaaaacccgctgggcatgccgcccctggccatacaggccgtgcaacgccatgccgacatgggctttcgctacccccagggcggcaatccccgtctggtggaggcgctggcccgcaggcactgccttgagcctgcccgcgtagtcgttggcaacggttcggatgagatcatagacctgcttatccgcatcatggccgaaccgggtatacacaacctcgtatgctttgacccctgtttcagcatttatcccattcagggacgcatcggcggcgtcgaggtgcggcggcagcctctcaatgacgacttttcctttgactttgacgcccttctttcgcatgtggacgacaacacccgccttgtgtttgtgaccacacccgataatccctccggctattgtcccccgcgtgaagccgtggcgcaactggcccgccgtctggcggaaaccgcgccccgctgtctgctggttgtggacgaagcctatatggattttgccgaaaatgagcaggaatcatccctgctggccagtggtatcctaccggaaaacacggcatttctccgcacattctccaaaagcttcggtctggcgggactgcgcgtgggctacggcattctgcccccggggctggccgacttctggtggcgggcgcgactgcctttttccgtcaacattctggcagaagaagccgctttggcggcgcttgccgatacggcctttcttgacgcgaccatgcacaccgtacgccggggccgcaatgtccttactgtagggctgaccgcactgggttgcatggtctggcccagcgcggccaactttgtactcttcagactgccggaaaacacccttggcgctcaggactgtttcgaggccctgctgcggcgcggcattatcatacgcccgctcaaaagctataacctgccggaacatttgcgggtcagcgtgggcaacaaggatgaaaacagggcctttctggccgctatggacgcaattttgctggaaaagcacagagccgccaacggccttgaaaacaaggagctgaaatga

SEQ ID NO: 1825 - DNA, 1116 bp, Desulfomicrobium baculatum DSM 4028
atgaccaaggttttggtgcggccggagatggcggggttcaaaccctattcccccggcctttccatcgacgagataaaaaagcgttacggcctgccccgggtcatcaagatggccagcaatgagaatccgctgggcacgtcccccgtggttcaggagcggctcaaaaacatgagccccatggctttccgctacgcgcaggccggttccccggccctgaccgagagattggcggcgcacctgggcgtgcccgcaagctgcgtggtagcgggcaacggctccgacgagatcatcgacctcctgctgcgcgtggtggcccggcccggcgtggacaacgtggtggcctttagcccctgcttcagcatctacgacgtgcagtcgcggctatgcggggtggagttcaggcaggccaagttgaacgcggatttttcctttccctttgatcagcttgtgtctctgaccgacgagaacaccgccctggtcttcgtgaccaacccggacaacccctcgggtcatgcctgcccggccgccgatctggtggcgctcgcgtccaggctcccggcgcgtacgctgttggtggtggacgaggcctacatcgatttcgccgagccgctggacgtgttcagcatgctcccgcatctggacgccatccccaacctggtcgtgctgcggactttttccaagatgcacggcctggcgggcctgcgcctgggctacggagtcatgcccgagtggctggcggacctcctgcttcgggtcaagctgccttttagcgtgaatattctggccgaacaggccggtctggccgcgctggaagacgacatcttcgtgtcccagacccttcgcgtcgtgagcgagggccgccgcctgctggaacgggagctttcggctcttggctgcaaggtctggccttcgcaggcgaatttccttatgtttgaaccgcccatggacgcgcgtgtcctttttgaggcattgcttgcgctcggggtcatcatccggcccctcggcagttacggcatgcccgagaagctgcgggtcagcatcgggaacgaggaagagaatctggaatttctgactaaaacagcggaggtattgcgtggtcacgatcgtcactcttga

SEQ ID NO: 1826 - DNA, 1101 bp, Desulfohalobium retbaense DSM 5692
atggcaaagttttcccgtgtgcgaccggagattgccggtttgaaaccctatacccctgggctgtctatcgaagaaatcaaggatcggtatgcattgaccactgtgtgcaagatggccagcaacgaaaatccactaggcacctcgccgctggtccaggaggcgttgtgccggtttgcgccgtatgcctttcgctatccgcgcggcggatgtccggatttgagtgcggctttggccaaagtgctgggggtccccggggagtgcgtcgtggtcggcaacggttcggatgaattgattgatctcttgatccgaaccacgctgcgccccgaaaaggacaatatggtcgtttttgatcccagctttagtatttatcggatgcaggccaccttgtgcggtgtggaatgccgacaggttccgcttgagcaggacctgacatttgactttgatcggttgctggagcaggtggattcccgaaccgggctggttttcgtgaccaacccggacaatccgtccggccacgccgtacctgcggcgcagcttatggaactcgcccggtccctgcctcagcagtgtctgctggtagtggacgaggcgtatattgaattcgccgaaaacggcatctcccccctggccgattgggatgcacacggaaatatcgtcttgctgcgcaccttttcgaaactctatgggctggccggtttgcgcctgggctacgggatcatgccggattggttggccgaggccgtactgcggatcaaattgccctttagcgtcaacctgttggctgaaaaggcaggcgtcgccgcgctggaagacaccgccttctatacccggaccagggaggtcgttggcgagggacggcgtatcttgagcgcggggttgcgggagttgggctgcgaggtcagtccgtcacaggccaatttcctcctcttccgtcccccgatgcccgcgcgcgaggttttcgagcgtctgctggccaaagggatcatcatccgccccctgaccagctacggcctggaagatgctctgcgtgtcagtgtcggtaccgctcatgagaattccagattccttgaagccatgcaggagatagtccatgcccgctaa

SEQ ID NO: 1827 - DNA, 1023 bp, Ralstonia solanacearum
atgcgcgcttcggctccttccaaccttgcccgccggcgttgcctgaccggcgtgcccctgctggcggtcggcctgttcgtgcggccggcgctggccgatcccgccgtccagcacgcgtcgcgccggctgctcggcacgcaagtcgacatcgtggcgcaaggcgcgatgcccggtgccgccgcgccggccatcgatgccgccttcgccgagatggcccggcttgaacggctgatgagccgctaccgcccggacagccaggtcagcgcactggcgcgcgcggccgggcggaacccggtgccggtggcgccggaattgatggcgatactcaagctggccgcgcggctctcggcgcgaagcgggggggccttcgatatcaccgtcggcgcgttctccggctggaatttcgatccggcccaggcccggatcccgagccgcgccgagctcgtgcacgagcagcggctggtgaactatcgcgatgtcgtcctcgaccaggcacgaggccgtgtctacctgcgccgccccggcatgaagctcgacctgggcggcgtcgccaagctgccgatcctgcaggcaggcctgcgcgtgctgcggcgacacggtgtccgtgacgcgatgatcaacgggggcggcgacgtgctggtcagcgggcagctccagggccacgactggcgggtcgggctgcgcaacccgctcgcgcccgaccgattgctcggcgtggtggcgctcagcgacggcatcgtggcctcatcaggcgactacgagcgcggcttcgtccgcaacggccagcgctaccaccacattctcgacccgaagaccggcctgccgacccatggcccgcatggcgtcaccctggttgctcgcagcgttgacgatgtgaacgggctcggtgcagccatcatggtggccggcgcggaggcagggcggcgcctgctggtgccgccggcgggcgtggatgcgctcatcatgggccccgggccccgtccatggatgtcgcccggcatggccttgcgcttgcagacatga

SEQ ID NO: 1828 - DNA, 1035 bp, Rhodoferax ferrireducens T118
atggcttctcctgcgtctgatcgcattcaacacgggcggcgtcagcttgcattggccttgccactgttggcgtgtggcctggtggtgccgtcggtgcacgccaaggcggatgttcagcagtcctcgcaaattctgatgggcacgcgggtcgacctgacgctgcagggcaatgacagtgcagccctggccgctgccgcaactgcagcgttcaccgagatgaaccggttggccgacatgatgagccgctaccgtgtgacgagcgcactgaacgccatcaacctgatggcgggtctgcaaccggtgccagtaccgccggagttgctgcgcgtgctgttgatggcgcgtcaggcgggacaggccagtggcggggcttttgatgccacggtcgggtctttgcgggactgggatttcagccccgagcatccgtccatcccctcaaagcagcagatcgcagcgcaattgcggctggtcgatcaaaaagccggtctggtgatcagtgaacatgcgggcacggcctatctgacccaaagaggcatgctgctggatctgggcggcattgccaaactgcccattcttcaggctggcctggggcaacttcaaagccgtggcgtcaccaacgcgatgatcaacggcggtggcgacgtgctggtgatgggccgtttgaatggccgcccctggcgcgtgggcctgcgcgacccgcgtcaacccagccaattattgggtgtggtgtccttgacccagggttttgtcgcggcctccggcgattacgaacgtttcatgatgcacgacggcaagcgcttgcatcacatccttgatcccaaaaccggctaccccagtaccggtccccatggggttaccttgatcagtgagcaactcgaactcatcaacggtctgggcgcggccctgatggtggcgggtgccgatgccgggcgaacccgggtcggccgcacaccgggaatcgatgccttgatcgttgatgccgacagcagcctctggctgtcgcccggtatggcgcagcggttcaagcgcagctga

SEQ ID NO: 1829 - DNA, 1023 bp, Cupriavidus metallidurans CH34 uid250
atgcacgcgctctctccttccggccttgcccggcggcgctacctgacggcggcaccgctgcttgccctcggcatgttcgtcctgccggcattggccgattcatcggtccggcacgcctcacgccggctgctcggcacgcgggtggacatcgtgaccgacggcgtgccagcggatgcggccgcgcaggccatcgacgcggcgttcgccgagatgggcaggctcgaacggatcatgagccgctatcgtccggacagtcaggtcagtgccctggcacgtgctgccggcaagcacccggtacccatcgcgcccgagttgatgtcggcgctcaggttggctagcgaggtctccgcgcgcagccagggcgccttcgacattacggtcggcgcgtttgaaggctggaacttcgatccgggccatgagcaagtgcccgggcaagccgaactgacgcaagagcgaccactagtgaactaccgtgatgtcgttctggactcaacgcgcggtagcgcctatctacggcgtcccggcatgaagctggatctgggcggcatcgccaagctcccgatcctgcaagccggcatggacgtgctgcggcagcaaggcatctcgaatgcgatgctcaatggcggaggcgacgtgctggtcagcggcaggcttcagggccgcgactggcgtatcggcctgcgcgacccgcttgcgccggagcgattgctgggagtagtggcgatcaccgatggcgtcgtggcgtcgtcgggcgactatgagcgctgctttgcccgtgatggccagcgctatcaccacatccttgaccctcgaaccggcctgccaacccgggggccgcacggggtcacgctggtcgcgcgcaaaacaagtgacgtcaacggcctcggggccgctatcatggtggctggtacagcggcaggacggagcctgctggggcccatggctaacgtggatgctctgattgtcgggcccgggtctcatccatggatgtccgaaggcatggcgacccgtatgcggtcgtga

SEQ ID NO: 1830 - DNA, 1089 bp, Acidovorax sp. JS42
atgaattcagatcggtgcatgccggcggtaggcaaccggtggacgcggcggcgcttcgcccttgcgctgccgttgctgggcgcgctggcgtacctcgacccgcgccaggctttggctggcatggtggagggcgcgcagcccctggtgcgcgcgagccgtaccctcatgggcacacgcgtggacatcgcggctgccgttggcaatggccgcgatgccgacgctgtgcagcaggtgatgctgcacgcgttcgcggaaatggagcgcctggaggcgctcatgagccgttaccgggagggcggcgacgtggcgcgcctcggcgcggccgccggccggcatgccgtgcacgtggccccggaagtgatgcaggtgctgcgcacggcgcgtcgcctgcaccaagaaagtgctggcgccttcgatcccaccatcggtgcactgcggggctggcattttgaacccggccacgaagccgcgccggcacctgaggagatcgctcaggcgctgcgtttggtgaacgcgcgccacctcgtgctggacgagcgcgcaggaacggcctaccttgcgcggacgggcatggggttggatctgggcggcgtggcgaagttacccattctgcaagcgggcttgcaagtgctggaacgcgccggtgtcacggatgctctggtcaacggcggtggcgatgtcctggtcatgggccggcagcacgaccgtccctggcgtgtgggcgtgcgcaatccctccgctccggcgcagctgctgggcgtactggagctgcaagggcgcggcgtggtggcatcgtccggcgattacgagcgaggcttcttgcgtgcaggacgccgcctgcaccatgtgctcaacccccgcacgggttggcctacggaaggtgtgtctggcgtggcgctcatggccgagcgtatcgaagacgtcaacggctggggcacggcgctgatggtccaaggacctgcggcagcacctgcatggcatgcgggccacgcacatgtcgaagccctcgtggcgagcgcggatggcacgcgctggagctcccctggcatgctcgccgcgctgcggccagtgcctgcgcgcgcagcatga

SEQ ID NO: 1831 - DNA, 1041 bp, Ralstonia pickettii 12J
atgcatccgctgcccccttccaacctgggccgccggcgctgcctggcgggggtgcccctgctggcagtcggcatgttcgtacggccggccctggcagaccccactgtggagcgcgcatccactcaattgctgggcactcaaatcgacatcattgcgcaagacgcgagaccgggcgccgccggtgcggccatgcgcgctgcctttgtggagatggcgcggctcgaatgcttgatgagccgctaccggcccgacagccaggtcagcgcactggcacgcgcggcggggcggaaccccgtgccggtggcacctgaagtcatgtcggtgttcaagcttgcccgacaggtctcggagcaaagccgcggcgccttcgatatcaccgtcggcgcgtactccggctggaattttgatccggagcacagccgcattccgagcagcagcgaactggcgcgtgagcgccgcttcgtcaactatcgagacgtcgttctggacgagcgccacggcagcgtctacttgcgacgcccggggatgaggctggatcttggcggcattgccaagctgccgatcctggaggcaggcatgcgcgtgctacggcaacacggcatacgcgatgccatgatcaacggtggaggcgatgtggtggccagcgggaagctgcaaggtcacgaatggcgcgtcggactgcgcgatccgcttgcgccggagcgactgctgggcgtggtcacgctcagtgacggggttgtggcgtcatccggagactacgagcgttacttcatgcacaacggtcagcgctttcatcacgttctcgatccggaaacgggtctgcctgcgcatgggccccatggcgtaaccctggtcagtcgcgacgttgacgacgtcaacggccttggcgcggcaatcatggcagcgggcaccgccaccgggcagcggatgcttgcaccgatgctcgcacgcgtggatgccctgatcgtaggttctggagttcggccatggatgtcggccggaatggcaacgcgcttgcggcagttctctgcaagcagttga

SEQ ID NO: 1832 - DNA, 1089 bp, Diaphorobacter TPSY uid29975
atgaattcagatcggtgcatgccggcggtaggcaaccggtggacgcggcggcgcttcgcccttgcgctgccgttgctgggcgcgctggcgtacctccacccgcgccaggctttggctggcatggtggagggcgcgcagcccctggtgcgcgcgagccgtaccctcatgggcacacgcgtggacatcgcggctgccgttggcaatggccgcgatgccggcgctgtgcagcaggcgatgctgcacgcattcgcggaaatggagcgcctggaggcgctcatgagccgttaccgggagggcagcgacgtggcgcggctcggcgcggccgccggccggcatgccgtgcacgtggccccggaagtgatgcaggtgctgcgcacggcgcgtcgcctgcaccaagaaagtgctggcgcctttgatcccaccgtcggtgcactgcggggctggcattttgagcccggccacgaagccgcgccggcacctgaggagatcgctcaggcgctgcgtttggtgaacgcgcgccacctcgtgctggacgagcgcgcaggaacggcctaccttgcgcggccgggcatggggttggatctgggcggcgtggcgaagctacctattttgcaggcgggcttgcaagtgctggagcgcgctggcgtcacggatgcgctggccaacggcggtggcgatgtcctggtcatgggccggcagcacgaccgtccctggcgtgtgggcgtgcgcaatccctccgctccggcgcagctgctgggcgtactggaactgcaagggcgcggcgtggtggcatcgtccggcgactacgagcggggcttcctgcgtgcaggacgccgcctgcaccatgtgctcaacccccgcacgggttggcctacggaaggtgtgtctggcgtggcgctcatggccgagcgtgttgaagacgtcaacggctggggcacggcgctgatggtgcaaggggctgcggccgcacctgcatggcatgcggaccacgcacatgtcgaagccctcgtggcgagcgctgatggcacgccctggagttcccctggaatgctcgccgcgctgcggccagtgccggcgcgcgcaggatga

SEQ ID NO: 1833 - DNA, 1041 bp, Ralstonia pickettii 12D; identical to SEQ ID NO: 1831

SEQ ID NO: 1834 - DNA, 216 bp, Nitrobacter hamburgensis X14
atgcgccgctccgattccgttgaggcccgcaagaaggacacgcgcgagaagatcgagctcggcggcctgatcgccaaggctggcttgcgctacgaaaagcgtgcgctgctgctgggcctgttgatcgatgccgccgaccgtctgcgcggcaacgaggcggagcacgagcgcctgacggcaatcggcgcaaaggcgttcggccatgaaggcacgtaa

SEQ ID NO: 1835 - DNA, 216 bp, Sinorhizobium medicae WSM419
atggcgagagcgatgacatctgatgcccgcaagaaggacacgcgggagaagatcgagttaggcggcctgatcgtcaaggcgggtttgcgatatgagaaacgcgcgctcttgctcggggcgttggtcgaactcagccgccggctgaagtccgacgaaggtgagcgggcgcggttaatcgcgatcggcgcggaagcttttggcaatgatagcgaatag

SEQ ID NO: 1836 - DNA, 198 bp, Methylobacterium radiotolerans JCM 2831
gtgaacgcgcggcgtgacgagcggcgcaccgacgcgcacctcaagatccagctcggcggtctgatcgtgaaggcaggacttgccgccatgccacgcgatcagcttctcggcctgctcttggatggaaaggagcgtgcccgggatcccgacaccgccgagcatttcgtgcggctcggagaaaaggcattccgggaatga

SEQ ID NO: 1837 - DNA, 198 bp, Methylobacterium chloromethanicum CM4
atgacgaagcggcatgaggagcggcgcgccgacgcctaccgcaagatcaagctcggtggcctcgtcatcaaagccggcctcgccgacctgccgagcaacgtcctgctcggcctcctgatggatggcgccgagcgcctccgtgatcccgacgccgtcgagcaattcgcccggcgcggtgacaaggagttcaagacatga

SEQ ID NO: 1838 - DNA, 216 bp, Agrobacterium vitis S4
atggcccgcacgatcacgaatgacgcgcgaaagaaagacacgcgcgagaaaatcgaactcggtggcctgatcgtcaaggcaggactgcgctacgagaagcgggctcttctgcttggcctgttgatcgatgccggtcgccgccttaagggcaacgatggggagcaatcgcgcctcacggcgataggcgcggaggcattcgctcatgacggcgagtaa

SEQ ID NO: 1839 - DNA, 246 bp, Agrobacterium vitis S4
atgaaggcgggcctggcgaggcttgaccggatggcaaagtcgaagacgtcagacgcacgcaagaaggacacccgcgaaaaaatcgaactcggcgggctgatcgtgaaagccgggctgcgctacgagaagcgggcgctactgctcgggctgttgatcgacggcgggcgccggctcaaaggcgacgaagacgagcggtcacgtttgaccgccatcggcgtggaggcgtttggccatgacggtgaatag

SEQ ID NO: 1840 - DNA, 216 bp, Rhizobium leguminosarum bv  trifolii WSM1325
atggcgaggacgaagacattcgacgcccgcaggaaggacacacgcgagaagatcgaacttggcggactgatcgtcaaggcgggcctacgatacgaaaagcgcgcgctgctgctcggggcgctgatcgaaacagcacgacgcatcaggagcgatgaggatgagcgatctcggctcacggcgatcggatcggaggcctttggcaatgacggcgaataa

SEQ ID NO: 1841 - DNA, 780 bp, Polaromonas JS666
atggctgcaattcaaattacccaagcggggccgctgctgaccctcaccctgagtcgtccggaggtgcgcaatgctttcaacgatgaagtgatcgccgaattgacagcggcgttcgcgcaggcaggccggcgcgaggacgtgcgcgcggtggtgctggcggccgaagggccggccttttgcgctggcgccgacctgaactggatgcggcgcatggcggactacacgcgcgaggaaaacctggccgatgcggcgcaactggccgagatgctgcgtgccatttatgaatgcccgaaacccaccgtggcgcgcattcagggcgatgtgtatgcgggcggcatggggctggtggcggcctgcgacatcgccgtctctggcgacacggcgcagtactgcctcagcgaagtcaagctgggcctgatcccagccaccatcagcccttatgtgattcgcgccatgggcgcgcgcgcagcccaccgctattttttgacggctgagcgttttgatgcccaggaggcgcatcgcatcggtttcattcatgaagtggtgagcgccgtcgcgctcgatgccaaggtggccgagattgcacaggcgctggtcaatgccagcccgcaggcggtgaaagcctgcaagcggctggtgcaggatgtggcacagcacgacatcacgcccgccctgatcgcgcaaaccgtgcagggcattgccgatattcgttccagcgaacagggcaaggagggcgtgcagtctttcctgcaaaagcgcaagccgtcctggatcatctga

SEQ ID NO: 1842 - DNA, 804 bp, Acidovorax avenae citrulli AAC00-1
atgacgaccaccgaataccgccatctgcacgtcggccaggccggatcgatcgcgcgcgtcaccctcgcgcggccggaagtgcgcaacgcgttcagcgacgaggtcattgccgagctgacacgcgcgttcgaggcgctgggccggcaggaggacgtgcgcgccatcgtgctcgccgccgaaggcccggctttttgcgcgggcgcggacctgaactggatgcgccgcatggccgactattcgcgcgcggagaacgtcgcggacgcgggccggctggcaacgatgctgcgcacgctgaacgattgcccgaagccgaccatcgcccgcatccagggcgatgtgtacgcgggcggcgtggggctggtggccgcctgcgacgtggcggtggcggtggatacggcggcgttctgcctgagcgaggtgcggctggggctgattcccgccaccatcgggccctacgtggtgcgggccatgggcgagcgcgcggcgcgccgctatgtcgtgaccggcgagcgcttcagcgcgctggaagcgctgcgcgtgggactggtgcacgaggtggtggatttcgagcagctcgacgagaagctcgatgccgtcctgcagtcgatcgccgcggccgggccgcaggcggtggccgcgggcaagcgcctggtgcgtgacatcgcggggcggcccatcgacgatgcgctcatcgcctcgacggtggagtccatcgcggacatccgggcgagcggcgaggggcgcgagggcgtgcaggccttcctgcagaagcgcaagccggcctggctgccggctcgcgactga

SEQ ID NO: 1843 - DNA, 783 bp, Acidovorax sp. JS42
atgagccagaacctttccatcacccaatcgggcgcggtggcgcgcatcacgctgacgcagcccgaaatccgcaatgctttcagcgacgaagtgatcgcagagatcaccgcggccttcacggaagtcgggggccgcgccgacgtgcgcgccgtggtgctggccgccgaggggccggccttctgcgcgggtgccaatctgaactggatgcgccgcatggccgactacacgcgccaagagaaccttgccgacgccgccaagctggccgagatgctgcgcgtgatctacgaatgccccaagcccaccgtggcgcgcgtgcagggtgacgtgtacgccggcggcatggggctggtcgcggcctgcgacatggcggtggcggtcgataccgcgggcttttgcctgtccgaggtgaagatcggcctgatccccgccaccatcagcccctacgtgatccgcgccatgggcgcgcgcgccgcgcaccgctacttcctcaccgcggaacgcttcagcgcggccgaggccttgcgcatcggcttcgtgcaccaagtggtcggcgcagagcagctcgacgcccaggtggacgagctgctcaaggcactgacggccgcgagcccgaacgccgtgcgcgcctgcaagacgttggtgcgcgatgtggccgggcgcgagatcgacgccgcactcatcgccgccaccgtggagggcattgccgacatccgcgcgagcagcgagggtcgcgagggcgtgcagtcgttcctgcaaaagcgcaagccctcctggctgggctga

SEQ ID NO: 1844 - DNA, 783 bp, Polaromonas naphthalenivorans CJ2
atgagcgccagccttgaaatttcttatgacggcgccgtggcccgcatcacgctcaaccgccccgacgtgcgcaatgccttcaacgacgaggtcattgccgaactcacggcagcctttcaggaaatggccgcgcgcgccgaggtgcgcgccgtggtgctggccgccatcggcccggccttttgtgccggcgccgatttgaactggatgcgccgcatggccgactacacgcgcgacgaaaacctgcttgatgcggccgcgctggccgagatgctgcgtgtgatgtacgaatgccccaagccgacgattgcccgcatccagggcgatgtgtatgccggcggcatgggcctggtggccgcctgcgacatggccgtcagcgtcgatacggcgaactattgcctgagcgaggtcaagctggggctgattccagccaccatcagcccgtatgtgatccgcgccatgggcgcgcgggcggcgcaccgctacttcttgacggccgagcgcttcgatgcgaaggaagcgcaccgcatcggcttcgtgcatgaagtggtcggcgccgacgcgcttgatgccaaggtggcggaactgacgaacgcccttagcagcgccagcccgaacgccgtgcgcagctgcaagacgctggtgcaggaagtggctgggcagggcatcgaggcgccgctgatcggccgcaccgtcgaaggtattgccgacatccgcaccagcagcgaaggccgggagggcgttcaggcctttctgcaaaaacgcaagccgtcctggctggcttga

SEQ ID NO: 1845 - DNA, 792 bp, Methylibium petroleiphilum PM1
atgagcgccgacacgaccgtccgcctgagccgaccgtcggccgcggtggcgcgggtgacgctgtgccgccccgacgtgcgcaacgccttcaacgacgagatcatcaccgcgctgacgcaggccttccgcgcgctcgatgccgacgacaccgtgcgcgtcgtcgtgctggccgccgagggcccggccttctgcgccggcgccgacctgcactggatgcgccgcatggcggactacacgcgcgcgcagaacctcgacgacgcggccggcctggcccagatgctgcgcagcatcgccggctgccgcaagccgacgatcgcgcgcgtgcagggcgatgcctatgccggcggcgtgggcctggtggcggcctgcgatctcgcggtggcagtggacaccgcacagttctgcctcagcgaggtgaagctcgggctggtgccggcgacgatcggcccctacgtggtccgcgcgatgggcccgcgtgccgcgcagcgctacatgctcacggcggagcgcttcgatgccaccaccgcgcagcgcacgggcctgctgcacgaggtcgcgccggccgaggcgctggacgcggcggtgcaggctctcgtcgacgcgctgctcgccgccagcccgcaggcgctggccaccggcaagcgcctgctgcacgagatcaccggggcgccgctcgatgcggccctgatcgcgcgcaccgtggagttcattgccgatgcgcgcgcctcggacgacggccgcgagggcgtgcaggcctttctcggcaagcgccgtccgcgctggcaggcgtga

SEQ ID NO: 1846 - DNA, 786 bp, Delftia acidovorans SPH-1
atgaaaaccaccgcactgaccctcgaattccagggccccctggccaccatcacgctgacccagcccgaagtgcgcaatgccttcagcgacgaggtcatcgccgacatcacccaggccttccactccgtgggcaagcgcagcgacgtgcgcgccgtggtgctggccgccgagggcccggccttttgcgcaggcgccaacctcaactggatgcgccgcatggccgactactcgcgcgacgagaaccgcgaggacgccggcctgctggccgaaatgctgcgggtgatctacgaatgcccgcagcccaccatcgcgcgcgtgcagggcgatgtctatgcgggcggcatgggcctggtcgctgcctgcgacatggccgtggccgccgagggcgcgggcttttgcctgtccgaggtgaagatcggcctgatccccgccaccatcagcccctacgtgatccgcgccatgggcgcgcgcgccgcccaccgctacttcctgaccggtgagcgcttcgacgcggccgaggcgctgcgcatcggcttcgtgcaccgcgtggtggcggcagacgagctggacaacgccgtggacggcctgctcaagcacctggtcagcgccggtcccgccgccgcccgcgcctgcaagcgcctggtgatcgacgtggccgagcgcgagatcaacgagcagctgatcgccgccaccgtcgaaggcatcgccgacatccgcgccagcgccgagggcaaggagggcgtgcaggccttcctgcaaaagcgcaagccggcctggctggcctga

SEQ ID NO: 1847 - DNA, 783 bp, Diaphorobacter TPSY uid29975
atgagccagaacctttccatcacccagttgggcgcggtggcgcgcatcacgctgacgcagcccgaaatccgcaatgctttcagcgacgaagtgatcgcagagatcaccgaggccttcacggaagtcgggggccgcgccgatgtgcgcgccgtggtgctggccgctgaggggccggccttctgcgcgggtgccaatctgaactggatgcgccgcatggccgactacacgcggcaagagaaccttgccgacgccgccaagctggccgagatgctgcgcgtgatctacgaatgccccaagcccaccgtggcgcgcgtgcagggtgatgtgtacgccggcggcatggggctggtcgcggcctgcgacatggcggtggcggtcgataccgcgggcttttgcctgtccgaggtgaagatcggcctgatccccgccaccatcagcccctacgtgatccgcgccatgggcgcgcgcgccgcgcaccgctacttcctcaccgcggaacgcttcagcgcggccgaggccctgcgcatcggtttcgtgcaccaagtggtcggcgcagagcaactcgacgcccaggtggatgagctgctcaaggcactgacggccgcgagccctaacgccgtgcgcgcctgcaagacgctggtgcgcgacgtggccgggcgcgagatcgacgccgcactcatcgccgccacggtggagggcattgccgacatccgcgcgagcagcgagggccgcgagggcgtgcagtcgttcctgcaaaagcgcaagccctcctggctgggctga

SEQ ID NO: 1848 - DNA, 789 bp, Variovorax paradoxus S110
atgaccttcaccaaactgaaactagaaatccaggacacagcagcgcgcatctggctagaccagcccgacgcgcgcaatgccttcgacgacgtggtcatcgccgagctcacgcaggccttcaccgacgccggcgccgcgccgaaggtcaaagccatcgtgctcggtgccaacggccccgccttctgcgcaggcgccaacctcaactggatgcgccgcatggccgactacacgcgcagcgagaacatcgccgacgcgagcaagctggccaccatgctgcgcaccattgccgagtgtcccaagcccaccatcgcgcgcgtgcagggcgatgtgtatgcgggcggcttgggcctcgtcgcggcctgcgacatggccgtgagcgtggacaccgcgtggtattgcctcagcgaagtcaagatcggcctcgtgcccgcgaccatcagcccgtatgtgctgcgcgccatgggcacgcgcgcatcgcagcgctactttctcacggccgaacgcttcaccgcggccgaggcgcaccgcatcggcttcgtgcatgaagtggtcgcggccgatgcgctcgatgccaaggtcgacgagctcctgaaggcgctcaccagtgccagccccgccgcagtgcgggcctgcaagcaattgatcgccgacgtggacggccgcgagatcgaggacgcgctgatcgccaagaccgtcgaaggcattgccgacatccgcgccagcgacgaaggccgcgaaggcgtgcaggccttcctgcagaagcgcaagccgtcatggctgggccactga

SEQ ID NO: 1849 - DNA, 312 bp, Nitrobacter winogradskyi Nb-255
atggcatcgccaacagtcgcagcaaacgcctatgcaagcctcgcgaggatgatggattctggcgccgtcgccggcaaggcgccgggtggcgatggtccctcgttcggggcggtgctgaaggatgtgctcggcggcgtggtggaagcggggcgcgcgtccgacgcgcagaccgtggcgatggcgtcgggcaaggccaacctgatggacgtcgtgacagcggtcgccgataccgacgtcgcggtgtcgacgctggtctcggtgcgcgaccgcgtcatccaatcctatgaagacatcatgaggatgccgatctga

SEQ ID NO: 1850 - DNA, 306 bp, Rhodopseudomonas palustris HaA2
atggcgtcaccgatttccgcagccaatgcctatgcgagcctcgcccggctcgccaatcccggcggtgccggcaagccgacagacaacggcccgtcgttcggcgcgctggtcaaggacgcgatgggcagcgtcctcgacgccggccgcaagtccgacgcccagaccgtggcgatggccaacggcaagtcgaacgtgatggacgtggtcactgcggtcgccgagaccgacgtcgcggtgtcgacgctggtgtcggtgcgcgatcgggtgatccagtcctacgaggaaatcctccggatgcagatctga

SEQ ID NO: 1851 - DNA, 288 bp, Jannaschia CCS1
atggacatcacccaaacactcgccgcgcgcgcgtatggcgacccgcgcgctgccgtgccaccaacgaccgcagcccaagacccgagcctgtttgctcaagccgttggaagtttcgccgacaccgtcgccaatggtgaggcacaagcgcgcgctgcaatgacaaccggcgccgatccgcatgcccttgtgaccgctctggcgcaaaccgagctggctgttgagaccgtcgtgactatccgcgaccgggtggttgaggcgtatcaggaaatccttcggatgccggtctga

SEQ ID NO: 1852 - DNA, 306 bp, Rhodopseudomonas palustris BisB5
atggcatccccgatttccgcagccaatgcctatgcgagcctggcccggctcgccaatccggccggcgccggcaaacagaccgacaacggcccgtcgttcggcgcgatggtcaaggaggcgatgggcagcgtgctcgacgccggacgaaaatccgacgcccagaccgtggcgatggccaatggcaagtcgaacatcatggatgtggtgaccgcggtcgccgaaaccgacgtcgcggtgtcgacgctggtgtcggtgcgtgaccgggtgatccagtcctacgaagacatcctgagaatgccgatctga

SEQ ID NO: 1853 - DNA, 312 bp, Nitrobacter hamburgensis X14
atggcatcgcccaccgtcgcagcaaacgcctatgcgagcctcgcgaagatgatggattccggcaccgccgccggcaaggcgtcggagggcggcggcccgtcgttcagttcggtgttgaaggatgcgctcggcagcgtgatggaagccgggcggaagtccgatgcgcagaccgtggcgatggcgtcgggcaaggccaatgtgatggatgtggtgacggcggtggcggataccgacgtcgcggtgtcgacgctggtgtcggtgcgcgaccgcgtcatccagtcctacgaagacatcatgaggatgccgatctga

SEQ ID NO: 1854 - DNA, 297 bp, Ruegeria sp. TM1040
atggatattcgttcgcttaccgccacctccggctatgccgctgcacgtccggcaaccaaagttgacccggattacaatccgacttccctgcaggagcaggccaagaccagctttcaggatttcaccaatacacttgcacacagcgagcaagtgtcggtgcaagcgatgacaggcggcgcagatccgcatcagcttgttcaggcgctcgcacagaccgagctggccgttgagaccgcggtaacggtgcgcaacaaggtcgttgaagcctatcaggaaatcctgcggatgccggtctaa

SEQ ID NO: 1855 - DNA, 321 bp, Rhodospirillum rubrum ATCC 11170
atggccgtcgatttcgccagtgccgtttccgcctataagtccgcgtcgcgcatcggcggcgcggagatgaccggggggcttcttccgtccggccagcccgagggcccgagcttcgccagcatggtcaagggcgcgatcgatgacaccatcaccgccggccgccagggcgaggcgcaaagccgcttggccatcgagggcaaggccgatctgcgcgatgtggtgatggcggtcaataacgccgaaagcaccttgcagaccgtggtcgccgtgcgcgacaaagtggtcaacgcctatgagaccattctgcgcatgccgatctga

SEQ ID NO: 1856 - DNA, 291 bp, Rhodobacter sphaeroides 2 4 1
atggacatcagaacctccaccgcagcacaaagctatgcgaaggcacggaccgcagccgcgcccgaccaaccgtcggtggggctcacggccgcattcgagcgtgcggctgaaagcttcacgcagacgctggcgcagggggaagaaaccgcccgtgccgccatgaccggaaaggccgatccccacgcgctggtcgaagcactggccgcctcgcagatggccgtcgagacggcggtcaccctgcgggacaaggtggtcgaggcctatcaggagatcctgaggatgccggtctga

SEQ ID NO: 1857 - DNA, 279 bp, Paracoccus denitrificans PD1222
atgatctcaccgacatttgccgccaccgcctatgatcgcgcccgccatgccgtcgccccggcccagggcctgccgcaaggcgtgaccaatgccgcggccgatttcgcccgggtgatggagcaggtcgacctggacgcggccggcgccatgaccgggcagaccgacacccatgacctggtccacagcatcgcacgggccgagatcgcgctcgaaaccgtggtcgccatccgcgacaaggtggtcgaggcctatcaggaaatcctgcgcatgccggtctga

SEQ ID NO: 1858 - DNA, 291 bp, Rhodobacter sphaeroides ATCC 17029
atggacatcagaacctccatcgcagcacaaagctatgcgaaggcacggaccgcagccgcgcccgaccaaccgtcggtggggctgacggccgcattcgagcgtgcggctgaaagcttcacgcagacgctggcgcagggggaagaaaccgcccgtgccgccatgaccggaaaggccgatccccacgcgctggtcgaagcactggccgcctcgcagatggccgtcgagacggcggtcaccctgcgggacaaggtggtcgaggcctatcaggagatcctgaggatgccggtctga

SEQ ID NO: 1859 - DNA, 291 bp, Rhodobacter sphaeroides ATCC 17025
atggacatcagcacctcggtcgcggcacagacctacgcaagggccagactcgcgacggcgccggaggcgccttcgatcggcgtggcggcggcgctcaaccgtgccgccgagagcttcaccgagaccctcgcccacggcgaggagacggcgcgggcggccatgaccggaaaggccgatccccatgccctggtcgaagcactggcggcctcgcagacggcggtcgaaacggccgtcaccctgcgggacaaggtcgtcgaggcctatcaggagatcctgaggatgccggtctga

SEQ ID NO: 1860 - DNA, 303 bp, Acidiphilium cryptum JF-5
atgtccggaacgatctcggctctcgtaaatccgtccaatgcaatctctgcctatggtcgcgctgccggcacgggcgcggccggttcgcccagctttggcgattacatgtcgaacgtcatcacgagcgcaattcatcagagcgcgtcgacggagcaggcagccagttccggtttgatgggaaagggagaccttacccatgtcgttgcctctgttgcccaggctcaggttgcgttgcagacgaccgttgccatccgtgatcgtctgatccaggcctatcaatcgatcatgagcatgccgatctga

SEQ ID NO: 1861 - DNA, 357 bp, Bradyrhizobium BTAi1
atggcctccccaatttccgcagcgaacgcctatgcaaattccgcccgcgtgctggacaccggcggttcgagcaatgccttcggcagccttgcacgcgtgcgcgatgtgctgggcaatggcaatggcgccgacaagggcggtccgtcgttcagcgcggtgctgaaggatgcgatcggcagcgtcatggaaaccggccgcaagtccgacagccaggccgtcgcgatggcggcgggcaaggcgaatgtgatggatgtcgtcacggcggtcgccgagaccgacgtcgcggtgtcgaccctggtctcggtgcgcgaccgcgtgatccaggcctatgaagacgtgatgaagatgacgatctga

SEQ ID NO: 1862 - DNA, 324 bp, Parvibaculum lavamentivorans DS-1
atgaccaccataccggcatccacagctctcaacgcctatgcccgcgccgcgggaatgggcggcggcgcgcagtcgccgcagacgggcgggctcaaggaagcaggcggcggcttcggcgacatgctgaagcaggcgctcgacgagacggttgaaacgtcgaaatccggcgaaatgaaaatggcggccctgaccggcacccgcgacggcaacatcgtcgatgtggtgacggcggtcgcggaagcggaaaccaccttgcagacggtcgtgaccgttcgcgacaaggtgatcgccgcctatcaggaaatcttgaggatgccgatctga

SEQ ID NO: 1863 - DNA, 279 bp, Dinoroseobacter shibae DFL 12
atggatatccgttccagcacggcggcacagctctacacacgttccaaggagctgaccgcgccgaaacacgaagggcccgacattgccggtgcggcgcggagctttgccgaaacgctccagaacggcgaggccgtcacgcaagcggcgatgaccggcggggcggatccccatgccctggtcgaggcactagcccagaccgagctggccgtggagaccgcggtgaccgtgcgcaacaaggtggtcgaggcctaccaggaaatcctgaggatgccggtctga

SEQ ID NO: 1864 - DNA, 306 bp, Rhodopseudomonas palustris TIE 1
atggcttccccgatttcagcagcgaatgcctatgcgagcctcgcccgcctggccaagccggccggcgccgacaaggggggcgaggacgctccgtcgttcggcaatcttgtcaagcaggcgatgggcagcgtgctcgacgccggtcgcaagtccgacgcgcagtcgatggcgatggcctcgggcaaatccaacgtgatggatgtggtgaccgcggtcgccgaaaccgacgtcgcggtgtcgacgctggtgtcggtgcgcgaccgggtgatccagtcctacgaagaaatcatgcggatgccgatctga

SEQ ID NO: 1865 - DNA, 342 bp, Gluconacetobacter diazotrophicus PAl 5 JGI
atgatcagtgacatcgccacacgcagtctcgatgcggtcaacgcctacgggctgactcagaaaacgatgcaggcgtccgccgacacgcaggacgccgaccccaacgcgcagtcctccgacgtcgtgaccggtttcagcgatgcgctgaacagcgcgatcaagggcgccatcaagacgggaaagacggccgaagcgcaaaccgcggtcgggctgtccgggaaggggaacctgacggacatcgcgacctcggtcgaggaagcgaagctgaccctgcagaccgttacggcggtccgcgaccgtgtcgtccaagcctaccagaacgtcatgcagatgacgatctaa

SEQ ID NO: 1866 - DNA, 303 bp, Methylobacterium nodulans ORS 2060
atgccgacgaacgccttcgcggccggcgcctatgcggcgatccagaatctcggccggcttagccccacccgcccggccgcgcccgagggcggcttcggccagctcctcacggcggcggtcgacggcgtcgcggaggccggccggcgcagcgagcagcagatgatggctgtcggcgccggcaaggccaacatcgtcgatgtggtcacggcggtggccgagagtgagaccgcgctccagaccctggtcgccgtccgcgaccgggtgatctcggcctacgaggacatcatgcggatgcagatctga

SEQ ID NO: 1867 - DNA, 1233 bp, Moorella thermoacetica ATCC 39073
ttgcccaaagacaatatagttgccggtatcgatattggcaccaccaaggtggtcgcggtagtagcggaagttatgccggaaggccgcctgaatatcatcggcctgggggaaactccgtccgggggcctgcgcaaagggattattgttgacattgaaaatacgtcccgggccatagccggagccatagagcaggccgaacgcatgagcggttgccaggtccattcggccttcgtcggtttgacgggaccccatatcgactccctcaacaaccggggagtggtggctgttaccggtgaagacggtgagataagccttgaggacgtagagagggtcctccaggccgcccgggtgatacccctggcggcggaacggcgcattattcacgtcctgcctcgccagtacatagttgatggctatgatggcgttatggaccctgtaggtatgtgcggttcccgcctggaggtcgaaacccaaatagtcaccgccgccggggccgcggtccagaatataatgaaaagcgtccagcgagccgggctggcagtggacgagctggttttaaatcccctggcctcggccggggccgtcctccaacaggcggaaagggaactggggtccgtggtggtggatattggcggtggcactacggaaatcgcccttatctcccagggcagcctgtggtttgcgtcggtcctgcccatcggcagtgaacatataaccagtgacctggctgtgggcctgcggacccccattgtccaggcagaagtaataaaaaaggagtatggctgcgtcccggcggacgccgttcctgataacgaggccgttgaagtcccgcctgtagggggaagggaaaaacgccgggtctccaggaaagccctggcggcaattattgaacccagggtcgaggagatattcaccttggtccgccgggagctaagctccgctcactttcaaggcctgctgccgggaggggtggtccttaccggcggtggtgccttgctggaaggtataaccgggatggcagccgagattctcgccatgccggtgcgcctgggctggccggaagggggcagcggtctggccgacatggtagctgcgcctccctatgctacggcagttggcctggtaaactatggtgcccgccgcctggcccatccccaggcggcagccacacgggaaacagggtgggaaaatttctggtcacggctaaagagctggtggcgtgaacttttttaa

SEQ ID NO: 1868 - DNA, 1233 bp, Syntrophomonas wolfei Goettingen
gtgcttggcattaatagaaacatagtagtagccctggatgtaggaaccagctttattaaggcagcgatggccgaacttagccagggccaggagattaatatcctgggggtttcccatgtgccatcactgggtttgcgcaagggtaatatcgtagatattgaaagcacagcccggtctattgatagttgtcttaatgatctggaaagattgaccggggttgatatagccagcactctcctggggttttccgggagcagcgtatatgctgtcaataatcacgcggtagtggctgtaggtaatcccagttatgagattacccaggatgatagacaaagagtattgcaatctgcctgcaatattgctttgccgcctgataagaccattgtacaagcggtggagagacagtatatcgtagatggttatgatggggtaaaagacccgatagcaatggttggtagcaggctggaattggagacgactataattgttgctgctacagcggctattcagaatatgcaccggagtatgcagcgtattaatttacagacggaaaaaatagtatataatcctttgctggtagcagaagctgttctcttgcctacggaaaaagaaatgggtgtggtactgcttgatatcggtggagggaccaccgagattagttttttcgaggcaggtagtcttctttacacttcagttctgccggttggtggtgagtatattacccgggatctggccattgtgttaagaacctctctggaagaggcgggcagaatcaaagaaagaaatggtgtggccagccctgatatagccaggaatgatgtaatagtaaatgtaaaaaatgttcaaggtaaagaaatccggcaggtgtcacaagaggtggtagcggagattatatcagcccggattatggaaattgtggaaatgatctatgcggagcttaaacaatttgcttgcctggatcggattccgggaggaatcgtagtaacagggggagaggctgagctaaccggtctggtaaagaccatagaggaatataccaatatccctacgcgcctgggaattcccgaaaacttaagaggaattccggttgatttcaatcgcccccagaatgcggtaattcttggtggattgatttattcatcccggtatttaaatataaattgtgataacaaacggggtattgcagctcttttcgaccaacttagcaggtggtttaaagaattattcaggtaa

SEQ ID NO: 1869 - DNA, 1242 bp, Clostridium thermocellum ATCC 27405
gtggatgatataatcagttgtattgatataggtactacaaaagtatgtgccattgtagcgaaacttgatgagaacggcaatgttgaaatattgggcagggcgactgaaccgtgcagcggtgtgaaaaaaggtgtaattgttgatatagacagtgtttccaatgccttaaaaagttgtgctcaaaagataagggctttgcttaatattgacattgagaatgtttatgtaaacgtcatggggtcacatgttgatgttttttttaacaaagctgcggttgatattttaaggccggaccgtcaaattacatccgaagatgttgagagaacgctgaaaaaggttgaggatgtaaagcttcctgataatgttcagattattgatgttattccaagacagtatattgtggacggttgtgatgaaatagttgaccctgtcggaatggcgggagtgaagcttgaacttgaagcggatgttgtagttggaaaaatcactaccttcaacaatattataaaaagcctcgacaacgccaatatcaaagtaaatggctttattgcggaagcattggcggtgggtgatttggttttaagtccggaggaaaaagatataggcgcaattcttattgacgtcggcggaggagttacaaacatatccgtgttcaaaaacaagtgtctcgccctgtatgattccatacctgtcggaggagaccatataacaaacgatatatccattggacttaaagtatcattgaatgatgctgaaaaactaaaacgggattatggtttggctcttacttcacttattgacaacgaccatgacataacaataaatgagtttagcgagaacaccaaaagaacgataaaggtttccgaagttgttgaaataatcgaggcaagagttcaggaaatattttcgctgtgcaaagaaaggcttgagcaagagggaatcttaaatggtttcaatgggggaattgtactggccgggggcggcatttcatatattgacggttctgttcagtctgcaaaggaaatctttggcttgcctgtcaggattgtgtcttacaaagccctggaaataaaaaatgccgaacatgtgacggcaatggccacggtaaagtatgttgcaaacagaatcaagtctgaggcaaaaggcggcggtactaaaaacaacaagcccggcaaacagaagcaaaaaaaggaatatggttttctgaaaaaaatagccagtttttttcacggattattttga

SEQ ID NO: 1870 - DNA, 978 bp, Desulfotomaculum reducens MI-1
ttggccaggagacatttcatcggtggacttgatataggaacgactaaaattgtatcggtaattgcagaaatcagccccagtggttatgcaatggttaaagggttaggggaatgtccaaccctgggcataagaaagggtttggttaccgatatcgtttcgttcagtaaagtgattgatcaggctgttaggctgtctgaaaagatggctaatgtaaaagttcgttcgttttttgtgactgcttctgcctttagacagctagctgaccagtatcatatgattgatgaaaaattggcagagagtatgcaaagagttggattagaacttgtgaaaatggttccctctgttctggcgtctgccgaagcagtgctaacagataccgataaaaatattggaactgttttggtagatatgggcgggaccatcacggaagtggctgtttttgaccagggcttgccgatatatatttcttctttgcctgttggctgtgaacatataaccagtgatttagcggtatgtttgcgtacttccattagtgaaggagaacgcattaagcggttgctgggcatgcaaaccctggagcaaaaaaaagatctggaagttagcagtgttggaggccatgaacaaagaaaggtgcccgtaaatgctgctatggatataatacattcacgggttcaagagatatttgaactgattcacaaggaattgactcaaaaatatcgattggagtcattacccgggggattggttctgacgggtggagggtctctcttaaaggatattgtgaattatgcaaattcacagatgaatttttttaaggtggagttgggttccccgtctaaggtgggtgtgtccaaagaagagtggcttaacccctcctatgcttcatcccttggactggtgatgtatggcgccaaaaataattcccgccgcttagagcgcctttcaggatggcgtgatgtcttaaataagtttatctag

SEQ ID NO: 1871 - DNA, 1248 bp, Herpetosiphon aurantiacus ATCC 23779
atgaatcgcaccattgtcggtattgatgtcggtacaaccaaaatatgtactttggttgctgaagttcacgatacaggcaaagtgaatattttaggggttggcctcactccttccaagggtctcgaccgtggggtcgtggtcaatatcgacgaggcggttagcgcgattgcgacctcggttgaaaaggccgagcggctttcgggttatcggattggaactgcctttgtcgggattgcgggccgccatatttcctcagttaatagtcgtggggtggtcgccatctcacggcctgatcatgaaatttcgcgcacagacgttgcccgcgctgtcgaagccgcccaagcgattgccatcccaacccaacgtgaagtgatccatgtgattccacgggcctatatcgttgatggccatgagggtattcgcgacccagtgggtatggcaggctatcggcttgaagttgaaacgcatatcgttactggcgaggtaatggcgattcaaaacttaatcaagagcgttgaacgggcgggggtcggcatcgacgacctggtgctgcaacccttggcttcaggcgaggcggtgctgagcgaagaagataaaagccgtggggttgtgctggttgatattggtggcggcacaaccgacattgcgatttttattggtggtggcatttggcacaccgtggtgttgccaattggcggagcacattttaccaacgatttggtttatgtgctgcatacaccgcataacaccgccgaatatctcaaattgcgctatggcaaagtaaccgatatcgacagccatgaccctgctgatgatctgatcgataccgatggcttttcgccaggcgaacatcaacaagtctcgcgagttgaattgaatgaaattctgcaagcgcgagccgaacaactaatcgacatgattggcaatgaaatccgtcgttctggctatgaaggcctactgcctgcggggattgtcctgacaggtggctcggctcaattgcctggcttagatgagatggcacgccaacttttaggaatgccagtgcgcattggcattccaacgaatttgactggattagctgaagcaatagatgcaccaccctatgccacggctgtggggcttgtccgttggggcttgcgtcatggaatgggcagcgttggcggccatgctgcgagccaaccagcaacgaccaactggaaacaaacctacgaccgcttcaaaatgtggttacgggaatttttaccgtaa

SEQ ID NO: 1872 - DNA, 1227 bp, Thermoanaerobacter sp. X514
atgggtgatttaatagttggtttagacattggtacatctaaagtatgtacaattattggagaaggggataaaaacggagaactgcatattgttgggattggctattatccttgtaatggggtaaaaaaaggagttattgtagatatagatgaaactgcctattctataaaaaagtctgtagagcaagcggaaagaatggccaaccaaaaaatatcctctgtgtatttgaaaatatatgggggattgacgacaatatataaaaacaatggagtagtagcagtatcgagagaagatagagaaataacaaaacaagacgtagatagagttttacaagctgctaaaattattgccattccttctgataaagaaattatcgatgttataccattagaatatattgtggatgggtatggggaaataaaagaccctgttggaatggcaggtataaggttagaggtaaatgctgctatagtaacaggaagtgttaccgctattcaaaatatggaaaagtgcgttaaaaaagcagggttagaggtagaaggaataattgtaggccctttagctacgggagaagcagtacttttaaaagatgaaaaagagttgggagttgcattaattgatgtgggtgcaggagtgacggatatttctgtttttaaagatggcaacattatttattcttctatgatagcagtgggaggatggcatatcacaaacgatttgtctgtagggttaaagatttcttttgaagaagccgaaaatataaagaagagatatggaactctagaaaaattacctcctgaaaaactggaaccaattaaaattgcaagtctagcaggtaaaaacaaatcaactacagatgtaaatgaaatatctgatataatagaagcaagggtttctgaacttttaatgcttgtgtacgagagattaaaagaagcgaaggttctggaagacattgttacaaatgttgttataacaggtggaggtatttccttcttaaaaggcaacatagagttggcacaaaaaatttttaatagaaacattcgtattggttctccgcaaaatatcggagtagcaactcctatttactcggcagggacaggagtggtaaaatatgtatataacaataagaggtttatgcataatgtccaaccgactgataaaaaagagaaaaagagttctaaattagttgacaagctcaaggaaatatttagcgatttttgggcgtaa

SEQ ID NO: 1873 - DNA, 1245 bp, Clostridium cellulolyticum H10
gtgtctgataatattgtaggaattgacataggtacttctaaagtaagtacggtaattggaagaattaacagcgtgggtgaggtcgaggtcttaggtaaaggaactgatctttgtacaggagtaaaaaaaggaattattgtagatattgaggccgtttcatcatctatcagaaaatctgtaaaaatggctgaaactcaggcagaaatcaaggttgttactgcatatgttaatatttcaggattacatgtggatatcataaaccataagaattttgtaaatattattagtgatggtaaggaaataaccagaaatgatgtacaaaaacttctttattcggcaggtactatggagatacccgaaggcagtgagattattgacgttgttcccagacagtacattgtagacgggtatgacggtataactgatcctgtaggtatgaagggagcaacgcttgagggagattttgacgtagtcataggaaagataatatctgtacagaatatcgtcagaagtatggaaaaagcaggtttaaaagtcgatggtataataccggaaggcttttcggcaggggaatgtattttagctcctgatgaaaaggaaatgggagtaatacttattgatgttggtggtggttcaacagaaataagtgttttcaaaaatgagatgctcgtcatgaacaaatgtattcccgttggaggggaccatataactaatgacttgtccatagctcttaaaattacatattcagaagcggaaaaggtaaaaagacaacttcaacttgcctccacagcacttattaagcatgatcaggatataaccgtaaatgatattagtgaaagttttaaaaagaatattaaggtttcagatattattgaagtcattgaagcgagagtttatgagatattcagcatttgctgcgacctggttcagaaaaactgtcccggtaattacggtgcaggagtagtactttcaggaaacggcatttccactatggacggttcagtccagattgcaaatgagttattcaatttgcctgtaaggatagcatcaccaaagataagaaacatatccggtttgcagcattgtacagccgccggtataatcaattatataggaaaacaggatagagaggcaagtacaacaagttctgtcagtaagaaagcagatccgaggcctgtaaaaaaagctaaacaacattctgtttttaaaaaggcattaaatgccttaaaagaatttttttactag

SEQ ID NO: 1874 - DNA, 1275 bp, Geobacillus WCH70
atgagcagcaatgagatcgtcgttagtcttgacattggcacgtccagtgttaaagtcataatcggagaaatgctaaatgaatctattaacattattggagtaggaaatgtaaaatcggaaggacttaaaaaagggtccatagtggatatagataaaacggtgcaatcgatcaaaagagcggttgagcaagcggaacggatggttggtttaacgatccgccgtgtcattgttggtgtgacgggcaatcatgtccagcttcaagactgccacggcatcgttgctgtttccagtgaaaaccgcgaaattaccgatgaagatgttgcgcgcgtgatggatgctgcgcaagtcgtatcgattcctccagatcgggaaattattggcgtgattccgcggcagtttatcgttgatgggttagatggcattaacgatccgcgcggaatgctcggtgtccgtcttgaaatggaaggaacgattattaccggttcgaaaacgattttacataacttactccgctgtgtagaaagagctggactggaaataagcgatatttgcctgcagccgcttgctgctggttctcttgctttgtcaaacgatgagaaaaacttaggggtggcgttagtcgatatcggtggcggttccacgactatcgctattttcgaacaaggatttttacaggccacttccgttttgccagtaggaggggatcatattacaaaagatttatcgatcgggctccgaacatcgacggaagatgcagaaaggattaaactaaagcatggacacgctttttatgactatgcttctgaagaagaagtatttatcgtgccggttatcgggactgatcagcatcagcaatttagtcaattagacattgccgatattattgaggcaaggctggaagaaatttttcaaatggttcaacatgaaatccgcaagctaggatttcgtgatttgccaggcggctatgtgctaactggcggagtagcaaatatgccaggaatattagaattggctcatgtcgtattaggaagcagcgttcgcattgctatgcctgattatataggtgtgcgcgatccgcagtatacgacaggagtagggctgatcaagtttgcttatcaacaagcgatgctgcaagggaaatcggttcctgttgctgcatcggttgcggagcctgttgaaaaacatccgcaaaagcaatcacaaccgaaacaaaaaaagaaagaagcgactcttggaaaaaaagtaaaaaaatttttcgggtatttctttgaatag

SEQ ID NO: 1875 - DNA, 1218 bp, Desulfotomaculum acetoxidans DSM 771
gtgttaaaatataacgatcaattaattatggctttggagatcggttcaacaaaaacagtgtgtggggttgggaagctgagccacgccgggaggttaagtattctaggttatcatgaggaatcctctataagctggcgaaaaggtagaattggtgataatgaattagctattagattttttcgtaatattgttgaagctgttcagcattctaccggtggtcggccgtatgtggtgcatgttggcatggccaaccatgaattatatataacacggcaaaatttcaagcatgttttttctgaaacagcacacaggatatcggaggaagatatatgttttgttttccaaatgctgaaagctttggcagccagggaaaacaacaggataatacatgttgtcccaacaggtttttatatagataatcaattggttaaagaacctcttgatttatctggaaaatgtttttctatagaggcaattgttatatcaatgaatactgaagcgctagataatctgcttatgctactaaagcttgcgggcataaaggtaaaggaagtgatattaggttcactggcatcggctgatgcggttttgaatgctacggagaaagaattcggttcggtttatgtggatataggcgggcaaaccacagctattgttgtatactctcatggctttttacaggatgtagtggtcttacctgtaggcagtaattatataaccggtgatttggtctttggtttgggcatatcttataccgccgccgagtacctgaagcttgagctgggtttaacaccggtaaggaatctagcagaggaaatagaagtcaagagtggttctgaattaaagagagtatcagctcgcctgattcttgatattattgaggccagaataaatgagattttagacttaatcaaaaaaaatatagaaatatataactgtgaggggttaataaaaacagggtttgtttttggcggcggtggagccaagttggctggtttggttgattatgctgaaaagcatttagatatgccggttcgggtgacaggtccagatgcatatttagatgcaggaactagtaccgaggctgtgagtttgggagtaataggattaattagattccgggaaaatcagagtttattgcctgccaagccagatacttcaaatattcttggaaccggctggttggaaaaaataaaattatgggcagttaaaaaatag

SEQ ID NO: 1876 - DNA, 1236 bp, Alicyclobacillus acidocaldarius DSM 446
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 1877 - DNA, 867 bp, Thermoanaerobacter sp. X514
atgaaaatattgattgctgagtatgcaggtttctgctttggagtaaaaagagctattgaaactgcatatcaggaaattgaaaaaggtgatggaaagaaaatatatactttaggtgaaattattcataatccacaagttatatcggacttatcgaaaaaaggggttaatgttattgaagaagaagagctggataaattaactgagggcgataaattaattatccgaagtcatggggtgtctaaaaaattatacgattttctcgctaaaaaaggagttgaagtcatagatgttacctgcccatttgtaaaaaaggtacaaaatatagtttatgagtactaccacaagggctactctattatcattgtaggagatagaaatcatccagaagtaataggagtaaacggatggtgtgatgacactgcttatgtggtaaattcaattgaagaagcttatgaattacctcaattagaaaaggcatgtgcagttgctcaaactactctcattgaaaagcattggaaagatattttagaagtaataaagctaaaagttaaagaccttattttttttaatactatatgtgatgctacacaaaaaagacaagatgctgctgatgagctttcaaaaaaggtagatgtaatgtttgtaattgggggaaaacatagctctaatactcaaaaactaaaaaagatatgtgaaaaaaattgtaaaaacacttttcatatagaagatgcagaggaattgactcttgagatggtaaaagaccatgagattataggagtaacagcaggagcttcaacccccgattatgtgatagaggacgtgataaaaaaaattagatttttaaaaggggaagatggggatgagtga

SEQ ID NO: 1878 - DNA, 867 bp, Sulfurihydrogenibium YO3AOP1
atggctaatataatagttgcacaaacagcaggattttgttttggtgtaagaatagctgtagatatggcaaagcaagccggagaaaaactcggacatgcatatacaaatggtccaataatccataacaagcaagttgttaattatctcaaatctattggtgttgaagagatgcaggactattcacaactaaaacccggcgatactgtaattataaggtcacatggtgtaccacccaaaacagaaagaatgttaaaagagttgaatataaacgttcttgatgctacatgtccgtttgtaaaaaaagttcatgataaagtcaagcaacttgttgaagaagggtactttgtagtaataataggtgaagaagggcatccggaagtgataggaacgcttggacaccttgaagaagttggcggaaaaggcgttgttgttgaaaattttgaagatttagtcaaaaaagttccaaaaagaaatagaatcggagtagtagcacaaacaacccaaagtgaagacttcttcagagaagcggtaggatatttggcagaaaatacagaagagttaaaagtttttaatacaatttgcgatgctacttctgtaagacaagaagaggttaaaaaaatagcaccagaagttgatgtgatgataatcatcggtggaaaacacagcggaaacacacaaagactttatcagatttcaaaagcattaaatccaaatacttatcatatagaaacagcagacgagctacaaaatcagtggtttgaaaataaagaaaatataggtatatcagccggtgcatccacacctgactggataattcaagaagttgtaaataaaatcaaagaaataaaaggagttagccatgaatga

SEQ ID NO: 1879 - DNA, 852 bp, Dictyoglomus turgidum DSM 6724
atgaaggtgtatattgctactccttacggattttgttcgggagtaaaaaaatccatatctcttgctgaaaaaatactgtccttaaaaggtgaagtatatactttgggagcattagttcataatccaaaggtaatagaggaattgtcgaaaaagggcataaaggtgcttgggaaggatgaaattgtagagggtaaagctttgatcgttagggctcacggtttacctcaaagagatatagatttttataaaagcttaggaaatgaaatctatgatgcaacttgtcctcttgttaaaaaagtacaggttcttgcagagtatcttaagaataacaaatataaagtaataataataggagaaaaaaatcatcctgaagtgataggaatattgagttatacagataatcaaggtatagtgatagaatatgagagtgatatagagaaagtagaatattatcctaaaattgggatagtttttcaaactacgcaaagttttgataatgctattcaaaaagtaaatctgataatgaataagggtaaagagatcaggatatttaataccatatgccctgaaactattgagcgacaagaaaaagctaaaaaactctcaaaaatagtagacgttgctctggttctaggcgggaaaaatagtgccaacacgaggaggttatatataacattgagtctaaaggtaccaacatatcatattgaaaatttggaagagatagataaaaattggtttaaagaagacagtaaagtaggcataattacgggcacatctactcctaataactttgtagaggaggtattagcattattaaagagtctttatcccttagagattcatttggtataa

SEQ ID NO: 1880 - DNA, 1992 bp, Anaerocellum thermophilum DSM 6725
atgattattaaggttgcgcaaagcgctggattttgttttggtgttcaaagggcagtagaaggcgttttggcatgggcgaaagcaaataagggaaaatctataaaggtgtatggaatgttaatacataatagttatgttatagataaattgaaagatttaggtgtaaaagttgtagaggatattgagcaaattgggaaagaagatataatttttattcgttctcacggtgtttcaatggaggagtatgccgagattgaaaaaagggcagataaagtttatgactttacatgcccatatgttaaaaagattcacgagattgtaatggaacattcagtgaacgggtatgatataattgttgttggagatatgaaccatcctgaagtaaaaggaattgttgggcatgttggaaataatagaaaatgttttgttgtagatagcattgaaaaagtaaaagaagcgattaatcaaattgaaggcaaagctgcagttgtctgtcagaccacgtttgacggaaaaaaatggagtgaaataagagaatttttagagtctcatacaaattataaagtgttcgataccatatgcaaagcaacaataaacaggcaaaaggaagcacaagagcttgcccagcatgtagacataatgttggtggtcggtgataagaaaagttctaataccaacaaattgtataagcttctgaaggagataaaacccacattttttattgaaaaagttgaagatttagattcaataaaattagatagctatataaaaagcattggggtgacagcaggtgcttccacttctcctgaacagattgaagaggtggtaaaacatctggaagaaaagtttaatgagatgaatctgaaagattttgagagacttattgatagaagctttttgacagtgcaaagaggtgaagttgtaaatggcaggataataaaagttgaggaagattatctacttgttgatattggttacaaggcagagggtataatttacaaagacgaggttatcaagaatggaaatgtaaatttgaaggacctgtttaagataggtgaggtaattgaagcagtagtgataaaagagtcagatgaagaaggaaatgtggttttatcaaagtatcgggcagatatacttcacgggtttgaagagctgctttcaaaatatgaaaataaagaaactgtaagagtaattgttaagtcaattaaagaaaaaagcattgtttgtgattttagaggtacaaatgtttatgtgccaatttctcagtggggtgaagatgttcaaacttctgatataggaaagatatttgaaatagaaatcacagatgtcagcaaagaaaaaaagatcgcttttggaagtcgaaaatctttgttaaaacaaagagaagaggagagatttattaaacagattaattctttagatttttccagagaatacgagggcactgtagttgagataagagaaaaaggcattgtggtaaattttgagaacctacgaggttttgtacctgcaagtgaaattggatatttgaaaaaaggtgcaggaattaaaaaattatttgaacttggcgaaaaagtcaaggtgaagattcttgatatagacaagaataaaaaacagatttatcttagcgtaaaaaagactcaagatgatgagtggataaaaaagattaaaaacttgtatttgggaatgcttgttgactgtgaagtgacaaaggtgttaccttttggacttgttgtatggattacagaacatgatgttgatggttttgttcacgtttcaaatattccccttggatacaaccaaagaccacataacctgtataaagttggagatagcttgagagcaaaggttatagagattgatgaagaaaagcgaaggattgcgttgtctttaaaagatttgcacgaagaagaaaacatagatactgagcataatgaagactttgtgataacactcgctgattttgtgaagaatataaagttagaacaataa

SEQ ID NO: 1881 - DNA, 1035 bp, Acidimicrobium ferrooxidans DSM 10331
atggccgtcgacaaggtcctgctcgccgctcctcgtggtttttgtgccggggtcgagcgggccatcggcgccctcggctggatgctgcgcatcttcgaaccgcccgtgtactgctaccacgagatcgtgcacaaccgcctcgtggtcgaggcgttcgaagcagcaggcgtcgtcttcgtcgacgacgtcgagagcgtcccccctggtcgcccggtcatgctgtctgcccacgggaccgcccccgaggtcctcgaggcggcgcgccaacgctgtcccatcgtcgtcgatgccgtctgtccgctcgtcacgaaggtccaccacgagatccgaacgcgagcccagcgcggctaccagatcgtctacgtcggtcatcgtggccacgaggaggccatcggcgccaccgccgaagctcccgaagccgtcaccttcgtcgagacgccagaggaggctcgcgccatcaccctcggcgacgggccggtcgcgctgctcgcccagaccacgctcgccgtgcccgaatgggaggcgatcgccgccatcgtcgccagccagacgcccaacctctggcagccgggccgctccgacctgtgctacgccaccacgaaccgacaggcggccgttcgggcgcttgcagagcgtgtcgacgccatggtcgtggtcggatctgcgaactcctcgaacacccgcgctctcgagcgcgtcgccacgagcgccggcgtgggccacgtcgagcgcgtcaaccgcccgagcgagctcgtcggcccgttcgagggcatcgtgggcgtcaccgccggggcatcggctgcggagtccgtcgtcaaagatgtggtggccgcactcgcgccgcggctgggcgtcgaggagatcagcgtcctcgaggaggacgagttcttcccactccctcccgatctgcgcgacctcatcggtgcgctcgcgggcgtcgtcgcggttgcaacaggcgtctccccagagggcgcactgcccgagcgagagtccgccgaggcgatactcgccgcactcgacactcgccaccgctag

SEQ ID NO: 1882 - DNA, 837 bp, Eggerthella lenta DSM 2243
atgagagtggtgaaggcaagctacgccggggcgtgctacggcgtgcagcgcgcgctcgacatggccgtcgaggccagcgccagcggcgagggcgcatccacgttgggcccgctcatccacaatccgcaggtggtggccgaactggcggcgcgcggcatccgcgcggtcgacggccccgagaacgtcgagcgcggctcggtgatcatccgcagtcacggcgtgacccccgcggtgcgccgcgcggttgaagaacgcgagctgcccctcatcgacgccacgtgcccgcacgtcgcccgcgcacagaaggccgccgccgatctcgcacgccgctgcggctgcgtcgtggtggtgggggaggagggccatcccgaggtggaaggccttgtggcctacgcgcgcgaagcggggggcgaggtgttcgtggtcgccgccccgggcgacctgtctgcgagcatcgaggcgccggtgggcatcgtcgtgcagacgacgcaaacccgcgaggcgctggacgcggtggtcgaggcgctcgccgcgcgcggcatccggcccgaggtgaagaacaccatctgcttcgctacgcgccagcgccaggaatcggccgcggcgctcgctgacgaggtggacgccatcgtggtcatcggcggccgcaactcgtcgaacaccacgcgcctggccgacatctgcgccgccgcgtgcccgcgcacccaccacgtggaggcgcccgaggagctggatccctcctggttcgtcggctgcgagagcgtcggcgtcaccgccggagcctccactcccgaagaccagatagccgccatcgtggagcgtctggaggcgctgtga

SEQ ID NO: 1883 - DNA, 855 bp, Cryptobacterium curtum DSM 15641
atggagattattatcgcttcgcgcgcgggtgcttgttacggcgtgcagcgtgcgttgaatcttgcgcaaaaggcagcccagtcgggtggcgacgttcagacgctcggctcgcttattcataacccacaggtagttgctgaacttgctgcttcgggagttgaagccgtatcaaagcctgaagaacttaccgcttcacgtgctattattcgcagccacggagttaccccacaagtgcgtgaggggatagagcaggctggtgccgatattattgatgccacctgtccgcatgtactgcgtgcgcaacaggcagctcgtgatcttgcgcttgaagggcgcctagttattgtggtgggcgaagaaagtcaccctgaagttgagggactccgcgcctgggccgagcaggctggaggacaggttgttgtcgctgccacaccagacgatgtgccctctcagattgatggatcggtcggtattgtcgtgcagacaactcagcgacgcgaaaaacttgatgccattattgatgtacttaaatcacgcggaattgaagcggagatacgtgacaccatctgcagtgccacgtcaacgcgacaagaagccgcggcagagcttgcaagccaagtcgatgttatggtggtaataggcgggcataattcttcaaacactactcgtctctttgaaatctgtcgggcacgcagtcctcaggcttttcacattgaatcgcccgacgaattgcaggccattgatttcaagggagcgcaacgcgttggggtaacagctggtgcttcgacacctgaagaccagatcgaaagcgttatcgaacgtctgcgttcttttgctgaaagccaagaggaataa

SEQ ID NO: 1884 - DNA, 831 bp, Slackia heliotrinireducens DSM 20476
atggagattctccgtgccaagcatgccggcgtctgctacggtgtcgagcgcgcgctcgacatggtatcggccgcatccatggatggcgacgaagacaccttcacgctggggccgctcatccataatccgcaggtggttgccaagctggaaagccgcggcgtgcgtgcagtcgacggccccgagcaggtcgaccacggcatcgtcatcctgcgcacccacggggttgaacctcacatcgcggccgatctcaagtcccgcgacctgacggtcatcgacgcgacgtgcccgcatgtggccaaggcccagcggtccgccgccaacctggccgacacctgcggcacggtgctcatcatcggacgcgccgagcatccggaaatccgaagcgttcgcgaatacgcaggcgagaaggccatcgtcgtggccgacgtcgacgaggtgcccgagcatctcgaagagccggtgggcgtcatcgtgcagaccaccgaaagcaaggagaaactgcaggccgtggtgaacgagcttgaggcccgcggtgtcgagacccaggtcaagaacaccatctgctttgcaacccgccagcgccaggatgccgcggcggccctggcagacgaggttgacgccatggtggtcatcggcggtaagaactcgtcgaacaccacgcatctctacgagatctgccgcgaccattgcgaccgctcgtacttcgtcgagaccaaagaggagctcgacccgtcctggttctcggccaccgaccgcgtgggcgtgacggccggcgcctccactcccgactaccagatcgaggacgtcatctcgtatttggaatcgctgtaa

SEQ ID NO: 1885 - DNA, 1251 bp, Pelobacter carbinolicus
atgtctcagactcttattcagcaagatcccgaaatcgccgaggccattcgcctcgaaaccgagcgccaggaatacaatctggaatttatcgcatcggaaaactttgtttccgagcaggtcatggaggcccagggctccatcatgaccaataaatacgccgaaggctatcctgcaaaacgctactacggcggctgcgaaatggtcgatattgccgagcgtctcgccatcgagcgtgccaaggaactgttcggtgccgaacatgccaatgtgcaggcgcatagtggatcgcaggctaacatggctgtctattttgccgcttgtaaaccgggcgacaccgtcctcggtatgaaccttgcccacggcggccatcttacccacggttcaccggtgaatttctccggtaaacttttcaatatcgtttcctacggtgtgcaaaaggaaactgggtacatcgattatgaagaggttgaacgactggctctcgaacacaaaccgactctgttggttgttggtgcaagcgcctatcctcggaccatcgattttcccgctttccgcaagatagcggataaggtcggcgccaagatcatggtcgatatggcgcatatcgcgggtctggttgcggccggagtacatcccagcccggtaccttatgccgaatttgtcaccacaaccacgcataaaaccctgcgcggtccgcgcggcgggatgattctttgtcgtgaggagtttgcaaaaactatcgacagtaatattttccccggcattcagggcggtccgttgatgcacgttatcgctgccaaggccgtttcctttaaagaagcactggcgcccgagtttaaagagtattcgacgcaagtggttaaaaatgccaaggtattggccgatgcgctggtcaaacggggactcaatctcgtttccgggggtaccgacaatcacctcatcctggtcgatttcaccggcactgaaaccaccgggaaaatggccgagaaagcccttgagaaagcgggtattacggttaataaaaactcggttcccttcgaaacccgttcgcccttcgttaccagcggtatccgtctgggaacgccggccaccacgacacgcgggctcaaggaagccgaaatggagcgtgtggccgattgggtggttcgtgctttggataacatggaaaatgatacggaacttgccgctattaagggtgaagttcgtgagatgtgcaaacggttccccctgtatgcacatcttctgaaataa

SEQ ID NO: 1886 - DNA, 1239 bp, Desulfovibrio desulfuricans G20
atggacgaactgcttattcaggatccggaagtcggtcgcgccattgttcaggaagtggaacgtcagaccggcaagctggaactcatcgcctctgaaaactttgtgtcccccgcagtccgcgccgcacagggcagcgtgctgacccataaatacgccgaaggataccccggcaagcggtattacggcggttgcgaatttgtcgacgtggcggaaaacctcgccatcgaccgcgcctgcgaaatattcggcgcccagtacgccaacgtccagccccactccggcagccaggccaatatggccgtatacttttccgcgctgactcccggcgacaccattctggccatggatctgtcgcacggcggacacctgacccacggcagccccgtcaacttttcgggccggttctacaatgtggtgttctacggtgtctcgcgcgaaaccggctgcatagattatgacagcgtggcagaactggcacgcgagcaccgccccgccatgattgtggccggtgccagcgcctactcccgcatcatcgattttgcacggttccgcgccatagccgacgaagtgggttccctgcttatggtcgacatggcccacatagccggtctggtggccgccggtctgcatccttcccctgtgggcacggcgcacttcaccaccacaaccacgcacaaaaccctgcgcggtccgcgtggcggcatgattctgtcggacgaagaagccgccaaaaaactgaacagccagattttccccggcattcagggcggcccgctcatgcatgtcatcgccgccaaggctgtggccttcggcgaagcgctgcgtcccgaattcggcgcctaccagaagcaggtggtcgccaacgccgccaaactggccgccaccctgaccgatgccggttttgaactggtttccggcggcaccgacaaccacctgatgctggtggacctgacaaacaaggatatcaccggtaaagatgcccagcatgcgcttgaccttgcgggcatcaccgccaacaaaaacacggtgccttttgaaacccgctcgcctttcgtgacttcgggcatccggctgggtacccctgccctgaccacccgcggcatgaaagaagctgaaatggtcaaagtggccggctggataatcgacgcgctgggcaatatcggcaacgaaacccgtctggcggaaataagccgcgacgtggaaaagttcgcccgtcagttcccgctgttccactggtaa

SEQ ID NO: 1887 - DNA, 1251 bp, Moorella thermoacetica ATCC 39073
atgaacctggaaacagtagccaaggttgatcccgaaatagtagccgccgtcaggggcgagcttcaacgccagcggacccacctggaactaatcgcctcagagaacttcgtcagccaggccgtcatggaggcctatagctgcgtcctgaccaataaatacgccgaagggtatcccggcaaacgctattatggcggttgtgaatgggccgacgtagtcgaaaacttggcccgggaaagggccaaagccctcttcggggccgagcacgccaatgtccagccccattccggcagccaggccaacaccgccgtctacctggccgttctgaacccgggcgataaggccctgggcatgaacctggcccacggcggccatttgacccacggtagcccggtaagcctttccggcaaatactataacttctgtttctacggcgtcgatgccaaaaccggccgtattgactatgacgccgtagcccgcatcgcccgtgaggagcggcccagactgatcgtcgccggggccagcgcctacccgcgggtaatcgactttgcccgtttccgcgagattgccgacgaggtcggcgccctgctgatggtggatatggcccatatcgccggactggtggccgccggtatccatcccaacccggtaccctacgcccacttcgtgaccaccaccacccataagaccatgcgcggtccgcggggtgggattatcctgaccaccagggaatacgcccgggatatcgataaggccgtcttccccggtgtccagggcggtcccctgatgcacgtcatcgccgccaaggctgtggccttaaaggaggccatgctgccggagttcaaacgttaccaggagcaaatagttaccaatgcccgtaccctggccgacgccctcatgggctacggatttaacctggtttccggcggtaccgacaaccacctaatgctcgtcgacctacgcaataagaatataaccggccgggaggccgaagatatcctggcctcggtccagattaccgtcaacaagaacgccatccccttcgacccgcagaagcccagcgtaaccagcggcatccgcctgggaacggccgctctgacctcccggggcatggacgccgacgccatggtccaggtggcccgggccatcgacctggccctctcctacggtccggatgagaagaaactggaggaagccaggggtatcgtcgccgaactctgccgggccttccccctctaccaggagctcgactaa

SEQ ID NO: 1888 - DNA, 1248 bp, Syntrophomonas wolfei Goettingen
atggattatattcaagagtatgttaagccggttgacccagaagtggcggaagccattgaaaaggaagaggccaggcaaaacaacaaattggaactaattgcttcggaaaactttgtatcccgtgctgttatggctgcccagggttcggtgatgaccaataaatatgccgaaggtttacctggggccaggtattatggtggttgcgaatatgtggacatagtagaagaactggcccgggacagggtaaaagagattttcggagctgaacatgccaatgtgcaaccccattccggcgcccaagctaatacagcggtatattttgcggcgttgcagccgggacaaaccatcatgggtatgaatctaaatcatgggggacatcttactcacggcagtaaagtgaatatatccgggaagtatttcaatattgtggactatggggttaacagggatacagagagaattgattatgaagagttacgagaaatagcgctaaaagctcgtccccaaatgattgtggccggagccagtgcttacccccggattttggattttaaaaagttccgggaaatcgctgatgaagccggggctcttctttttgttgatatggcccacatcgctggtctggtagctgcaggccttcatcccagcccggttccctatgccgattttgtatcctctaccactcacaaaactttgcgtggaccccggggaggatttattttatgccggcaagaatgggccaacaaaatagacaaagcggttttccccggcatacagggagggcctttgatgcatgtaatagcagccaaggccgtttgcttcaaagaggctcttacgccggaatttaaagcctatcagcaggatattgttaacaatgccgctatattggcaaaggctttgatggagcagggtttacgtgtggtatcaggaggaacggacaatcacctcatgttagtggatgtccgtcccaaaggacttaatggccgggatgccgaagccattctggaatccataaatataaccgtaaacaaaaatgctatcccctttgatccagagaagccgactgttaccagtggcatccgggtaggaactccagcggttaccagccgggcgctaaaaggagacgatatgagggaattggcccgggctataaccctggtactggacaagcatgacagcgaggaagtaaaggaagaagcccggaggatagtaaaagctctctgtgataagtatccactgtatacctag

SEQ ID NO: 1889 - DNA, 1239 bp, Desulfovibrio vulgaris DP4
atggacgagttgctgcttcaggaccccgaggtcggcaaggccatcattctcgaaatcgaacgtcagaccggcaagcttgagctcatcgcgtcggagaacttcgtctccgccgccgtccggcaggctcagggcagcgtcctcacccacaagtacgccgaaggctaccccggcaagcgctactacggcggatgcgagttcgtcgacatcgccgagaacatcgccatcgaacgcgcccgcaccatcttcggctgcgaatacgccaacgtgcagccccattcgggcagtcaggccaacatgggtgtctatttcgcgtgcctcaagcccggcgacaccatcctcggcatgaatctctcgcacggcggccacctgacgcacggcagccccgtcaacttttccggtcgtctcttcaacgtggtgttctacggtgtcgagaaggagactggccgcatagactacgagcaggtggccgcactcgcacgcgagcacaagccctccctcatcgtcgccggtgctagcgcctacccccgcaccatcgacttcgcccgtttccgcgccatcgcagatgaagtgggcgcgaagctcatggtcgacatggcccacatcgcaggtctggtcgccgctggctaccaccccagccccgtgcagcacgcccactacaccacgaccaccacgcacaagacgctccgcggcccgcgcggtggcatgatcctctccaccgaggacaacggcaagacgctgaacagccagatattccccggcattcagggcggcccgctcatgcatgtcatcgccgccaaggccgtggccttcggcgaggcgctgcgccccgcgttcaaggagtaccagaagcaggtggtggacaacgccgccgcccttgccggtgtgctcaccgccgccgggttcgatctcgtttcgggcggtaccgacaaccacctgatgctggtcgacctcaccagcaaggacgtcaccggcaaggatgccgagatagccctcgacaaggcgggcatcaccgtcaacaagaacaccgtcccgttcgagacccgttcgcccttcgtgacctccggtgtgcgtctcggcaccccggccctcaccacccgcggcatgaaggccgccgagatggagaaggtgggcggatggatcgtggacgccatcgccaacaccaccaatgagacccgactggcggagatcagccgcgaagtggaacgcttcgcacggcagttccccctgttcgcatggtag

SEQ ID NO: 1890 - DNA, 1242 bp, Desulfotomaculum reducens MI-1
atgtttaacggtaaactagctcaaaccgacccggagcttgcaaaagctatcgagctggaacaccaacgccagcagagaaacatcgagttaattgcatcggagaactttgtgagtcctgcagtattggaagcccagggatctattcttaccaacaaatacgcagagggttaccccggcaaacgctattatgggggctgtgaatttgtggatattgcagagtccctagctattagtagggctaagaaattatttggggcagatcatgccaatgtgcagccccattccggagctcaggccaactttgccgtatactttgccctgttacaacccggggacaaaattctaggtatgaacctggcccacgggggacatctaacccatggcagcccggtcaacgtatcgggtaaatattttaatgtggtggcctatggagtagaagaggacactgggtgcatcaattatgagaaactacgggagatcgccctgcaggaaaagcccaaaatgatcgtggcaggtgccagtgcctatgcccgggccatcgattttaaaaaaattggggaaattgccaaggaaattgatgcttacttctttgtggatatggcccatattgctggtttagtagctgcagggttacatcagagtcccgtaccctatgccgatgttgttaccaccaccacccacaaaaccctgcggggaccccggggcggtatgattttatgcaaagaagaatatgctcagttaattgacaaagccatattccctggcagccaaggcggacccttgatgcatgtgattgcggccaaggcagcggcctttggggaagcactgaaaccagagtttaaagcataccagcagcagattattaataacgctcaagccttggccaagggtttactggagcggggctttaaccttgtttccggcggtaccgacaaccacctgatactggtggacctgcggggcaccggcattacgggtaaacaggccgaaacactgttggacgaagttcatatcacctgcaacaaaaacgccattccctttgacccggaaaaaccctttgtaaccagcggtattcgcctaggtacaccggcggtaacaacccggggctttaaagaaaaggatatggataaagtggcagaaatcattgctcttaccctgcaagaaaaagacaacccagacacccaggaaaaagccagagccatggtcaaagaactctgcgacaaatatccgctgtatgcttag

SEQ ID NO: 1891 - DNA, 1260 bp, Candidatus Desulfococcus oleovorans Hxd3
atgatcattgactatctggcacagcaggaccccgaggtggccggggccgttgcccgtgaagtggagcggcagcagcacaacctggaactgatcgcatcggaaaacatcgccagccgggccgtaatggcggcccagggaagcgtgctgaccaacaaatatgccgaggggtacccgggcaaacgctattacggcggatgtgaatacgtggaccaggccgagcagatcgccattgaccgggccaaaaccctgttcggcgccgcctacgccaatgtccagccccactccggttcccaggccaacatggcggtctattttgccctgctgtcgcccggcgacacgggactgggcatggacctggcccatggcggccacctgacccacggcagcccggtgagtttttccggccggctgtttgactttaaacactatggcgtaaaaaaagagaccggcaccatcgactatgatcaggtggccgacctggcgaaaacccaccggccgaaaatgatcatcgccggcgccagcgcctatccccgaaccctggattttgaaaagttcgcgcagatcgccgcgtcagtggaggcctgcctggtggtggacatggcccatatcgccggcctggtggcggccggggttcatccgtcgccggttccccacgcggacgtggtcacctccaccacgcacaagacgctgcgcggcccccggggcggcctgattctttcagccagggccgatttcggaaaggccttgaacaaggagatttttcccggcattcagggcgggcccctgatgcacgtgatcgcggcaaaggccgtggcctttggcgaggcccttaccgacggttttgtggcctaccagcagcaggtggtaaaaaacgcccgcgcactggccgcgcacctgatggaacagggcattgagctggtatccggcggcaccgacaatcacatgatgctggccgacctgcgcaacatcagcgtcaccggcaaagccgccgagaccgccctggaacgggccggcctgaccctgaacaaaaacgccgtgccctttgacacggaaaaccccaccgtgaccagcggggtccgcatcggcaccccggtgatgaccacccggggcatgaaggagccggaaatggcggtggtggccgggctgatcgtgaacgtgctgaagaacatttccaacgataccgtgattcaggccacccggaagcgggtcatggagctgtgcgaggcctttccgatttaccgtgacaacgacaatggataa

SEQ ID NO: 1892 - DNA, 1239 bp, Desulfovibrio vulgaris  Miyazaki F
atggacgaactgctgattcaagacccggaagtgggtcgcgcggtcactcttgaaatcgaacgtcagaccggcaaactcgaactcattgcgtccgagaacttcgtctccgccgccgtccgccaggcccagggcagcgtactgacccacaagtacgccgaaggctaccccggcaagcgttactacggcggctgcgaattcgtggacatcgcggaaaacctggccatcgaccgggccaaggccatcttcggctgcggctacgccaacgtgcagccccattccggcagccaggccaacatgggcgtgtacttcgcctgcctgaagccgggcgacaccatcctgggcatgaatctttcgcacggcggtcacctgacccacggcagcccggtaaacttttccggtcgcctgtacaacgtggtgttctacggcgtgaagaaggaaaccggctacatcgactacgacgaagtggccgcccttgcccgcgagcacaagcccaccctgatcgtggccggtgccagcgcctacccgcgcaccatcgactttgcccgcttccgcgccattgccgacgaggtgggcgccaagctgatggtggacatggcccacatcgcgggcctggtggccaccggcctgcatcccacgcccatcgggcaggcccacttcaccaccaccaccacccacaagaccctgcgcggcccgcgcggcggcatgatcctgtccgacgaggacaacgccaagaccctgaacagccagatattccccggcattcagggcggcccgctgatgcacgtcatcgcggccaaggcggtggcatttggcgaggcgctgcgccccacctttgtcgactaccagcagcaggtggtgaagaacgccgccaggctggccggttgcctgaccgccgccgggtacgacctggtttccggcggcaccgacaaccacctgatgctcatggacctgacggccaaggacatcaccggcaaggacgccgagcacgcgctggacaaggcgggcatgaccgccaacaagaacaccgtgcccttcgagacccgttcgcccttcgtgacctctggcgtgcgcctgggcacccccgccctgaccacgcgcggcatgaaggaagcggaaatggaaaaggttgccgcgtggatcgtggacgccctggccaacgtgaacaacgagacccgccttgcggccatcagccgcgaagtggaagtcttcgcgcggcagttcccgctgttcgcctggtag

SEQ ID NO: 1893 - DNA, 1245 bp, Desulfovibrio desulfuricans ATCC 27774
atggatgaaattctgctgcaagacccggaaatcgcaaaggccattgctctggaatcgcaaaggcagatgggcaagcttgagcttatcgcctcggaaaacattgtttccacggcggtgcgcgaagcccagggcagcgtactgaccaacaaatacgccgaaggctatcccggcaagcgctactacggcggctgcgaatacgtggatatggtggaaaccctggcgcaggaaagagccaagctgctttttgacgcacaatacgtcaacgtgcagccccactccggctcacaggccaacatggccgcctacctggcagttctcaaacccggcgacaccattcttggcatggacctttcccacggcgggcacctcactcacggcagccccgtgaacttttccggccgtcttttcaagatcatctcgtatggggtgcagcgcgaaaccgggcgcatcgactatgacgatgtggccgcaaaagcccgcgaacacaagcccagtgtcattgttgccggcgccagcgcctacccccgcgccattgattttgcccgttttcgcgccattgccgatgaggtgggcgcaaagcttgtggtggacatggcccacatcgcgggtctcgtggctgcaggtctgcaccaaagcccggttccgcatgcccatatcaccaccacaaccacgcacaaaaccctgcgcggtccgcgcggcggcatgatactgtccacggaagatatgggcaaaaccctgaacagccagattttccccggcattcagggcggtcccctcatgcatgtcattgccgccaaggccgtggccctgggcgaagccctgcaccctgccttcaaggtgtatcagcagcaggtgctggataacgccgcaaccctggccgcatgccttacggaagcgggttacgaccttgtctccggcggtacggacaaccacctcatgctggttgacctgaccagcagggatattaccggcaaggacgctgaaattgccctggatacggcgggcatcacggtcaataaaaacaccgtgccctttgaaacgcgctcgcccttcgttacgtccggcatacgcctgggcactgccgcccttaccacgcgcggcatgaagcaggagcacatgcgcactgtggggcagtttatcattgcagcgcttgaaaaacggaacgacactgcggaacttgaaaaaattcgtaaaaacgttgaagaattcgcacatcagttccccctgttcgcccaccttgcctga

SEQ ID NO: 1894 - DNA, 1239 bp, Desulfomicrobium baculatum DSM 4028
atggacgaactcacccgccaggatccgcagatcgccaaagcgatccagctggagaccaaccgccagatcaccaaactcgaactcatcgcctcggagaacttcacctcccttgcggtccgcgccgccatgggcagcgtcatgacccacaaatacgccgaaggctatccgggcaaacgctattacggcggctgcgagttcgtggacatggccgaaaacctggccatggagcgggcccgccagctctttaacgccgaatacgccaacgttcagccccactccggttcccaggccaacatgggcgcgtatttcgcggccatccagcccggcgacaccatcctcggcatgaatctgtcccatggcggtcacctgacccatggcagcccggtcaatttttcaggacgcctgttcaagaccgccttttacggggtcgagaaggaaaccggccagatcaactatgacgaagtcgaagccctggccctggaacacaagccccagatgatcatcgccggggccagcgcctacccgcgcaccctcgatttcgcccgtttccgggccatcgccgacaaggtgggggccaaactgctggtggacatggcgcacatcgcgggcctggtggccacgggcctgcacccctcgcccatcgagcacgcccacttcaccaccacgaccacgcacaagaccctgcgcggtcctcgcggcggcatgatcctgagcaccgaggaattcggcaagaccctcaactcccagatcttccccggcatccagggcggaccgctcatgcacgtcatcgcggccaaagccgtggcctttgccgaggcgctgcgcccggaattcaaggattatcagcagcaggtcgtcgccaacgcccagactctggcggccgaactgacggcagccgggtaccatctggtctccggcggcacggacaaccatctcatgctggtggacctgactgcccaggacatcaccggcaaggacgccgagatcggcctcgacaagggcggcatcaccgtcaacaagaacaccgtgcccttcgagacccgctcccccttcgtcacctccggggtgcgcctgggcacgccggccttgaccacgcgcggcatgaagagcgacgacatgcgcaaggttgccaaatggattgtcgccatcctggaaaacctggacaatgagtccagactgaccgagattcggctggaagtggagaaattcgcgggccagttcccgcttttcgcctggtag

SEQ ID NO: 1895 - DNA, 1242 bp, Desulfotomaculum acetoxidans DSM 771
atgaccttgttgcgcagcttagccgacactgacccggaaatcttgcgggccatagaattggaaactgagagacagagaaacaaaatagaattaatagcttcggaaaactttgtcagccgggctgtcatggaagcacagggttcggtcatgacgaataaatatgccgagggctatccggctcaccgctattacggcggctgtgaatatgtggatgtagcagagaatattgcccgtgaaagggccttaaagttattcggagcggagtatgttaatgttcagcctcattccggttcacaggccaatatggccgtttattttgctttgctgaaaccgggagacactatattgggcatggatttagctcatggcggtcacctgacacacggcagcaaagttaatatttccggcaaatattttaattttatttcttacggcgtggaaaaagacacgggccgtatagattatgaaaaagtacaggccattgcttcagagtacaagcctaaaatgatcgtggccggggccagcgcctacccgcgggaaatagattttgagaaattaaaaaaagccgcggacgaaataggagcttatttaatggtggatatggcgcatatcgccggtttgattgcggccggcctgcacatgagtcccgtaccttacgcggatgttattaccactacaacacacaaaaccctgcgcgggcccaggggcggcatgattttttgcaaggagtgctacgggccggatattgataaggctattttccccggtatacagggcgggccgctgatgcatgtaattgcggccaaagcggttgctttcggtgaagcactgaagccggatttcaaagaataccaaaagcaaataattaaaaatgccgccgctctggccgaagccttgaccggttacggtttttcactggtttccggtggtacggatacccacttgatgctggtggacttgcagaataaaggtataaccggcatgcaagcggaaaatatgctggatgaagtcggcgtaaccgtaaataaaaatgccgtgccttttgaccctcagccgccgaaaataaccagtgggatcagaatcggtacgcctgccgtaaccacaagaggttttgatgaagaagccatgcggcaggtagcggaagtgttccactgtgtattggattactttggagacaagcattatcaggaaaaagcccgtgccctggtgcggcaaatctgcggcaggtatcctctctactag

SEQ ID NO: 1896 - DNA, 1263 bp, Desulfohalobium retbaense DSM 5692
atgcagcacttgctccagaccgacccagatatggccaaggcaatcgatctcgaacaccaacggcaattgagcaagatcgaactcatcgcctcggaaaatttcacatccgccgccgttcgcgaggccaccggctcgatcatgacccacaaatacgccgaagggtatcctggcaagcggtattacggcggctgcgaattcgtggacatggccgaagaactcgcccgggaacgggcctgccagctcttcggggccgagtacgccaacgtccagccccattcgggctcccaggcgaacatggcggtctatttcggggccttgaagccaggcgacaccatcatgggcatggatctgtcccacggcggccatctgacccacggcgctccggtgagcttctccggcaagctcttcaaaaccgtgttctacggtgtggatcaagccactgggatcatcgattacgagcaggtcgccgaacaggcccgcacgcatcgcccccaactgatcattgccggggccagcgcctaccccagggaaatcgacttcgcccgattccgggctattgccgacgaggtcggcgcccaactcatggtcgatatggcccacatcgccggtcttgtcgccaccgggctgcacgcctctcccatcggccatgcccatttcacgacctcgacgacccacaagacactgcgcggcccgcgcggcggactcatcctcagcggttctgaatttggcaagacactgaattcccagatttttcccggtattcagggtggaccgctcatgcatgtcatcgccgccaaaggggtggcgtttggcgaggccctgcaaccgagctttcgcgcctatcaggagcaggtcgtggccaacgctcaggcactgggccacgccctgaccgagaccggtttcgacctcgtctccggcgggaccgataaccacctcctgcttgtcgatctgacgcgcaagaacatcaccgggaaagatgctgaagctgccctggacaaagccggaatcaccgccaacaagaacacggtcccttttgagacccgttctcctttcgtgacctccggtatccgcctaggcacaccggcagtaaccacccgcggcatgaccgccgagcacatgcatcagatcgcggcctggatcgaagccgcgctggacaatatggacaacgaaactcgcttgctggagatcaacaaggaaattgccgccttcgccggtgaattcccgctattcatctcccagcctggggcggacctctcctcatga

SEQ ID NO: 1897 - DNA, 393 bp, Ralstonia solanacearum
gtgacgcagatgcacgttcctgctttccgcttttccgtaaatccgattccccgcgtatccagcctcgcgtggctgcgcagcctggcccgcccggcggggcaagggctgctgctggccgcgctgctgctgttcatcgccggaactgcgcaggccgccggttcctcgatgccgtgggaaggcccgctgcaatccattctggagtcgatccaggggccggtggcgcgcatcgtcgcggtcatcatcatcatcgccacgggcctggcgctggcgtttggcgacacatcgggcggcttccgcaagctgatccagattgtgttcggcctgtccatcgcgttcgcggcttcgagcttcttcctgtcgttcttcagcttctccggcggggcggttgtatga

SEQ ID NO: 1898 - DNA, 333 bp, Novosphingobium aromaticivorans DSM 12444
gtgacccaaacccttgcccgcgcccgcaatggcgcgtccgccctcgtgcttgccgctgtcgctgcgctggtcacggtcatgccggcacatgccgccggctcgtcgatgccgtgggaagccccgctccagtcgatcctcgaatcgatccagggcccggtcgccaagatcgtcgcggtgatcatcatcatcgccaccggtcttgcactcgccttcggtgacacctctggcggcttccggcgcctgatccagatcgtcttcggcctgtcgattgcctttgcggcctcgtccttcttcctctccttcttctcgttcggcggcggagcgctggtctga

SEQ ID NO: 1899 - DNA, 345 bp, Rhodopseudomonas palustris BisB18
atgatccatcgtccgcacccacttcgccgcgccatcgccacgcccgccggctttacaaccctgaccacggtcctggcttcgttgaccgctgcaccggcttgggcggccggctccagcatgccgtgggagcaaccgctcaaccagatcctgcaatcggtcgaaggcccggtcgccaagatcatggcggtgatcatcatcatcgtcaccggcctgacattggcgttcggcgatacctcgggtggatttcgccgactgatccagatcgtgttcggtctctcgattgcgttcgcggcaagctccttcttcctctcgttcttctccttcggcggcggagcgctggtctga

SEQ ID NO: 1900 - DNA, 330 bp, Rhodopseudomonas palustris BisB18
atgaatccgtcgcttcagcatattcgtcgccacgccgtcaccgcagtcactaccgccccttttgcgctcatctcaggttcggtttgggctgccggctcgaacatgccttgggaacagccgctcagtcagatcctgcaatcggtggaagggccggtcgccaaaatcctcgcggtgatcatcatcatcgtcactggcttgacgctggcgttcggcgatacctcgggtggtttccgcaggctgatccagatcgtgttcggcctgtcgatcgcgttcgcggcgagctccttcttcctgtcgttcttctcgttcggcggcggcgtggtggtgtga

SEQ ID NO: 1901 - DNA, 384 bp, Cupriavidus metallidurans CH34 uid250
atgacgcagatgaccatttctgctttccgtgtttccgtaaatccggctttgcgccttgcacggctgcgtagcctggcccgccctgctgggcaagggctgctgctggccgcgctgctgctgttcctggccggcaccgcgcaggccgccggttcctcgatgccgtgggaaggcccgctgcaatccatcctcgaatccatccaggggccggtggcgcgcatcgtcgcggtcatcatcatcatcgcaaccggcctcgcgctggccttcggcgacacgtcgggtggtttccgcaagctgatccagatcgtgttcggcctgtccatcgcgttcgcggcttcgagcttcttcctgtcgttcttcagcttctccggcggggccgtcgtatga

SEQ ID NO: 1902 - DNA, 384 bp, Cupriavidus metallidurans CH34 uid250
atgacgcagatgaccattcctgctttccgtttttctgcaaatccggctttgcgtcttgcgcggctgcgctgcctggcccgccctgcggggcaagggctgctgctggccgcgctgctgctgttcctggccggaaccgcgcaggccgccggctcctcgatgccgtgggaaggcccgctgcaatccattctcgaatccatccaggggccggtggcgcgcatcgtcgcggtcatcatcatcatcgccacgggcctcgcgcttgcgttcggcgacacgtcgggcggctttcgcaagctgatccagatcgtgttcggcctgtccatcgcgttcgcggcttcgagcttcttcctgtcgttcttcagcttctccggcggggcggtcgtatga

SEQ ID NO: 1903 - DNA, 345 bp, Sphingopyxis alaskensis RB2256
atgaaagcaaagaagacccggctgctggccgggaccgccctcgatcgcctcggcgtgctggccgtcacgtccgccgggcttctcatcaccgcgccggcgcacgcaggcggttcgtcgatgccctgggaagcgcccctccagtccatcctcgaatcgatcgaaggcccggtggcgaagatcgttgccgttatcatcatcatcgtgaccggcctcagcctcgccttcggcgacacctcgggcgggttccggcggctgatccagatcgtgttcggcctgtcgatcgcctttgccgccagctccttcttcctcagcttcttcagcttcggcggcggggcgctggtgtga

SEQ ID NO: 1904 - DNA, 333 bp, Rhodospirillum rubrum ATCC 11170
atgacccgatttgctcttcgcacgcgccgtcatctggcgacagtcggctctatcaccgtcatgaccctggccctggctccagccgcttatgcctccggctcgtcgatgccctgggagacgccgctggagcagatcctcgactccgtccaagggccggtggccaagatcatctcggtgatcatcatcaccgtgaccggcctgacgctggcgttcggtgagacctcgggcggattccgccggctgatacagatcgtcttcggcctgtcgatcgccttcgccgccagctcgtttttcctgtcgttcttctcgttttccggcggagcgctggtgtga

SEQ ID NO: 1905 - DNA, 333 bp, Mesorhizobium BNC1
atgatccaacctatcgcgcgcggccatcagcgcctcgcaaccgccgccacggcgctgaccctgagctttcttctggcgcccgccgcccatgcatccggctcctcgatgccctgggaagcgccgctgcagtccatcctgcagtcgatcgaggggccggtcgccaagatcatcgcggtgatcatcatcatcgtcaccggcctgacactggcgttcggcgacacgagcggaggatttcggcgcctcatccagatcgtcttcggcctgtcgatcgccttcgcggcgtccagcttcttcctgtcgttcttctcgttcggcggcggggcgctcgtctga

SEQ ID NO: 1906 - DNA, 333 bp, Mesorhizobium BNC1
atgatccgtttcgtctcgcgcggctgccggcatatggcgacggccgtcgccgctgtgtccgtcagcctgatgctggcgccctctgcccatgcttcgggttcgtccatgccgtgggagcagccgctccagcagatcctggagtcgatcgaggggccggtcgccaagatcatcgcggtcatcattatcatcatcaccggcttgacgctggcttttggcgataccagcggcggttttcgccgcctgatccagatcgtcttcggtctgtcgatcgcatttgccgccagttcgttcttcttgtcgttcttctcgttcggcggcggggcgctggtctga

SEQ ID NO: 1907 - DNA, 378 bp, Mesorhizobium BNC1
atgatccctgaacgacagcccatgcggtcggcacgccggctgcgcagtcagcccctttgtcgatgcatcctcggccggctcagcagcgccggaatctctgtcgtcacgatgctctatgcgctcccggcctatgccgctggctcctcgatgccttgggaagcgcctctggaatccatcctcgaatccatcgaggggccggtcgccaagatcattgcagtgatcatcatcatcatcacgggcctgacgctcgcattcggcgacaccagcggcggctttcggagattgatccagatcgtattcggtctgtcgattgccttcgccgcgtcaagcttcttcctgtccttcttctcgttcggcggcggggcgctggtcggatga

SEQ ID NO: 1908 - DNA, 384 bp, Burkholderia ambifaria AMMD
atgacgcagatgcacattcatgctttccgcatttccgtaaatccggcttcggccttcgcacgcctgcgtcgcctggccgcgccggcgcagcacggcctgatgctggccgccgtcatgctgatgacggctggcaccgcgcaggccgccggttcctcgatgccctgggaagggccactaacctccatcctcgaatccatccaggggccggtggcacgcatcgtcgcggtcatcatcattatttccaccggcctggcgctggccttcggcgataccagcggcggcttccgcaagctgatccagatcgtcttcggcctgtccatcgcgttcgcagcttcgagcttcttcctgtcgttcttcagcttctccggcggggccgtcgtatga

SEQ ID NO: 1909 - DNA, 387 bp, Shewanella sp. ANA-3
atgacacacgcccatgctttccgcttttccgtaaatccgcttccccacctgtccggtctcatgcggctgcgcagcctcgcgcgccctgcggggcaggggctgctgctggccgcactgctgctgttcctggcggatacggcgcaggccgccggttcctcgatgccgtgggaggggccgttgcagtcgatcttggagtcgattcaggggccggtcgcacgcatcgtcgcggtcatcatcatcatcgccacgggcctcgcgctcgccttcggcgacacgtcgggaggctttcgcaaactgatccagatcgtcttcggtctgtccattgcgttcgccgcgtcctcgttcttcctgtcgttcttcagcttctccggcggggccgtcgtatga

SEQ ID NO: 1910 - DNA, 333 bp, Paracoccus denitrificans PD1222
atgatccgtcacgccctgcgcatccgccagcacatcgccaccgcggccgccgccacctatgtcagcctgttcatcgctccggctgcgcatgcctccgggtcttccatgccctgggaagcgcctctgcaatccatcctcgactccgtcgaggggccggtggccaagatcgtggcggtgatcatcatcatcgtcaccggtctgacgctggccttcggcgataccggcggcggattccggcgcctgatccagatcgtgttcggcatctccatcgcctttgcggcctcgtccttcttcctgagcttcttcagcttcggtggcggagcgctgatctga

SEQ ID NO: 1911 - DNA, 333 bp, Paracoccus denitrificans PD1222
atgatccgtcatgccctgcgcatccgtcatcacgtcgcgacggcagcgaccacactctatgtcagcctgttcatggctccggcggcccatgccgccggttcttccatgccctgggaggcgccgctgcaatcgatcctcgattccgtcgaggggccggtggcgaagatcgtcgcggtgatcatcatcatcgtgaccgggttgacgctggccttcggcgataccggcggcggctttcgtcggctgatccagatcgtcttcggcatctccatcgccttcgcggccagttccttcttcctgtccttcttcagcttcggcggcggagcgctggtgtaa

SEQ ID NO: 1912 - DNA, 387 bp, Acidovorax avenae citrulli AAC00-1
atgacgcacgttgatgctttccgtctttctgtaaatccgctttcttggcggccctcgctggcacggctgcaccgcctggcccgacccgcagggcaagggctgctgctggaggcgctgctgctgttgctggccggtacggcgcaggccgccggttcctcgatgccgtgggaaggcccgctgcaatccatcctcgaatccatccaggggccggtggcccgcatcgtcgcggtcatcatcattattgcgacgggcctggcgctggccttcggcgataccagtggcggctttcgcaagctgatccagatcgtcttcggcctgtccatcgccttcgcggcttcgagcttcttcctctcgttcttcagcttctccggcggggccgtcgtatga

SEQ ID NO: 1913 - DNA, 378 bp, Acidovorax sp. JS42
atgacgcacgctgatgctttccgtatttccgcaaatccgcttcctcggcccgcacggctggatggcctggctcgcccggccatgcagggcttgatgctcgcggcgctgatgttgctgctcgcaggcaccgcgcaggccgcgggttcctcgatgccctgggaagggccgctgcaatccatcctcgaatccatccaggggccggtggcgcgcatcgtcgcggtcatcatcatcatcgccacgggcttggcgctggccttcggcgatacctcgggcgggttccgcaagctgatccagatcgtgtttggcctgtccatcgcgttcgccgcttcgagcttcttcctgtcgttcttcagcttctccggtggggccgtcgtatga

SEQ ID NO: 1914 - DNA, 360 bp, Polaromonas naphthalenivorans CJ2
atgacgcacatcgctttttcgacttcccgtttttctgcaaatccgcatctgcggctgacgttgcacgttgtcgtgctcgccgcgctgatgctgtgcctgactttgccggcacatgcagccggctccagcatgccttgggaagggccgctgacatccatcctcgaatcaatccagggaccggtggcccggatcgtcgcggtcatcatcatcatttccaccggcttggcgctggccttcggcgatacgtcgggcggcttccgcaagctgatccagatcgtgttcggtctgtctattgcgttcgccgcgtcctcgttcttcctgtcgttcttctcgttctcgggcggggcggtggtcgcatga

SEQ ID NO: 1915 - DNA, 327 bp, Bradyrhizobium BTAi1
atgaagttcaatcaatcgggcatgcgagggattgtaggggcggccgcgttcgcaatcacctaccttaccatcacttcagcatcggctgccggctccaacatgccgtgggagcaaccgctcaaccagatcctgcaatcggttgagggccccgtcgccaagatcgtcggcgtcatcatcatcatcgtcaccggactctcgctcgcgctaggcgatacgtccgggggcttccgcaagttgatccagattgtgttcggcctgtcgatcgcgtttgcggcctcgagtttcttcctgtcgtttttttcattcggcgggggagttgtgatctga

SEQ ID NO: 1916 - DNA, 324 bp, Bradyrhizobium BTAi1
atgttaatcaaggatgcccgccgtgcgttcgccacggcaaccgccttcgtcttcgtcgccctcgcaaccgcgccggcctatgcggccggatcgaacatgccgtgggagcagccgctcaaccagatcctggagagcatccaagggcccgtggccaaggtcgtgtcggtgatcatcattatcgtcaccggtctgacgctcgccttcggcgagaccagcggcggcttccgtcgcctcattcagatcgtcttcggcctcagcatcgccttcgcagcgtcgagcttcttcctgaccttcttccagttcggcggcggggtgacggtgtga

SEQ ID NO: 1917 - DNA, 360 bp, Bradyrhizobium BTAi1
atgaccgccgcccgacagccatcaactaagcatcgcctattcgtcggctcggttctcgaccggatcggcgccatcggtctgaccgcgacagggcttctctacgcggcgccggcctatgccagcggctcgtccatgccgtgggagcagccgcttcagcagatcctgcaatcgatcgaaggcccggtggccaaggtcatcgcggtgatcatcatcatcgtcactggcctgacgctcgccttcggcgatacgagcggcggcttccgcaggctcgtgcagatcgtctttggcctgtcgatcgcattcgcagccagctccttcttcctgagcttcttcaacttcggcggtggggcggtggtgtga

SEQ ID NO: 1918 - DNA, 336 bp, Sphingomonas wittichii RW1
atgatccatgcccttcggcatggcgcacgccgcgccatgctcgccgccaccgccagcgtcatcgcgctgaccatctcggcacccgcccatgcgggcggatcgtcgatgccgtgggaagccccgctgcaatccatcctcgaaagcatcgaggggccggtcgcgaaaatcatcgcggtcatcatcatcatcgtcaccggcctgaccctggcgttcggcgacacctcgggcggctttcgccggctgatccagatcgtcttcggcctgtcgatcgccttcgccgcgtcgagcttcttcctgtcgttcttctcgttcggcggggggctcgtcgtcgcatga

SEQ ID NO: 1919 - DNA, 384 bp, Pseudomonas aeruginosa PA7
atgacgcagatgaccattcctgctttccgtttttctgcaaatccggctttgcgtcttgcgcggctgcgttgcctggcccgtcctgcggggcaagggctgctgctggccgcgctgctgttgttcctggccggaaccgcgcaggccgcaggttcctcgatgccgtgggaaggcccgctgcaatccatcctcgaatccatccaggggccggtggcgcgcatcgtcgcggtcatcatcatcattgccacgggcctcgcgctcgcgttcggcgacacgtccggcgggttccgcaaactgatccagatcgtcttcggtctgtccatcgccttcgcggcttccagcttcttcctgtcgttcttcagcttctccggcggggccgtcgtatga

SEQ ID NO: 1920 - DNA, 330 bp, Ochrobactrum anthropi ATCC 49188
atgatccgttgcgccgttcgtatccgtcatcatctggcgaccgccgccgccttcacctgggcgagcctgatgactgcccccgcccaagcgtctggctcctccatgccctgggaagcgccgctgcaatccatccttgaatccgtcgaaggcccggtggccaagatcgtggcagtgatcatcatcatcgtcaccggcctgacgctcgcattcggcgataccggcggcggcttccgtcgcctcatccagatcgtcttcggtatctccatcgccttcgcggcgtccagcttcttcctctcgttcttcagcttcggcggcggagcgctggtctga

SEQ ID NO: 1921 - DNA, 333 bp, Parvibaculum lavamentivorans DS-1
atgatccgcaccaccatgcgcgttcgccgctatgccgcgacggccgccgccttcatctacatcaatctcgtcctcgttcccgccgcccatgcctccggctcgtccatgccgtgggaagcaccgctccagaaaattctcgaatccatcgaagggccggtcgccaagatcgtcgccgtcatcatcatcatcgccaccggcctggcgctggcgttcggtgacacgtccggcggcttccggaagctgatccagatcgtcttcggtctcagcatcgcgtttgcggcgtcgagcttcttcctgtcgttcttctcattcggcggcggggcgctcatctga

SEQ ID NO: 1922 - DNA, 333 bp, Xanthobacter autotrophicus Py2
gtgactccgaaccgcgtttcctttgatcgccgcctgctgcgaaccgctgctgcaatcgccgccttcgcctgcgctgtgtctgccgcccacgcctccggctcctccatgccctgggagacgccgctgcagtccatcctggagtccatccaggggcccgtcgccaagatcatcgcggtgatcgtcatcatctcgaccggcctcgcgctcgccttcggcgacacgtcgggtgggttccggcggctgatccagatcgtgttcggcctctccatcgccttcgccgcctccagcttcttcctctccttcttctccttcagcggcggagcgctggtctga

SEQ ID NO: 1923 - DNA, 333 bp, Xanthobacter autotrophicus Py2
atgatccgccatgccctgcgcgttcgccatcatatcgcgacggccgtgtccgtcactgtcctcagcatgatgctggcgccggccgcctacgcttccggctcctcgatgccgtgggaagcgccgctgcagtcgatcctcgaatccatcgagggaccggtcgccaagatcgtggcggtgatcatcatcattatcaccggcttgacgctcgccttcggcgatacgagcggtggttttcgcagactgatccagatcgtgttcggcctctcgatcgccttcgcggccagctcgttcttcctctccttcttctccttcggcggcggagcgctcgtctga

SEQ ID NO: 1924 - DNA, 333 bp, Xanthobacter autotrophicus Py2
atgatccgccatgccctgcgcgctcgccgtcatatcgcgacggccgcgtccgtcgccgtcttcagcatgatgcttgcgccagcagcccatgcttccggctcttcgatgccgtgggaagcgccgctgcaatcgatcctcgaatccatcgaggggcctgtggccaagatcatcgctgtgatgatcatcatcatcacagggctaacgctagccttcggcgatacgtcaggcggcgcgcggaagctgatccagatcgtcttcggcctgtcgatcgccttcgccgcgtcgagcttcttcctgtccttcttctccttcggcggcggagcgctcgtctga

SEQ ID NO: 1925 - DNA, 333 bp, Xanthobacter autotrophicus Py2
gtgatccaacgcctgcatcaaacgcgccatcgcctcgtctcggcgctgtccgtcgccacgctctccgtcgtgatggcggcgcccgcccatgcctccggttcatccatgccgtgggaagcaccgctgcaatccatccttcagtcgatcgaagggccggtggccaagatcgtcgccgtcatcatcattatcacgaccggactgacgttggccttcggcgacacctccggggggttccgtcgcctgatccagatcgtcttcggcctgtcgatcgcctttgcggcgtcgagcttctttctgtcgttcttctcgttcggcggcggggcgctcgtctga

SEQ ID NO: 1926 - DNA, 333 bp, Xanthobacter autotrophicus Py2
gtgactttcacgctccctccattctaccgccgattgctgcaggccgtggccggtgccaccgcctgcgtgtgtgttgtctccgcggcccacgcctccggctcctccatgccgtgggaaacgccgctgcagtcgatcctggattcgatccaggggccagtcgccaagatcatcgcggtgatcgtcattatctccaccggcctcgcgctcgccttcggcgacacctctggcggattccggcggctgatccagatcgtattcggcctctccatcgccttcgccgcttcgagcttcttcctctccttcttctccttcagcggcggagcgctggtctga

SEQ ID NO: 1927 - DNA, 384 bp, Delftia acidovorans SPH-1
atgacgcagatgaccattcctgctttccgtttttctgcaaatccggctttgcgtcttgcgcggctgcgctgcctggcccgtcctgcggggcaagggctgctgctggccgcgttgctgttgttcctggccggagccgcgcaggccgccggttcctcgatgccgtgggaaggcccgctgcaatccatcctcgaatccatccaggggccggtggcgcgcatcgtcgcggtcatcatcatcatcgccacgggcctcgcgctcgcgttcggcgacacgtccggcgggttccgcaagctgatccagatcgtattcggtctgtccatcgcgttcgccgcttcgagcttcttcctgtcgttcttcagcttctccggcggggcggtcgtatga

SEQ ID NO: 1928 - DNA, 378 bp, Delftia acidovorans SPH-1
atgacgcacgttgatgctttccgtatttccgcaaatccgcttcctcggcccgcacggctggatggcctggctcgcccggccatgcaaggcttgatgctcgctgccttcatgctgctgcttgcgggcactgcgcaggccgccggctcctcgatgccctgggaaggcccgctgcaatccatcctcgaatccatccaggggccggtggcgcgcatcgtcgcggtcatcatcatcatcgccacgggcctcgcgctcgcgttcggtgacacgtcgggcggctttcgcaagctgatccagatcgtgttcggcttgagcatcgccttcgccgcgtcctcgttcttcctgtcgttcttcagcttctcgggcggggccgtcgtatga

SEQ ID NO: 1929 - DNA, 378 bp, Burkholderia multivorans ATCC 17616 JGI
atgacgcacgttgatgctttccgtctttccgtaaatccgcatcccagtctcgcaagactgcgcctcctggctcgccctgccgcacagggactgctgctggccgcactgatgttgctgctggccggcacggcgcaggccgccggttccagcatgccgtgggaaggtccgctgacctccatcctcgaatcgatccaggggccagtggcccggatcgtggcggtgatcatcatcatttccaccggactggcgttggcgttcggcgacaccagcgggggctttcgcaagctgatccagatcgtgttcggcctgtccatcgcgttcgccgcgtcctcgttcttcctgtcgttcttcagcttctccggcggggccgtcgtatga

SEQ ID NO: 1930 - DNA, 342 bp, Caulobacter K31
atgatgtttcatcgtgctgcttcgcgtgcgcaacgtgatccgcgcccgctgcttttgaccaccaccctgaccctgctggtcagcgctcaggcccaggccgccggttcgggcatgccctgggaagagccgcttcagcaagtcctggagtccgttcagggacccgtcgccaagatcatcgccgtgctggtgatcatcagcaccggtctggccctggccttcggcgagaccagcggcggctttcgcaagctgatccagatcgtcttcgggctcagcatcgccttcgccgcctccagcttcttcctgtcgttcttcagcttcggcggcggggccctgatcgcatga

SEQ ID NO: 1931 - DNA, 333 bp, Caulobacter K31
atgatccgccatgccctgcgcgtccgtcgccaaatcgcaacggtcgcatccgtcaccttcgtctcgctggcgctcgcgcccgccgcctatgcggccggttcgtcgatgccatgggaagcgccgctgcaatcgatccttcagtcgatcgaggggccggtcgccaaaatcctcgcggtgatcgtcatcatcgtcaccggtctgacgctcgccttcggcgacacgtcgggcggctttcgccggctgatccagatcgtcttcggcctgtcgatcgcgttcgccgccagctccttcttcctgtcgttcttctcgttcggcggcggagcgctggtctga

SEQ ID NO: 1932 - DNA, 333 bp, Methylobacterium populi BJ001
gtgattcaacgcctgcaccaggcccgccatcacctcgtcacggctctgtccgtggccgcgctttccgtggtgatggccgcgccggcccatgcctccggctcgtccatgccgtgggaggcgccgctgcaatccatccttcagtcgatcgaaggccccgtcgccaagatcgtcgccgtcatcatcattatcaccaccggcctgacgctggctttcggcgacacgtcgggcggcttccgccggctgatccagatcgtgttcggtctgtcgatcgcctttgccgcatcgagcttcttcctctccttcttctcgttcggcggcggggcgctggtctga

SEQ ID NO: 1933 - DNA, 393 bp, Ralstonia pickettii 12J
atgacgcagatgatcgttcctgctttccgtatttctgcaaacccgcttgccctgcgctgccgtcccgcgcggctggatggcttggcacgcccagccctgcagggcctgatgctcgcggcgctgatgctgctgctcgcaggcaccgcgcaggccgccggttcctcgatgccttgggaggggccgctgcaatccatcctggagtcgatccagggtccggtggcccggatcatcgcggtcatcatcatcatcgccacgggcctggcgctggccttcggcgatacctcgggcggttttcgcaagctgatccagatcgtcttcggtctgtcgatcgcgtttgccgcgtcctcgttcttcctgtcgttcttcagcttctcgggcggggctgtcgtatga

SEQ ID NO: 1934 - DNA, 303 bp, Prosthecochloris aestuarii DSM 271
atgaaaaaacatgtcctccttctgccggttctgatattgctgatgtcgaatgccgcatatgcagcatcaacaggtatgccctgggaaggtccgcttgaccagctcctcaactcgctcaccggccctgtttcacgtgtcatcggtgctgtctccattatttctcttggtcttggccttgcgttttcagaaggtggaggcgtcatgagaaaagcgctctgggtcgtcatgggccttgccatcgcctacaatgcggtaagctggggtatcgggttcatgggatttggcggaggactgctggtatga

SEQ ID NO: 1935 - DNA, 327 bp, Gluconacetobacter diazotrophicus PAl 5 JGI
atgacccgcatgatcgtcctgcgccgccatctcgaagtggctggtgccaccctgtcgctcgccctgctgtcggccccggcttacgcggcaggctccaacatgccctgggaggagccgctcaaccagatcctggaatccgtgcaggggccagtggcgcgtatcgtgtcggtgatcatcattaccgtaaccggcctgaccctggccttcggggaaacctcgggcgggttccgtcgcctggtgcagatcgtcttcggcctgtcgatcgcttttgcggcgtccagcttcttcctgtccttcttctcctttgcgggcggggcgctgacctga

SEQ ID NO: 1936 - DNA, 342 bp, Gluconacetobacter diazotrophicus PAl 5 JGI
atgatccgtgttctcgccaccgcccgccggatgcaccggcgcgccctcgacgtcatcaccttcgctgcgctctcgctggccttcgctccggcggcctatgcctctggctcctccatgccgtgggagacgccgctcaactccatcctggagtcggtgcaaggcccggtcgcgaagatcatctcggtgatcatcatcacggtgaccggcctgaccctcgccttcggcgacacctccggcggcttccgccggctgatccagatcgtgttcggcctctcgatcgccttcgccgcgtcgagcttcttcctgtccttcttcagcttctccggcggagcgctgatctga

SEQ ID NO: 1937 - DNA, 393 bp, Thioalkalivibrio HL EbGR7
atgacgcagatgatcgttcctgctttccgtttttctgcaaatccggctttgcgccttcccgcgcggtcgcggctgcacagcctggcccgccctgcggcgcaaggcttactgctggccgcactgctgctgttgctggctggaaccgcgcaggccgccggttcctcgatgccgtgggaaggcccgctgcaatccatcctcgaatccatccaggggccggtggcgcgcatcgtcgccgtcatcatcatcatcgccacgggcctcgcgctggccttcggcgacacgtcaggcggcttccgcaagctgatccagatcgtgttcggcttgagcatcgccttcgccgcgtcctcgttcttcctgtcgttcttttcgttctctggcggggctgtcgtatga

SEQ ID NO: 1938 - DNA, 366 bp, Agrobacterium vitis S4
atgtcgcgtagaatgtttacgttggtcgcccttgcggccatctcgatgatgatggccgaaccggcctttgctgccgggggagggggtggtctgccctgggagggaccgcttcaacagatccagcagtccatcaccggccccgtcgccatggcaatcgccctgatcgcagtcgcggtcgcaggtggcatgctcatctttggtggcgagatcaacgacttcgcgcgtcgtctcgcctacgtcgttcttgtctgcggtatccttcttggcgcgacacaggttgtcggcctgttcggcgggggaggggcgtcgattggcgttcctctcgaggcaacgcaggacgtgacgctggacagggcgcatggctga

SEQ ID NO: 1939 - DNA, 387 bp, Diaphorobacter TPSY uid29975
atgacgcacgttgatgctttccgtatttctgtatatccgctttcccgccgctccagccccgcacggctggatggcttggctcgcccggccatgcaaggcttgatgctcgctgccttcatgctgctgcttgcgggcactgcgcaggccgccggctcctcgatgccctgggaaggcccgctgcaatccatcctcgaatccatccaggggccggtggcgcgcatcgtcgcggtcatcatcatcatcgccacgggcctcgcgctcgcgttcggtgacacgtcgggcggctttcgcaagctgatccagatcgtgtttggcctgtccatcgcgttcgcggcttcgagtttcttcctgtcgttcttcagcttctcgggcggggccgtcgtatga

SEQ ID NO: 1940 - DNA, 285 bp, Azotobacter vinelandii DJ
atgctggccgccatcatgttgatgacggccggcacggcgcaggccgccggttcctcgatgccctgggaagggccgctgcaatccatcctggagtcgatccaggggccggttgcacgcatcgtcgccgtcatcatcatcattgccacgggcctggcgctcgccttcggcgacaccagcggcggctttcgcaagctgatccagatcgtcttcggcctgtccatcgcgttcgccgcgtcgtcgttcttcctgtccttcttcagcttctccggcggggcggtcgtatga

SEQ ID NO: 1941 - DNA, 315 bp, Geobacter M21
atgaggactaaagaaaaggtcgtcggtctctggttcgctctcgtcgtattcctcaccacacagccggctttcgcaggcggctccagcatgccgtgggaatccccgctcaacaacatcctcaacagcatcaccgggccagtggccaaggccggaggggttttggccatcgttgcgaccggatttggccttgccttcagcgagggaggcgggttcatgaggaaggtcgtcggcgtcgttttcggcctctccatcaccttctccgccgggactttcatctccgattttctcggttacggcggcggggccggtttctga

SEQ ID NO: 1942 - DNA, 2397 bp, Bacillus cereus ATCC 10987
atggataaacaaaagcatgtgacgctcggcgttacaggaatgacatgtgcagcatgtgcaacccgaattgaaaaagtgctaaataaaatggatggggtagacgctaatgtaaacttggctatggaaaaagcaagtattaaatatgatccatcacagcaagaaatctctaatataaaaaataaaattgaaaacctaggctataacgtagcagaggaaaaaatcactttagatattgaaggaatgacatgtgcagcatgtgcaactcgaattgaaaaggtactaaataaaatggaaggtgtttcaaatgctactgttaatttagctacaaacagcgcggttgttgaatataatgaaggtttaatttctacagaaaatattttagaaaagataaagaaaacaggatataaaggacaaatacgcagtgaagatgtagatcgttcagaacgaaaagaagaagtgattaaggcaaaaaaacgtcaacttatcatttcaattattttatccttgcccttactctatacaatgattggacatatgccatttgatacagggataccaatgccacatattttaatgaatccgtggtttcaacttttattagcaacacctgttcaattttatattggtggacatttctatgtaggtgcttaccgtgcgcttcgaaataaaagtgctaatatggatgttttagttgccttaggaacatcggcagcgtacttttatagcttatatgaggcattgaaaacactaggaaacgcaaactacagtccggatctttattttgaaacaagcgcagttttaattacattaatactagttggaaaatattttgagacattagcaaaaggacgtacaacggaagcaatttctaaattattgagtttacaagccaaagatgcacttgttgtgcgtgatggtcaagaaatacgagtaccactcgaggaagtagttatcggagatacgattattgtaaaaccaggtgaaaaaataccagtagatggtattgtaacctcaggggtatcttctgttgatgaatctatgattactggagaatctattccagttgataaaaaagagggagacgctgttattggcgctactataaatgcaaatggagttctaacaattaaggctgaaaaggttgggaaagatacagctttagcaggtattattaaaattgttgaggaagcacaagggtcaaaagcacctattcagagattagcggacatcatttcaggtatttttgttcctattgttgtagcgattgctgtagttgcttttattgtatggtatttctttatcacaccaggagatttaccaaatgcattagaagttgggattgcaatccttgtaattgcttgtccgtgtgcgttaggtctggctacaccaacttctattatggttggtacaggaaagggagcagagaaaggaattctctttaaaggaggtgaattcctagaaggaacgcataaaattaatgctgtattacttgataaaacaggaactgtaacaaaagggaaaccggaagttactgatgtcttagaatttgaagaaggtatgttggattatgccatttcagctgaaagtgcttctgaacatccattggcacatgccattgttgaatacggaaagcaacagggaattaacttaaaagatttagcgcagttttcagcaatcccaggccatggtattgaagcaaacattgaagataaaaaagttcttgttggaacacgtaaattaatgaatgaacagtcaattgagatatcacagcatgaagaagttatgaaagacttagagtatcaaggtaaaacagcaatgcttgtcgcgattgatggaaaacttgctggaattatcgctgtagctgatacagtaaaagaaagctctaaggctgcgattcaaacattaaaagagataggaatcgaagtatacatggtaacgggggataataaacgtacagctgacgcaattgcgaagcttgttgatcttgaccatgtatatgcagaggtattaccagaagataaggctaaaattgtagaagatttacaaaaacaaggaaaacgagtagcgatggtgggagacggcattaatgatgcaccagctcttgcgaaagctgatattggtatggctattggaactggtgcagatgttgcaattgagactgcagatgttactttagttggtggtgatttgtcacacataccaaaagcaattgaattaagccgtaagacaatgaaaaatattcgacaaaatttattctgggcattattttataatgcaattggaattcctgtagctgcggctggactattagagccttgggtagcaggggcagcgatggcatttagctcagtatctgttgttactaacgcgcttcgtttgaaacgtgtcaaaatataa

SEQ ID NO: 1943 - DNA, 207 bp, Bacillus anthracis Ames 0581
atggaacagttaacattacaagttgaaggtatgtcttgtggacattgtgtaaatgctatcgaaagcagtgtgaaagagctaaacggtgttgaacaagtgaaagttcaattagcagaaggaactgttgaagttactattgactcgtcagttgtaacattaaaagatatcgttgctgtaatcgaagatcaaggatacgatgttcaataa

SEQ ID NO: 1944 - DNA, 207 bp, Bacillus anthracis str Sterne; identical to SEQ ID NO: 1943

SEQ ID NO: 1945 - DNA, 207 bp, Bacillus thuringiensis konkukian
atggaacagttaacattacaagttgaaggtatgtcttgtggacattgtgtaaatgctatcgaaagcagtgtgaaagagctaaacggtgttgaacaagtgaaagttcaattagcagaaggaactgttgaagttactatcgactcgtcagttgtaacattaaaagatatcgttgctgtaatcgaagatcaaggatacgatgttcaataa

SEQ ID NO: 1946 - DNA, 207 bp, Bacillus cereus ZK; identical to SEQ ID NO: 1945

SEQ ID NO: 1947 - DNA, 207 bp, Thermobifida fusca YX
atggccagtaccaccatcaccgtcaccggcatgacctgcgggcactgcgtgagctcggtgaaggaagaaatcagcgaactgcccggggtgaccgacgtgcgggtggacctggagagcgggcgggtcgaaatcgacagcacggccccgctcagcgacgagcagatccgcgccgcggtagcggaagcaggctacgaagtcgtcgcctga

SEQ ID NO: 1948 - DNA, 180 bp, Nitrosospira multiformis ATCC 25196
atgacctgcatgggctgtgtcaatagcgtgaagaatgtgctggaaaagatacctggcgtgagcaatgcaaatgtctctctggaacagcagcaggtgaccatcgagtatgatgcttccagggctcataccgatcaattcagagaggcgatcaaggatgcgggctttgaagtcgaaaactga

SEQ ID NO: 1949 - DNA, 2418 bp, Anaeromyxobacter dehalogenans 2CP-C
atgagcgaccgggtcgagaccaccgtccgcgggcgcgagcccgccgccgcgcgcgccgccgccgtcgaggcgagccccgaagaccgccgcgcgcgcgtcaccatcaacgtctcgggcatgacctgcgccgcgtgccaggcgcgcgtgcagaaggcgctctccggcgcgccgggcgtgctcgacgccagcgtcaacctcatgaccgccgaggcggccatctcctacgatccggcggtggccgcgcccgaggcgctgatcgagcgggtgcgctcgaccggctacggcgccgcgctgtccgagccgggcgccgacgcgctggagcagcaggacgcggcccgcgcgaaggagttccgcgagctgcgcgcccgcgccctggtggcgctcgccgccggcgtggtggcgatgatcgcgtcgatgccgctcatggcggcgcacgcgcaccacgggctcggcgcgcccaccgacccgttcatgagctggagcatgcgcgtgctcgacccggtgctggagcgcgcgctgccctggctctacgcgatcccggagcaggtgctctcctacgggctgctcgcgctcaccaccgcggtgatggcctgggccgggcggcacttctacacccgcgcctgggcggcgttccgccaccactcggccgacatgaacacgctcgtggcggtcggcaccggcgcggcgtacctgctctcgctcgccgccaccgtcgcgcccggcttcttcgtgtcgcgcggcgtcccgcccgacgtgtactacgaggcggtcgtcctcatcatcgcgctcatcctggtgggcaacaccatggaggcgcgcgcgaagcgccagacctcggtcgcgctccgcaagctcatgcagctccagccccgcaccgcgcgcgtggtgcgcggcggcgcggaggtggacgtgccggtggaggacgtgcgcgagggcgacgtggtggtggtgcgcccgggcgagcggctgccggtggacggcgagatcgtctccgggacgagcgcggtggacgagtcgatgctcaccggcgagccgctgccggtgcagaagcgcgccggcgatcgcgtcatcggcgcgaccgtcaacggcaccgggtcgttccgctaccgggccaccggcgtgggcgcggacacggtgctcgcgcacgtggtgaagctcatgcgcgaggcgcagggctcgcgcgcccccatccagaagctggccgaccgcatcagcggcatcttcgtgccggtggtgctctccctctccatcgccaccttcgtggtctggttcgtggccgccgacgccgcgcccgcggtgcgggcgctggtggccgcggtcgccgtgctggtcatcgcctgcccctgcgcgatgggcctcgcggtcccgaccgcggtcatggtcgccaccggcaagggggccgagctgggcgtgctgctgaagggcggcgaggcgctggagcgggcgcacgcggtggacacggtggtgctcgacaagaccggcacgctcacgctgggcaagccggcggtgaccgaggtgcggctcgcgcccggcgcgccggtggacgaggacgcgctggtgggcctggtcgcggcggtggagcgcgccagcgagcacccgctcgcggccgccatcgcggcgcacgcgacggcgcggggcgcggcggtgccgcaggtggaggcgttcgagtcgatcaccggccgcggcgcgcggggcctcgccggggggcggcgcgtggtggtgggcaacgcggcgctgctcgagtcggagggcgtctcgaccgcgccgctggaggccgaggcgggcgcgctcgccgcgaaggcacgcaccgcggtgttcgcggcggtggacgggaagctggccggcctgctcgccgtcgcggacgagctgcggccgacctcgcgggacgcggtggcgcggctgcgccgcatgggcctcgaggtcgtcatgctcaccggcgacgtgcgccgcagcgccgaggcggtggcgaaggccgcgggcgtggagcgggtggtggcgggcgtgctgccggagggcaaggtggccgaggtggagcggctgcaggcggagggccgcgtggtggccatggtgggcgacggcatcaacgacgcgccggcgctggcgcgggcggagatcggcatcgccatgggcagcggcaccgacgtggcgctcgaggccgccgacgtgacgctgatgcggccggacctgcgcgcggtggccgacgcgatcgcgctctcccggcgcaccatgcggaccatgcgccagaacctgttctgggcgttcgcgtacaacgtggtcgggatcccggtggccgcgggcgtgctgttcccggcgttcgggctgatgctctcgccggtgctggcgagcgcggcgatggcgttcagcagcgtgagcgtggtcacgaacagcctgcggctgcggcggttccgcggggcctga

SEQ ID NO: 1950 - DNA, 213 bp, Rubrobacter xylanophilus DSM 9941
atggagaagaggatcacgctgcgcgtgccggacatgagctgcggccactgcaaggccgccatcgagggcgagctcggcaggctgcccgtcgcggaggccagcgccgacccgcagaccaaggccgtcgaggtcgtctacgacgaggagcgggtggacgagcggcagatacgcgccgccatagaggaggccggctacaccgtcgaggccggatga

SEQ ID NO: 1951 - DNA, 201 bp, Alkalilimnicola ehrlichei MLHE-1
atgaaactgaaggtcgagggcatgagttgcgggcactgcgaaaaggcggtgcgtgaggcgctggcagcggtgcccggtgtggagggcgtggtccgggtctccgccgcagaaggtgaggcggagatcagcggccaggccgagccccgggcgttggtggctgcgttggacgagcagggcttcgacgcctgcgtggaggagtga

SEQ ID NO: 1952 - DNA, 2466 bp, Alkalilimnicola ehrlichei MLHE-1
atgagcaccgaaaccggtaacgcacggggattcgacctgggcgtgcagggtatgacctgcgcctcctgcgtggcccgcgtggagcgggtcctggggcgggtgccgggggtgcgctccgtgagcgtcaacctggccaccgagcgggcccgggtggaggcctcggaggggctggagctgggggcgctgctggatgctgtcggcaaggccggctttgaaccggtggtccaggatctggacctgaccgtggagggcatgacctgcgcctcctgtgttggccgggtggagcgggtgctggcgcgccaacccggggtgatttccgcctcggtcaacctcgccaccggcaaggcgcggttgcgcaccctgccgggggtggcggagccgcaggcgctgatccgggcggtggaaaaggccggctttggtgccgtgctggagaccgacgagacggagcccgggggcccatcgcccgcagagcgggaactgcaacagctgcgcatcgccaagcgggtcgccctgctcctcaccgttcccctggtgatgatcgccatggggccgatgatgatcccgccgctggccgaggtgatgcaccggcttctgccgccggcgggctggcgctgggtcgaggccgtgctcgccacgccggtgttgttctgggccggtgcgcgcttcttccgtcacggctggccggcgctgcgccggctcaatccggacatgaacagtctggtcatgctcggtgcctcctccgcctggctctactccatgttggtgctattggcgccggggctgtttccggaggccgcgcgcggcgtctacttcgaggcggtgggcgtcatcgtcaccctgatcctggtggggcgctacttcgagctgcgggtgcggggccgggcctccgacgccatccgtcagctcctggccctgcaggtgcgcgaggcccgcgtccgccgggagggtggtctggtcagtgtgccgctggaggcgctccagcccggcgatgtggtggtggtgcgccccggcgagcgcatcccggtcgacggcgaggtgctggacggcggcagttacgtggatgagtcgatggtcaccggggagccggtgccggtggaaaagggcgtcggtgcctcggtggtgggcgggaccgtgaacggctcgggcagcttcagcttccgcgccaccggcattggcgaggacagcgtgctggggcggatcgtgcacatggtcgaggaggcccaggcctccaagccaccgattcaggccctggtggaccggatcgccggggtcgtggtctggggcgccatcgccatcgccctggtggccgcgctgatctggttcgccgtcgggccggggccgcattacgctctggtcaccgctgccagcgtattgctcatcgcctgcccctgcgccatgggcctggccacccccatggccatcatggtcggttccgggcgcggggcccgccagggcatcctgttccggcgcggggccgccttccaggccatcgccggggtggataccgtggtggtcgacaagacgggtaccctcaccgagggccggcctgcgctcaccgaattcgaacgccatggcggttggtcccaggacgcgctggcgcccctggtggcggccctcgagtcccgtagtgaacacccggtggccgaggccatcgtgcgcggcctggacgacccgggcgagcgggtggtggagggcttcaccgcccacgccgggctcggggtcgagggccgggtggaggggcgccatctgcaggtgggggcggatcgctacatgagccgctcggggctggacctttcccccttcgccgaccgcgcccgggcgctggccgatcgcggtcgtacgccgttgtacgtggcggtcgacggggaattggtcgcgctgctggcggtggccgacccggtcaagagcggcagcccggaggcggtccgggcattgaaggccttgggcctgcgcgtggtcatgatcaccggtgacaaccggcgcaccgccgaggccgtggcgcgggagaccgggatcgaggaggtgatcgcggaggtcatgcccgaggacaaggcccgcgaggtgggagcgctacaggcggccggtcacagtgtcgtgttcgtcggcgacggcatcaacgacgcgccggccctcgcccgggccgatgtgggcatggccatcggcaccgggaccgatatcgccatcgaggccggcgaggtggtgcttatgtccggcgacctgcgaggggtcgccgccggcatccgtttggcacggcgcaccttccggaccatccgccagaacctgttctgggccttcttctacaatatcaccctgatgccggtggccgcggggttgctctaccccgccttcgggctgttgctctcgcccatgatggcggccgcggccatgagcctctccagcatcctggtggtgagcaacagcctgcgcctgcgccgtgcccggctcggtggcccactcgaggtctag

SEQ ID NO: 1953 - DNA, 231 bp, Arthrobacter FB24
atgagccccgtatccaccaccgtgaacgtgtccggcatgacctgcggacactgcgtgtcctccgtgagcgaagaactggaagcactggaaggcgtggaaacggtcgacgtcgacctcaacgccggcggcatctccaccgtcaccatcacatccgataaggccctttcccgttccgagatcggcgaagccgtagccgaggccggttacctggtggtggccaacgaggcctga

SEQ ID NO: 1954 - DNA, 204 bp, Acidothermus cellulolyticus 11B
atgacgaccaagacctacaccgtcgagggaatgtcctgccagcactgcgtcagcgctatcaccgccgaggtcggcaaggttccgggtgtcgccggcgtcacggtcgaccttgccggcaagacggtgacggtcaccggcgacgccttcgaggacgccgccattgcagcagccgtcgaggaggccggctacacacttgtcggctga

SEQ ID NO: 1955 - DNA, 243 bp, Mycobacterium vanbaalenii PYR-1
atgagcacgaccacaaccaccaagtcctacgccgtgaccggcatgacctgcagccactgcatcgccgcggtgagcgcagaactcggcgcactcaccggtgtcaccgacgttcatgtcgatctggttgccggaggcatctccaccgtgacggtttccagcgacacaccactgaccgtggcgcaggtcgccaccgcactcgacgaggccggcgactaccgcctatccaccgatcaacctcgctag

SEQ ID NO: 1956 - DNA, 2412 bp, Desulfotomaculum reducens MI-1
atggaaaatcaaacacaggtcacagagaaaaataatctagcaacatgtaccataccagttacgggtatgacctgtgcggcctgttctgcccgggtagaacgggggttgaaaaaactgcagggcgttgcaggagccaatgttaatctggcaatagagaaagccaccatctcctttgactctaaccaaacgaaggtagaagatataatcaccaagatacaaacccttggttatgacgtaccagttgaaacccttgagttggttatttctggtatgacctgcgccgcttgttcagccagggttgagaaaaggctgaatgctttacccggtgttcaggaagcagcggtaaatcttgctacaaataaagcaaccgtgaaatacatttctgggctcattcatgctacagaaatacgcaaaacagtggaaaaactcggctataaagcccagcgggccaatgacctatcccaggatcaagagggaaaggcacgtcaaaaagagattcgttatcagattcttaagtttgtccttgcaacagtgttatcccttcctctggcctggatgatggttaccgaagtgttaggttggcaccagtttatgattgatccgtggattcaattagcactagcgactccggttcagttttatgctggttggacattttatcggggtgcttattacgccttaaaatccggtggtgccaacatggatgtactggtagtgctgggcacgtcagttgcttatttttatagccttattgctgttttgcaaggatggaaaacgctatactttgaatctgcagccattgtgatcaccctaatcctattaggaaagatattggaagccatagccaagggcaagacttccgaagccattaaaaaattaatgggcctacagccaaagacagctcgggtggtgcgggatggagaggaagttgacacccctattgacgaggtggaagtgggagataccattctggtccgtccgggtgaaagaattcccgtggatggggtggttctcaatggattatccaatgtggacgaatccatgttaacgggtgaaagcataccagtagaaaaaggccccggcgatgaagtggtgggagcatcggtcaacaaacaaggcagttttacattccgagccaccaaggttggcaaagacactgcgttggctcagattattcgcatggtggaagtagcccagggttctaaagccccaattcagcggttggcagatcgggtttctggtatctttgtacctgtggttatagtcattgctgcactgacctttctgggctggtattccacaggagcaacaatcaccgaagcattgattcatatgaccactgtgctggtcatagcctgtccctgtgctctaggtctggcaactcctacggctattatggtgggaactggtgtgggtgctgaaaagggaattcttattaagggtggtgagtatctagaaagggcgggtcgacttgataccattgtattggataaaacagggaccataactaagggagaaccttctctaacaaatttattcgttttagcaccctttcaggaaaatgaagtattacaagcagttgcttctggagagaaaaaatccgaacatccccttggccaggctattattcaggaagctgatgaacgtaagttgcctttaatggaaacagccgaattcgaagcactgccgggtaaaggaattcgttttaaactagataataacctctggtatataggaaatgaagcattggcccattcacttcacattgatctgtctcctgtcagagcagaaaaggataaatgggaggaagatggcaagactgtcatgattgccgtggcaggggatgatttagcaggattggttgcggtggcggatgcggtcaaagaaaatgccagggaagccatagccgaactgaaggaaatggggctggaggtttatatgctaactggcgaccaaagacgtactgccttggccatagctaaacaggttggcattgatcatgtaattgcggaagtattacctgcacataaagccaaggaagtggaaaacctaaaaggtataggcaaggttgtggcgatggtgggagacggaattaatgatgcaccggcattggccactgcagatgtgggaatggccattggcaccggaaccgatgtggcaatagaaagtgcagccatcaccttgatgcggggggatttacgagccattgctgcgggcataaggctatcgcgacagacattgcgtaaaattcgacaaaatcttttttgggcttttatctataatgtaattggtatacccttagcagtattcggcttgcttaccccggtgatgggtggcgcagccatggcctttagttcagtatctgttgtaacaaactctctgttattaaaaagatataatccatcaatatga

SEQ ID NO: 1957 - DNA, 237 bp, Salinispora tropica CNB-440
atggtcaccaccacgtaccaggtgcgcggcatgacctgcgggcactgtgtgaatgcggtcagcgccgaggtgggtgggcttacgggtgtggagaaggtccaggttgacctggaagctggccgcctcacggtcaccagccagcacccgatggagatcgaggcggtgcgcgccgccgtcgacgaggccggctacgacctcgtcgacgccgcacccacgtcgagaccgaggcccgcatga

SEQ ID NO: 1958 - DNA, 222 bp, Kineococcus radiotolerans SRS30216
gtgcgttcgtcctacgcggtgattggcatgacgtgcgggcactgcgtcagcgcggtgcgctccgaactgagtacggtgccgggcgtgcgcgcggtcgacatcgacctcgtcgtcggtggcgctaccaccgtcactgtcacctcggatgccgcactggagcacgacaccgtcgccggcgccatcgacgaggccggctacgagctggctggtcagcgttcttga

SEQ ID NO: 1959 - DNA, 2391 bp, Bacillus cereus cytotoxis NVH 391-98
atggggaaaacaaaacaaataacaattggtattgatggaatgacatgttcagcttgttccgcgcggattgagaaagtattaaataagctagatggtgtggaagcgaatgtgaatgtagcaatggaacaagcgacggttcaatatgatgaagaggaacaaaatatagaagcaattacaaatcgtattaagaaattaggatatgaagttcgaacgaaaaaagtaaattttgatattgaaggtatgacatgtgctgcatgttcaaatcgaattgaaaaagtaatcggcaaaatggaaggaattgaaacagttaccgttaatttagctatgaacactgcaacgattgtctataaagatggtcttcttacaatagaagcgattctcgataaaataaagaaattaggctataaaggtaaactgcaagaagacgttggatcgacgaaaaaagaagagcaactaaaaaagaaaagaaaacaactgtttctttctattttattgtcacttccccttctttatacgatggtggcacatttgccgtttgaaacgggaataccaatgccgcattttttaatgaatccatgggtgcaattattatttgcaacaccggtacaattttatattggtgcacacttttatagcggtgcatatcgtgcattgcgaaataaaagtgcaaatatggatgtacttgttgtacttggtacatcggctgcatatttttatagcttatacgaagggatcaaaacaatacaggaaccatcttatttacctcagctttactttgaaacaagtgcggtgctaattacactaatacttgttggtaagtatttcgaggcgcttgcaaaaggaagaacaacagaggctatttcaaaattactaagtttacaagcgaaagatgccttggttattcgtgatggaaatgaaatattaattcctatagaaaatgttgtgattggcgattcaattatagtgaaaccaggtgagaaaatacctgtggatggtattgtattatcaggtatatcctcagttgatgaagcgatgattacaggtgaatctatcccggttgaaaaacaagttggtgatgctgtaataggagcgacaatcaataaaaatggtattctcacaatgcgtgctgaaaaaatagggaaggatactgcccttgcaagtattattaaaatcgttgaagaagctcaagggtcaaaagcaccaattcagcgcatggcagatatcatttctggcattttcgttccgatagtagttgcgattgcgatagttgcttttcttgtttggtattttgctattgctcctaatgatttaccacaatcattagaagtcgccatagctgtattagtaattgcttgtccttgtgcacttggtcttgctacgccaacatcaattatggtgggaactggaaaaggcgcagaggcaggtatactttttaaaggcggagaatatttagaagcgacacataaaattaatgctgtgttactagacaaaactggtactgttacaaagggaaaaccagaagttacagatgtattaagcttgcaagataatatgctcgcatttgccgcttcagcagaaaatgtttcagaacacccattagcggctgcaattgttgagtacgggaaacaacaaggaattacactcttacctgtagaggattttcgggcggcacctggacacggtattgaagctaggattgaagcacagtccattgtgattggaacgcgaaaattaatgaatgagcatggtgtgaatataggtcagtttgaagagcacatggccgctcaggaagctgatggtaaaactgttatgcttgtagcgattgaaaatcaattcgcaggaatgatttctgtagcagatacaattaaagaaagttcaaaagaagcgattcatgagatgaaatctgctggaatcgatgtatacatggtaacaggtgacaatcagcgaacagcagaagcaattgcaaaacaggtaggaattgaacatgtgtatgcggaagtgttacccgagaaaaaagcacgtattgtggaggaattacagcataacgggaaacaagtggcgatggttggtgatgggatgaatgatgctccagccttagcaaaagccgatattgggatggcgattggaacaggaacagatgtagcaatcgaagcagcagatgttactcttgtcggtgggaacttaaaacatatcccgcaagcaattgagctaagtacaaaaacaatgaaaaatattcgccaaaatttattctgggctctgttttataatgcaattggtataccaattgcggcaagcggtctgttagagccttgggtagctggtgcggcgatggcatttagctctgtgtctgttgtaacaaatgctcttcgtttgaaacgtgttaaaatataa

SEQ ID NO: 1960 - DNA, 210 bp, Salinispora arenicola CNS-205
atgatcaccgtcacgtaccaggtgcagggcatgacctgcgggcactgtgtgaactcggtcagcaccgaggtgggtgcgctcccgggtgtggagaacgtccaggtcgacctggacgctggccgggtcaccgtcaccagtcagcgcccgctggacatcacgtccgtgcgtaacgcggtcgacgaggccggctacgacctcgtcagcgcctga

SEQ ID NO: 1961 - DNA, 207 bp, Bacillus weihenstephanensis KBAB4
atggaacagttaacattaaaagttgagggtatgtcttgtgggcattgtgtaaattctattgaaagtaatgtgaaagaactaaacggcgttgaacaagtaaaagttcaattagcagaaggaactgttgaagttactatcgactcatcagttgtaacgttaaaagatatcgttgctgtaattgaagatcaaggctatgaaattcaataa

SEQ ID NO: 1962 - DNA, 2418 bp, Anaeromyxobacter sp. K
atgagcacccccgccgactccaccgtccgcgggcgcgagcccgccacctcccccggcgtcgcggtcgaggccacccccgccgaccgccgcgcgcgcgtcaccatcaacgtctcgggcatgacgtgcgccgcgtgccaggcgcgggtgcagaaggcgctctccggcgcgccgggcgtgctcgacgccagcgtcaacctcatgaccgcggaggcggccatctcctacgacccggcggtcgccgcgcccgaggcgctcatcgagcgggtgcgctccaccggctacggcgccgcgctgtccgagcccggcgccgacgcgctggagcagcaggacgccgcccgcgcgaaggagttccgcgagctgcgcgcccgagccctggtggcgctcgccgccggcgcggtggcgatggtcgcgtccatgccgctcatggcggcccacgcgcatcacggcctcggcgcgcccaccgatccgttcatgagctggagcatgcgcgtgctcgacccggtgctggagcgcgcgctgccctggctctacgcgatcccggagcaggtgctctcctacgggctgctcgcgctcaccaccgcggtcatggcgtgggccgggcggcacttctacacccgcgcctgggcggcgttccgccaccactccgccgacatgaacacgctcgtcgcggtcggcaccggcgccgcgtacctgctctcgctcgccgccaccgtcgcgcccggcttcttcgtgtcgcgcggcgtcccgcccgacgtgtactacgaggcggtcgtcctcatcatcgcgctcatcctggtcggcaacaccatggaggcgcgcgccaagcggcagacctcggtcgcgctccgcaagctcatgcagctccagccccgcaccgcgcgcgtggtgcgcggcggcgccgaggtggacgtgccggtggaggacgtgcgcgagggcgacgtggtggtggtgcgccccggcgagcggctgccggtggacggcgagctcgtggccggctcgagcgcggtggacgagtcgatgctcaccggcgagcccctgccggtcgagaagcgggtcggcgaccgcgtcatcggcgccacggtcaacggcaccggggcgttccgctaccgcgccaccggcgtgggcgcggacacggtgctcgcgcacgtggtgaagctcatgcgcgaggcgcagggctcccgcgcgcccatccagaagctggccgatcgcatcagcggcatcttcgtgccggtggtgctctcgatctccatcgccacgttcgtggtctggttcgtggccgccgacgcggcgcccgcggtgcgcgcgctggtcgccgcggtcgcggtgctggtgatcgcctgcccgtgcgcgatgggcctcgcggtcccgaccgcggtgatggtcgccaccggcaagggcgccgagctgggcgtgctgctcaagggcggcgaggcgctggagcgggcccacgcggtggacacggtggtgctcgacaagaccggcacgctcacccagggcaagccggcggtcaccgaggtccgcgtcgcgccgggggcgccggtggacgaggacgcgctggtcggcctggtggcggcggtggagcgcgccagcgagcacccgctcgccgcggccatcgcggcgcacgcgaccgcgcggggcgcggccgtgccgccggtggaggcgttcgagtcggtgaccgggcgcggcgcgcgcggcctcgccggcggccgtcgcgtggtggtcggcaacgcggcgctgctcgaggcggagggcgtctcgaccgcgcccctggaggccgacgccggcgcgctggccgcggagggccgcaccgcggtgttcgcggcggtggacgggcggctggcgggcctgctcgcggtggccgacgagctgcggccgacctcgcgcgaggcggtggcgcggctgcgccgcatgggcctcgaggtcgtcatgctcaccggcgacgtgcgccgcagcgccgaggcggtggcccgcgccgcgggcgtggagcgggtggtggccggcgtcctgccggagggcaaggtggccgaggtggagcggctgcaggcggagggccgcgtggtggccatggtgggcgacgggatcaacgacgcgccggcactggcgcgggcggagatcggcatcgccatgggcagcggcaccgacgtggcgctggaggccgccgacgtgacgctgatgcgcccggacctgcgcgcggtggccgacgcgatcgcgctctcccggcgcaccatgcggaccatgcgccagaacctgttctgggcgttcgcgtacaacgtggtcggcatcccggtggccgcgggcgtgctgttcccggcgttcggcctgatgctgtcgccggtgctggcgagcgcggcgatggcgttcagcagcgtgagcgtggtgacgaacagcctgcgcctgcggcggttcggcggggcctag

SEQ ID NO: 1963 - DNA, 207 bp, Bacillus cereus AH187
atggaacagttaacattacaagttgaaggtatgtcttgtggacattgtgtaaatgctatcgaaagcagtgtgaaagagctaaacggtgttgaacaagtgaaagttcaattagcagaaggaactgttgaagttactatcgactcgtctgctgtaacattaaaagatattgttgctgtaatcgaagatcaaggatacgatgttcaataa

SEQ ID NO: 1964 - DNA, 207 bp, Bacillus cereus B4264
atggaacagttaacattacaggttgaaggtatgtcttgtggacattgtgtaaatgctatcgaaagcagtgtgaaagagctaaacggtgttgaacaagtgaaggttcaattagcagaaggaactgttgaagttactatcgactcgtctgccgtaacattaaaagatatcgttgctgtaatcgaagaccaaggatacgatgttcaataa

SEQ ID NO: 1965 - DNA, 207 bp, Bacillus cereus G9842
atggaacagttaacattacaagttgaaggtatgtcttgtggacattgtgtaaatgctatcgaaagcagtgtgaaagagctaaacggtgttgaacaagtgaaggttcaattagcagaaggaactgttgaagttactatcgattcgtctgctgtaacattaaaagatatcgttgctgtaatcgaagatcaaggatacgatgttcaataa

SEQ ID NO: 1966 - DNA, 207 bp, Bacillus cereus AH820; identical to SEQ ID NO: 1943

SEQ ID NO: 1967 - DNA, 2397 bp, Bacillus cereus AH820; identical to SEQ ID NO: 1942

SEQ ID NO: 1968 - DNA, 240 bp, Arthrobacter chlorophenolicus A6
atgagcaccacctcccccaccaccacgaaagtcagcgtctccggcatgacctgcggccactgcgtttccgccgtcagtgaggagctcgaagccctcaccggagtggaagccgtggacgtggacctcaacgccggcggcatttccaccgtcaccatcacctcagcgggcaaattgtcaccctctgaaatcggcgaagccgtggctgaggccggttacctggttgtcgccaacgaagcgtag

SEQ ID NO: 1969 - DNA, 2418 bp, Anaeromyxobacter dehalogenans 2CP 1
atgagcacctccgccgactccaccgtccgcgggcgcgagcccgccacctcccccggcgtcgcggtcgaggcgagccccgccgatcgccgcgcgcgcgtcaccatcaacgtctcgggcatgacctgcgccgcgtgccaggcccgcgtgcagaaggcgctctccggcgcgccgggcgtgctcgacgccagcgtcaacctcatgaccgccgaggcggccatctcctacgacccggcggtggccgcgcccgaggcgctcatcgagcgggtgcgctccaccggctacggcgccgcgctgtccgagcccggcgccgacgcgctcgagcagcaggacgccgcccgcgcgaaggagttccgcgagctgcgcgcccgcgccctggtggcgctcgccgccggcgcggtggcgatggtcgcgtccatgccgctcatggcggcgcacgcgcaccacggcctcggcgcgcccaccgatccgttcatgcgctggagcatgcgggtgctcgacccggtgctggagcgcgcgctcccctggctctacgcgatcccggagcaggtgctctcgtacgggctgctcgcgctcaccaccgcggtgatggcgtgggccggccggcacttctacacccgcgcctgggcggcgttccgccaccactccgccgacatgaacacgctcgtcgcggtcggcaccggcgcggcgtacctgctctcgctggccgccaccgtcgcgccgggcttcttcacgtcgcgcggcgtcccgccggacgtgtactacgaggcggtcgtcctcatcatcgcgctcatcctggtgggcaacaccatggaggcgcgcgcaaagcggcagacctcggtcgcgctccggaagctcatgcagctccagccccgcgccgcgcgcgtggtgcgcggcggcgccgaggtggacgtgccggtggaggacgtgcgcgagggcgacgtggtggtggtgcgccccggcgagcggctgccggtggacggggagctcgtctccggcacgagcgcggtggacgagtcgatgctcaccggcgagccgctgccggtcgagaagcgcgccggcgaccgcgtcatcggcgcgaccgtgaacgggaccggctccttccgctaccgcgccaccggcgtgggcgcggacacggtgctcgcgcacgtggtgaagctcatgcgcgaggcgcagggctcgcgcgcgcccatccagaagctggccgaccgcatcagcggcatcttcgtgccggtggtgctctccatctccatcgccacgttcgtggtctggttcgtggccgccgacgccgcgcccgcggtgcgggcgctggtggccgcggtggcggtgctggtcatcgcctgcccgtgcgccatgggcctcgcggtcccgaccgcggtgatggtcgcgaccggcaagggcgccgagctgggcgtcctgctgaagggcggcgaggcgctggagcgggcgcacgcggtggacacggtggtgctcgacaagaccggcacgctcacgctgggcaagccggcggtgacggaggtgcggctcgcgcctggcgcgccggtggacgaggacgcgctggtgggcctcgtggcggcggtggagcgcgccagcgagcacccgctcgcggcggccatcgcggcgcacgcgacggcccggggcaccgccgtgccgcaggtggacgcgttcgagtccgtcaccgggcgcggggcccggggcctcgtcggcgggcggcgcgtggtggtgggcaacgcggcgctgctcgaggcggagggcgtctcgaccgcgccgctggaggccgaggcgggcgagctcgccgcgaaggcccgcaccgccgtgttcgcggcggtggacgggcggctggccgggctgctcgcggtcgcggacgagctgcggccgacctcgcgggacgcggtggcgcggctgcgccgcatgggcctcgaggtggtcatgctcaccggcgacgtgcgccgcagcgccgaggccgtggcccgggccgcgggcgtggagcgggtggtggcgggcgtgctgccggagggcaaggtggccgaggtggagcggctgcaggcggagggcagggtggtggccatggtgggcgacgggatcaacgacgcgccggcgctggcccgggccgagatcggcatcgccatgggcagcggcaccgacgtggcgctggaggccgccgacgtgacgctgatgcggccggacctgcgcgcggtggcggacgcgatcgcgctctcgcggcgcaccatgcggaccatgcgtcagaacctgttctgggcgttcgcgtacaacgtggtcgggatcccggtggccgcgggcgtgctgttcccggcgttcgggctgatgctctcgccggtgctggcgagcgcggcgatggcgttcagcagcgtgagcgtggtgacgaacagcctgcggctgaggcggttccgcggggcctga

SEQ ID NO: 1970 - DNA, 231 bp, Beutenbergia cavernae DSM 12333
atggggagaggatccgacatgtcgacgcagacctaccaggtgaccgggatgacgtgcggccactgcgagagcgccgtgcacggcgaggtcgccaccctccccggcgtcacgcgcgtggaggtgtcggcggtgaccggacggctcgtcgtcgtcgccgaggcgatcctggccgacgacgccgtcctcgccgccgtcgacgaggccggctactccgcggagcgtgcggaatga

SEQ ID NO: 1971 - DNA, 399 bp, Beutenbergia cavernae DSM 12333
atgcccaccaccctcaccacgctcgacgtcaccggcatgacctgtggtcactgcgtgtccgcggtcacgaacgagctggagacggtcgacggcgtgcagagcgtcacggtcgagctgcacgccggcggtacgtccgaggtcacggttctctcgcacgcaccgctcgcggaggacgcgctgcgcgccgcgatcgacgaggccgggtacgacgtcaccggcgtgcgcgcccacggcgaggccgaggagtgggccgaggaaggccacgcgcagcagaccgccgacgacgccgctgcgggcagcgcgggtgtgcccgcctcgggcggtgggtgcggctgcggctgcgggacggcgtccgacgccggcccgaacgtcgtcgagatcgggaagcgccccagctga

SEQ ID NO: 1972 - DNA, 2394 bp, Geobacillus WCH70
atgggtgagaaaaagcatgttacgttgcatattaccggcatgacgtgcgccgcatgctcgagccgcatcgagaaagtgctcaataaaatggacggagtcgaggcgaacgtcaatttagcaatggaaaaagcaacgatcgagtatgacccaacgaaacaaagcattcacgatattcaagaaaaaatcgaaaaacttgggtatggtgtggcgaccgaaaaggtgatgctggatattgaagggatgacatgcgctgcttgtgcggcgcgaattgaaaaaggtttgcggcgcatggaaggcgtggaaagtgctacggtcaacttagcaacaaacagcgcggtggtggagtataaggaaggcatcacatcggtcgaagcgatattagaaaaaataaaaaaacttggctataaaggacaagtgcggaaggaagaagagagcgcgggcttcaaagaagaacagttgaaacaaaaacagcggcagcttatgatttcgattattttatcgcttccgcttctatatacgatgattgcgcatcttccgtttgatcttggtctgccgatgcccgcttggctgatgaatccgtgggtgcagcttctgttagcgacacctgtccagttttatatcggcggtcctttctatgtcggcgcgtatcgcgcgctaaggaacaagagcgcgaacatggacgtccttgtcgcgctcggcacgtctgccgcttacttttacagcttggtggaagcggctaaaacgattggaagccctcactatatgccaaatttatattttgaaacaagtgcggtgcttatcacgcttgtgcttgtcggcaaatacttcgaagcgcgggcaaaagggcggacgaccgaagcgatttcaaagctcttaagtttgcaggcaaaagaagcgctcgtgcttcgcgacggaaaagaagtcaaagttccgctcgaacaagtggcagtcggtgacacgattatcgtcaaaccaggcgaaaaaataccggtagacggtatcgtgattgcgggagcgtccgctgtcgatgagtcgatgattacaggggaatcgattccggttgataaaaaagaaggcgaccgcgtcattggcgcaacgatcaacacgacaggcactcttacgattcgggcggaaaaggtcggaaaagacacagctttagcgaatatcgtgaaaatcgtcgaagaagctcaaggttcgaaagcgccgattcaacggatggccgatgttatctcgggaatttttgtgccgattgttgttggtattgctgtgttggcgtttattgtctggtacttttttgttgcaccgggcgatttgccaaaagcgttggaagtggcgattagcgtgcttgtcatcgcttgtccgtgcgctctcggtcttgctacgccgacatcgatcatggtcggcaccggaaaaggagcggaacacggcatcctctttaaagggggtgagtacttagaagaaacgcataaaatcaacgcggtgctattggataaaacaggaacggtgacaaaaggaaagccacaagtgacggatgtccttgaatttcaagaaggaatgcttaattttgcggtgtcggcggaaagcgcttcggaacatccgctcgcgcaggcgattttcgaatacggcaaacagcaacaaatcgctgtgaagccgcttgagcacttcgcggcgcttgcgggccacggtattgaagcgaaaatcgatggcaaacgtgttctcgttggaacgagaaaactaatgaaagaaaacaacatcgacatttctcgacatgaagaaaaaatgatacaattagaaatagaaggaaaaacagcgatgttcgtggccattgatggacagcttgccggcatcatcgccgtcgctgatacaatcaaagaaaacgcgaaagaagcgatccgtgcattaaaacaaatgggaattgacgtctacatggtcacaggcgacaatgaacggacggcaaaagcgattgccaaacaagcgggaatcgaccatgtatacgccgaagtgcttccggaggacaaagcaaacattgtcgaaacactgcagcgtgaaggcaaacgggtggccatggtcggcgatggcattaatgacgctccggcgttggcaaaagctgatatcggtatggcaatcggcacgggaacggatgtcgccatcgaaacggccgatgtcacattagttggcggcgatttatcgcatattccaaaagcgatcgagcttagccgtaaaacgatgacaaatattcggcaaaacttgttttgggcgctgttttacaatacgatcggcatcccggttgccgccgctggactgttggaaccttggatcgccggagcggcgatggcgtttagctccgtatcggtagtaacgaacgcacttcgcttgaagcgagtgaaactataa

SEQ ID NO: 1973 - DNA, 219 bp, Micrococcus luteus NCTC 2665
atgaccaccaccgacctgaagatcaccggcatgacctgcggccactgcgtcgcctccgtccgggaggagctcggcgagatcgccggcgtctccgccgtggacgtggacctgaacgccgggggcgtgtccaccgccaccgtcacctccgagggccccctcgaccccgccgccgcgcgcgccgccgtcgaggaggccggctacacgctggtggaggcctga

SEQ ID NO: 1974 - DNA, 2268 bp, Kytococcus sedentarius DSM 20547
atgagcacccccccggtcctggacaactcccccatcgagctcgacctgcagggcatgacctgcgcgtcgtgcgcgaaccgtatcgagcgcaagctgaacaaactcgacggggtcgaggccaccgtcaactacgccaccgagaaggcccgggtgcaggcccccgcggggtacgacccccagctcctcgtggacgaggtggcgaaggcggggtacacggccagcctcccggccccgccccgcgacgagaccggcacggccggggagacggacgcggccgggaacgccgacccggagctgcactccctgcgccagcgcgtgatcatctcggccgccctcacggtgccggtgatcgcgatggcgatggtccccgccctgcagttcacttactggcagtgggcctccctgaccctggccgcgcccgtcatcgtgtggggcgcctggcccttccacaaggcggcgtggaccaacctgcggcacggggcagccaccatggacacgctggtgtcgatggggacgctggccgccttcggctggtcgctctacgcgctcttcctgggcacggccggcacccccggcatgacccaccccttcgagttcaccgtcgccccgtccgacggcgccgccaacatctacctcgaggccgccgcgggggtgacgctgttcatcctgctcggtcgctatttcgagaagcgctccaagcgccaggccggggccgcgctgcgtgccctgctggagctgggcgccaaggaggtcaccgtcctgcgcgacggccgggaggtcaccgtccccgccggggagctgcaggtgggcgacgagttcgtcacccgacccggcgagaagatcgccaccgacggggaggtcgtctccggctcctcggccgtggacgccagcatgctcaccggcgagtccctgccggtcgaggtgggcccgggtgacaccgtcaccggcgccaccgtgaacgctggcgggcgcctggtggtccgcgccacccgcgtgggctccgacacccagctggcgcagatggcccgcctggtggaggacgcccagaccggcaaggccgaggtccagcgcctggccgaccgcatctccggggtgttcgtgccgatcgtcatcggcatcgccgtggccaccctgggggcctggctgggcgccggcttcccggcgaccgcggccttcaccgccgcggtggcggtgctcgtcatcgcctgcccctgtgcactcggcctggccacccccaccgcgctgctggtgggcaccggccggggcgcccagatgggggtgctcatcaagggcccggaggtgctcgagtccacccgcaccgtcgacaccgtggtgctggacaagaccggcacggtcaccaccggcgagatgaccctggccgatgcggtgagcgccgagggcagcgaccgcgaggacgtgctgcgcgcggcgggggccctggagagctcctcggagcaccccatcgcgcgggcgatcgttgccggcgcccgggccgagctgggcgacctgcccacccccaccgacttctcgaacctcgagggccgcggtgtccgcggcacggtggacggccaccgggtcctcgtggggcgccccgccctcctggccgacgagggcatgccgctgggcgcgcacctccaggaggccctggaggccgcccagcagcagggccgcaccgccgtggcggtcggctgggacggtgccgcgcggggcgtgctggtggtctccgacaccgtcaagaccaccagtgccgaggccatcgaccggctccgtgggctcgggctgacgccggtgctgctgaccggcgacaacgaggccgccgcccggcacatcgccgccgaggtgggcatcgaggaggtcatcgcggaggtcctgccgcaggacaaggtggacgtcgtccgccgcctgcaggagcagggcaaggtggtggccatggtcggcgacggcgtgaacgacgcccccgcgctggcccaggcggacctggggctggccatgggcaccgggacggacgtcgccatcgaggcctcggacatcaccctggtgcggggcgacctgcgcagcgccgtggacgccatccgcctctcccggcggaccctctcgaccatcaagaccaacctgttctgggccttcgcctacaacgtggccgccatcccggtggccgccctgggcatgctcaacccgatgctggccggcttcgccatggccttctccagcgtcttcgtggtgggcaacagcctgcgactgcgtggcttccgctcggtctcggcctga

SEQ ID NO: 1975 - DNA, 2580 bp, Eggerthella lenta DSM 2243
gtgaagcaaacgttcgatgtcaccggcatgacgtgcgcggcgtgctccgcgcgcgtggagaaggcgacgcgggccgtgcccggcgtggccgacgttgccgtgaacctgctgaagaacagcatggacgtcgccttcgacgacggcgcggaaccgtcggccgtgacggtcgccgtcgaggccgcggtcgacaaggcgggctacggcgccgccgcgcgcgtcccggcaggcgcgagcggcggccggcagggcgcggggagccgtgcggcccaggcgcgccccgtggccgacgcggccgccgaggccaagcatgttcgcatgcgcctcatcgtgtcggccgtgttcacgatccccttgttctacctgtcgatgggacacatgttcggctggccgctgcccgggttcttcctgggggacgagaacgtgctcacgttcgcgttcacgcagttcctgctgttgctgcccgtcgtgttcgtcaacttcaagttcttccgcgtgggcttcaagacgctgttccacggcgcgccgaacatggactcgctcatcgcgctcggctcgacggcggccacggtgtacggcatctacgccatctacaagatcggcatcgcgctgggcgcgggcgacctgcacgccgcgcacctggcggccatggacctgtacttcgagtcggcggccatgatcctcacgctcatcacgctgggcaagtacttcgaggcgcgcgcgaagggcaagaccaccggcgccatcgccaagctcgtggacctcgcgccgaaggaggccacgcggcttgtggacggccgcgaggagcgcgtcgcggtggaggcggtgcgcgcgggcgacgtgctggcggtgcgcgcgggcgagggcgtccccgtggacggcaccctgctcgagggctcggggacggtggacgagtcggtgatcacgggcgagagcgtgcccgtggacaagcgccccggcgatgcggtgaccggcgccaccgtgaaccgcaccggatggttcaccatgcgcgccgaccgcgtgggcgacgacaccacgctggccggcatcatccggctcgtggacgaggccacatcgacgaaggcgcccatcgagaagatcgccgacaagatatcgggcgtgttcgtgcccgtggtcatcgtcgtcgccgtcgtcacgttcgccgtgtggatgctcggtggctcgacgctcgagacggccatgtcgcacgccatcagcgtgctcgtcatctcgtgcccgtgcgcgctcggcctggcaacgcccacggccatcatggtgggcaccgggcgtggggcgaccaacggcatcctcatcaagtcggccgaggcgctggaaaccgcccacgacgtgaagaccgtcgtgttcgacaagacgggcacggtgaccgagggcgcgccgagcgtcaccgacgtggtcccggccccgggcgtgggcgaggagcgcctgctggagctggcggtgtccatcgaaggccgctccgagcacccgctcgcccgcgccgtgtgcgactacgcgcgcagccgtcatgcctacccgctgctcgtggaggacttcaagcaggtgcccggcgaaggggtggcggcgctcgtcgacgaccgcccgtcatgcgccggcaacctgcgcatgatggaggcccgcaacgtcgcggtgggcgcgttcgccgaggaggcgcagcggcaggccgacatgggcaagacgccgctcttcttcgcgcaggacggcgagctcctgggcgtgatcgccgtggccgacacggtgaagccctcgagcgccgccgccctggccacgctttcggccatgggcatccgcacggtgatgctgaccggcgacaacgagcgcaccgccgccgccatccaacgcgaggtgggcgccgacgaggtcatcgccggcgtgctgcctgacggcaaggaacgcgagatccgccgcctgtccgagcagggccgcgtggccatggtgggcgacggcatcaacgatgccccggcgctcgcgcgcgccgacgtcggcatcgccatcggggccggcaccgacgtggccatcgagagcgccgacatcgtgctcatgaaaagcgacctgctcgacgtgcccgcctccatccagctgtcgcgcgcgacgctgcgcaacatcaagcagaacctgttctgggcgctcgtctacaacgcggtgtgcatccccgtggccgccggcgccctgtcgttcatgggcctgaacctcaaccccatgatcgccgcggccgccatgagcctgagctcggtgtgcgtcgtgtcgaacgccctgcggctgcgcggctggaagcccaacctcccctcggcagcgatggacgcgcccgcgtccgcgcccatcgatagcaccgtacccagcgaacccaacgaaaaggagactgtcatggagaagaccctgaacgtcgaaggcatgatgtgccagcactgcgtcgcccacgtgaagaaggccctcgaaggcgtggagggcgtcgaggaggccgtcgtcgaccttgacgccggcaccgccaccgcgaagctggcccgggacgtaccggaggagacgctggccgccgccgtggtggaggcgggctacgaggtgaagtag

SEQ ID NO: 1976 - DNA, 225 bp, Chloroflexus aggregans DSM 9485
atggtaacagagcagtttcgcgtgccgggggtatcgtgccagcactgtgttcacgcagtgcgcaaagaggtgggagcgttgaacggcgtagtgcaggttgatgttgatttggataacaaaattgtgacggtcgtccacagtgatgatgtggagatcaccgatattgttatggcgatcaaagaagccggttacgatgacgtgacgccgttaggcattgcgtgttag

SEQ ID NO: 1977 - DNA, 2778 bp, Cryptobacterium curtum DSM 15641
atgaagaagacattcgatgtcactggtatgacatgtgccgcctgttcggcgcgggtgacaaaagctacacaagcagtgcccggtgtagatgaagcggtcgtgaacctgctgaaaaacagtatggaagtaacctacgatggcaacgatgcaacacttgctgccgtcagcgcagcggtggaaaaagcagggtacggtgccacggtgcgcggtcaggcttcgtccgaagcggcaccatcccgcggaagcgcttctgacgcagcgcaaaaagaagctcgtcacgtgcgcatgcgcttgatcgtctctattttatttacggtgccgctcttctatctttcaatgggacatatgtttagctggccaattcctgcagcactcgctggccatgaaggcatgatgtcattagcgctgaccgagcttttgttaactattccggtggtgtttgttaacttcaaattcttccgtgtgggctttaaaactcttatacatcgtgcgccaaatatggattcgcttattgcgcttggttcgacggcatcaattatttacggtattgcagcgatgtatcgcatgagcgcggcactgggcgtgggtgatgtgcaggctgcgcatacggcgggcatggatttatattttgaatcagccgtgatgattctcacgctgatcacgctcggtaagttttttgaggcgcgagcaaaaggtcgtaccaccgacgcgattaacgggttacttgacttggcaccggcaacggctcttcgtgtgcgcgatggccaagaagaggaaattctgattgagcaggttgttgtaggcgacatactggcagtacgtgctggtgcggctgttccctgtgatggcgtggtggtggaaggcactgctgcggtcgatgaatcggttatcacaggggaaagcttgcccgtagaaaaggaagcaggcgataccgtaactggcgcgacggtgaatcgcagtggctggttcaccatgcgcgcaacggcagttggtgccgatacggcgctggcgcacatcgtaaagcttgtggatgaagcaacaagtaccaaagcccctatcgaacgtaaagctgaccagattgcaggtatattcgtgccggctgttatcggtgtggccatcgtggtatttgctatctggctagtgattggtgatttttctgcagccgtatcgcatgctatctcggtgctcgtcatctcgtgcccatgtgctttgggtcttgctacaccaacagccattatggtgggtacgggtcgtggtgcacagcagggagtgctcatcaagagtgccgaagcgctggaaaatgcgcacgacacacgtattgtcgtgcttgataagaccggtaccatcaccgaaggtgcaccgcgtgtgactgatgctcttgtgtacgaacatgatggctggactgccgtagaaacaaaccaactgactgccgaccaaacgcgcgtagtgcaggctgccctttcgcttgaggagcgcagcgaacatccgctggcacgtgcctttgttgactatgccactgaaaggggtgtcgaagcgcagccagtggaagactttacaacggtggcaggtcgtggcgtaaagggtatagttgacggctctttctgcgttgccggtaacgaacgcctgttgcgtgaaactggcgtaacggtcgatgcatttgccactgaaacaaagcgccttgccgaagaaggtaaaacgccgctgattgtggctcgcgacggtaaagctgaactgatagttgcttgtgccgatgtggttaagccgacaagcaagcacgccatcgaacgcctgcgtgctatgggcgttaaaacggtcatgcttaccggtgatgatgcgcgtactgccgcggtgatacaacgcgaagtcggcaccgatgaggccattgccagtgtgctgcccgaaggcaaggaagaacgcgttcgtgcgttctgcgctgaaggtaagacggctatggtgggggatggcatcaatgatgcccctgctcttgcccgtgctgatgttggtattgctattggggcggggactgatgttgccatcgacgccgctgatatcgtgctgatgcgcagcgatcttgaagatgtggcaacgtcgctggaactttctcgtgcgacaatgcgcaatattaagcagaacctattctgggcacttatctacaatgcaatctgtattcccatagcagcaggtgcgctgtctgcgtggggcattgcgcttaaccctatgatcgcagctgcgtgtatgagcttctcgagtatctgcgtggtaacaaacgctctgcgcctgcgcgggtggaagccatcgcttgaggctgcctcagtttcagtggacgctggtcaattgagcgccggacaacggaacagcgaccagttgggtgatgacattaaggtaaacagcaacatcaaactggagggcgataaccgatcgaagaataacagtcagccagatgacgataagtcaaaaagcactggtcagtctggtgatagcacatcagatagcgtgagccaatcgaatggtgaaggacagacaactcaaaacaatcctgaaaacgaagtagatagaaaggaaccaactatgaagaagacccttgcagtagacggcatgatgtgcgagcactgtgttgctcatgtaacgaaagcgcttgaaggcattgaaggagtcagttcggtaaaggtaagccttgccgacaaaaatgcagtggttgatcttgctcaagaggtacccgatgccgcacttgttgatgcggttgttgacgcgggatacgaagcttcggtggttgcgtag

SEQ ID NO: 1978 - DNA, 207 bp, Saccharomonospora viridis DSM 43017
atggttcagcagacctacaccgtgaccggcatgacctgcgagcactgcgctcgttcggtgcgcgaggaggtcggtgagatcaccggcgtcaccgacgtggccgtggacgtgcccacggggaaggtcaccatcaccagtgacacggagatcgcggtcgacgacgtacgtaacgcggtggaagaggccggttacacgttgcacgcctga

SEQ ID NO: 1979 - DNA, 2520 bp, Anaerococcus prevotii DSM 20548
atgaaagaacgattcgatattagcggaatgacttgtgcttcttgtcaggctaatgtccaaaaagcggttcaaaaattaggagttaatgatgttaatgtcaatctcattagtgaatctatgattgttgattacgattctgataagattaataatgacgatattataaaggcagtagagaaaattggttatggagcaagtcttaaagataaagacagatcaaacgatgtaacactaaaggaaagcgaagaaatgtctacaataagtagattgaaaatttctttcttgtttttgatcccactgatgtatatatcaatggggccaatgattaatcttcctatacctggttttctagaaggtcgaactggagcagtaaataatgcttttgttcaatttttgctagccttacctgtaatttttgtaaatcgcaaattttttgtatcaggcttcaagggactagttaataaagcgcctaacatggatacgcttgttgccctaggagcaagtgctgctactatatttggtatatttgccataatgagaatgtcttatgctttaggaataaacgacaaccaagttttagatcattataggcacaatatctatttcgaatcaagtgcaactatcctaactttgattactttaggtaaatattttgaagcaaggagtaagggtgagaccaaatcatctctgaaacatcttatggaacttgccccaaaaacagctagggtgattaaagatggtaaggaatttgaagtatccatcgaggatattaaaataggtgatactataattgtaagaccaggagaggcaattccagttgatggggttgtgacaaagggctcttccctagttgatcaatctgctattactggcgaaagcattccagtaaataaaaatcctggcgacgaagtaatatctgcaagtataaacaagcaaggctcttttcaatttagggccaaaagagttggtgaaaatacaaccatttcacaaattataagtcttgttaatgaagcaaatgaaactaaagctccaattgcaagattggctgataagatagcagcaatttttgttccagtggtaatagttattgcaattttaacttttgctatatgggcttatattacaaaagattttgaattcgcattaaatcttatgattgctgttcttgtaatctcttgtccatgtgccttgggtcttgctactccaatggctataatggtcgcaacaggcaagtcggcagagttaggacttctgtttaaaaatgctgaaagcctcgagaaccttcataaaattgattccatccttctagataagactggaactattacagaaggtaagcctgtagtaactgatgtctacacgaaaatggatgaagcagaatttatttctattgcaagaagcatcgaggaagcttccgaacatcctttgagtaattcgatagtagaatatgctaatgatgaaaacataagtcctagagaaatcacagattttcattctataacaggaatgggacttgaagcaaaaatagatggaaaaatttattatgccggaaatattagacttatgaatgaaaaaaatatttctgtagaaggctttgaagataagtctatagcctattccgaagaaggaaaaacatccatgtatttcgccaatgaaaataaggtcttaggcctaatagcagttcaagacttagcaaaggatagttctattaaggcaatagaaaaattaaaagcaatgggctaccatataataatgctaactggagataatgagaaaacagccgaagccattagaaaaaaactggatatagatgaaaaatatgcagaggtccttccacaagataaggataaagttgtaagaaaacttcaagaatcgggtaaaaaggtagcgatggtcggagacggtataaacgatgcacctgctctagcaagatctgatatcggtatagctatcggtagtggaactgacatagcgatagactcagctgatgtagtactgattaagaattccctattggatatagtaaattcgataagattatctagtaagactataaagataataaaggaaaatctcttttgggcgtttttctataatattatccttataccagttgcagcaggcatcctctaccctagatatggtgtaaccttaaacccaatgtttgcggccttggcaatgagtatttcctcagtctttgtatgccttaactcactaagacttaggaactttaagcctgaagaagaaagtgaagaaagtaaagaagaaaataaattaataaaggagaataaaatgagtgaattaaataaaatgattgtaaaagttgatggaatgagctgtcaaaattgtgcaaaacacgttacagaagccctagaagctgttgcaggaataaaacaagttaatgttgatcttgaaaataaagaagctaatgttgagtttttcggatcagtagatgaaaatgaaatctcaaaggcaattagcgaagctggctacgaatacaagggtatcgaatacaaataa

SEQ ID NO: 1980 - DNA, 354 bp, Jonesia denitrificans DSM 20603
atgtcaactgtgacaactttgatggtccctggcatgacctgcgcccactgcgtgtcgtcggtcacccgcgaactcgatgccgtctccggagtcgagaacgtctctattgaactgcgcaaagacgcagagtccgaagtcaccgtcttttcagacaacccactggacgaggcagcacttcgcgaagcagtcgacgaagccgggtacgaggtcgcatccatcgccgtggacacccaagctctcgccaccgaatcaggtgaacaaggcgacaaagcaaacgccaatgaagaccttggcttaaccgccaagggtgcctccggtggcggttgtggctgcggcaactgcaactgccagtaa

SEQ ID NO: 1981 - DNA, 2718 bp, Slackia heliotrinireducens DSM 20476
atgaagcagacattcgatgtgacaggcatgtcgtgcgcggcgtgctcgtcgcgggtcgacaaatgcacgcgcggcgtcgaaggcgtcgcggacgtggcggtgaacctgctcaagaacagcatggaggtcgaatacgaccccgaggcaacccctgagcagattgcccggatcaatgaggaaatttccgccaccgtggacaaggcgggttacggcgccacgccccgcgccgtgcaggccgcggcaggcggtacggcaaacggcaagtccacagcacagctcgcccacgaggcggcaaccaagaacgccgtcgccaacgagaagcacatgcgcatgcgtctgattctgtccatcgtgttctgtgtgcccctgttctacctggccatgggccacatgatgggttggccgctgccgagcgtcttcctcgggcacgagcacatgatggtcaccgccctggccgaactcgtgctggtggcgccgattatcttcatcgatttcaaattcttcagcaacggcttcaaaagcctgttccacggcgcgccgaacatggactcgctcattgcgctcggcgccacggcgtccaccgcatatagcatcgcgaacatgttcatcatggccaacgccatggggcagggcgacttggaatcggcgcacgaggcgttcatggggttgtacttcgattctgcgggtatgatcttgactctgatcacgctgggcaagtacttcgaagcccgcgccaagggccgcaccaccgacgccatctccaagcttatggacctggcgcccaaaaccgccaacgtgttgcgtgacggcgtcgaaaccgaagtgcccgtcgaacaggtgcgcgtcggcgacgtgctggtggtccgcgcgggtgagggtgtgccgctggacggcgtggtgcttgaaggcagcgcatcggtggacgaatcggccatcacgggcgaaagcgtgccggtggacaagcacgtcggcgaccctgtgaccggtgccaccatcaacaagtccggttacttcaccatggaagtccagcgcgtcggcgacgacacggtgctggcgggcatcatcgcgctggtcgacgaagccaccagctccaaggcgcccattcagaacatggccgacaagatcgccggcatcttcgtgcccgcggtcatcgggttcgccatcctcgtcttcgtgttgtggatgctgctggcggcccccttcgaaaccgcgctcacccatgccatctgcgtgctggtcatctcctgcccctgcgcattgggcctggccacgcccacggccatcatggtgggtacgggccgcggcgcttccaacggcattctcatcaagtccgccgactccctcgaaaccgccggccgcatcaagaccgtcgtgttcgacaagaccggaaccatcacccaaggcaaaccgggcgtggtggacgtggcccctgcaaatggcgtggccgcttccgacctggtggctttggccagcgccgtggagtccaagtccgaacaccccgtggcccaggccattgtggaatacgccgaatctcaaggcatccagcctgttcaggacactgtttccgacttcacccaggtgcctggcgaaggcgtgcgcgcccttgtgggcggacgcacctgcctggccggcaacgcccgcatgatggcttccaaccaggtggcgctggacaatgccgaagacgccgccgaacgttatgccgacgagggcgcgacacctctgtttttcgcgctggacggcaaactgcagggcatcatagccgcagccgacgccatcaaacccaccagtgctcgagctattcgcgaactgcacgccatgggcatcgacacagtcatgctcacgggcgacaacgagcgcacggctcacgccatccagaagcaggcgggcctcggcaaggtcatcgccggcgtgctgcctcaggataaggagcgcgaggttgcgcggctgtcccaggagggcggcgtgggcatggtgggcgacggcatcaacgacgcgccggctttggcccgcgccgacgtgggcatcgccatcggcgccggcaccgacatcgccatcgaaagcgccgatctggtgcttatgcgttccgacctgatggacgtgcccgcggccatccagctgtctcgccgtacgctgcgcaccatcaagcagaacctgttctgggcgcttatctacaacgtcatctgcatccccattgcggcgggcctgttctcgtgggcggggttgaccctcgatccgatgatcggcgcggccgccatgagcttcagctcggtgtgcgtggttaccaacgcgctgcgtttgcgcacgtggaagccgaaattcgtcacgcctgaggagccttctgcccaggtgacttcggtccaggcgccgaaggcgtcgcccgcgctcgaatcggccgcgcccgcgcccgcgccccagcctgcggcggcccctgcacctgcggcgaagcccgaacttcccaccgagcccgaggacctttccgcacctgacggaactgtcgccgtgaaaaccctcgccgtgaaggagatgatgtgcggccactgcgtgcgatgggtcacgcaggcgctgcaggatgtagaaggcgtgctgcgtgcagacgtcagcctgagcagggagaacgccgtggtgtacttgaaccgcgacgtgcctgatgacgtgctgaccgcagccaccgacgaacagggttatcccgcgcaggtcatagaaacgcaagccaattaa

SEQ ID NO: 1982 - DNA, 2604 bp, Atopobium parvulum DSM 20469
atgaatcagaaagtttttgatgtacaaggaatgacgtgtgcaagttgttctgcgcacgtagagaaagcagctaactctgtttctggcgtctctgaggctcgtgttaatttgcttaagaactcgatggaagttgattacgacggtaacccagacacccttaagcagatttctgacgcagtaagtaaagcaggctatgaggcaacgcctcgtagtgacaaaaaggattctgctgcagctattaaggcagatgctaccgatgcttcagaaagggcagtaaagcaaaagagggttgagctcatttcctcaatggcctttgcaattccactgttctatcttgccatgggtgagatgatgggagcacctgttccacctgctgtttctggtatgaatggcatgatgaacttggctcttacagagcttttgctctgcattcctattctgtttatttgtcgtcactattttattggcggattccgctcattgttgcacggtgcacctaatatggactcacttattgcgctgggctcagcggcgtcgtttgcctacagcgttgtcagcctgtatcagatggcaaacgcttttgttgcaggagacgtgactgcagctcaccatgcaatgcacggtatgtactttgagtccgctggtttgattcttgctctgattaccctgggcaagttctttgaggctcgcgcaaaaggtcatactactggtgcaattaatgcgctcatgaatcttgctccaaagacggctattctcgtcaaagacggtgttgagcaggaagttcctgcagagacagttgtggtgggagatatgcttgttgtaagggcgggacagtcaattcctgttgatggccaagtcattgagggagaaggatctgtcgatgagtccgctattaccggagagccagttcctgtaagtaagactgttggtgacttcgtgacaggcgctacggtgtctactggtggctggtttaagatgcgcgccactgccgttggtgatgatacaacgcttgcaggtattattcgcttggttgatgaggcaacaagttccaaagcacctatcgagcgtcttgctgacagcatcgccggagtctttgtccctgttgtcattggaattgcactggtgacgtttgtagcatggtttggctttgtggcaccgggtgactttgcagttgccctgtcgcacgccgtttctgttttggtcatctcttgcccttgtgcacttggccttgcaactcctaccgctattatggtgggcactggtctgggggcttcaaatggcattttagtgaagtccgctgaggcacttgagggagcggtacgagcaaccgtggttgttcttgataagacgggaacgcttactgagggcaagccaagtgtaactgacgtactttgtgcaggtagcgtttctaaggatcagctgcttgagtatgcatacgcgcttgagcaaaagagcgagcacccacttgcacaggcaattgttacgtatgctcaagagaagcttgggaagtctgaagctggctcacttgatgtccaagagttctcacaggttgctggcggtggtctcacggcaaaggttggcgagaaacaccttgtagcaggtaatgctcgccttatggagcaggaggacatcaacacacaagagctgatttcccaagctcagcagctggctgagcaggcaaagacaccactgtactttgcacttgagggtaagcttcttggcgtcattgctgtggctgataaggtaaagcagaccagtgcgtccaccattgatcgtcttcgcgctatgggcgttaagtctgtcatgctcaccggcgatcaggcaacaacagcaaacgtcattggtaaagaacttggcgttgaccaggtcatctctgatgtgttaccaagtcaaaaagagtcctacatcaggcaattccaggatgctggagaaaatgttgttatggttggcgatggcatcaatgatgccccagcacttgcgcgagcaaatgtaggaattgcaattggtgcaggtactgatgttgctattgaatccgctgacattgtcttgatgaagtctgatccagctgatgtcgcaacctcaattgagctctctcgtgccacaatgactaacattaaagagaatctgttctgggcactgttctataacaccatttgtatccctgttgctatgggtctgttgtatccatttggtatttcgctgaaccctatgattggtgcagccgccatgggcttctcgtcagtctttgttgtatgcaatgcgctgcgtttgcgtacctggaagccaaagaacgccagctcagtaactcaccaagacgctcatgacacaaaagcagtcattgacgttcaatctaagtccacaaacgacacatccgtgtcacagaaggaggaatcttatatgaagaagaaactaaacgtagagggtatgtcctgccagcactgtgttgcacatgtcacccatgcccttgaggctgtcgagggtgtctctaaggcaactgtttcacttgacgagaagagcgcagtagttgagctgtcttctgatgtccctgatagtgcattggttgacgctgttgttcaggcaggatacgaggctactattgcctaa

SEQ ID NO: 1983 - DNA, 2454 bp, Desulfotomaculum acetoxidans DSM 771
atgattggtgaaaactctatgagagcgcaaagtttgcctgctgaaaaccttgtattcaagatttccggcatgtcctgtgcagcctgtgctcgcaggattgaaaaagctttgtcaggtatagaagggattgctgaggcgggagtgaacttggctgcagagacagcttcggtaaaatacgacccaaattcggttactgttgaacaaatgatggatagaataaaaaaattgggttttgaagtagtcacagaaaaaattgatataaacatctcaggtatgagttgtgcggcctgtgccggtagaatagagggaaaactaaacaagacaggcggtgttataaaagccacggttaacctggctactgaaaaagcttttatagagtataacgctgcccaggttaatttagctgatattaaacaagtaatcaataatctaggttttaaagtcgtccatgaggatagcggtcttcctgtagatactgaaaagaacaggcgccaatcggaaataaacagacagaaaaagttatttgctttttctgctgtgttatcatttccactgtttttgtttatgctggctatggtgactaaatcgcatcactttttcccggctattatcatgaatccttattttcagtttgctttggctacaccggtacagttcgggccaggttactttttttacagggatgcttatctaaccttaaagagtaagggagccaatatgtctgtactggtagcacttggtacctctgccgcttatttttacagtgtggctgttacctttttcggcagccgtctgggacttaatgaggtctattatgaagcgggtgctctggtaattactctggtattgctcggtaaaatgcttgaatccatagccaaaggtaagacctcggaggctatcaagaaattaatgggcctgcagcctaagacggcccggattattaaaaacggccaagaagtcgaaattcaggtcgatgaagttagagtaggtgatctggtggtagttcgtcccggtgaaaaaattccggttgacggaattgttcgggaggggatctccagtatagacgaatcgatgctcaccggtgagagtatgcctgttgataaaaaaaccggtgaccaggtggttgcagctactataaataaactgggcacctttaaatttgaagcgatcaaggttggcagagacactgctctggctcaaataattaaaattgtcgaatcagcacagggttccaaagctcctatacagagaatggccgacattatttccggttatttcgttccggcggtggttgctatggctctgttaacttttgcctcttggtatttaattgggacacccggtgattttaccagggcgctggttaactttacagccgtattggtaatagcctgtccctgcgcgcttggcctggcaactcccacatcaatcatggtgggtacaggaaaaggggcggaaaacggtattttaattagaggcggcgaacatttagaacgtgtgcataagctaaatacgctggttttggacaagaccggcactataactaaaggcaaaccggaattgactgatataatttccttgtatgaataccagggtcaagaaaataccttgcttaccatggcagccggtgctgaaaagggttcggaacaccctctggcccgtgcggtaatcaatgctgcgttagagagaaaccttgccattaaggaacctgaaatttttcaagccgttccggggcatggtgtagaggctcatatagaaggtcaaaaggtgcttctgggaactaaaaaactaatgttggagcacggagtaaatgttaataaaattaccagtgatatagaacgactggagagtcaaggtaaaactgtcgttattctgagcatagatgagcaaccggctggtctgctggctattgctgatactgtaaaagaagaatcacaggctgctattgcagcactgcaggctatgggcttggaagtttggatgattaccggggataaccagcgaacagctcatactattggtcaacaagtaggaataagtaatattctggctgaggttttgccggaggagaaagccagcgaaattaaaaaactccagtctcagggcaggattgtcggcatggtgggtgacggtattaacgatgctccggcgctggttgtggccgatgttggctttgctataggtacaggcacggatgtagctatggaggcagctgatataaccttgatgagaggggacttgtggggcctggttaacagtataaaattaagccgggcaaccattattaatatcaaacaaaacctgttctgggcgctcatatataatactataggcatacccgtggcagcattgggatttttaaaccctgtgcttgccggtgcagctatggccttcagttctgtatcagtggtttccaacgctctgcgtctaaagaatttcaagtttaaccattag

SEQ ID NO: 1984 - DNA, 2385 bp, Alicyclobacillus acidocaldarius DSM 446
atgagcgaggccaaagagatcatgctgcccatcgaaggtatgacgtgcgccgcctgcgcagctcgaattgagaagaacgtcgcgaaactgcccggtgtgaaggaagtgaacgtgaatctcgcttcagagcgagcccgtgtggtgctcgattccgacacaccgtggagcgaggtggtctccaaaatcgaaaagaccggctattcggtaccagtacgggaggtggatctccacatcacgggcatgacgtgtgcggcctgcgccgcccgcatcgagaaagtcgtcggtcgcctagaggccgtcaagtccgttcatgtcaatctggcatcggagaaagcgcgtgtcagttatgtcccgggcgtgatcgacgaagcagacatcattcaggcggtggaaaaggccgggtacggcgctatcctcgcgagtgaggcggcagaaaccgaagagaaagaacggaaactgcgtgcataccacagggacctcgcgaaatttgggttttccgtgctcatgaccgtgcccttggtcgtacagatgttcgtaatgctcgtcggaggacgaccgtttctgccgaactggctctcttggctcctcgccacgccagtgcagttttacgtaggttggcggttttacaaaggtgcgtaccatgctctccgaggcggggcagccaacatggacgtgttggttgcccttgggaccagcgtagcgtatgtgtacagcaccgtcttgaccctgcttgggcgctccgacgtgtattttgacagctccgctaccgtggtaaccctgatctttatgggcaagttgcttgaggctcgtgccaaggccaagtcgagtgccgccatcgaatccctggccaagctcggcgcaaaggtggcccatgtcctgcgggaaggtgtggaaaccgacgtggccgtcgaggagctgcgggtaggagatctcgtccgggtccgtcctggggaaaaggtgccgacggacggcgttgtcgtggagggcacgacttcggtcgatgaatcctttctcaccggcgagtcgatgcccgtctccaaacacctgggcgatgaggtcgtgggcgcatccatcaaccaaacgagcgcctttgtcatgcgggtgacgaaagtcggccgggataccgcgctggcacaggtgatccgattggtcgatcaggctcagggttcgaaagcgccggtgcagcgactggccgacaagatctccggcattttcgttcctgttgtcctcggagcggcgctcgtcacgcttcttgtctggggaatgttagggcactggtcgcatggattgctcgcagcgattgccgtgctggttatcgcctgcccatgctccttggggcttgccacccccaccgccatcatggtcggcacgggccttggggcagaatccggcatccttgtcaagggtggagaacacctggaactcgcccaccgggtgaacacggtggtcttcgataagacgggtacgctcacaaccggcaagcctgtagtgacggacgtctggtcggcagatggagtggaacaagatgatgttctcaaggtggcagccgctcttgaagcgcagagcgaacatccgcttggccgagccgtggtcgcttacgccaaggagcatggtgtcgagatcccgtcggcgtccgaggtccagtctgttccaggttatggaattcggggcatggtgaagggtgccagaacacgcgttgggaatcggacctggttcgtcgatgcgaatgtaaccatccccgacgatgtcttggcggcgtttgagtctgcaggcaagacggcggtactggtggcacaggatgagcggttgctcggcgccatcgctatcgccgacacgcttaagtcggacgtccaaggtacggtaaaagaactccagacaatggggatcgaggtttggatgatcacgggcgatggagcccgcaccgcagaggccatcgcgaagctcgcggggatcacgaacgttatggctggtgttcttccagccgagaaggcggccaaggtggaaagcctgcggcacgcaggtcgggtggtcgccatggtaggcgatggcatcaacgatgcacctgcactggcggcagccgacatcggaatcgccatggggactggcaccgatgtggcgctggaggtggcggacatcgtcctcatgcacggccagacacacggagtcgtcgacgctttgcgtctgtccaaggcgaccatgcgtaaaatacgccaaaacctgttctgggcgtttttctacaatgtcttggggatcccgctagcagctttgggtgtcctcagccccatcattgccggggcggccatggcgttcagttcagtcagcgtcgtctccaacagcctgctgttgcgccgtctacagatcggaaaggaggtgcatgcagcgtag

SEQ ID NO: 1985 - DNA, 204 bp, Alicyclobacillus acidocaldarius DSM 446
atggcaacgacaaccctgcgcgtgaaaggtatgacctgcgacggctgcgtgcgctccgtgacgcgcgcgctgactgctgtcgagggcgtctccaaggtggacgtgagcctggagaaaggagaggccgtggtcacgcacgccgactcgacgcccgtttctgcgattcgggccgccgtcgaggaagcgggatatgacgtggaatga

SEQ ID NO: 1986 - DNA, 756 bp, Moorella thermoacetica ATCC 39073
atggaccgacagtccctggcccattttcgccagaagctgctggaggaaaaagcgggcctggaagaacagcttgattccttaaacagcggtggcctgggggagtccctgctggaatccacccaggaattatcccgctacgacaaccaccccggggacctgggcacggaggaattcgagcgcggtaaagacctggccctgcgggacaacgtccaggtccagttacgaaaaattgaagacgccctgcaaagcatagccgaaggtacctacggttactgtcgccgctgcggccgggagatcccccgggagcgcctggaggccataccggagactaccctctgcctggagtgccgccggaaaatggaggggaaggctgataaacactcccgccccgtggaagaggccgtcatcctgcctccctttggcggccagactacggatccccaccagaaacacgccgacgaggaagaggctgttgagtatgacggtgaggacgtctggcaggaactgggccggaccatcgaacacgcttccgaggcccgcagcggttcctacttcggtcccctggacctcgatgaagatcagggctttgtggaagccgtagagaatatcccttatttcaggggcgccgacggcatgttttacgaagacaccggggcctacctcgaagacgaaggggccccggaggaaaaggtgatcggcgacgccggctgggatcgggtgctgaagggagaaggggatagggaacatcagtcgtag

SEQ ID NO: 1987 - DNA, 444 bp, Syntrophomonas wolfei Goettingen
atggactaccaggataatttaatgcagcgcaaagctgaaatagagcaggttattaaacaaaaacgggatgaactgattattcccctgggtgagtggagtgatgagctttccctttatgaccagcacccggctgatattgccagtgaggtaacccaaagggaaaccaatctgggtatattggaaatgttggaatatgagctggagaaagtaaatgatgccctgtcccgcctgcaaaatggccagtatggtgtttgtgaagcttgcgggcaaaagatcgagccggctcgtctggaacgcctggtgaataccactctctgtaccaactgtgcccggagccagcagaagggcttcaaacggcccgccgaggaaggagtcatagcggcaggtcagatgtcagacctgggcgaaggaatacagatcgccggttatgagttttatgagtag

SEQ ID NO: 1988 - DNA, 621 bp, Thermoanaerobacter sp. X514
atggatagtgaaaaactggaacactttagacagttactgttaaaagaaaaggaaaaggtcttaagtactataaatcaaatgaatttgaatgatggtataggagggattgcacaaagagaatattatcaagaactttctcttttggataatcatccggcagattttgcttctgaagtttatgaagtagagaaaaattatgctctcaaagataatgaaaaatatattttaaggcaaatagaagatgcttttaaaagaatggaaataggtacttacggcatatgtgctcactgtcataagccaattgaagaagagcgtttagaagcccttccttatactgttctttgtgcagagtgtgctaaaaataatgatttagaacttaaggatttaaaaaattcaaggcctaatgaagaaagaatgataaaatacccctttggatgggggtataaggatttaaaaggtgaaattcaatttgatgcagaggattcttatcaagaagttgcacggtttaataagacgaaaagtggcttggacaattatgacgatgtctatgatgatgaaaatgctggctatgtagaagaaactgataaaataagtaatgaggattataagaagacattataa

SEQ ID NO: 1989 - DNA, 639 bp, Candidatus Desulforudis audaxviator MP104C
ttggggagtgataaagtggattcggccaagctcgaacaactgcgcgtccgcctgctccgggaaagggccgccgtgcagcgggagatcaatgccatccagcagaccatggacgtggcgctggaagataccatcggggagctcagcacctacgacaaccatccggcagatatagccagcgagacttttgaacggagcaaggattttgctctgcgggagaacgcccggttccgcctgctggccgtggaggacgcgctggccaggatggaccggggcacctacggccgctgtgacgaatgcggggtggacatcgacctcgagcggctggaggcggtgccgttcacgaccaagtgccgggagtgcaaggcccgggccgaggggaaagacgagcgggcgcgcccggtggaggaagaggtgttcaaccgtccgtggctcccgccgggaaacgagagcgtgatgtacgaccgggaggatgcttggcaggacgcgtcgcaggacagcctttcgaccgaaaccgagaattcggaagaggaggaccgcggccatacggaggatgtggatgcgatcccctacgtcaaagaggatgggatgttcttccaggacacccgggtgcggggtgacaccggggaatttggtcgttag

SEQ ID NO: 1990 - DNA, 651 bp, Natranaerobius thermophilus JW NM WN LF
atgacagatcaagaaattgagaaatatcgccagaaattgttatctattaaagcagatcttgaaaaacacgaagctgaaggacaacatgataatcgtactagtattagagataatgtctcagaactatcgagctatgataatcatcctggggacttaggttctgaacaatatgaactagaaaaagatacaactttatcaaatctaagagaacaaaaattacgagaaatagaaattgctttagaaaaaattgctaatggtgattatgggaaatgtgaatcatgtggaaaggaaattaataatgaaagattagatgcagttccatacactagatattgtatttcatgtctaggagatttagcttcaaatcaggatgaacacccttattttgaaggacatactcacttggagactatgagctcaaaagacgaaaattcaatccacttcgataaagaagatatgtggcaaaaattagagaactacggtcaggccgggggaactaacgaagattatgaaaactccgatgaaaattggggtgctgctgataaaatggatgaatattctattggaggcaaagatcttagtattaaccctaaaacagatccagaacgatttaaaagaaggaaaagacggggaagaaatgatcaatcatag

SEQ ID NO: 1991 - DNA, 669 bp, Desulfitobacterium hafniense DCB 2
atggataccagtaaatacgcccggcttattgaacaattgaagaaagataaagaggaggcttgggcaacagctcagggactgattacgggagatatgagagaatccatcgccgaactttccttaatcgacaaccatcccgcggatattgccactgaggtttatgagcgttcccgggatgtggccatccacgaccggcttcaccaccgcatccaagctattgactccgcccttcagcgttatgaggagggaaagtacggcctctgtgagcattgtcaaaaagagattcccctgggaaggcttgaagcgttgcccttcactactgtctgcacggaatgcagccgtcttgaggaaatggaagaacagcattccctgcatcgggactctgtggaagaagagattctggacatgcctttcgccaggacctttaatgatggcaaggatcaggtgggctttgatggggaagattcctggcaagctgtggcccgtttcggcacctcggataccctgcaggatttaggaaccaatcatgatttgagtgatccgaacagcttttatgagcacggggatgaagtcatcggtgccgtgcaagctgtggaaaccatcgaagtggaactggagcctgggcatgccaatacagtgtattatgggaaaaagcacggccggacatag

SEQ ID NO: 1992 - DNA, 687 bp, Halothermothrix orenii H 168
atggataggacaaaagagaaaaaataccgtcaattattaataaatgaaaaaaatagtttattacatgagctaaaacatttttctgatgacgagtttgccagtgttaaggactcaaccggagaattatccagttacgataatcatccagccgatcagggaagtaatacctatgaccgggagaaagacagaggtttaagggataatgcacaggtattattaaataaagtcgaaaacgcccttaacaggctagaagaaggtaattatggattgtgtgaaaaatgtggccaggagataagggaggaaagactggaaaccattccttacgcaaccctgtgtgagcgttgtcaggcgaaagaggaagggaaggattataacagggaccgcccccttgaagaagaaaatttgactcctccctttggtagagggttctatgacgagacaaattataatgcctatgatgctgaggatacctggcaggatgtggcccagtatggaacttccaatacaccccaggatgtccctgaagagacttcagggacgggggcagaggcttatattgattcagaagagactgttgggtcagttggatttgaagatagtatcattgatgatgaagcagataatttagaagaggcatctgaaaaagagagtacttttaccggggaaaaaggaaaggataaaaaatag

SEQ ID NO: 1993 - DNA, 633 bp, Clostridium cellulolyticum H10
atggacaagaatcagctattacattacaaggataaacttttaaaggaggccaaaaaggctgacactgcattggaacaaatgagagacttggacgagggagagatgagcaactatactccttcggagctgtcaaattatgataatcatcctgctgaattgggaagtgagttgtatactctggaaatgaatctggctcttaaagttcatgaacagacaaagattaatgacattaagcttgcattgaaaaaaatagataatggaacatacggcatttgtgaaaattgtaaaaagaagataaacccggccagactagaagttatgcctactgcaaggttttgtatggaatgtcaggaagataaggaggcagaagaaattaatacgccagatcagcagtataacgaaatttttgatagcccgtttggaaggaagtatttgaacaagcaagaagatgacgagtttgaaggtctggaccaattaaatgaccttctaaaatacggaagtgcagatacccctcaggatatgtcgggatatgcggattacgaagaattttatacaaatgaaattgataatcagggatatgtagaggagactgataagatatcaaaccagcagtacaagaatcaacttccttaa

SEQ ID NO: 1994 - DNA, 618 bp, Anaerocellum thermophilum DSM 6725
ttgcagccagctgaaattgaaatgctgaaaaaattgcttttagagaaaaaatctgaagtagaagagtatttaaaaaatactaaagaaaatcaggttgcaaactttagctcactctattcaaatgaggtgtcaaactatgacaatcatccagctgacattgcatcagacctatttgaagcggaaaagaacatgagctttaaagctgacatgaaaagaaaacttgagctgattgaaaaagcactctccaaaattgaaaagggaaactttggctactgtatgtcctgcaaaaaagaaattcctatagaaaggcttttggcaatcccttatacagaattttgtatagagtgccagaaagatatagaaaatcaagaaaattatcaaacagaccaaagaccaatcgaagaaaaggtgctgggcaaaccattcaatgacatgtttccaagtcaaggtgaagaagagcatgatggtacagatatgtggagcatacttgagatgcattcaacaagcaacggtcctcaagatgaagtagtatctgatggaaaaaattactacaagaatataaacgatattgatgatagtgttgaagaaatagataaaatttctaaagataatttttaa

SEQ ID NO: 1995 - DNA, 696 bp, Desulfotomaculum acetoxidans DSM 771
atggacagacagaaaatgcaggcattcaaagaaacactgttgaaagaaaaaaaagaactggaggattctgttcattcttttgacgagcgtggtctaggcatatctctgtcacaagcgaccagtgaattgtcaacttacgacaatcacccggcggatgtcggcagcgaggtatttgaaaggagtaaagactttgcgttaagagatgatgccatgttaaaaatcagagctgtagaggatgctctgaaaaatattgagatgggtaaatacgggatttgcgacatttgcggtaaagaaataggttacgctcgtctgactgctttgccccgcaccacactgtgcaaggaatgcaaagaagcgcaggaaagaatcccttcccgaaacatacggccggcggaggaagacattctgcagcctccttttgaaagaagtttcaatgaccgtgtcagtgatgacgcgggtataggctatgatggtgaagacgcctggcaggatgttgcccgggcctctgaccatgctcctaacgcgcaaagcggttcctattatggcggcgatcaattgctggacgaggatcggggctatgtgcagtcagtagaggacataccctgcgtaaaaggtacagacggtgtgatttaccaggactttgtaggtacagatgacgaggactcgcctgttgcattaagaacaaaggatatctaa

SEQ ID NO: 1996 - DNA, 642 bp, Alicyclobacillus acidocaldarius DSM 446
atggacacggattcgattcgatcccgcctggaggcggcgcgggagcgcctgatcgatcgcctgaacggagccgaaacgtctgcggacatccgcagcgccatgcccgacgaattctcggaactcgccatgtatgacaatcatcccgcggacgtcgccagtgaactcgcgctccgcaatcaggcggttggcgaacggctgcgcgacgagcgcgcgcttgccgacgtggaggatgcgctctcgcggatccgccagggaacctatggccaatgcgagtcctgcgggcggcccattccgccggatcggctagaggcaattccgacgactcgtcgatgcgtggactgtgagcgggaggtggaggccaggcaggcgtcagcacgtcgccccgtggaggaggacgtgctggcgcccgcgtttggccagttcgatcgcgacggcgcggacgagacgggatacgacggggaggacgcgcttcaggacgtcatgcgttacgaccgccccgttaccggtctcgcgcgttacgacgaacccgacctcgacgacgacgccgggtacgtcgagtcggtggaccgtatctcggaggacgactatcggcggacgttgccgtcgccggcccagcttctcaccgattacgacgagccgtga

SEQ ID NO: 1997 - DNA, 834 bp, Frankia CcI3
atgagtcgtgagaaggcgctggtcgacgcctcgtgggtcgaagcgaaccgtaacgacccgaaggtcgtcctggtcgaggtcgacgaggacgtctccgcgtacgacaaggggcacatcccgggggcggtgcgtctcgactggaagtccgagcttcaggacccggtcattcgtgacttcatcaacagggagcagttcgagaagcttctctccgagaaggggatctcgaacgacgacatcgtcgtgctctacggcgggaacaacaactggttcgccgcatacgcatactggtacttcagcctctacggccacgccgacgtccgcctgctcgacggtggtcgcaagaagtgggagctcgacagccgtgagctgaccaccgaggccaccccgcgccagcccaccagctacaccgccccggagccgcgcaccgacatccgggccttccgtgaggaggtcatctccgcgatcggtgagaaggccctggtggacgtccggtcgcccgacgagttctccggcaggctgctcgctcccgcgcacctgccgcaggagcagtcccagcgggccgggcacatccccacggcgaagaacatcccgtgggcgaagaccgcgaacgaggacggcacgttcaagagcaatgacgagctgaccggcctctacaccgaggccggggtcgacctgtccagggacatcatcgcctactgccgtatcggcgagcgttcggcgcacacctggttcgcgctgcacgagttgctcgacctgccgaacgtgaaaaactacgacggttcgtggaccgagtacggctcgctcgtcggcgtgccgatcgagaagggcgcgtga

SEQ ID NO: 1998 - DNA, 834 bp, Mycobacterium MCS
atggctcgctccgacgtcctggtcaccaccgactgggccgagagcaatctcgacgcgccgaacaccgtgttcgtcgaggtcgacgaggacacctcggcgtacgacaccggccacatccccggcgccgtacgactcgactggaagaccgaactgcaggatcaggtcaagcgcgacttcgtcgaccagcagcagttctcgaaactgctgtcggagaagggcatcgccaacgacgacaccgtgatcctctacggcggtaacaacaactggttcgccgcctatgcctactggtacttcaagctctacggccacgagaacgtcaagctgctcgacggcggccgcaagaagtgggagctcgacgggcgtccgctgtccagcgagccggcgaaccgacccgcgaccagctacaccgccaagcagcccgacaccagcatccgggccttccgcgacgaggtgatcgccgcgatcgggcagaagaacctggtcgacgtgcgctcccccgacgagttctccggcaagatcctcgctcccgcgcacctgccgcaggagcagagccagcgtgccggccacatccccaccgccatcaacgtgccgtggagcaaggccgccaatgaggacggcaccttcaagtcggacgaggatctgaccaagatctacgccgacgccggcctggacggtgagaaggaaaccatcgcctactgccgcatcggtgagcgctcgtcgcacacctggttcgtgctgcaggaactgttgggacacaagaacgtcaagaactacgacggcagttggacggaatacggctcccttgtgggggccccgatcgagttgggaagttag

SEQ ID NO: 1999 - DNA, 849 bp, Nocardioides JS614
atgagccgcgagacttccctcgtcaccgcccagtgggtggaggagcacctggacgacccgaaggtcgtgctgatcgaggtcgacgaggacaccaccgcctacgacaagggccacatcaagggcgccgtcaagctcgactggacgaccgacctgcaggaccaggtccggcgcgacttcgtcaacaagcagcagttcgaggcgctgctctccgagcgcggcgtcgccaacgaccacaccgtggtcctctacggcggcaacaacaactggttcgccgcctacgcctactggtacttcaagctctacggccaccaggacctcaagctgctcgacggcggccgcaagaagtgggagctggactcccgcgagctgaccgaggagcggccgacccgcgcgaagacgtcgtacaccgcccaggagcaggacctctcgatccgcgcgttccgcgacgacaccgtcgccgcgatcggcgtgaagaacctggtcgacgtgcgcagccccgacgagtacgccggccggctgctcgccccggcccacctgccccaggagcaggcgcagcgcgccggccacgtgcccacctcgatcaacgtgccgtggagcaaggcggccaacgacgacggcaccttcaagtccgacgaggagctcaaggcgctgtacgccgacgccggcctcgacgacgccaaggagaccatcgccctgtgccggattggcgagcgctcctcgcacacctggttcgtgctcaaggagctgctcggccaccagagcgtgaagaactacgacggctcctggaccgagtacggctccctcgtcggcgtcccggtcgccatcggcgacgagcccggggaggcctga

SEQ ID NO: 2000 - DNA, 834 bp, Mycobacterium KMS; identical to SEQ ID NO: 1998

SEQ ID NO: 2001 - DNA, 834 bp, Mycobacterium vanbaalenii PYR-1
atggcacgctccgacgtcctggtcacagctgactgggccgagagcaatctcgaggcgccgaagaccgttttcgtcgaggtcgacgaagacaccagcgcctacgacaccggccacatccccggcgccgtacgactggactggaagaccgatctgcaggacccggtcaaacgcgacttcgtcgacgcggcgcagttctccaagctgctgtccgagcgcggcatcgccaacgacgacaccgtcgtgctctacggcggcaacaacaactggttcgccgcctacgcctactggtacttcaagctctacggtcaccaggacgtcaagctgctcgacggcggccgcaagaagtgggagctcgacgcccgcccgctgtccaaggacgcggtcgagcgtccgcagaccagctacaccgccaaggaacccgacaacagcatccgcgctttccgcgacgaggtgatcgccgcgatcggcaccaagaacctggtcgacgtgcgctcccccgacgagttctccggcaagatcctggccccggcgcatctgccgcaggagcagagccagcgcgccgggcatatccccaccgccatcaacgttccgtggagcaaggcggccaacgaggacgggaccttcaagtccgacgaggacctggccaagctgtacgccgaggccggtctggacggggagaaggagaccatcgcctactgccgcatcggtgagcgctcgtcgcacacctggttcgtgctgcaggagttgttgggacacaagaacgtcaagaactacgacggcagttggacggaatacggctccctggtgggtgccccgatcgagttgggaagttga

SEQ ID NO: 2002 - DNA, 834 bp, Mycobacterium JLS; identical to SEQ ID NO: 1998

SEQ ID NO: 2003 - DNA, 834 bp, Mycobacterium gilvum PYR-GCK
atggcacgctccgacgtcctggtcagcaccgactgggccgagagcaatctcgacgcaccgaacacggtcttcgtcgaggtcgacgaggacaccagcgcctacgacaccgggcacatccccggcgcgatcaagctggactggaagaccgacctgcaggatcaggtcaagcgggacttcgtcgacgcggcgcagttctccaagctgctctccgagcgcgggatcgccaacgacgacaccgtgatcctctacggcggcaacaacaactggttcgccgcgtacgcgtactggtacttcaagctgtacggccatcagaacgtcaagctgctcgacggcggtcgcaagaagtgggagctcgacgcccgcccgctgtccaaggacgccgtcgagcgtccgcagaccagctacaccgccaaggaacccgacaccagcatccgcgcgttccgcgacgaggtgatcgcggcgatcggcaccaagaacctggtcgacgtgcggtcccccgacgagttctccggcaagatcctggcccccgcgcacctgccgcaggagcagagccagcgcgccgggcatatccccagcgccatcaacgttccgtggagcaaggccgccaacgaggacggcaccttcaagtccgacgaggatctggccaagctgtacgccgacgccggcctggacggggagaaggagaccatcgcctactgccgcatcggtgagcgctcgtcgcacacctggttcgtgctgcaggagctgctgggacacaagaacgtcaagaactacgacggtagttggaccgaatacggctccctggtgggtgccccgatcgagttgggaaattga

SEQ ID NO: 2004 - DNA, 834 bp, Frankia EAN1pec
atgagccgtgagaacgcgctggtcgacgcgacctgggtggacgcccacagcggcgaccccaaggtcgtcctcgtcgaggtcgacgaggacgtgtcggcctacgacaagggccacatccccggcgcagtgcggcttgactggaagtccgaactgcaggacccggtgatccgtgacttcgtgaacaaggagcagttcgagaagctcctgtcggagaagggcatcgccgacgatgacaccgtggtgctctacggcggcaacaacaactggttcgccgcctacgcctactggtacttcgtcctctacggccacgccgaggtccgcctgctcgacggcggccgcaagaagtgggagctggacggccgtgagctgaccatcgaggtcaccccgcgcgcggcgaccaagtactccgcctcggaggcgcgtaccgacatccgcgcgttccgtgacgaggtcatcaccgccatcggtgacaagaacctggtggacgtccgctcgcccgacgagttcagcggccgcctgctcgccccggcgcacctgccgcaggagcagtcgcagcgggccggccacgtgccgaccgcgaagaacatcccgtgggcgaggaccgccaacgaggacggcaccttcaagtcgaacgccgacctggagaagctgtactccgaggccggtgtcgacctgtcgaaggacaccatcgcctactgccggatcggggagcgctccgcgcacacctggttcgccctgcacgagctgctgggcctggcgaacgtcaagaactacgacggctcgtggaccgagtacggctccctggtgggcgtgccgatcgagaagggtgcctga

SEQ ID NO: 2005 - DNA, 846 bp, Actinosynnema mirum DSM 43827
atgagccgtgcagacgtcctggtctccgccgcctgggccgaggagaacctcgccgcgcccggcgtggtgttcgtcgaggtcgacgaggacaccaccgcctacgaggggggccacctccccggcgcggtgcggatcgactggcgcaccgagctgcaggacccggtccgccgcgacttcgtcgaccgcgcgggcttcgagaagctgctgtccgccaagggcatcgcgaactccgacacggtgatcctctacggcggcaacaacaactggttcgccgcgtacgcctactggtacttcaagctgtacggccacgaggccgtgaagctggtcgacggcgggcgcaagaagtgggagctggacggccgccccctggacaaggaggtcgtggagcgcgaggcgaccacctaccaggcgcaggagcaggacctgtcgatccgggccttccgcgacgaggtcgtcgaggcgatcggcgcgaagaacctggtggacgtgcgctcccccgacgagttcagcggcaagctgctcgcgcccgcgcacctgccgcaggagcaggcgcagcgcggcgggcacatccccacggcgatcaacgtgccgtggagcaagaccgcgaacgaggacggcacgttcaagtccgacgaggagctgaccgcgctgtacgcggacgccggcctcgacggctcgcgcagcaccatcgcgtactgccgcatcggcgagcgctcctcgcacagctggttcgcgctgcacgagctgctcgggcactcggacgtgaagaactacgacggctcgtggaccgagtacggctcgctgatcggcgtgccggtcgagctcggccccggcaaggaggcgtga

SEQ ID NO: 2006 - DNA, 840 bp, Saccharomonospora viridis DSM 43017
atgagccgtgaagacgtgcttgtcaccgtcgagtgggccgagcagaacctcgacaccccgggtgtggtgttcgccgaggtcgacgaggacacgaccgcctacgacagcgggcacatcccgggtgccgtgaagttcgactggaagaacgagctgcaggatccgaagcgacgtgacatcgtcgaccggcagggcttcgaggaactgctgtccgccaagggcatcgccaacgacgacctggtgatcctctacggcggcaacaacaactggttcgccgcctacgcctactggtacttcaagctctacggccacgagaaggtgaaactgctcgacggcggccggaagaagtgggagctcgacggtcgtccgctgacgaccgaggtggtcgagcgggagcgcacgaactacaccgctaaggagcaggaccactcgctgcgcgcgttccgtgacgaggtcgtcgaggccatcaacgtcaagaacctggtggacgtccggtcccccgacgagttctccggcaagctgttggcaccggctcacctgccacaggagggggcgctgcgggccggtcacgtcccgagtgcgatcaacgtaccgtggtccaaggcggccaacgaggacggcaccttcaagtccaacgaggagctggagcagctgtacaaggaggcggggttggacccgtccaagccgaccatcgcctactgccgtatcggtgagcgctccagccacacctggttcgccctgcacgagttgctggggttgaaggacgtgaagaactacgacggttcgtggtccgagtacggctcgctggtcggcgtgccggtggagacgggagagcagtcatga

SEQ ID NO: 2007 - DNA, 354 bp, Clostridium thermocellum ATCC 27405
atgaaggctagggagattttagaaattttaaatgcagaacttttgaccggggaagaaaatcttgacatggagtttaatgcagcctgtgggtcagaccttatgagcgatgttatggcctatgtcaaagaaaatgtggttttgctgacagggcttgtcaatcctcaggtgattaggactgcggaaatgatggatataaaattggtggttttcatcaggggaaagaggcccgaggagaagattattcaaatggcaaaagaaaaagggatagcaatcatgaccacgaacgacccgatgtttatagcatgcggaaagttgtacagtgcaggtataacagaaagaggtgtttgggattga

SEQ ID NO: 2008 - DNA, 351 bp, Thermotoga petrophila RKU-1
gtgacaatagaagagatcgccagaatcgtagaaggagagatcctttgtggaaacaaagatctgaacatagaaagagccgttgccacagatctcatgagtgatgttctcgcgtttgctgagccgaacgttcttctgatcacagggcttcactctccacaggccgtgcgaaccgccatggtggtggggatacccgctgttctcttcgtcagaaaaaaagatattcctgagactatagtcaattttgcgaaagaatgcaacatcaccgttcttgcaacgaatctttccatgttcgaaacttgtggcagactttacatgaaaggtttgaagcccgtcaggagagcgatagaatga

SEQ ID NO: 2009 - DNA, 351 bp, Clostridium phytofermentans ISDg
atgactgtaagagatgtgaaagaaatacttggagcacaggtaattagcggagaagaatttttaaatcgtgaggcacaaactggttgtggatccgatatgatgagtgatgtacttgcatttgtcgaagaacaatgcgtattgttaaccgggttgtgcaatttacaggtaattcgcacagcggagatgatggatgtcgtatgtatcgtttttgttcgaggaaaaagaccagatgaagctatgattgagcttgcaaatgaaagagaaataccgttattatgtaccggacatcgtatgtttacagcatgtggtttattatatcaaaatggtctgcgaggaggtacctcaaattga

SEQ ID NO: 2010 - DNA, 354 bp, Thermoanaerobacter sp. X514
atgaaattaaaagaggtaaaagaaattttaaatgcagaagttatggtgggagaagaaaaattagaagaagaagtatttactgcttgtggtgcagacttgatgagtgatgttttggcatctcgtgacgaaaaggctgtgcttttgacagggcttactaatgcccaagttataaggactgcagaagtagtgggagatattaaatgtatagtgtttgtaagaggtaagactccgggagaggaaatattggaacttgctaaaaaagcaggacttgtgataatgaagacaaaatatcctctttatattgcctgtggccttttgtattctaatgggcttacttgtagaagtggtgaatga

SEQ ID NO: 2011 - DNA, 351 bp, Thermotoga RQ2
gtgacaatagaagagatcgccagaatcgtagaaggagagatcctttgtggaaacaaagatctgaacatagaaagagccgttgccacagatctcatgagtgatgttctcgcgtttgctgagccgaacgttcttctgatcacaggacttcactctccacaggccgtgcgaaccgccatggtggtggggatacccgctgttctcttcgtcagaaaaagagatattcctgagactatagtcaattttgcgaaagaatgcaacatcaccgttcttgcaacgaatctttccatgttcgaaacttgtggcagactttacatgaaaggtttgaagcccgtcaggagagcgatagaatga

SEQ ID NO: 2012 - DNA, 393 bp, Natranaerobius thermophilus JW NM WN LF
ttgaaaatttcacaaataaagaagatacttcaagccgatatattaactggaaaagaggaaaactcagtcgaagttgcatttggaacagatttgatgagcgatgtgctagctttttttggtgaatctgacaataccctgttgctaactggacttacaaacttacaagtgatcagaactgctgaactactcgatataaatgccattattttcgtacgaggaaaagagccaaaagatgaactgattaaggaagctgaagaatgtggtattaccttgttgtctacggattacacgctttacgaagcatccggtttattatttacccatggtttaagaggaataaatactgatgataatttacccgaaagccctgaaagagggttagaccatggatga

SEQ ID NO: 2013 - DNA, 360 bp, Dictyoglomus turgidum DSM 6724
atgactttaggaaaggtcagagaaattttaaaggctcaggttttgtgtggagaggaaaatttgaatagagaaatttctattgttggagctacagatctcatgagtgatgcactatgtttgttagaagagggcgcattacttttgactggacttataactatacaggtagtaagaactgcagaaatgttggatctggtgggtgtagtatttgtaagaggaaagattcctcctaaggatgttattgaccttgctcgtaagtctaatttacctcttctctcaaccaagtaccctatgtatgaggcttgtggattattgtacaccgctggatttaaaggaaagaaggtagatgttgattcttga

SEQ ID NO: 2014 - DNA, 354 bp, Anaerocellum thermophilum DSM 6725
atgaaattaacaaagattaaggaacttttaaattgcagggtttatttcgagcctgaagatctatgtaacgaagaatttttaaatgcatgtggctctgaccttatgagtgacgttttggcatttgtaaaagaaaaggtgattttattgacaggtcttgtaaatcctcaagtggtaaggactgcagagatgatggatataaaagctgtgataattgttcgagggaaacaaccatctgaagaaatgttaaaacttgcaaaagaaaagtgtatagctcttcttggaactgactatccaatgtttcaagcatgtggaatactttatgaaaacggacttgggaaagaaaggtgctgctga

SEQ ID NO: 2015 - DNA, 351 bp, Desulfotomaculum acetoxidans DSM 771
gtgatcagtatcaaactgcatcaggtgaatgaacttttagaagctgaagttataacaggtgaagaacttttagaccttactgtaaattatggttttggctgtgatttaatcagtgactcactgagtttttccagacctgactgcctgttgttaacgggacttaccaatattcaaatcatccgggtggctgaaatggttgaggctaaagctatagtatttgtaagagggaaaaaacctggcaccgaaataattgaaatgtcccgacaaaaaaaaattcccctgatgagcaccaagcgatttcttttcgaaagctgcggcattctttaccagcatggtctgcgcagctactaa

SEQ ID NO: 2016 - DNA, 717 bp, Brucella suis 1330
atgaacaaagcgatccttgcagtagcaatggtgctccttctggccggttgcgccaccaagcccgaggaaattggccgcgcgcccgacctgtcgccggtcgcggcccatctcggcatgcagaacaatccgcagttcaacggctatccggcgcggcccggcaaggcgtcctattcgctctgggatcagcgttcgaccaatttcttcaaggacccgcgcgcggcgacgccgggcgatgtgctgaccgtcatcatttccatcaatgatcgcgccaacctcgataacaagacggaccgcgagcgcgtgtcgaagggcatttacggcggaggcggttcattcgccaccagcagcattacgggcgcggcggctggcggtgatatggatgcttcgatcaacactcattccgacagcaagtcgaagggcaagggcacgattgaacgcagcgaggatatccgcttgcagattgccgccatcgtcaccgacacgctgccgaacggcaacctcattatccgtgggtcacaggaagtgcgtgtgaacaatgaattgcgcgtgctgaacgttgccggtgtcgtgcgtccgcgcgatatttccggcaacaacacgatttcctacgacaagatcgccgaagcgcgcatctcctatggcgggcgcgggcgactgagcgagattcagcagccgccttatggccagcagattctcgaccagttttctcctttctaa

SEQ ID NO: 2017 - DNA, 705 bp, Rhodopseudomonas palustris BisB18
atgacgctgatgcgattgcccgttgcggtgacggcgtgcctggccttggcgggctgcgccaacaatctggccgaactcggccaagcgccggcgatgtcgccgatcggccagggcttgtatgccgacgcccgcgcgattccggtcgagccgcgcagccgctacgcgcaaaatcgctactcgctatggaacgagcgcagggacctctatcgcgatccgcgggcgtcgcgggtcggcgacctgctgaccgtcaccatctcgatgaacgacaaggcgacgctcgacaacaagaccgatcggtcgcgggattccgaaaccaaattcaaaaccaattatctcgccgagtttctgccctggtcgagcaagggtaagctggaagccaatgtcgattcgcaaacctcgaccaaaggcacgggcaagatcgatcgcaccgaagaggtcaagttctcggttgccgcggcggtggtcgacgtgctgccgaacggcaatctgctgatcgcgggctcgcaggaagtgcgggtgaactacgagatgcgcgtcctgcacgtcggcggcatcgtccggccgctcgacatcacccgcaacaacaccatcgcctacgagaaagtggcggaggcgcgaatttcctatggcggccgcgggcgcctgatggaggtgcagcagccggcgtggggtcaccaggtctacgatcaggtggtgccgttctag

SEQ ID NO: 2018 - DNA, 708 bp, Mesorhizobium BNC1
atgaacaagatcgcaggaaccctgttcctcctcgccggccttgccatggccggctgcacgacgaccgaggagctcggcaagccgcctgcgctttcgccggtggggtccggcgccgagccgaccgccatgcaagcctatcattacccggacaggcggcaggcccatgtcagccgctattcgctctggagcgaccggcagagccgtctgttcaccgatccccgggcgcttgaggtgggcgatatcctgacagtcgtcatatccatcaacgataaggccaaattcgagaatgaatcggaacggtcccggcaggcgacgcgcaatctcggcctagccggtacgttcgcgatcggcagcgcgaccggttcggcggaagccgacgcggatatcggctccggcacatcgaccgtcggctccggcgcaacgaaacgctcggaggatatgcggctggtcattgccgccatcgtgacggagaggcttccaaacggcaacctgcgcatctccggcacgcaggaggtgcgcgtcaacgccgaactcagggtgcttaccatcgcagggctcgtgcggcccgccgatatcgggccaaacaacacgatttcctatgaacggattgcagaagcacgcatttcctacggtgggcggggaaggctgaccgaggtgcaacagccgccatatggccagcagttcctcgatactgtcctgcccttctga

SEQ ID NO: 2019 - DNA, 693 bp, Bartonella bacilliformis KC583
ttgtatttggtgtttggcatcatttttacatcagtgatagtgacttcttgttcatacaatacgaaagattttaattcggttccagatttttcacctgtgcgtgcagatttaggctatgctccttcgcgtacagcgcagacctatccattgcccccgagggagagcaattattcactttatcgtgcaagcgggaatagcttttttcgtgatccacgggctatgcagccgggtgatgtgttaactgtgcaaatatcaattaatgatcgcgctagtttgaataataaaagcgacctaaagagtgattctagttctaaatataccattgggacgggatattctttcatggatagaattgcagggagccttgaaggtgagtcatcaaaccaatctaaaggggatggcaagattgagcggcaagaaaatattcgcttgtctgtggctgcaattgtgactgatgttttgcccaatgggaatttaattattcgcggttcacaagaggttcgggttaatcatgaattgcgtattctcaatattgcaggggtcgttcgtccacgtgacatttcaggcaataacatgattgagtatgataaaattgctgaagcacgcatttcatatggtgggcgtgggcgtataagtgaaatacaacaacctccctatggtcagcagttattaaatcaaatttcgcctttttaa

SEQ ID NO: 2020 - DNA, 729 bp, Brucella ovis
atgaaaaacagcatgaacaaagcgatccttgcagtagcaatggtgctccttctggccggttgcgccaccaagcccgaggaaattggccgcgcgcccgacctgtcgccggtcgcggcccatctcggcatgcagaacaatccgcagttcaacggctatccggcgcggcccggcaaggcgtcctattcgctctgggatcagcgttcgaccaatttcttcaaggacccgcgcgcggcgacgccgggcgatgtgctgaccgtcatcatttccatcaatgatcgcgccaacctcgataacaagacggaccgcgagcgcgtgtcgaagggcatttacggcggaggcggttcattcgccgccagcagcattacgggcgcggcggctggcggtgatatggatgcttcagtcaacactcattccgacagcaagtcgaagggcaagggcacgattgaacgcagcgaggatatccgcttgcagattgccgccatcgtcaccgacacgctgccgaacggcaacctcattatccgtgggtcacaggaagtgcgtgtgaacaatgaattgcgcgtgctgaacgttgccggtgtcgtgcgtccgcgcgatatttccggcaacaacacgatttcctacgacaagatcgccgaagcgcgcatctcctatggcgggcgcgggcgactgagcgagattcagcagccgccttatggccagcagattctcgaccagttttctcctttctaa

SEQ ID NO: 2021 - DNA, 711 bp, Sinorhizobium medicae WSM419
atgagaatgcgaatcacggccatattggccgcagggctcctggcggggtgccagaaccaggccttcaacgagatcgggcgagcgccggccatgagcccgatcggcagcggactgcaatatacgcagacgcctcagctcgccatgtatccaaagcagccgcgccacgtcacgaacggatattcgctctggaacgaccagcaggcggccctcttcaaggatgcacgcgcgatcaatatcggcgacatattgaccgtggacatccgcatcgatgacaaggcttccttcgaaaacgagacggaccgcagccgcaagaactcgagcggcttcaatctgggcgccagcggggagtcgcagacgagcgattttgcctggtcgggcgatctcgaatacggctccaacacaaagacggaaggcgacggcaagacagagcgctcggagaagctcaggctgctcgtcgcggcggtcgtcaccggggtcctcgaaaacggcaacctcctcatcagcggctcgcaggaagtgcgcgtcaatcacgagctgcgtatcctcaacgtggcaggcatcgtccggccgcgcgacgtggatgccgacaacgtcatctcctacgaccgcatcgccgaggcacgcatctcctatggcggccgcggccgcctgacggaagtccagcagccgccatggggacagcagctcgtcgacctcgtctcgcccctctga

SEQ ID NO: 2022 - DNA, 729 bp, Ochrobactrum anthropi ATCC 49188
atgaaaaacagcatgaacaaagcaacccttacagcagcagtactggttcttctggccggttgtgccaccaagccggaggaaatcggtcgggcacccgatctgtccccggttgcggcccatcttggtatgcagaacaatccgcagtccaacggctatccggcgcgtccgagcaaggcgacctattcgctctgggaccagcgttcgaccaatttcttcaaggatccgcgtgcggcgacgccgggtgatgtcctgaccgtcatcatttcaatcaacgaccgcgccaatctcgataacaagacggatcgcgagcgtgtgtcgaagggcatttacggtgccggtggttcgtttgccacgagcagcagcacgggtgccggtgccggcggcgacatggatgcttcgctcaacacccattccgacagcaagtcgaagggtaagggcaccatcgagcgcagtgaagatatccgcctgcaggttgctgccatcgtcaccgatacgctgcccaatggaaacatgatcatccgcgggtctcaggaagtgcgcgtcaacaatgagctgcgcgtgctgaatgtcgccggtgtcgtgcgtccgcgcgatatttccggcaataacacgatttcctacgacaagattgccgaggcccgcatttcctatggtggccgcggacgtctgagcgagattcagcagccgccttacggccagcagattctcgatcaggtttctccgttctag

SEQ ID NO: 2023 - DNA, 708 bp, Methylobacterium extorquens PA1
atgcgcccctcctccgccgccgtggccgtgctggccctctcgctcggcgcctgccagagcgatctcgaccgcctcggccgcccgccgctgctgacgccgatcggcaccgggctcaacgcgccgcgtgagccgctgccgacctcgttcggcgcgctcggcccgcgccacagctaccactcgacctggagcccggcgagcgccgcgctctaccaggatccgcgcgcccgcgacgtcggcgacgtcatcacggtcagcatcgccatcaatgataaggcgcagttcgacaacgcgagcgagcgcggccgcagccagaagagcagcctcggcttcgatttcggctacggcatctcggggctcaaggacacggccaccgccgataccggcatccgctccggcaccgagaccaagggccagggctcgatcgaccgcaaggaatcgctcagcctctcggtcgcggcagtggtcaccgaggtgctgcccaacggcaacgtgctgatctcgggctcgcaggaagtgcgggtcaacaacgaggtccgcgtgctcgaagtcgccggcatcgtccgcccgcgggacatctcgcgcaagaacaccatcgattacgacaagatcgccgaggcgcgcatctcctacggcgggcgcggccgcatcaccgacgtacagggcccaagcctgggccagcgagtcttcgagaccgtcgcaccgttctga

SEQ ID NO: 2024 - DNA, 699 bp, Methylobacterium radiotolerans JCM 2831
atgaagcggctggctgccatcgcggcgctcacgaccctcggggcctgcgcgacacccgttcaggagatcggccgggcgccggccctgagccccgtcggcctcggcatcgatccgaaccacgacgccgtgccgccgctcgccgtcgcgtcgcaggcgcagggctaccattcgacctgggcccagcagagcgcggacctgttccaggacccgcgcgccaagaatgtcggcgacgtgctgaccgtgctcatcgcgatgaacgacaaggcccagttcgacaacgccaccgaccggtcgcgcgattcgcgggccaagacgagcctcgacctccagttcgacctgttcggcctcacgccggaatcgaagaaccactacgaggtcaacggcaactcgtcgaccaagggacagggcaccatcgaccgcaaggagcagctgcggctctccgtggccgccgtcgtcacgcacgtcttcccgaacggcaacatgctgatcagcggctcgcaggaggtgcgggtcaacttcgaggtccgcgtcctcaacatcgccggcatcgtccggccgcgcgacatctcgcgccggaacacgatcgactacgacaagatcgccgaggcgcgagtctcctacggcggtcgcgggcggctcatggaggtgcagcagccggccgtcgcccagcaggtctacgacctggtctctccgttctga

SEQ ID NO: 2025 - DNA, 1035 bp, Beijerinckia indica ATCC 9039
atgccaagctttcttatcaagaacgcccaggaaaatccccaagacaatctccagatggcttcgatcccaatggaagccattccgatagaagctgttcgtgcagaagtctcgcccgcgaccatccaaaaaaatattttctggcggattggcctcaatggacttttgcgaacagattccctgtccaccaatcacgagtctgttcccgagtgccacgcctacggcaagcacaaacagttccaatcgatcatgacaaacggtcgcaacgccatcagcgccggggcaagatcctgcttttcgcttgagcgtctcattgatcaaaagatttcgttacggttctccttcgccttcgtcgccctcggttcagtggcgcttgcgggatgcgcgggcgatatacgggaacttggacgagagccagccatgagtgcactcggaaccggcctcgctgcgcgagttcaaccatcggcaacggccgttttccaaaatgccagcatgacgcggccgcaatcgatctggaatgggagccgaaccgatatcttcagtgacccacgtgctgccagaataggagatgtcgtcactgtgatgatctttatcaatgatcacgcgacatttggcaataatacggaccgctccctcgaagccaagatcaatacaggattcgactacaaactcggcctcagcaatcagacaatccagttcaagccgacgatcacatcggatattctttcgtcgacccaaggccaaggcgccatcgaccgttcggagaaaatgcaactttccgtggcggccgtcgtaacggatgtccttcccaacgggaatctcatcatttcagggtcgcaagaagtgcgcgtcaattttgaactacgtctcctgaatgtagccggtatcgtgaggcctcaagatatcgccaaggataatacagtttcctatgacaagattgctgaagcccgtatttcctatgggggacgtggccgcatcatggaggtgcagcagccggcgatcggtcaacaaatctatgaccgcttcaaaccgatttag

SEQ ID NO: 2026 - DNA, 711 bp, Methylobacterium populi BJ001
atgcgccctgctccctccgtcgcggcggccctgctcgccctctccctcggcgcctgccagagcgacatcgcccagatcagccgcccgcccgtgctgacgccgatcggcagcgggctcaacgcgccgcgcgagcctctgccgacgaccttcggtgcgctcggcgcgcgccacagctaccattcgacctggagcccggcgagcgcggcgctctaccaggatccgcgggcccgcgacgtcggcgacgtcatcacggtgagcatcgccatcaacgacaaggcgcagttcgacaacgcgagcgagcgcgcccgcagccagaagagcagcctcggcttcgatttcggctacggtgtctccgcgctgaaggacacggccacggcggataccggcatccgctccggcaccgagaccaagggccagggctcgatcgaccgcaaggaatcgctcagcctctccgtcgcggcggtggtcaccgaggtgctgcccaacggcaacgtggtgatctcgggctcgcaggaggtgcgggtcaacaacgaggtacgtgtgctcgaagtcgccggcatcgtccgcccgcgggacatctcgcgcaagaacaccatcgactacgacaagatcgccgaggcgcgcatctcctatggcgggcgcggacgcatcaccgacgtgcaggggccgacgctcggccagcgggtcttcgagaccgtggcgccgttctga

SEQ ID NO: 2027 - DNA, 717 bp, Rhizobium leguminosarum bv  trifolii WSM2304
atgaatatgcgtttcccggccgcgatcgccgtcctcgcactccttgcaggttgccagtcaccgacggcagtcagcgagatcggccgcgcgccctccatgagcccgatcggcagcggtcttgcctacggtcagacgccgcagatggcgctttatccgaagcagccgcgcgccgtggcgcagggttattcgctgtggagcgattcacaggcggcgctcttcaaggatgcgcgcgcgctcaatgtcggcgacatcctgaccgtcgacatccagatcaacgacaagggctcgttcgataacgagaccaaccgcagccgcaagaattcaagtggcatgaattgggacgtcaacgcccagatcttcggctggacgcccgagtccaagactgacctgacctatggttccgacaccagcaccgacggcaagggcaagatcgagcgcaccgacaaactgacccttctggttgccgccgtcgtcaccggcattctcgaaaacggcaacctcgtcatatcgggctcgcaggaagtccgattgaaccaggaactgcgtatcctgaacgttgccggtatcgttcgcccgcaggacgtcaatgccgaaaaccaaatctcctacgacaagatcgccgaagcccgcatctcctatggtggccgcggccgcctgatggaagtgcagcagcctccgcgcggccagcaggccgtcgatcttttctcgccgctttga

SEQ ID NO: 2028 - DNA, 702 bp, Methylocella silvestris BL2
atggagcgcgccattttgatcctcacgatgttatgtctttgcggctgcgccggcgatctccgcgagcttggccgggagccctccatgagcccggttggaacaggcctcatggcagaagtgcagccaaccgcgagcgctttgttcctgcccgcgccgaagccggactcccgctccatctggagcggcggacgcgccgacatattcagcgatccgcgcgcggcgaaaatcggcgacgtggtgaccatcaacattggcatcaacgatcgggcgagctttggcaacacgacggaccgctcgctcgactccgccgtcggcgctagccttgattggaagctcggtctcaacaacactcggaacgagttcaagccggaatatctcgcgactgcgatttcgaaaacgaaaggcgaaggcaacacggatcgcgcggagaaaattcaattgtcggtcgccgcgatcgtaaccgacgtgttgccgaacggaaatctgatcatcagcggctcgcaagaagtgcgggtgaatttcgagctgcggctgttgaatgtcgccggcatcgtcaggccgcgggacatctcaaaggagaatacgatctcctacgacaaggtggccgaggcgcgtatctcctatggcggtcgcggccgcatcatggaagtgcaacagccggcctggggccagcaggtctatgattggttcaaacctctctag

SEQ ID NO: 2029 - DNA, 708 bp, Methylobacterium chloromethanicum CM4
atgcgcccctccgccgccgccgtggccgtgctggccctctcgctcggcgcctgccagagcgatctcgaccgcctcggccgcccgccgctgctgacgccgatcggcaccgggctcaacgcgccccgcgagccgctgccgacctcctttggcgcgctcggcccgcgccacagctaccactcgacctggagcccggcgagcgccgcgctctaccaggatccgcgcgcccgcgacgtcggcgacgtcatcacggtcagcatcgccatcaacgacaaggcgcagttcgacaacgcgagcgagcgcggccgcagccagaagagcagcctcggcttcgatttcggctacggaatctcggggctcaaggacaccgccaccgccgataccggcatccgctccggcaccgagactaagggccagggctcgatcgaccgcaaggaatcgctcagcctctcggtcgcggccgtggttaccgaggtgctgcccaacggcaacgtgctgatctcgggctcgcaggaagtgcgggtcaacaacgaggtccgcgtgctcgaagtcgccggcatcgtccgcccgcgggacatctcgcgcaagaacaccatcgattacgacaagatcgccgaggcgcgcatctcctacggcgggcgcggccgcatcaccgacgtgcagggcccaagcctgggtcagcgggtcttcgagaccgtcgcgccgttctga

SEQ ID NO: 2030 - DNA, 714 bp, Agrobacterium vitis S4
atgataaagcgtagcgctgtggttctcatggccgttatcctcaccggctgtgggaacaagacattggaagaagtcggcaatgctccggccatgagcccggtgggcagcggcttgcgttacaatcaggcgccgcagcttgccagctatccgaagcagaccaaggctgtcagcaacggctactccctctggaacgacagccaggcggcgcttttcaaggattcgcgcgccatcaatgtcggggatctgctgacggtcaatatctcgattgccgacaaggcgaagttcaagaacgacacatcacgcagccgtaagaactcgacatcgctgacatggtcgacggtgatcaacctgttcggcatcacaccgccagattcgtccggcgacatgagcaccgattcgaattcgagttccgatggcaagggatcggtcgatcggtctgaaacgctgaccttgatggtggcggctgtggtgaccagcattcttgaaaacggcaatctgctgatcagcggttcccaggaagtgcgcgtcaaccatgaagtccgcattctgaatgtcgcgggtattgtgcgcccgcaggatgtcgatgccaagaacaccatttcctatgagaagatcgcagaggcccgcatttcttacggcggcaagggacgtttgacggaggtgcagcagccgccggttggccagcaggtcgtcgacatgttctccccattctga

SEQ ID NO: 2031 - DNA, 717 bp, Rhizobium leguminosarum bv  trifolii WSM1325
atgaatatgcgtttcccggccgcgatcgccgccctcgcactccttgcaggttgccagtctccgacggcggtcagcgagatcggccgtgcgcctgccatgagcccgatcggcagcggccttgcctacgggcagacgccgcagatggcgctttatccgaagcagccgcgcgccgtggcgcagggctattcgctgtggagcgattcgcaggccgccctcttcaaggatgcgcgcgcgctgaacgtcggcgacatcctgaccgtcgacatccagatcaacgacaagggctccttcgacaacgagaccaaccgcagccggaagaattcgagcggcatgaactgggacgtcaacgcccagatcttcggctggacgcccgagtccaagaccgacctcacctatggttccgacaccagcaccgacggcaagggcaagatcgagcgcaccgacaagctcacccttctggtcgccgccgtcgtcaccggcattctcgaaaacggaaaccttgtcatatcaggctcgcaggaagtccgcctgaaccaggaactgcgcatcctgaacgttgccggtatcgttcgtccgcaggacgtcaatgccgaaaaccagatctcctacgacaagatcgccgaagcccgcatctcctacggcggccgcggccgtctgatggaagtgcagcagcctccgcgcggccagcaggccgtcgatcttttctcgccgctttga

SEQ ID NO: 2032 - DNA, 477 bp, Rhodoferax ferrireducens T118
atgcgatgcttggtgaagagattggatacaagaatgcaagcaaatcagacaagctattcagtgcccgccgtgcagttgcccgtcatgttggtggcggaggtgcaggattcgttgctggttgtggttcatgatttaaaccgtcttgacgggctgttggtgcacacgatggagaacctgatggaacggttcacctgtgccagtgccaatctggctgaccccatgctggtcgactccgctgcacttgatgctgttcgtagcgccctgcgggcggcggtgaccgagttacagtttcaggatattgcctcgcagctgatcgttcatacttccaagatccttcagggttgcgcctaccggctggcgtccgagtccatggggctcgaagatggcgaggcggtgccgtttgttgaagaggtgccggagcgccccaacccggtcacccaggatgccatggacgctggttccattgagcttttttaa

SEQ ID NO: 2033 - DNA, 447 bp, Acidovorax avenae citrulli AAC00-1
atgcaatctacgctaacaggccctgatgagccaggagtccagctccccgtcatggtggctgcggaacttcaggattccctgctcgtcgtcatgcgcgacctgcaccgcctcgaaggcctgctcagccatgcgaccgacaatctgctcgcccgtttcggcgaagccaaccaggcgctgtcggacgagctgatcaagggttccccagaactgctcgccctgcgcaccgccttgaggagtgccgtcacggaactgcaattccaggacatggcttcccagctgatctggcacaccaccaaggtcctgcagggctgcgcattccggcttgcctccgaagccatgggctccgaagagggcgaggaggccgcaccgttcgccgagatggcgccagaccgccccaatccggtcacccaaagcgagatggacgctggttccattgatctcttctga

SEQ ID NO: 2034 - DNA, 447 bp, Acidovorax sp. JS42
atgcaatctacgctaaatacgccagatgggcctgccgtgcaggtgcccgtcatggtggcggccgagttgcaggattccctgctgatggccatgcacgacctgcaccggctggaagggctgctcaaccacgccaccgagaacctgctcgcgcgtttcggcgaggccaacgcctcgctgacggatgagctcatcggcgcgtcggcagagttggccgatttgcgcaccgccttgcgcagtgcagtgacggagttgcagtttcacgacatggcgacccagctcatcatccacactaccaaggtgttgcagggatgcgcctttcgcctggcggccgagaccatgggacaagaagagggggaggacgctgcgccgctggacggcgtggtgcccgatcggcccaaccctgtcacgcaaagcgagatggaggccggctcgatcgagctgttctga

SEQ ID NO: 2035 - DNA, 447 bp, Verminephrobacter eiseniae EF01-2
atgccatctacgccaacgacatccaccgggcctgcggtgcaggttcccgtcatggtggcggcggaactgcaggattcgctgctggtcgtgatgcatgacctgcagcgcctggaggggctgctcaaccatgccaccgacaatttgctggagtgcttcggtgcggccaacgcctcgttgacggatggcgtggtcggcacttggcccgaactgcgggcggcccggtcggcgctgcgcaacgccgtgaccgagttgcagtttcaggacatggcctcgcaactgatctggcacaccaccaaggtgctgcagggctgcgcctttcgcctggcctcggacgcgatgggccatgaggagggcgaagacgcggcgccctttgccgagatggcgccggaccggcccaacccggtcacgcaaagcgagatggacgcaggttccgtcgacctgttttga

SEQ ID NO: 2036 - DNA, 432 bp, Methylibium petroleiphilum PM1
atgccacaagcccagatctccgccgaaccggcgttgccgctgctgctggctgcggacctgcaggaccatctgatgatggccagcaacgatctcgaccgcctgcagcgcctgctcgccgacacctgcgatgcgctgatgcagcgcttccacggcgccgtcggccagctggacggtggcgacgcgatcgacgccggcaccgtgcgcgacgtgcgccgcctgctcggcgaagccgtcacggccctgcagttccaggacatggcctcgcaactgatcgcccacacccaccagcgcctgcgcaactgcgccgaccagctggcgcgcgacgcgttcggcgccgacggcgacggcgaggcggtgatcgcccccccgccgctgcgtccgaatcccgtgacgcaggacgaaatggacgccggcaccgtcgagctgttctag

SEQ ID NO: 2037 - DNA, 447 bp, Delftia acidovorans SPH-1
atgcagtcaatgcacaagccttcgggcgagcctgccgtccccatgcccgtcatggtggccgcagacctgcaggatgccttgctggtggcgatgcgcgatctgcagcgcctggaaggccttctcaatcatgcaacgcagaacctgctggaccgtttcgacgagacccacggccagctggccggtgaggcgctaggcgccttgcccgagctggacgccgcgcggtccacgcttcggttggcggtgaccgagttgcagtttcacgacatgtcctcccagttgatcgcccatattacgaagattttgcaaggctgcgcgttccagttggccgcagccaccatgggcgtggacgagggggaggacgattccctgggcctgccggcgatacccgaccggcccaatcccgtcacgcaaagcgagatggatgctggctcggtcgagctgttctga

SEQ ID NO: 2038 - DNA, 462 bp, Leptothrix cholodnii SP 6
atgcagatgtccgacgaaatcgatcccgacgcgcccgctgcctttcccttgctgatggcagcggaactgcaggatcacctgctcaccgccaccaacgatctcgatcgcctgcagcgcctgctgaccgacgcgagcgaggagctgatggggcatttctacggcgccaacagccgcctgtcgggtctgctgcgcgacgccgccgtgctgccgcacgtcgacaccacggcgctgcattcggcgatgcagagcctgagcggggcggtcaccgcgctgcagttccaggacatggcctcgcagctcatcgagcacacccaccgccgcctgcggtcctgcgtcgaccagctggcgcgcgaggccatgggcttcgatcccgaaggcgatgccgtgatcgaggatgcgccgttgcgccccaacccggtcacccaggacgagatggacgccggttcggtcgaactgttctag

SEQ ID NO: 2039 - DNA, 447 bp, Diaphorobacter TPSY uid29975
atgcaatctacgctaaatacgccagatgggcctgccgtgcaggtgcccgtcatggtggcggccgagttgcaggattccctgctgatggccatgcacgacctgcaccggctggaagggctgctcaaccacgccaccgagaacctgctcgcgcgtttcggcgaggccaacgcctcgctgacggatgagctcatcggcgcgtcggcagagctggccgatctgcgcaccgccttgcgcagtgcagtgacggagttgcagtttcacgacatggcgacccagctcatcatccacactaccaaggtgttgcagggatgcgcctttcgcctggcggccgagaccatgggacaagaagagggggaggacgccgcgccgctggagggcgtggtgcccgatcggcccaaccctgtcacgcaaagcgagatggaggccggctcgatcgagctgttctga

SEQ ID NO: 2040 - DNA, 3630 bp, Burkholderia mallei ATCC 23344
atgagccacgctgtcgcacgcatcgttcgcccgctgccgtcgcgggacatctggacgttcgccggcctcgtcgtgctggcgtgtttcgtttggcttgccgggccgctgttcgcgttcgccgagttccgcccgttcgagagcggcgcggtgcgcgcggcgacgatcgtcgcgctgttcgtcgcgtggggcgcgcggatcgcgtggcgcggctggcgcgcggggcaactgaacgcgcagttgctcaaccagttgcgcgaagcggcgccgcggcccgccgcgacgggcgatcccgcgcaggcgcagctcgacgagctgcgcagccgcttcgacgaagccgcgacgctgttgaagaaagtccgtttcggcgaagccgacggcgcgcgcaagggcctgccgcggtggctcgagcagatgtcgcgccagtatctgtaccaactgccgtggtacgtgttcatcggcgcgccgggctcgggcaagacgacggcgctcgtcaactcggggctgagctttccgctcgccgagcagttcgggcgcgcggcgattcgcggcgtcggcggcacgcggcactgcgactggtggttcacgaacgacgcggtgctgatcgacaccgcgggccgctacacgacgcacgagagcaaccgcgcgctcgacgaggccgaatggaagggcttcgtcgatctgctgaagaagtaccgcgcgcgccagccgctgaacggcgcgatgctgacgatcagcgtcgccgatctgctcggcgcgtcggaggcggagcgcacgcagcacgcgatggtgctgcgcaagcgcctgctcgagctgcgcgcgcagctcggcatccgctttccggtgtatctgctcgtgacgaaggcggacttgctcgccggcttcgccgaatacttcggcggcttcggccgcgccgaatgcgcgcaggtgtggggcttcacgttcccgctcgccgagagcgaagcgcccggcttcgagctgcgcgcggcgttcgaccgcgaataccggctgctgcaccagcggctgaacgacgggctgccggagctgctcgcatcgcagaccgacgcgcgccagcgcgagatgacctacctgctgccgcagcagatcgccgatctgcaggacatgctcggccagttcgtcgccgaggtgttctcggtgtcgagcttcgagccgatgccgatgctgcgcggcgtctatctgacgagcggcacgcaggaaggcaccgcgttcgaccgcgtgatgagcgggatcaagcgcttcctgaagatcgagggcgtgccgcccgccgcgcagacgggctcgtcgggccgcagtttcttcctgaaatcgctgctgcaggatcacatctttcgcgaggcggcgcttgccggcagcaatctgcgctggcatcagcggcagcgtgtgctgcagatcgtcggctacgcggcgatcgcgctgctgtgcgtggcggtgctgttcgcgtggctgcgcagctactcgcgcaatcgcgactatctcgacgaggtcgccgcgcgcgtgccggcggtcgacgcgcagatcggccgcgcgaaattcacgggcgcggccgacatcgtgcaactgctgccggtgctcgacgagctgagcggcctgccgaacgcgggcggcgtggacttgcggcatccgccgctcgcgtatcgctggggcctgttccagggcgagaagatcgaggaggcgagcgacgccgtctaccggcgcgcgctcgacgacgtgctgctgccgatcgccgcgagccggatggagcaggcactgcgcgacgcgcggcccgacgaggtcgagtatgcgtacgcggcgctcaaggcgtacctgatgctttacgacagcgcgcactacgatcccgcgttcgtgcaggccgtcgtcgatctcgagatggagcgcgcgctgccggccgatttctcgtccgcgcagcgcagcgcgctgcgcgcgcatctcggcgcgctgttcggcaatcgcgtcgcggtgtcgccgtttccgatgaacgagcggctcgtcgccgacgtgcgcgagcggctgcggcaggtgccgttctcgcagcggctgtatcggcagctcgcgcgcacgctgcacgcgagcaccgcgtcgtacgatttcagcgtcgcgcgcgcggtggggccggacgcgtcgctcgtgttccggcggcagagcggcaagagcctcgccgacggcgtgccgggcctctacacgcgcagcggctaccgcaacgtgttcgcgccgcgtctgcccggcgcgatcgattcgtacgggcgcgaggaggtgtgggtgctgaacctcggcgcgtccgagatcccgaatccggccgacgcggccgcctgggcgcgcgacatccggcagctctacctgaacgactacatcaagacctgggacgactatctggccgacatccggctgcagcgcacgtcgacgctcgcgcagagcatccaggtcgcgcgcacgctgtcgtcggccgattcgccgctcacgcggctgatggtcgcgctcgcgcgcgacacgccgctcggcgatgcgcccggcggcgcgcgcaatctcgcgtcgcgcgcgcaggacaaggtcgacgaggcgcgcaactcgctcgcgcagatcttcgccgggcagccgggcggcgaagcgggcgcggcggccgcgccgcccgcgagccccgagcagatcgtcgacagccacttcgcggggctgcgcgcgttcgcgccgggcggcggggatcaggcggcgtcgttcgacgcggtgctcaaggcgatcgacgcgctgtacacgtacctcaccgcgaccgacgacgcattgcgcagcggcgcggcgccgccgccgtcggacgcgcccgcgcggctgcgcgcgcaggcgggccggttgccgacgcctgtgcgcgaggtgctcgacgatttgtcgaacgtcgcgaacggcagcatcgcgagcgtcgagcagcgcaacgtcgcgcagcgcgcgggcgcgaacgtcggcgatttctgccggcaggcgatcgccgggcgctacccgttcgcgcgcggcgcggcgcgcgacgtcgcgccgtccgatttcgcgcagctgttcgcggcgggcggcctgatggacgacttcttccagaagaacctgcaaacgctcgtcgacacgaccgcgcatccatggcgtttcaacaaccgcaacgccgaagccgacccgtcggcggccgcgatgctcggctcgttcgagaaggcggcggtgatccgcgacgtctatttcggaggcggcgcgcggaccgcgcagatcaaggtcgagatcgtgccgctcgaaatggacccgtcgatctcggagatgctgctcgacgtcgacggccagatcgtccgctacgcgcacggcccgcaggtgccgacggcggtgcagtggcccggcacgcgcggcagcaatcaggtgcggctgcaggtgaccgagcagtcgggggcgacgggcggcttcacgaccgagggcccgtgggcgctgcaccggctgttcgaccgcgcgggcgtgtcgggtgggcgcggacccgagcagatggtcgcgagattcgcggtcgacggcaagccgatcgtgctgcaggtgacggcgagcagcgttcgcaacccgttccggttgccgcagatggagtcctttacatgtcctccgaagcaatga

SEQ ID NO: 2041 - DNA, 3630 bp, Burkholderia pseudomallei 1710b
atgagccacgctgtcgcacgcatcgttcgcccgctgccgtcgcgggacatctggacgttcgccggcctcgtcgtgctggcgtgtttcgtttggcttgccgggccgctgttcgcgttcgccgagttccgcccgttcgagagcggcgcggtgcgcgcggcgacgatcgtcgcgctgttcgtcgcgtggggcgcgcggatcgcgtggcgcggctggcgcgcggggcaactgaacgcgcagttgctcaaccagttgcgcgaagcggcgccgcggcccgccgcgacgggcgatcccgcgcaggcgcagctcgacgagctgcgcagccgcttcgacgaagccgcgacgctgttgaagaaagtccgtttcggcgaagccgacggcgcgcgcaagggcctgccgcggtggctcgagcagatgtcgcgccagtatctgtaccaactgccgtggtacgtgttcatcggcgcgccgggctcgggcaagacgacggcgctcgtcaactcggggctgagctttccgctcgccgagcagttcgggcgcgcggcgattcgcggcgtcggcggcacgcggcactgcgactggtggttcacgaacgacgcggtgctgatcgacaccgcgggccgctacacgacgcacgagagcaaccgcgcgctcgacgaggccgaatggaagggcttcgtcgatctgctgaagaagtaccgcgcgcgccagccgctgaacggcgcgatgctgacgatcagcgtcgccgatctgctcggcgcgtcggaggcggagcgcacgcagcacgcgatggtgctgcgcaagcgcctgctcgagctgcgcgcgcagctcggcatccgctttccggtgtatctgctcgtgacgaaggcggatttgctcgccggcttcgccgaatacttcggcggcttcggccgcgccgaatgcgcgcaggtgtggggcttcacgttcccgctcgccgagagcgaagcgcccggcttcgagctgcgcgcggcgttcgaccgcgaataccggctgctgcaccagcggctgaacgacgggctgccggagctgctcgcatcgcagaccgacgcgcgccagcgcgagatgacctacctgctgccgcagcagatcgccgatctgcaggacatgctcggccagttcgtcgccgaggtgttctcggtgtcgagcttcgagccgatgccgatgctgcgcggcgtctatctgacgagcggcacgcaggaaggcaccgcgttcgaccgcgtgatgagcgggatcaagcgcttcctgaagatcgagggcgtgccgcccgccgcgcagacgggctcgtcgggccgcagtttcttcctgaaatcgctgctgcaggatcacatctttcgcgaggcggcgcttgccggcagcaatctgcgctggcatcagcggcagcgtgcgctgcagatcgtcggctacgcggcgatcgcgctgctgtgcgtggcggtgctgttcgcgtggctgcgcagctactcgcgcaatcgcgactatctcgacgaggtcgccgcgcgcgtgccggcggtcgacgcgcagatcggccgcgcgaaattcacgggcgcggccgacatcgtgcagctgctgccggtgctcgacgagctgagcggcctgccgaacgcgggcggcgtggacttgcggcatccgccgctcgcgtatcgctggggcctgttccagggcgagaagatcgaggaggcgagcgacgccgtctaccggcgcgcgctcgacgacgtgctgctgccgatcgccgcgagccggatggagcaggcgctgcgcgacgcgcggcccgacgaggtcgagtatgcgtacgcggcgctcaaggcgtacctgatgctttacgacagcgcgcactacgatcccgcgttcgtgcaggccgtcgtcgatctcgagatggagcgcgcgctgccggccgatttctcgtccgcgcagcgcagcgcgctgcgcgcgcatctcggcgcgctgttcggcaatcgcgtcgcggtgtcgccgtttccgatgaacgagcggctcgtcgccgacgtgcgcgagcggctgcggcaggtgccgttctcgcagcggctgtatcggcagctcgcgcgcacgctgcacgcgagcaccgcgtcgtacgatttcagcgtcgcgcgcgcggtggggccggacgcgtcgctcgtgttccggcggcagagcggcaagagcctcgccgacggcgtgccgggcctctacacgcgcagcggctaccgcagcgtgttcgcgccgcgtctgcttggcgcgatcgattcgtacgggcgcgaggaggtgtgggtgctgaacctcggcgcgtccgagatcccgaatccggccgacgcggccgcctgggcgcgcgacatccggcagctctacctgaacgactacatcaagacctgggacgactatctggccgacatccggctgcagcgcacgtcgacgctcgcgcagagcatccaggtcgcgcgcacgctgtcgtcggccgattcgccgctcacgcggctgatggtcgcgctcgcgcgcgacacgccgctcggcgatgcgcccggcggcgcgcgcaatctcgcgtcgcgcgcgcaggacaaggtcgacgaggcgcgcaactcgctcgcgcagatcttcgccgggcagccgggcggcgaagcgggcgcggcggccgcgccgcccgcgagccccgagcagatcgtcgacagccacttcgcggggctgcgcgcgttcgcgccgggcggcggggatcaggcggcgtcgttcgacgcggtgctcaaggcgatcgacgcgctgtacacgtacctcaccgcgaccgacgacgcattgcgcagcggcgcggcgccgccgccgtcggacgcgcccgcgcggctgcgcgcgcaggcgggccggttgccgacgcctgtgcgcgaggtgctcgacgatttgtcgaacgtcgcgaacggcagcatcgcgagcgtcgagcagcgcaacgtcgcgcagcgcgcgggcgcgaacgtcggcgatttctgccggcaggcgatcgccgggcgctacccgttcgcgcgcggcgcggcgcgcgacgtcgcgccgtccgatttcgcgcagctgttcgcggcgggcggcctgatggacgacttcttccagaagaacctgcaaacgctcgtcgacacgaccgcgcatccgtggcgtttcaacaaccgcaacgccgaagccgacccgtcggcggccgcgatgctcggctcgttcgagaaggcggcggtgatccgcgacgtctatttcggaggcggcgcgcggaccgcgcagatcaaggtcgagatcgtgccgctcgaaatggacccgtcgatctcggagatgctgctcgacgtcgacggccagatcgtccgctacgcgcacggcccgcaggtgccgacggcggtgcagtggcccggcacgcgcggcagcaatcaggtgcggctgcaggtgaccgagcagtcgggggcgacgggcggcttcacgaccgagggcccgtgggcgctgcaccggctgttcgaccgcgcgggcgtgtcgggtgggcgcggacccgagcagatggtcgcgagattcgcggtcgacggcaagccgatcgtgctgcaggtgacggcgagcagcgttcgcaacccgttccggttgccgcagatggagtcctttacatgtcctccgaagcaatga

SEQ ID NO: 2042 - DNA, 3627 bp, Burkholderia 383
atgaaccaggctgtcgcgcgtttcgtccggccgttgccgtcgcgggagatctggactttcgccggtctcgtcgtgctcgcgtgcttcgtgtggctcgcaggcccgctgttcgcgttcgccgaggtccggccgctcgaaagcggctgggcgcgcgggctcacgatcgcggtgctgttcatcgcgtggggcgcgcgtgtcgcatggcgcagctggcgcgcgggccgcctcaacgcgcagttgctgaaccagctgcgcgaggccgctcccgggccggccaccgccgacgatccggcaaaggcgcagctcgacgagttgcgcagccgcttcgacgaggccgcttcgctgctgaagaaggtgcgcttcggacaggccgacaccgtgcgcaagggcctgccgcgctggttcgaccggatgtcgcgccagtatctgtatcagctgccttggtacgtgttcatcggcgcgccgggctcgggcaagaccaccgcgctcgtgaattccgggctcagctttccgctcgcggagcagttcggccgcgcggcgattcgcggcgtgggcggcacgcggcattgcgactggtggttcacgaacgacgcggtgctgatcgacaccgccggccgttacacgacgcacgagggcaatcgcgcgctcgacgaggccgagtggaaaggcttcgtcgacctgctgaagaaataccgcacgcgccagccgctgaacggcgcgatgctgacgatcagcgtcgccgacctgctcggcgcgtcggaggccgaacgcacgcagcacgcgatggtgctgcgcaagcggctgctcgaactgcgcgcgcagctcggcattcgctttcccgtgtacctgctcgtgacgaaggccgacctgctggcgggcttcgccgagtatttcagcagctacggccgcaccgaatgcgcgcaggtgtggggctttacgttcccgctcgcgcagagcgaggcgccgggtttcgacctgcgcgcggcgttcgaccgtgaataccggctgctgcaccagcggctgaacgacggactgcccgaactgctcgccgcgcagaccgacgcgcgccagcgcgaaatgacgtacctgctgccgcagcagatcgccgacctgcaggacatgctcggccagttcgtcgccgaggtgttttcggtgtcgagctacgagccgatgccgatgctgcgcggcgtctacctgacgagcggcacgcaggagggcaccgcgttcgatcgcgtgatgagcggcatcaagcgtttcctgaagatcgagggcgtgccgccggtcgcgcaggtcggctcgaccgggcgcagcttcttcctgaagtcgctgctgcaggaacacatcttccgcgaagccgcgctcgccggcagcgacctgcgctggcatcagaagcggcgcgtgctacagatcgtcggctacgtgctgctcgcgctggtgtgcgtggccgtgctggtcgcgtggctgcgcagctattcgaacaatcgcgcgtatctcgaccagatcgccgcgcgcgtgccggccgtcgatgcgcagatcgccggcgcgaaattctccgatgcggccgacgtcgcccgcctgttgcccgtgctcgacgcgctcggcaacctcgcgaatgcgggcggcgtcgacctgcagcatccgccgcttgcgtatcggtgggggctgttccagggcgagaagatcgacgaagccgtcgacgccgtgtaccggcgcgcgctcgaagacgtgctgctgccgatcgccgcgcgccggatggaggccgcgctgcgcgacgcacggcccgacgagaccgaatacgcgtatgcggcgctgaaggcgtacctgatgctgtacgacagcgcgcactacgatcccgcgttcgtgcaggccgtcgtcgatctcgaaatggaacgcgcgctgccgcccgatttctcgccggccgaacgcaccgcgctgcgtgcgcatctcgccgcgctgttcggcaaccgtgtcgcggtgtcgccgtatccgatgaacgagcggctcgtggccgacgtgcgcgaccgcttgcggcaggtgccgttctcgcagcggctgtaccggcagctcacgctcacgctgcggccggccacgtccgcgttcgacttcagcgtcgcgcgggcggtcggccccgatgcttcactggtgttccgccgccagagcggcaagccgctgtcggaaggcgtgccggggctctatacgcgcaacggctatcgcaatgtgttcgcgccgcgcctggccggcgaggtcgacacctacgggcgcgaggaagtgtgggtgctgaacctcgggttgtccgagattccgggcccgaacgacgctgccgcgtgggcgcgcgatatccgccagctctacctgaacgactacctgaagatctgggacgactatctcgccgacatcaagctgcagcgcacggcgacgctcgcgcagagcatccaggtggcgcgcgcgctgtcgtccgccgattcgccgctcacgcggctgatggtcgcgctcgcacgcgataccgcgctcggcgatgcaccgggcggggcgcgcaatctcgccgcgcgcgcgcaggacaaggtcgacgaggcgcgcagctcgctgtcgcagatcttcgcgggccagggcagcgattcgagcgcgtccgcggcggcgcccgcgagcgccgagcagatcgtcgacagccacttcgccgggctgcgcgcgttcgcgccgggcagcggcgaccaggcccaggcgttcagcgaggtgctgaagtcgatcgacgcgctgtacacgtacctgacggccaccgacgacgccttgagaagcggcgcgcaaccgccgccgtccgacgcgccagccaggctgcgcgcacaggccggccgcctgccgacaccattccgcgaagtgctcgacgacctgtctaacgtcgcgaacggcagcgtcgcgactgtcgagcagcgcagcgtcgcgacgcgggccggtgcgaacgtcggtgacttctgccggcaggcgatcgcgggccgctatccgttcgcgcgtggctcgtcacgcgacgtcgcgccggcggatttcgcgcagatgttcgcgcccggcggcctgatggacgacttcttccagaagaacctgcagtcgatcgtcgatacgacgtcgcacccgtggcgcttcgcgaaccgcaatgcggacgccgatccgtcggccgccgcgatgcttgcttcgttcgagaaggcggcggtgatccgcgacgcctatttcggcggcggcgcacgcaccgcgcagttgaaggtacagatccagccgctcgaaatggacccgtcgatcacggagatggtgctcgacgtcgacgggcagatcgtccgctacgcgcacggcccgctcgtgcagagtgcggtggactggccgggcccgcgcggcagcaaccaggtgcggctgcaggtgtccgggcaggccggcgcgaccgacggcttctcgaccgacgggccgtgggcgctgcaccggttgttcgaccgcgcggccgtgtcggccggacgcggctcggaccagatgattgcgcggttcacggtcgacggcaaaccgatcgtgctgcaagtgaatgcgggcagtgtccgcaacccgttcaggctgccccagatggagtcctttacatgccctccgaagccatga

SEQ ID NO: 2043 - DNA, 3630 bp, Burkholderia thailandensis E264
atgagccacgctgtcgcacgcatcgttcgcccgctgccgtcgcgggaaatctggacgttcgccggcctcgtcgggctggcgtgcttcgtctggctcgccgggccgctgttcgcgttcgccgagttccacccgttcgagagcggctgggcgcgcgcgctgacgatcgccgcgctgttcgtcgcgtggggcgcgcggatcgcgtggcgcaactggcgcgcgggccagctgaacgcgcagttgctgaaccagttgcgcgaagcgtcgccgcggccggccgcgccgggcgaccccgcgcgcgcgcagctcgacgagctgcgcagccgcttcgacgaagcgtcgacgctcctgaagaaagttcgcttcggcgccgccgacggcgcgcgcaagggcctgcctcaatggctcgaacggatgtcgcgccagtatctgtaccaactgccgtggtacgtgttcatcggcgcgcccggctcgggcaagacgacggcgctcgtcaactcggggctcagctttccgctcgccgagcagttcgggcgcgcggcgattcgcggcgtcggcggcacgcggcactgcgactggtggttcacgaacgacgcggtgctgatcgacaccgcgggccgctatacgacgcatgagagcaatcgcgcgctcgacgaggccgaatggaacggcttcgtcgatctgctgaagaagtaccgcgcgcgccagccgctgaacggcgcgatgctgacgatcagcgtcgccgatttgctcggcgcgtccgaggcggagcgcacgcagcacgcgatggtgctgcgcaagcgcctgctcgagctgcgctcgcagctcggcattcgctttccggtgtacctgctcgtgacgaaggcggacctgctcgccggcttcgccgaatacttcggcggcttcggccgcgcggagtgcgcgcaggtgtggggcttcacgttcccgctcgccgagagcgaggcgcccggcttcgacttgcgcgcggcgttcgatcgcgaatatcggctgctgcacaaacggctgaacgacgggctgcccgagctgctcgcgtcgcagaccgatgcgcaccagcgcgagatgagctacctgctgccgcagcagatcgccgatctgcaggacatgctcggccagttcgtcgccgaggtgttctcggtgtcgagcttcgagccgatgccgatgctgcgcggcgtgtacctgacgagcggcacgcaggaaggcaccgcgttcgaccgcgtgatgagcgggatcaagcgcttcctgaagatcgagggcgtgccgcccgccgcgcagacgggctcgaccggccgcagcttcttcctgaaatcgctgctgcaggaccacatcttccgcgaggcggcgctcgccggcagcaatctgcgctggcatcggcggcagcgcgtgctgcagatcgtcggctacgcggcgatcgtgctgctgtgcgtcgcggtgctgttcgcgtggctgcgcagctactcgcgcaatcgcggctacctcgaccaggtcgccgcgcgcgtgccggccgtcgacgcgcagatcagccgcgcgaagttcacgggcgcggccgacgtcgtccagctgctgcccgtgctcgacgagctgagcgggctgccgagcgcgggcggcgtcgatttgcggcatccgccgcttgcgtatcgctggggcctctttcagggcgagaagatcgaggaggcgagcgacgccgtgtaccgccgcgcgctcgacgacgtgctgctgccgatcgccgcgagccgcatggagcaggcgctgcgcgaagcgcggcccgacgaggtcgagtacgcgtacgcggcgctcaaggcgtacctgatgctctacgacggcgcgcattacgatcccgcgttcgtgcaggctgtcgtcgatctcgagatggagcgctcgctgcccgccgatttctcgtccgcgcagcgcagcgcgctgcgctcgcatctcggcgcgctgttcggcaatcgcgtcgcggtgtcgccgttcccgatgaacgaacggctcgtggccgacgtgcgcgagcggctgcggcaggtgccgttctcgcagcggctgtaccggcagctcgcgcgcacgctgcgcccgagcaccgcgacgtacgacttcagcgtcgcgcgcgcggtcgggccggacgcgtcgctcgtgttccgccggcagagcggcaagagcctcgccgatggcgtgccgggcctctacacgcgcgacggctaccgcaacgtgttcgcgccgcggctgcccggcgcgatcgatgcgtacgggcgcgaggaggtgtgggtgctgaatctcggcgcgtccgagaccccgaatccggccgatgcggccgcctgggcgcgcgacatccggcagctctatctgaacgactacatcaagaactgggacgactatctggccgacatccggctgcagcacacgtcgacgctcgcgcagagcatccaggtcgcgcgcacgctgtcgtcggccgattcgccgctcacgcggctgatggtcgcgctcgcgcgcgtcacgccgctcggcgatgcgcccggcggcgcgcgcaacctcgcgtcgcgcgcgcaggacaaggtcgacgaggcgcgcaattcgcttgcgcagatcttcgccggccagccgggcgcggacgcgggcgcggcggccgcctcgcccgcgagccccgagcagatcgtcgacagccacttcgcggggctgcgcgcgttcgcgccgggcggcggcgatcaggcggcgtcgttcgacgcggtgctcaaggcgatcgacgcgctgtacacgtatttgaccgcgaccgacgacgcgctgcgcggcggcgcgacgccgccgccgtcggacgcgcccgcgcggctgcgcgcgcaggcgggccggctgccgacgccgtttcgcgaggtgctcgacgatctgtcgaacgtcgcgaacggcagcgtcgcgagcgtcgagcagcgcaacgtcgcgcagcgcgcgggcgcgaacgtcggcgatttctgccggcaggcgatcgccgggcgctatccgttcgcgcgcggcgcgtcgcgcgacgtcgcgccgtccgacttcgcgcagatgttcgcggcgggcggcctgatggacgacttcttccagaagaacctgcagacgctcgtcgacacgaccacgcacccgtggcgcttcaacaaccgcaacgccgaagccgacccggcggcggccgcgatgctcggctcgttcgagaaggccgcggtgatccgcgacgtctatttcggaggcggcgcgcggaccgcgcagatcaaggtcgagatcgtaccgctcgaaatggacccgtcgatctcggagatggtgctcgacgtcgacggccagatcgtccgctacgcgcacggcccgcaggtgccgacggcggtgcagtggcccggcccgcgcggcagcgatcaggtgcggctgcaggtgaccgagcagtcgggcgcgacgggcggcttcacgaccgaggggccgtgggcgctgcaccggctgttcgatcgcgcgggcgtgtcgggcgggcgcgggcccgagcagatggtcgcgagattcgcggtggacggcaagccgatcgtgctgcaggtgacggcgagcagcgtgcgcaacccgttccggctgccgcagatggagtcctttacatgccctccgaagcaatga

SEQ ID NO: 2044 - DNA, 3474 bp, Jannaschia CCS1
atgaacccccttggcatgtggaccacgatccgctcaaacgtccagtcctacgcctctgtgcttggaccgcgctttgcggcgctgatctgggtcggcgcgatctgcgccgtgatctggatcttcggcccccgtctgccctggggcgacacgcgcccgctggagcccgcccgcatccgtctgatcctgattgcagtgatccttggtctctggctgatttatgcgctgatttcctggctgcgcggacgcaaacgcgccgcgtctgaggacgcagccatcaccgaaagccccgaggcggtcgccgccggcgaggcccgggaagagattgcggaactccgctcccgtctgcgcgatgccctcaagatgatgcgcaaacacgcgcggcggcggtttggctatgcctatgactttccatggtatttgatgatgggcgcgcccggggcgggcaagacgacgctgctgcaacgctcgggcctgaagttccccctcggcgatgcgttgcgggcagagccggtgcagggcgtgggcgggacgcgcaattgcaactggtggttcaccgaccgcgccatcctgatcgataccgccgggcgctataccacgcaggaaaccggacaggcccgcgaccgcgaagggtttttgggatttttatcgatgctgcgccgcacccgtcgacagcagccgatcaacggcatcgtgctgaccctgtcgctgacggaccttctggcccaggaccccgaagatcgcctgcgcgacatccgcgccatccgccagcgcctgaccgagacggaagaggcgcttggcgcgcgcattccggtttatatggtgttgaccaaggccgatcgtctgaccgggttttcgcgctttttcgatagtctcggccagcaggcgcgcaagcaagtctggggcatcacctttccatatgaggaggcgcagacaaaaggcaccctccccgacattttcagccgcgaatatcaggggcttctggcacgcttgaatgcgatgctgatcgagcggtttcagcaggaaaccgacatcgaccagcgcgggcgtatcttccggtttcccgcccaggtcagcgcgctccatgatgccctgcgcgagattgtggaagagctgtcatcgggggccgcaaatgtgtccgagccgttgttgcgcggcatctactttgcctccgccacgcaggaaaacgcaggtcccgtcgccgccatcccaggcgtgcctcaaaccgccgccgcgatgaaccgcacctatttcgtggagcggttattccgcgaagtgatcctgggagaggccgcgctggtgggccgcgacgcccgcgtcagccgccgtcgccgcattgcgaccggcctggcctacggggccgcggcatccttggcactgttcctgcttggcagctggacccttggcttcagcaccaaccggcaggcgttggccgccattgatactggtctcgtgaattacgaagatctggccgacacgatccccgtgcgcgacgtggccgacgccgatttcctgcgcgtcctgcctgcccttgaccgtctggcgcggacgccggacgcctttcacgtggcagaggggccgggcctgaccatgcgccgcgccagctttggcatggaccgctccgcccggatcgagtctggccacgcggaggcctattccgaggcgctcggcgcgttcctgctgccccgctacatggtcgccctgcaaaacgtgctgcaagacggcgaaaccgacgaagccactgcgttcgagaccttgaagcattacctttcgctcgccgggctggggccgattgatcgcgacggtcttctggcccaatcggaacgtctgtttgaccagctttaccccggctccgggcgcgggcccacgcgcgacgccctgcaagcgcatatggtcgccatgctggatcgcggcacccttccggtgctggaaattgacgagatgctggtggaagacacccgcgcccgcatcgccgaacgcagccccgcccaacgtgtgctggatctgctggccgaccgccccgctgcccgcgccattcccgactggacgctcacctctgccgccgggccccgggcgcgtcaggtgtttgtgggcgacggcaccgtgatcgacgggctctatacccgcgcgggctaccgtgaggttcttctgccccgcatcggggccctgtccgaagtcgctgtgcatgaggattgggtccgcggacccggcacgcccacccgtgccacgccgtccgatatcgccgccgatgcggtgacgctctactatgccgcctttgaaagccattggcgcgcggcgctcagtggattgtccatcgtgccgaccgaggccctgtccggtgcggcggatcttgccctgaccctcgcgtccgaggcagatcccctcagccgtctggcccgcgacatcgccgcgcgcaccgacctgataaccccgtcgcccatcgatgatttcgacgcctcggccctgcccttcgatccggccactgccccggacccctacggccccctgcgccggtcactggagcccgaggaggacgccgaaggcaacacaacggacgcccttactccgctggtccccctctatgacgagatctaccagcagctcacccggctggattcgcctgatcccgccgccgccgcagcactggcatctgagaccgccttgcgggatgccgcgcaatcgctggtggccgaggggcggcagctggatgcccccatcgacgccttcgtcgtcaccatcgccgcccgtgtatccgaggccgccgtgggtcaggcccgcgccgccgccgatgcgctgtggcaggccgagggctacccgatgtgtgaccgtgccatctcggaccgctatcccttcagccccgccgcctctgccgatgtgacgctgactgatttcaccgctgtcttcggcccaaatggcctctttgccaccttcttcgccgagcatctcgctgacctcgtcaacaccaccgccgatccctgggtctggtccgggggtcttgcgcccgatggcgacatccagaccgccctgcaccagtttcagcgcgccgcccagatccgcgccgccttcttccccaatggcgtggccgaaccgcgggtggaactgcgcgtggaccttatcgctctggaacagggcgcgcgggtggcgctgtttgaaatcggtgatcgcaggtcagcccaccgcgaagatctgtccgatgaagaacgcctgatctggccgcccgaggattctgacatcgcccgcgtcatgctgctgcccggggaccgggaaaccgcccccacggaacgcggcccctgggcccccttccgcctgatcgaccgcgccgaagtgacccccggcaccgacaacgaatttcaggcgcgcttcaccgtcgatggccgtgcggtgacattcaacctgacctcgggcagcgtgaacaacccgttcaacctgcccgcgttgacggcgttccgctgtccccaatctctcgcggcccaatga

SEQ ID NO: 2045 - DNA, 3546 bp, Saccharophagus degradans 2-40
ttgaaacgttttttccaacaatttacccagccctggtttctttctcttttgggcgtacttttgctgtgcttgattatttggtacatagggccacttatagcaattgcagagtacaaaccacttagcgccgagtgggtaagattaagcatggtatttgttgcccttatactttggggcttaaataatttacgtaagagaaccagaacaaaccaagccacagataaattggcaaatgctattgcggaagatgccaagccagctgctagcaaaaccaagaaggtaccatcggccgatgaacaaattttagaatccaaccttcaaaaaagccttggcttgctacaaggtagtggctttggcaaagacaataaactgtataagctgccatggtatatggtaatcggcgccccaggctcaggaaaaaccacagcgttaaagaattctggccttaacttcccgctgcaaaataaacttggcgacgcccccattcaaggcgaaggcggcacacgctactgcgactggtggtttaccgaggaagccatattaattgacaccgccggcaggtacaccacgcaagacaacccacaaactaaagacagtgaagcgtggcttggctttttagcgcgccttaaaaaagcgagacccaagcaacccttaaacggcataattgttactgtaagcatacaggatattctgcaaaagacgcccactcaaaaagctttacaagcaacggcaataaagcagcgcgtacaagagctcaacaatcatttaaacatgaaaataccggtgtatttggtattaagcaaactcgacatggttgcaggctttaacagctttttctctgatttagaagcgcaagacagagaacaagcatgggggtttacctacagccagttcaaagcgggcgatatttctgctactgaagaagtgtttaacaatgaatttgatttactactacaacgccttgaagaccgtgtgctatctcggctaaataatgagcacagcccacaaaagcgtgcattaatctacgagttccctcgtcagatgcgcgcacttaaaactgagattcttaagtttgtagcccctatttttacccccaatcaatttgaaacccctattatgtggcgcggcttatacctgcttagtagcacgcagagcaatatggcttcgcgctgggtaacaggtattttacccccagaacaatgcgcgcccccaattgacataattggcattcaacctaaaacctatttcgttaataacttacttaaaaaagttatctttgctgaggccaacctagcaacactaaacgacaaaatgcgcgctcgttaccgctggatatacactggcctaacaggctgtgctattgctgctttttcttgcttggccatcgcctggtcgcacagtaaaaccttaaataaggattacattcacgaaattgaagaccagctagaaaagtattctaaaattgataaaaaacaaaatactgcagtgcgagactggcacaacctcgccttaaaactaaacctactgcgagacttacccacaggctatatgcttaaagatagccaatatacctttaaacagggttttggtttataccaaggtaacaagttaggtgaacaagccgaaaccacctataaaaaagcgctcgaatcgttttttatgcagcacttagaagaaatgctaggcgaacagcttgagcttgctaaaaatgacgatgagcgactgtacgaagcccttaagttctacttaatgccctaccactccagcaaaatggatacagacagttttaccttatgggtaaacattctatgggagcgccaactacctaatcaaaacaagcaagttttattaagtgagttaaatagccaccttaaaactgcgctaagcgaaaaagtatccccgtttcctatcgacgacactaaagtcgaaatggcccgtaacatacttataaaaaccccgcttgatctacgcgtataccgacgcttaaaaaatgattacatggatcttcatccagaagagttttcgatcaaaagcgtattaggcaaaaaagcagatgcaatgttttatagaaaaagtggaaaggctcttgaaaatggcattccagaattattcacctattctgggtttcatcgagggtttaacttagagaacattaaattatcgcaacgcctagccgatgaacaatggatttatggcgacaaacaagaagaggcgcttactgaagagcgcataaaagaaataagcagcagagtaaaccaatattactttaacgagtatattgcgcgctgggatgaatacctaaacgatgtagctattcaatcgtttggcaccgttaaccgaggccaatctgtggtgcaaatgcttgccagctctgaccaaccgctggttaaactgcttgttcaaattcgcaaacataccgcactaagcgaagcgcctgttattagcgacaacatgaaagattccgctaaccaattagctgaagaattttccagcagtcaaaaaggtagactcgaacggttagtgccaaaatctgcggggcttagtaatataaaactccccggcttcgacgtaaccgagcatttcgaagacctaaacagctatataaatactgaagaaggcctgcctttactgcagttacagcaagctttaattaatttagacgactactttcaaaacttagcttattctgaaaacaccaaacaagccgcatttgacgctagtaaagaatggaaaggtggcagcagccctgttgtatttgtacagcgcgctatatccgatgcaccacctcaaattgaaacttggttctcatctattgcaagagataccgcgcaggttaccgcagcagctacccaaagccatatgaataatatttggcaaacagaggttgtgagtttttataatcgtgcgattaaagataaataccccttaaacccaaaaagtaagcgtgatgttaaactagcagacttcacaaaattttttggccccgccggcatattagattcctactttgtggaatatatagaaccctttgtagacacatctaaacacccgtggcgctggaagaaaaatataggccttagcacaaacagcctagaacttttttatcaagcccaaaacattaaaaatgcctacttctcggataaaagcggcgaaccagaagttgcattctcgatgaagccgcacacactcgaccatattgccagtggctttttactagaaacagcaggtaccactatcgcctacaatcacggcccagtgcgcaatgtaaatgtactatggcctggcgcaaaaacagacctatctaaaattgtttttagcctgtccagtaaaggcaccccaattagcgctcgcaccgaaggcgagtggagctggtttagactgctagacgaacacagcaagatagaacgcaagaaagaatccgacggattattggttacttttgaactggatggaattgcttcggcttatatcattcagcccgcaagtaccgacaacccttaccataataaagatgtgcaaaagtttagcttgcccacacagctgtaa

SEQ ID NO: 2046 - DNA, 3522 bp, Rhodobacter sphaeroides 2 4 1
atgcgcgcgctccgcctcctcctcgccgccctgacctcgcggacgctctggaccttcctcgggctcgcgctcctctgcgggctggtctggcagttcggcgcgctggtctcggtgggcgagacggtgccgctcgcctccgacctcgcgcgcgggctggtcgtgggctgcatcgcggtgggctggcttctgtcgctgctggcagcccagctgcgggcggcgcgcaggaaccagctcttcgtgaccgagcttgcggcgcccgcgcccgccgcccccgatcccggcgcggcggccgtggccgaggtcggggcgcggttccggcaggtgatggccgagatgaaacgctcgcgcgtgggcgggcggcgctttctgcgcgacatgccgtggtatctgctgatcggcccgcccggcaccggcaagaccacggccctgcgccagtcggggctgcatttcccgatcgatcccggcgacgacctgcaaggcgtgggcggcacgcggaactgcgactggttcttcaccgaacaggccgtgctggtggacaccgccgggcgctacgtccagcagcagagcgatcccgaggccgatgcggcggaatggtcgggttttctggaccttctgaagcgccaccgcgggcggcgggcgctgaacggcgtgatcgtggccctgtcgatgaccgagctccttgggcccgagcctgcgctgcgcgctcatggccgcgagatccgcaagcggctgagcgagctcggccagaggctccagatccgcctgccggtctatctgatggtgacgaaggccgacctcgtgccgggcttcgagaccttcttcgcgcccctgcccgcgcgcgggcgcgagcaggtctggggggcgacgctcgcgcccgacgaacgtcccgagggcggggcggtcgaccgcgaggcccgggcgctctggcaggaactcgaggcccgcgtcgggccgcggctggccgaggaggccacgctggccgaccgggccgagatcttccgcttccccgcgcggatggccgaagtcgaggcgccgctgcgggtgctgatcgccaccctcttcggcgagagccgctacgaggacagcccctggctccgcggcttctacttcacctcggccacgcaggagggctcgcccatcgaccggatgctcggggatctggcgggcgccttcggcctcagcgcgcccgcgcctccccgccgggcgcggggcgagacacgctcctatttcctgcacgatcttctggcgaaggtgatcttcccggaagccgggctcggtcgcctcgaccgggcggcggaggagcggcgccgctggctctggcgcggctcggtggcgggcgcggcgctcgccacggcggtggcggggctggggttccttctctcgttcctcggctggtcgggcgccatcgaggatcaggcgcggctgaccgcggatctctccgcccggctggccaatgtggccgcgcggcaggcgccgaccgagccgctggaccttcccctcgcgctggaagccgcgactgccgcggacgccgcgcgcacggagccgccctcgggccccttcgccctcatcggcccctcggctgcggccgagatcgagcgggcgggcaccatcgcctacgagcgcacgctggccaatgtgcttgcgccgcggatggtggcgctgctcgaggcctcgatgtggcggcaggtgcgcgatcccgacgacatgctgggcgcgctcaaggcctatttcatgctcaccggcctcgcgccctacgaccgcgacttcctgaccggctggcggcaggagcagctgccgcagcaggcggtgctcgacccgttcccgaccgaggcggcccgctggcaccagctggccgcgctttcccttttcggcacgcagggcgaccccatcccgcccgacgaggagctggtggcggcggcgctggccagcatctgcaccatccccctcgcggcccgcgcctatggcgcgctgatgcaggatcccgcggtcacgggcctgcccgactggatcccgggcgaccgcgccgggccgaacggcgcgaggatcttcacccgcctctctggcaagacgctgcgggtggggctgcccggcgccttcacctttgcgggctttcacgagacgatcctgccgctcgtgcccgaggtggccgcgcaggccacgctcgaccggaccctctttgcgggcggctgcggcggcagcgccggggcctcggccgccacgctcgaggcggacatcctgaagctctattccgacgatttcatcgcgcgctgggatgggcttctgcgcgacatccggctggcgccgctgacggacttcgccaccgccactgcggcgatgaaggatctggcgagccccgacagtgcgctgaagcggctgctcgctgcggtcgtggccgagaccgacctcacgcgcgttcccgccccagatgcggcgccgcccgagggtctcctcaaggccgccggcaagaagctcgggaaggtgggcaagctcgtgaagggggccgcggcgctgtcggcgggctccgctccgcccacggagccgccggggcaggcggtggcgcgccatttcgagccgctgaaggggatgatcgccgaggtggagggggtgccgccgcggatcggggatgccgaactcgcgctcggcgcgctggccaatgcgcttcagaccgcggcggccaatcccgatccgcaggcggcgctgaccgcgcagggggggcttgccacgctgaccggcgggctgaccgaggtcgccgcccgcctgccgccccccatcggcgcctggctcgaggggctggccacggacacggccagcgtgacgcgcgaggcggcgatcgctcggctgaacgcgcgctaccgggccgacatcctgcccttctgccgcgccgccaccgcgggccgttatccgttcgagccgggctcggccatcgatgtgaacacagccgatttccagcgcctcttcgggcccggcggcctcttcgacggcttcacgggcgacgcgctcgggccctggatcgatacgacgcggcacccttgggcctggcgcgccgatctggggctcgatgcccggagcctcgcgcccttcgaggccgcccggcggatgcgcgacggtctcttcgccggaggcatcggcccggtgatgggcttcctgcttcaggcgacggacctgtcgcccaatgccgcccgggtgacgctgagcctcgacggccagcagcttgtctacatgaatgcggccacgccccccgtgggcatgacctggcccggccagaacggaacgaacctcatcgtgctctccttcacgccgctcgacgggtcggccgaggcggtgacctcggaatccggcgcctgggcctggctccggctgatcggcaagggcagcctcgcgcccaccgcgcagcccgacctgttccggctgcgccttgccgccggagcctatgccgcgcgcttcgatctccgggcgaattcggtggagaacccgctcgacctcaggctcttcggcgggttccgctgcccggatggcttctga

SEQ ID NO: 2047 - DNA, 3549 bp, Shewanella frigidimarina NCIMB 400
atgtctttaaaatcaattggcaaaggaattgtcgacacacttaagtctaaatgggcaattaccataataggttttttatgtttggctttacttatttggtttggtggtcctttagtggctatagctgggtatgaaccattagcatcagcagcaacacgggttatcttactactggttattgttattatttttggtgccattcactttactcgacaactcaagaataaaaaacaaagcgagaaaatggttgatagcttaattaacggtgaagagggtaactctgtgaccggtgatgacttagccaaaagtgaaatcactgttttacagaataaaatgacccaagcgttagatattcttaaaaataccaagctaactaaaaataaaagtatttacgaattaccttggtacatcatgattggtccgccaggaagtggaaaaaccaccgcgattcagcattcaggtcttgaatacccattaaaagaaaaaatgggtgtagatatgattgaaggcgttggcggtacaagacactgtgattggtggtttaccaataaagcagtattaattgatacggcgggtcgttataccactcaagatagtcatgtaaaacaagactctcgggcatggcaaggttttctggggttattgaaaaaatatcgccctgttcgtcctattaatggggtgataatcagcatgggtatgtctgatttattaaaccaaaccaagactgagagaaacttacatgcgcgagcaattaagcagcgtttacaagaactgcaaaatcaactgggtatgacttttccggtatatgttttattttctaaatcagatttagttgccggttttaatgagttttttgatgatttaaccaaagaagattgtgaacaaatttggggtattaccttcccattaaatgcagatacagaagacactgatattgttagttcatttaataaagaatttcatgatttattattaaatttaaatgcaagattaaatagccgcctaaaaaacgaacgcgacctagagcgtcgtgcggccatctatgagtttccaaagcagcttcggttattacagagctcagcagatgattttcttaaagaaatttttgcgcctaatgcatatgaagaagcaccgctattgcgtggtgtttacttaaccagtgcaactcaagaaggtacgccaatcgatcatctttctagtcacttatctagtggcattaagagtaaagctaaaaccttcgccgcaaataaacaacgcagctattttattaaacgcctgttagaagacgttatttttccagagaaaaatttagcatcaaccaatcgaaagcatacaaaccataataaacttttacgtaaagtatcagtaggcattgctgcaggtgtgaccttgcttgctagttatgtttggtggcaaagttatgattggaatagacaattgattgatgatacctatcaaggtgtcacgacatacaaaaccattaccagtggtgggttaaatgctaagtcagatgtgattacacttaccaaaggcttaacattaattcgtgatctccctgttggttttggtactgataaacctgaggatgcatatacctttggtttgtatcaaggagataagcttaaacaacctgctacagcggcttatcaccgtgctttagaaacacatttaatgccttacctacaaagtgtgcttagtgcagaaatggacgctaatggtgagcaccttaactacctatatgaaacattaaaaacctatttaatgttgtattttcctgagcattttgacaaaagtgatgtgcaagtctggttctccgcttatatcgatagaaacattgttggtgatgtaaatggtgaggttaggaaagagctaaataagcatatagatacattactgtctttaggggttagaggtcatcaatacgacagtatgacagttgatagtgctcggattaatttgaccatgttacctctggttgagcgcgcatatcagcgtttaaaaagtgatttttcaaacagcagtatcccagattttaaactggttgatattctgagtttagacagtttagatggtttggtgttcaccagtggtcgccaatttaatcaaggcattcctggtctttatacttttaatggttttcatggcatttttagtatagaaaagaataagataataaaaaacctaaccgcagacagttgggtatatggtgatgagttagttgatttagacgaacaagccaaagcgcagattacccaagagttagaaaacagatacattcgtgattatattttctattgggaagatttcttaagcgaccttgctatcaaaccatattcaacacgtgaggaagctgagagtgttactgcagcacttgctagcccagatcaaccgatcaaaaccattattaccgcagttcagaaaaatgtgaatttaactaagcttcctgccgattcaaataatttaaaggccgcggcggaagtggccggtaatatttctgatgttgcatttcgatctaaaaaagcacgattaaataggctattacccgatacagcaatagagttagatattgatttgccgggcaaggatgtggaatttgcttttgcagaattgctcaaaatcaatcccgctgatattgataaaattcaaacgacgttacgcgctcttaatcgaaactacaataaattatcaatgcagtcagaaggacaaggtaacgttgttaatcaagccacagaagaaagctttgctcaactaggttctagtttatctgagcaattgatggatctaccttatccagtaaaaaattggttaagtgaagtggcttatcgtactcgctcgtttgccaaatccaatcaaagtcagcgtttcaacggtatttggcgttcgcaagtgttggccgaattcaatcgagcgattgcagggcgttacccatttgaccgaaaatcgtcagaagatgtcagactaaaagacttcagtaagttttttggttatggcggcaccttagataaattttgggatcaatacctcgcttcacatgtagataccagcaaaaaaccttggcgttttaagcgtaatatcggcattcgtaatgacattttagaaatgtatcaacgcgctgaaattattaaagaagcatttttcgaaccaggatctaagcagcctattgttaacttttcattagaaccggaattattagatagaagtgtgagtatgtttttattcgaaatagacagccaacagctgaagtatcgacacggtcctactcgcaaagagttatttacgtggcctggccctggtgcaaataacgaaacacgaattgcattttcacctcctaacggcgggcgctctatcaataagaaatatgagggtgaatggtcattcttcaaattattagatgaattaagtaaaaagcgtccacaaactaaaaaagatggcaagttactcatcaatctcaaaggctacaacgctgtactgaaattgaccgcaaacagtgttaacaatccattttggatggcaaatatggagaagtttagatgtcctgcgaacctttaa

SEQ ID NO: 2048 - DNA, 3309 bp, Pseudomonas aeruginosa UCBPP-PA14
atgcagagtctcgccgaggtcagcgcgccggacgccgccagcgtcgccaccgccgaagagctggcgaccctcaagcaacgcatggacgaggccctggccctgctcaagcgggccaagctgggcggcagcgagcggcgcaacctgtacgagttgccctggtacgtgatcatcggcccgcccggttcgggcaagaccaccgcgctgatgaactccggcctggacttcccgctcgccgcacagatgggcgccggggcgatccgcggggtcggcggcacgcgcaactgcgactggtggttcaccgacgaagcggtgctgctggacaccgccggccgctataccacccaggacagccacgcccaggtggacaaggccgcctggctgggcttcctcgacctgctcaagacccagcgcaagcgccgccccatcgatggcgcgttcatcgccatcagcctttccgacctgctgctgggcagcgacgccgagcgcgccgcccatgcccaggcgatccgcgcgcgcatccaggagctgtaccagcagctcggggtgcgcttcccgatctacgtgatgctgaccaagttcgacctggtgccgggcttcatggagttcttcgacagcctgaaccgcgaggaacgcgcgcaggtctgggggatgaccttcgccctcgacgacggcaagagcgcggaaggcccgctggcggtgttcgacagcgaattcgccctgctcgaacagcgtctcaccgcgcgcctggtggaacgcctgcagcaggagcgcgacccggcgcggcgcgacctggtctacggcttcccgcagcaattcgccgccctgcgcgaatgcctcggcgagttcctcaacggcgtgttcaagcccaacccctacgaggaacgcccgctgttgcgcggcctgtacttcaccagcggaacccaggaaggcagtccgatcgaccgcctgatcggcagcatggcgcagtcgatgaacctcgaccgccagcacctggcgcggcagaccggaaccgggcgcagctacttcatcgagcggctgttccgcgaagtggcgttcggcgaacgcggcctggtcggcaccaacccgaaggtcgagcgccgccgcaaatggctgaccatcggcgcgctgagcgccaccgcgctggtggtgctggcggtgacggcggtatggatcgccagctaccgcgccaaccagagctacatcgccgcggtcgaccagcgcgtcgacccgctggcgcgcggcatcgagtcgctgagcccggcccagcgcgacgtcctggccgtactgccacagctcaacgcggtgcagaatctcgccggcgacgcgccaagctgggccgaaggctacgggctgtaccagggcgacatgctcggcgaggagtccgccagcgtctaccgcaagctgctgatcgcggtgttcgccccgcgcctggtgacccgcatcgaggaacagttgcgctccggcggcagcagcgatttcctctacgagggcctgaaggcctacctgatgctcggcagcccggaccattacgacgccgacttcatcaaggcctggatcagcctcgactgggaacgcaacctgccgcgcgacctctcgccggaacagcgccaggcgctgcacgcgcacctcgacgcgttgctcgaacgacggccgccgtcggcgcgcctggaccaggacctggtcgaggacctgcgccgccagttgcagcaactaccggtggcgcagcgggtctacgaccgggtcaagcggcagaggctgcccaaggacgtgcccgacttccgcatcagcgacgccgccggccgcgacgcaccgctggtgttcgcgcgcaagagcggcaagccgctcaccgacccgctcagcggcttcttcacctaccgcggctatcgcgaggtgttcctcaccgccagcctcagccaggccggcaccatcgccgaggaacagtgggtgctcgggcgcgacctgaacgatgccggcgatgccgccaacctggccctcgacgtgcgtcgcctgtacttccaggactacctgcggcaatgggacgacctgctcgccgacctcaccgtggtgccgatcaccaacgtcacccaggccgccgacgtgctgcgcattctctccgggccgacctcgccgttccgcaagctgctcgaggcggtggcccgcgagaccgacctgcagaagggcgaccggctggtcgccgcgcaagtgaagaaggccgccgacggcaccgtggacaagctcaagcagcgcctcggctcgctggtcggccaggaggaggaggaaggcgcccgcgaacagccgcagcaggccgacagcgacccgatcagcgcccacttcgccgaactcaacagcctggtcagcaagggcgagggcggcaacgagccggcgccgatcgacagcctgctggaggacatgaacgcgctctacgtacaggtcagcgccatggccggagccagcggcgactcgctgctcggcgacgccaagaaccaggtggccgccgccgcctcgcgcgtggccctcagcgccgagcgccagccgccggtggtccagggcctggtgaagaacgtggtcaactccaccaccagcagcatgatgggcagcgtgcgcaaccagctcaacgcggcctggatcagcgacgtggtcagcgtctaccggcagtccctggccgggcgctacccgatcgccgccggcagctcgcgcgacgccaccctggaagacttcggccacttcttcggtgccggtggggtgatggacagctacttccgccagtacctgcaaccctacgtcgacacctccgccagcacctggcgctggcagcccggcgcggcgcagaagctcggcatcaaccccggcgtgctgcacaccttccagcgcgcggcggcgatccgcgacgccttcttccgctccggcggcatgcagccggcggtgcgcttcgaactcaagccggtgaccatggacgcggcgatcagccagttcatcctcgacctcgacggccagcagctgacctacgaccacggccccgcccgcccggtggcgatgcagtggccgagcgccaacggcctcggcgtggtccgcctgacggtgacgccgccgcccagcagcggccgttccggcctgaccctggagggcccctgggcctggttccgcctgctcgaccagtcggacctggaacgcggcaactcgccggaccgcttcaccctgcggctgcgcatcgacggctccagcatcgcctgcgagctgcgcgccagcagcgccttcaaccccttcaagagccgggtcgtgtccggcttcagcctcccggagcgcctttga

SEQ ID NO: 2049 - DNA, 3531 bp, Paracoccus denitrificans PD1222
atgcgtatcctcaaggccatattccggttcttcctgtctcgcggcttctggaccttcgtcgggctggcgctgctggcggcagcgatctggttctatggcccgctggtttcggtcggcgaggcggcaccgctggaaagcgccgaggtccgcgcgctctgcctgggcgccatcctggttctgtggctgctgatcctgctggtcggccagatccgcgccgcgcggcgcaaccgcatgttcgtcaccgaactggccgcgccaccgcccctgcccgacacgcccgatgcggcggccgagatcggcggcaagttccaggagatcctggcgacactggcgcgctcgcgcctgggcaagcggcgctttttgcgcgagatgccctggtatgtcatcatcggcccacccggcaccggcaagaccacggcgctgcgccagtcggggctgaactttcccatcgcgctgaacgacgacctcaagggggttggcggcacgcgaaactgcgactggttctttaccgaaaacgccgtgctggtcgacaccgccggccgctataccgaccagtccagcgaacccgagcgcgatgcggcggaatgggccggcttcctcgacctgctgaaaaggcatcgcggccggcgggcgctgaacggggtaatcgtcgccctgtcgctggacgagttgctgggccccgaggacgcgctgcgccgccacgcgcgcgagatccgcaagcgcctgaccgagatcgccgagcggctggagatgcagctgccggtctatctgatgctgaccaaggccgaccggctgccgggcttcgagacgttcttcggcgcgctgacctcggccgagcgggcgcaggtctggggcgccaccctgccggtcgacgccctgcccgagcccgaggcgatcacccgcgagtttcgcagcctcgccgccgtgctggagggccggctggacgcacggctggccgaggatgccgacctgccgcagcgcgccgcgatcttccgctttccggccgagttcgagcggctggaggcgccgctccggctgctgatcgacaccgccttcggcgaaagccgctatgagcagacgccctggctgcgcggcttctacctgagctcggccacgcaggagggctcgccgctggaccggatgctggcggggatggcggcgggcttcggccttgcgcccgcgccggtgccgcatcgcgcgatgggcgagcggcggtcgttcttcctgcacgacctgctggccggggtgatcttcggcgaggcgggcttgggcctgttcgatccgcgcgccgaggagcgccggacatggatctggcgcggctcggccgtggcggcggcgctgctggtgctgctggcgggcctgggctttctgttcaacaccatgcgccagtccggcgcggttgcggaccagcagcgcctgctggccgaccttgcggggcggcttgccaacgccgcctcgcgacaggccccgaccgagcccctggacctgcccgtcgcccttgacgccatgaccgagatcgaggcggcccggacgccggtgcccggcgggccgctggcgctgatcggcccctcggctgcggccgagatcgagggcgcggcccggctggcacgcgaacgcggactgcgcaacctcctggagccgcgcatggtcgcctttctggaggcgacgatgtggcggcagatccgcgacccggatttcctgctgggcgcgctgaaagcctatcagatgctgaccgggcttggtccctatgaccgcgcctggctcgcggaatggtggcaggaggtgctgcccgcctttgccgccgagacccccttcccgaccgaggccgcgcgcctgtggcagcttgccgcgctggaccggctgggcggcgacgaaagccgcatcgaggccaatccgcagctggtcgaggccgccttgcaggcgatctgcaccgtgcccttgtcgctgcgcacctatcgcgcgctgatgtccgaacccgagatcgccaccctgcccgactggataccggcggaaaaggccgggccgctggcggggcaggtgctgacgcggctgtcgggccagaccctgcgccagggcattcccggcgcctttacctggcagggctttcacggcacggtgctgccgatgctgcccggcatggccgaggcggcgctgaacgaccgcaaggtctttgccggcggctgcgcggaaagcgccgatgcctcggccgcctcgctgcaagccgacatgatgaagctttaccaggacgatttcatcaatgcctgggaggggttcctgcgcgacgtgcggctggcgccgatccccgacctggccaccgccaccgcgaacctgaaggaccttgccagccccgacagcacgctgaagcggctgctgaacgccgtcgtcgccgaaaccgacctggcgcgaccgcccgaacagggcgacagccccgagatcaatcccggcgtgctgaagaaggtggccggcaagctgggccttggcgccgcagccaggatcggcaccaaggtcgccgccgccgcccgccgtccgggagagcccgagccgccgccgcccggggccgagatcgcccggcatttcgccccgctcaaggccatcgtcgccgaggtggacggcaagccgccgctgatcgcggatgccgagacggcgctgggggcgctgtccaaggagcttctgaccgtgcaggccagccccgatccgcaggcggcgctgttgtcgcgcggcgggctgccgcaattgacgggcgatctgcgcaatgtcgcggccaccctgcccgacccggtcaacgcctggctgggcgccatcgccggcgacacgatcagcgtcacgcgcgaggcgatcctggcccagctcaacgcgcgctggcgggcggatgtgctgcccttctgccgcgcggcgacgggggggcgctatcccttcgtcgcggattcggccatcgacgtgacggtcagcgacttccagcagcttttcggacccggcggccgcttcgacggcttcaccaacgagacgctggcgccctatgtcgataccagcgcgcggccctggcgctggcgggccgacctggggctggacgcccgcacgctggccccgttcgaacaggcccgcgccatccgcgacgcactgtttccgggtggtgccgggccggtcatggcctttacgctggagccgaaggacctgacccccaatgccgcgcgggtgacgctgaacgtggacgggcagagcctggtctatttcaacgccgccgcccggccgatgccgatgacctggccgggcaaggacggcaccaacctgatctcgctgagcttcaccccggtggatggcacgggcgaggcgatcagcaccgaaaccggcgcctgggcctggctgcggctggtgcgcaaggccgggctgtcgcccaccgcgctgcccgaggtctttggcctgcggctgggcatcggcccctatgccgcccggttcgaactgcgcgcggcttcggtcgagaatcccttcgatctcagcatgttcggtgccttccgatgcccggaagcgttctag

SEQ ID NO: 2050 - DNA, 3630 bp, Acidovorax avenae citrulli AAC00-1
atgctgcgcaagatcttttcattcttcttcaaccggttcacgctggtgctgtgcggcctggtgctgctcagcctgctggtctggttcgtcggtccgctggtctatatcaagccctaccagccgctcgagagcgaggcggtgcgcggctggatcatcgccgcgctgttcggcatctggttcctgcggctgttcatccggtggtggcgggccaaggagatgaatgcacgcctgctgggccagctggcccgcatcggcgcatcggatgcctccgcccccgaggccggtcccggcaaggaggaggtggccgaactcgagaagcgcttcaaggaggcggtcgatgtcctgggcaagacccgcttcgggcagacggagcagggctggttcggccggctgtcccgccgctacctctaccagttgccctggtacctcatcatcggttctccgggatccggcaagaccacggcactggtcaattcgggcctcgattttcctctggccgcccagttcggcaaggcgtcgatccgcggcgtcggcggcacgcgcaactgcgactggtggttcaccgaccaggccgtgctgctggataccgccggccgctacaccacgcaggagagcgacgaggcgcaggacagtgccgcctggtcggggttcctcggcctgctgcggcgctttcgcgggcggcagcccatcaacggggtgctggtcaccctcagcgtgcaggagctgctgagcggcggcgatgcggagcgcgagcgcctggcccggctgatcggcctgcgcctggccgagctgtgcgaggggctgtccatcaagttcccggtgtacgtgctggtcaccaagaccgacctgctggccggcttcaacgagttcttcggcaacatgacccgcgaggagcgggcacaggtctggggcttcaccaatccctatgtggaagggcaggcgcaggaagacccggggctgcagttccgcaaggaattcgacggcctggccgaccagatcaaccggttgctgccgcagcgcctgctggcggagcccgacctcgcgcgccgtggccagatctatggcctgccgcagcagttcgtcggcctgcgggacgtggtccagcagacgctgtccacgatcttcgcgtcctcgcgtttcaaggaaaagccgctgttccgcggcgtctatttcaccagtggcacgcaggagggcatgccgttcgaccgggtgctgtccgccctgtcgcggcgcttctcggtggcgcctccggcccatcccgccggggaagggcgcgcgggcaagagctatttcatcgagaccctgctcaagggggtcatcttcaacgaggccgggctgacgggacgcaatgccaagaaggagcgccagttgcggctgctgcaggccgccggctttttcgccctggccgcggggctggcgggcgccacgatcgcctggacgatcagccacggcaacaaccagaaatacctggacgaggtggccgcgaaggtgcccacgctcaagcaggcggtggaggaatcccgcgacgcggatcccgagaacatggtggcgctgctgccgctgctgaaccacgccgaggccctcgccgtgagccagcgctacaccggcgattcgccgccgctcagctggcgctacggattgctgcaggtgcccaaggtgcagaccgctgccgacgcgacctacatgcggctgctggaggatgcgtggctgccccgcctcgcgcggcacctgcgcaattcgctgcagcaggcctcgacggccaaccccgaggccagctacgaggcgctcaaggtctatctgatgctctacgatccggagcgcttcaacccccgcgtggtgaaggcctggatgctcaacgagtgggaagccacgctgcccccggccctggtgcagtcgggcatgctggaccagctggcgcaccacctcgaccggctcatggaagaccgtgccctggtttcgccgattccgatagaccagccgctggtggacgaggtgcgccaacggctggcgcagctgtcgcctgcgcagcgggcctacagccggctgaagcagttgctgaccacgggcacggcgctgccgccggacttcacgctggtgcgggccgccggccccgaggcgccgcaggtgttcacgcggcgcagcggcaagccgctcactcaggggatttctggactgttcacctacgacggctactacggcgtgttctcgcatgagctgcccaaggtgacctcgctgctggcgcaggaggaaacctgggtgctgggcaaggcgcaggggcagcgcagcgtggccaacgaggtcatgaccgggcagctcgcgctcgaggtcaagcgcctctacctcatggagtacgccaaggtctgggaggacttcctcgccgatgtgcggcccgtgcaggtggcgtcgctcgaccaggccggcgagcaggcgcggctgtattcgtccgccaattccagcctggagcagttcatccgcgcggtggccaaggaaaccacgctgggtcagaagccgggggccggcggcagcagcaccagcagctggctgggcgagaagatcaaccgcatcaaggaggagcaggagcagctcagccgcctcaccggcaagcgggtgaacatcggcgggctcgcggccagcaccaacctcgaggccgatctggtggacttccgcttccgcgaataccgccgtctcgccacctccaacggatcgggcccggcgcccatcgccgccagcctgcaggtgctcaacgaagccgccgcggtcatctcgtccgcgcgccagcagatcagtgccggcggcaccgtgccgccgtcgctctcgccggccctggagcgcgtgcgcatggaggccaagcgcgtgccgccgcccctcaacaccatgtacgaggatctggcatcgtccacgtcggccatggtaggccgcgacgtgcgtgccaccgtgggcagcaacctcaatgccaccatcgggacgttctgccgcagggcgatcggcggccgctatcccttcaccaagggatcggccagcgacgtgacgagcgacgacttcgccagcctgttctcgccgggcggcatgatggacgagttcttccgcaacaccctgcagccgatggtggacatctccaccaccccctggcgcttccgccagggtgtcgatgggacgccggtcggtggatcggccgcgctggcctcgttccagcgcgccgcgaccatccgcgacgtgtatttccgggcgggcggcaaggtgccgtccatccgcatggacatcaagccgctggaaatggacgcctccatttcgcagatggtgctggacatcgacggcgaggtgctgcgctaccagcacggcccgcagatcccgaaatcgatggcctggcccggcacccggggcacgggccaggtccgcctgcagatcaccgggggcggtgccgagaacacgggcctggtgaccgagggaccctgggccgtgcaccgtttcttcgacaaggcccagattctgccgggcagcacgcccgagcgcttcgtcgccgccttcgatatcggcgggcgcaagctgcgcttcgaggtcaccacgggcagcgtgctcaacccgttccgtctcaaggccatggaggagttcgcgtgtcctggcaatctctga

SEQ ID NO: 2051 - DNA, 3630 bp, Burkholderia mallei SAVP1; identical to SEQ ID NO: 2040

SEQ ID NO: 2052 - DNA, 3522 bp, Rhodobacter sphaeroides ATCC 17029
atgcgcgcgctccgcagcctcctcgccgccctgacctcgcggacgctctggaccttcctcgggctcgcgctcctctgcgggctgatctggcagttcggcgcgctggtctcggtgggcgagacggtgccgctcgcctccgacctcgcgcgggggctggtcgtgggctgcatcgtggtgggctggcttctgtcgctgctggcagcccagctgcgggcggcgcgcaggaaccagctcttcgtgaccgagcttgcggcgcccgctcccgccgcccccgatcccggcgcggcggccgtggccgaggtcggggcgcggttccggcaggtgatggccgagatgaaacgctcgcgcgtgggcgggcggcgctttctgcgcgacatgccgtggtatctgctgatcggcccgcccggcaccggcaagaccacggccctgcgccagtcggggctgcatttcccgatcgatcccggcgacgacctgcaaggcgtgggcggcacgcggaactgcgactggttcttcaccgaaggggccgtgctggtggacacggccgggcgctacgtccagcagcagagcgatcccgaggccgatgccgcggaatggtcgggttttctggaccttctgaagcgccaccgcgggcggcgggcgctgaatggcgtgatcgtggccctgtcgatgaccgagattctcgggcccgagcccgcgctgcgcgctcatggccgcgagatccgcaagcggctgagcgagctcggccagaggctccagatccgcctgccggtctatctgatggtgacgaaggccgacctcgtgccgggcttcgagaccttcttcgcgcccctgcccgcgcgcgggcgcgagcaggtctggggggcgacgcttgcacccgacgaacgtcccgagggcggggcggtcgaccgcgaggcgcgggcgctctggcaggaactcgaggcccgcgtcgggccgcggctggccgaggaggccacgctggccgaccgggccgagatcttccgcttccccgcgcggatggccgaggtcgaggcgccgctgcgggtgctgatcgccaccctcttcggcgagagccgctacgaggacagcccctggctccgcggtttctacttcacctcggccacgcaggagggctcgccgatcgaccggatgctcggggatctggcgggcgccttcggcctcagcccgcccgcgcctccccgccgggcgcggagcgagacacgctcctatttcctgcacgacctgctggcgaaggtgatcttcccggaagccgggctcggtcgcctcgaccgggcggcggaggagcggcggcgctggctctggcgcggatcggtggcgggcgcggcgcttgccacggcggtggcgggggtgggcttcctcctctcgttcctcggctggtcgggcgccatcgaggatcaggcgcggctgaccgcggatctctccgcccggctggccaatgtggccgcgcggcaggcaccgaccgagccgctggacctgcccctcgcgctggaagccgcgactgccgcggacgccgcacgcacggagccgccctcggggcccctcgccttcatcggcccctcggccgcggccgagatcgagcgggcgggcaccatcgcctacgagcgcacgctggccaatgtgcttgcgctgcggatggtggcgctgctcgaggcctcgatgtggcggcaggtgcgcgatcccgacgacatgctgggcgcgctcaaggcctatttcatgctgacaggcctcgcgccctacgaccgcgacttcctgaccggctggtggcaggaagagctgccgcagcaggcggtgctcgacccgttcccgaccgaggcggcccgcaggcaccagctggccgcgctttcccttttcggcacgcagggcgaccctgtcccggccgacgaagagctggtggcggcggcgctggccagcatctgcaccatccccctcgcggcccgcgcctatggcgcgctgatgcaggatcccgcggtcacgggcctgcccgactggatccccggagacgaagctgggccgaacggcgcgaggatcttcacccgcctctctggcaagacgctgcgggtggggctgcccggcgccttcacttttgcgggctttcacgagacgatcctgccgctcgtgccggaagtcgccgcgcaggccacgctcgaccggaccctctttgcgggcggctgcggcggcagcgccggggcctcggccgccacgctcgaggcggacatcctgaagctctattccgacgatttcatcgcgcgctgggatgggcttctgcgcgacatccggctggcgccgctgacggacttcgccaccgccactgcggcgatgaaggatctggcgagccccgacagcgcgctgaagcggctgctcgctgcggtcgtggccgagaccgacctcacgcgcgtccccgtccccgatgcggcgccgcccgagggtctcctcaaggccgccagcaagaagcttgggaaggtgggcaagctcgtgaagggggccgcggcgctgtcggcgggctccgctccgcccacggagccgccggggcaggcggtggcgcgccatttcgagccgctgaaggggatgatcgccgaggtggagggggtgccgccgcggatcggggatgccgaactcgcgctcggcgcgctggccaatgcgcttcagaccgcggcggccaatcccgatccgcaggcggcgctgaccgcgcagggggggcttgccacgctgacgggcgggctgaccgaggtcgccgcccgcctgccgccccccatcggcgcctggctcgaggggctggccacggacacggccagcgtgacgcgcgaggcggcgatcgcccggctgaacgcgcgctaccgggccgacatcctgcccttctgccgcgccgccaccgcgggccgctatccgttcgagccgggctcggccatcgatgtgaacacagccgatttccagcgcctcttcggacccggcggcctgttcgacggcttcacgggcgacgcgctcgggccctggatcgacacgacgcggcacccctgggcgtggcgcgccgatctggggctcgctgcccggagcctcgcgcccttcgaggccgcccggcggatgcgcgacggtctcttcgccggaggcatcggcccggtgatgggcttcctgcttcaggcgacggacctgtcgcccaatgccgcccgggtgacgctgagcctcgacggccagcagcttgtctacatgaatgcggcgacgccccccgtgggcatgacctggcccggccagaacggaacgaacctcatcgtgctctccttcacgccgctcgacgggtcggccgaggcggtgacctcggaatccggcgcctgggcctggctccggctgatcggcaagggcagcctctcgcccaccgcgcagcccgacctgttccggctgcgcctcgccgccggagcctatggcgcgcgcttcgatctccgggcgaattcggtggagaacccgctcgacctcaggctcttcggcgggttccgctgcccggatggcttctga

SEQ ID NO: 2053 - DNA, 3630 bp, Burkholderia mallei NCTC 10247; identical to SEQ ID NO: 2040

SEQ ID NO: 2054 - DNA, 3630 bp, Burkholderia pseudomallei 668
atgagccacgctgtcgcacgcatcgttcgcccgctgccgtcgcgggacatctggacgttcgccggcctcgtcgtgctggcgtgtttcgtttggctcgccgggccgctgttcgcgttcgccgagtttcgcccgttcgagagcggcgcggtgcgcgcggcgacgatcgtcgcgctgttcgtcgcgtggggcgcgcggatcgcgtggcgcggctggcgcgcggggcaactgaacgcgcagttgctcaaccagttgcgcgaagcggcgccgcggcccgccgcgacgggcgatcccgcgcaggcgcagctcgacgagctgcgcagccgcttcgacgaagccgcgacgctgttgaaaaaagtccgtttcggcgaagccgacggcgcgcgcaagggcctgccgcggtggctcgagcagatgtcgcgccagtatctgtaccaactgccgtggtacgtgttcatcggcgcgccgggctcgggcaagacgacggcgctcgtcaactcggggctgagctttccgctcgccgagcagttcgggcgcgcggcgattcgcggcgtcggcggcacgcggcactgcgactggtggttcacgaacgacgcggtgctgatcgacaccgcgggccgctacacgacgcacgagagcaaccgcgcgctcgacgaggccgaatggaagggcttcgtcgatctgctgaagaagtaccgcgcgcgccagccgctgaacggcgcgatgctgacgatcagcgtcgccgatctgctcggcgcgtcggaggcggagcgcacgcagcacgcgatggtgctgcgcaagcgcctgctcgagctgcgcgcgcagctcggcatccgctttccggtgtatctgctcgtgacgaaggcggatttgctcgccggcttcgccgaatacttcggcggcttcggccgcgccgaatgcgcgcaggtgtggggcttcacgttcccgctcgccgagagcgaagcgcccggcttcgagctgcgcgcggcgttcgaccgcgaataccggctgctgcaccagcggctgaacgacgggctgccggagctgctcgcatcgcagaccgacgcgcgccagcgcgagatgacctacctgctgccgcagcagatcgccgatctgcaggacatgctcggccagttcgtcgccgaggtgttctcggtgtcgagcttcgagccgatgccgatgctgcgcggcgtctatctgacgagcggcacgcaggaaggcaccgcgttcgaccgcgtgatgagcgggatcaagcgcttcctgaagatcgagggcgtgccgcccgccgcgcagacgggctcgtcgggccgcagtttcttcctgaaatcgctgctgcaggatcacatctttcgcgaggcggcgcttgccggcagcaatctgcgctggcatcagcggcagcgtgcgctgcagatcgtcggctacgcggcgatcgcgctgctgtgcgtggcggtgctgttcgcgtggctgcgcagctactcgcgcaatcgcgactatctcgacgaggtcgccgcgcgcgtgccggcggtcgacgcgcagatcggccgcgcgaaattcacgggcgcggccgacatcgtgcagctgctgccggtgctcgacgagctgagcggcctgccgaacgcgggcggcgtggacttgcggcatccgccgctcgcgtatcgctggggcctgttccagggcgagaagatcgaggaggcgagcgacgccgtctaccggcgcgcgctcgacgacgtgctgctgccgatcgccgcgagccggatggagcaggcgctgcgcgacgcgcggcccgacgaggtcgagtatgcgtacgcggcgctcaaggcgtacctgatgctttacgacagcgcgcactacgatcccgcgttcgtgcaggccgtcgtcgatctcgagatggagcgcgcgctgccggccgatttctcgtccgcgcagcgcagcgcgctgcgcgcgcatctcggcgcgctgttcggcaatcgcgtcgcggtgtctccgtttccgatgaacgagcggctcgtcgccgacgtgcgcgagcggctgcggcaggtgccgttctcgcagcggctgtatcggcagctcgcgcgcacgctgcacgcgagcaccgcgtcgtacgatttcagcgtcgcgcgcgcggtggggccggacgcgtcgctcgtgttccggcggcagagcggcaagagcctcgccgacggcgtgccgggcctctacacgcgcagcggctaccgcaacgtgttcgcgccgcgtctgcccggcgcgatcgattcgtacgggcgcgaggaggtgtgggtgctgaacctcggcgcgtccgagatcccgaatccggccgacgcggccgcctgggcgcgcgacatccggcagctctacctgaacgactacatcaagacctgggacgactatctggccgacatccggctgcagcgcacgtcgacgctcgcgcagagcatccaggtcgcgcgcacgctgtcgtcggccgattcgccgctcacgcggctgatggtcgcgctcgcgcgcgacacgccgctcggcgatgcgcccggcggcgcgcgcaatctcgcgtcgcgcgcgcaggacaaggtcgacgaggcgcgcaactcgctcgcgcagatcttcgccgggcagccgggcggcgaagcgggcgcggcggccgcgccgcccgcgagccccgagcagatcgtcgacagccacttcgcggggctgcgcgcgttcgcgccgggcggcggggatcaggcggcgtcgttcgacgcggtgctcaaggcgatcgacgcgctgtacacgtacctcaccgcgaccgacgacgcattgcgcagcggcgcggcgccgccgccgtcggacgcgcccgcgcggctgcgcgcgcaggcgggccggttgccgacgcctgtgcgcgaggtgctcgacgatttgtcgaacgtcgcgaacggcagcatcgcgagcgtcgagcagcgcaacgtcgcgcagcgcgcgggcgcgaacgtcggcgatttctgccggcaggcgatcgccgggcgctacccgttcgcgcgcggcgcggcgcgcgacgtcgcgccgtccgatttcgcgcagctgttcgcggcgggcggcctgatggacgacttcttccagaagaacctgcaaacgctcgtcgacacgaccgcgcatccgtggcgtttcaacaaccgcaacgccgaagccgacccgtcggcggccgcgatgctcggctcgttcgagaaggcggcggtgatccgcgacgtctatttcggaggcggcgcgcggaccgcgcagatcaaggtcgagatcgtgccgctcgaaatggacccgtcgatctcggagatgctgctcgacgtcgacggccagatcgtccgctacgcgcacggcccgcaggtgccgacggcggtgcagtggcccggcacgcgcggcagcaatcaggtgcggctgcaggtgaccgagcagtcgggggcgacgggcggcttcacgaccgagggcccgtgggcgctgcaccggctgttcgaccgcgcgggcgtgtcgggtgggcgcgggcccgagcagatggtcgcgagattcgcggtcgacggcaagccgatcgtgctgcaggtgacggcgagcagcgttcgcaacccgttccggttgccgcagatggagtcctttacatgtcctccgaagcaatga

SEQ ID NO: 2055 - DNA, 3630 bp, Burkholderia pseudomallei 1106a
atgagccacgctgtcgcacgcatcgttcgcccgctgccgtcgcgggacatctggacgttcgccggcctcgtcgtgctggcgtgtttcgtttggcttgccgggccgctgttcgcgttcgccgagttccgcccgttcgagagcggcgcggtgcgcgcggcgacgatcgtcgcgctgttcgtcgcgtggggcgcgcggatcgcgtggcgcggctggcgcgcggggcaactgaacgcgcagttgctcaaccagttgcgcgaagcggcgccgcggcccgccgcgacgggcgatcccgcgcaggcgcagctcgacgagctgcgcagccgcttcgacgaagccgcgacgctgttgaagaaagtccgtttcggcgaagccgacggcgcgcgcaagggcctgccgcggtggctcgagcagatgtcgcgccagtatctgtaccaactgccgtggtacgtgttcatcggcgcgccgggctcgggcaagacgacggcgctcgtcaactcggggctgagctttccgctcgccgagcagttcgggcgcgcggcgattcgcggcgtcggcggcacgcggcactgcgactggtggttcacgaacgacgcggtgctgatcgacaccgcgggccgctacacgacgcacgagagcaaccgcgcgctcgacgaggccgaatggaagggcttcgtcgatctgctgaagaagtaccgcgcgcgccagccgctgaacggcgcgatgctgacgatcagcgtcgccgatctgctcggcgcgtcggaggcggagcgcacgcagcacgcgatggtgctgcgcaagcgcctgctcgagctgcgcgcgcagctcggcatccgctttccggtgtatctgctcgtgacgaaggcggatttgctcgccggcttcgccgaatacttcggcggcttcggccgcgccgaatgcgcgcaggtgtggggcttcacgttcccgctcgccgagagcgaagcgcccggcttcgagctgcgcgcggcgttcgaccgcgaataccggctgctgcaccagcggctgaacgacgggctgccggagctgctcgcatcgcagaccgacgcgcgccagcgcgagatgacctacctgctgccgcagcagatcgccgatctgcaggacatgctcggccagttcgtcgccgaggtgttctcggtgtcgagcttcgagccgatgccgatgctgcgcggcgtctatctgacgagcggcacgcaggaaggcaccgcgttcgaccgcgtgatgagcgggatcaagcgcttcctgaagatcgagggcgtgccgcccgccgcgcagacgggctcgtcgggccgcagtttcttcctgaaatcgctgctgcaggatcacatctttcgcgaggcggcgcttgccggcagcaatctgcgctggcatcagcggcagcgtgcgctgcagatcgtcggctacgcggcgatcgcgctgctgtgcgtggcggtgctgttcgcgtggctgcgcagctactcgcgcaatcgcgactatctcgacgaggtcgccgcgcgcgtgccggcggtcgacgcgcagatcggccgcgcgaaattcacgggcgcggccgacatcgtgcagctgctgccggtgctcgacgagctgagcggcctgccgaacgcgggcggcgtggacttgcggcatccgccgctcgcgtatcgctggggcctgttccagggcgagaagatcgaggaggcgagcgacgccgtctaccggcgcgcgctcgacgacgtgctgctgccgatcgccgcgagccggatggagcaggcgctgcgcgacgcgcggcccgacgaggtcgagtatgcgtacgcggcgctcaaggcgtacctgatgctttacgacagcgcgcactacgatcccgcgttcgtgcaggccgtcgtcgatctcgagatggagcgcgcgctgccggccgatttctcgtccgcgcagcgcagcgcgctgcgcgcgcatctcggcgcgctgttcggcaatcgcgtcgcggtgtcgccgtttccgatgaacgagcggctcgtcgccgacgtgcgcgagcggctgcggcaggtgccgttctcgcagcggctgtatcggcagctcgcgcgcacgctgcacgcgagcaccgcgtcgtacgatttcagcgtcgcgcgcgcggtggggccggacgcgtcgctcgtgttccggcggcagagcggcaagagcctcgccgacggcgtgccgggcctctacacgcgcagcggctaccgcaacgtgttcgcgccgcgtctgcccggcgcgatcgattcgtacgggcgcgaggaggtgtgggtgctgaacctcggcgcgtccgagatcccgaatccggccgacgcggccgcctgggcgcgcgacatccggcagctctacctgaacgactacatcaagacctgggacgactatctggccgacatccggctgcagcgcacgtcgacgctcgcgcagagcatccaggtcgcgcgcacgctgtcgtcggccgattcgccgctcacgcggctgatggtcgcgctcgcgcgcgacacgccgctcggcgatgcgcccggcggcgcgcgcaatctcgcgtcgcgcgcgcaggacaaggtcgacgaggcgcgcaactcgctcgcgcagatcttcgccgggcagccgggcggcgaagcgggcgcggcggccgcgccgcccgcgagccccgagcagatcgtcgacagccacttcgcggggctgcgcgcgttcgcgccgggcggcggggatcaggcggcgtcgttcgacgcggtgctcaaggcgatcgacgcgctgtacacgtacctcaccgcgaccgacgacgcattgcgcagcggcgcggcgccgccgccgtcggacgcgcccgcgcggctgcgcgcgcaggcgggccggttgccgacgcctgtgcgcgaggtgctcgacgatttgtcgaacgtcgcgaacggcagcatcgcgagcgtcgagcagcgcaacgtcgcgcagcgcgcgggcgcgaacgtcggcgatttctgccggcaggcgatcgccgggcgctacccgttcgcgcgcggcgcggcgcgcgacgtcgcgccgtccgatttcgcgcagctgttcgcggcgggcggcctgatggacgacttcttccagaagaacctgcaaacgctcgtcgacacgaccgcgcatccgtggcgtttcaacaaccgcaacgccgaagccgacccgtcggcggccgcgatgctcggctcgttcgagaaggcggcggtgatccgcgacgtctatttcggaggcggcgcgcggaccgcgcagatcaaggtcgagatcgtgccgctcgaaatggacccgtcgatctcggagatgctgctcgacgtcgacggccagatcgtccgctacgcgcacggcccgcaggtgccgacggcggtgcagtggcccggcacgcgcggcagcaatcaggtgcggctgcaggtgaccgagcagtcgggggcgacgggcggcttcacgaccgagggcccgtgggcgctgcaccggctgttcgaccgcgcgggcgtgtcgggtgggcgcggacccgagcagatggtcgcgagattcgcggtcgacggcaagccgatcgtgctgcaggtgacggcgagcagcgttcgcaacccgttccggttgccgcagatggagtcctttacatgtcctccgaagcaatga

SEQ ID NO: 2056 - DNA, 3516 bp, Pseudomonas mendocina ymp
gtgaaggccttcttcaatttctgtgtgcgctggctcgtgccgattctcggtctgatcgccctcagcctggtgatctggttcgtcggcccgctgatcgccatcggcggcttcgagccgctggcctcggcgtccgtgcgctggattctgatcgcgctgctgttcctgatctggatcggctttcgcgtcctgcgcctgatccagacgcgacgcaacgccgccaaggtcatgcaggggctggtggccgtggcgccggatgccgccagcgtggccaccgccgaggagctggcgaccctcaagcagcgcatggacgaagccctgcaactgctgaagaaggccaagctcggcggccaggagcggcgcaacctctacgagctgccctggtacgtgatcatcgggccgcccggttcgggcaagaccaccgcgctggtcaactccgggctcaacttccccctggccgagcatatgggcggcggcgccatccgtggcgtcggcggcacgcgcaactgcgactggtggttcaccgacgaggccgtgctgctggataccgccggccgctacaccacccaggacagccacgccgaggtggacaaggccgcctggctgggctttctcgacctgctcaagaaccagcgtaagcgccgccccatcgacggcgcattcattgccatcagcctgtccgacctgctgctgggcagcgagagcgagcgcgccgcccatgcccgttcgatccgcgcgcgggtgcaggagctctacgcccaactcggcgtgcgtttccccatctacgtgatgctgaccaagttcgacctggtgccaggcttcatggagttcttcgacgacctcggcaaggaggagcgcggtcaggtctggggcatcaccttccccctggacgacggcaagagcggagaagggccgctggctggcttcaagcaggagttcgccgccctcgaggagcgcctgacccaacgcctggtggagcgtctgcagcaggagcgcgaccccaaccggcgcgacctgatctacggcttcccgcagcaattcgccgcgctgcgcgacaacctcgccagctttctcgacggcgtgttcaaacccaatccctacgaggagcgggtgctgctgcgcggcgtctatttcaccagcggcacgcaggaaggcagccccatcgaccgcctgatcggtgccatggcgcagagcatgaacctcgaccgccagcacctggcgcggcagaccggcaccgggcgcagctacttcatcgagcggctgtttcgcgaggtggccttcggcgagcgcggcctggtcggcgccaatcccaaggtggagcgccgacgtaagtggatcacccgcggcgccctggccgcttccgtgctgctgttcgtcgcggtcgccagcgtctggctggtcagctacaacgccaaccaggcctatatcgccgaggtcgacgcgcgggtggcgccgctcaagggccagctggaggccctgagtccggcgcagcgcgaagtgctggcggtgctgccgctgctcaacgccatccgccacgtggcggacaacccgccgtcctgggccgccggcttcggcctttaccagggcgacatgctcggcgccgaagccggcagcgtctatcgcaagctgctgatcgcggtgatggcgccgcggctgctgacccgcatcgaggaacagctgcgcagcggcggcaattccgacttcctctacgaggggctcaaggcctatctgatgctggccagcgccgaccagtacgatgcggacttcatcaaggcctggatcaacctggactgggaccagagcctgccgcgcgatctggcgccggatcagcgcctggccctcggcgagcacctcgatgcgctgttcgcgcgcaagccgccaccggcgcggctggacgagaacctgatcgaggacctgcgtcgccagctgcagcagatgtcggtggcgcagcgcgtctacaaccgggtcaagcgacagaagctgcccgacggtctgccggactttcgcatcagcgaagcggccgggcgcgacgccgcgctggtgttcacccgcaagagcggcaagccgctgaacgatccactgagcggcttctacacctaccgcggctatcgccaggtgttcatggtcgccagcctcagccagtccggcgcgctggccgaggagcagtgggtgctgggccgaccgctggcggacaaccaggacgccgccaccctggccctggaggtacgcaacctgtacttccaggattttctcggccaatgggaaagcctgctcggcgatatcgatttcgtcgccatcatcagcgtggcccaggcggccgacgtgatgcgcgtgctgtccgggcccaattcgccgctcaagcagctgctcgaggcggtggcgcgggaaaccgacctgcagcaggaagatcgcctgctcgccgacaagctcaaggccgccgacggcacggtggacaagctcaagcagcagctcggctcgctggtcggccagggggcgcaaaaccagccgcaggccgcgccccaggtggacccgatcaccgcccgcttcaacgagctgaacagcctggtgcgcaagcccgagggtagcaacagtgcgcccatcgacgacctgctggcgcagttcaacgaactctacgtgcagctcagcgccatgagcggcgccagtggtgacgccttgctcggcgaggcgaagaatcaggcggtggcctcggcgcagcgggtcaagctggccggcgaacgccagccgccgctggtgcagaacctggtcaactcggtggtcagcgccaccaccaacagcatgatgggcggcatccgcagccagctcaacgccgcctgggtggccgaggtggtcaacgtctaccgccagtcgctggccggccgctacccgctggacagcggcagtacgcgtgacgccacgctggaggacttcggcaacttcttcggcgtcggcggggtgatggacaactacttccgcaagtacctgcagccctacgtcgacacctcggcgaccacctggcgctggcagccgggggcggccgagcgcttggggataggcagcggcgtgctgcagacctttcagcgcgcggcggcgatccgcgatgccttcttccgctccggcggcacccagcccacggtgcgcttcgaactcaagccggtggccatggacgcggcgatcagccagttcatcctcgatctggacggccagcagatgacctacgaccacggccccagccggccggtggccatgcagtggccgagccccaacagcctgggcgtggtgcgcctgtcgatcaccccgccgaccagcgccgggcgttccggcctgaccctggacgggccctgggcctggttccgcctgctcgagcaatcggacctgacccccggcgcttcgccggaccgtttcaccctgcgcctgcgcgtggacaacgccagcgtggcctgcgaactgcgcgccagcagcgccttcaatcccttccgtggccgtgtgctgagcggcttcagcttgccggagcggttatga

SEQ ID NO: 2057 - DNA, 3528 bp, Acidiphilium cryptum JF-5
atgagcgcacggctggtccgctggctgctgagcggcgtcggcgccgcgatcatcgcggccctggtctggttcttcggccccttcctcgccgtgctcgccggcatcctgccgcgcgcggcgatcgctgtcctggtgttcgtgatctggcttgcggccaatctctggctcgatcgccgcgcccgcaagaaggcggccgccgtcgaagaggcgatcaccgagacccaggccgaccccgaggccggcatgcgggcggaggaagtcgccgcgctggcggacaagatgaagaaggcgctcggcatcctcgcccgggcgcgcggccggcgcggctttctctacgaacagccctggtacgtcatcatcggcccgcccggcgccggcaagaccaccgcgctgctcaatgccgggctgaactttccgctcgccgccgagctcggccaaggggcggtcgccggtgtcggcggcacccgctattgcgactggtggttcaccgaccaggcggtgatgatcgacaccgccggccgctacacgacgcaggattcctcggcgtcggtcgaccaggccggctggcacggcttcctcgacctgctgcgccgcacccggccgcgccagccgctgaacggcgtgatcgtcgccatcgccctgtccgacatcgcccaggccgacgccgcggcccgcgccgcccatgcgcgcgccatccgcgcgcggatcaaggagatcaacacccgcctcggcgtcaccgtgccggtctacgcgctgttcaccaaggccgacctgatcgccggcttcaccgagttccatgacgatctcgacaccgccggccgcgcgcaggtctggggcatgacctttccgcccgatcgcacgccggcgggcatggcgggccggttcgccgccgagttccgcgagctggtcggccgcgtggaagagcgcatgctcgaccgcctcgccgccgaacgcagcccggatcgccgctcgctcatcgccggcttcccgatgcaggtcgcgagcctgcaggcgccgctggaggccttcctgaacgaggcgttcgccggctcccagctcgatcccgcgccgtggctacgcggggtctatctctgctcgggcacgcaggaaggcacgccgatcgaccgtctgaccggcgcgctggcccgcagcttcggcatcgaccagcggcgcgcgcccagcctgcggccgcaatccggccgctcctatttccttggccggctgatcggcgaggtgatcttcggcgaggccatgctgggctcggcggaccggtccggcgcccggcgccgcctcgcgctgcgcggcgcggggttcggcgcggtcggcctcgtgttcgtcgtgctgctcgcggcgctgttccgcagccatgccgacaatgccgccgccatcgcccgcgcgcgcgccgggcttgccgccgaacagaaggtcgcggcgcagatccggctcgatccggtcgccagcgccgatctgtcgcggatcgcgccgctgctgcgcgaggcccgcgaccttgccggcgcgccccccgagcgcggctatcacggtatcggcctcgaccagggcgcctcgatcagggctgcgaccgccgccgtctaccgcaacgtgctcgaccatgcgctgctgccgcgcctcgtgcttcagctcgaggcggaaatgcgcggcgggctcgaccggccggatttcctgtatcaggcgacccgcgtctatctcatgctcggcaatcagggaccgctcgacgcctcgctggtcgaggcctggatgaagctcgactggcggcgcctctatccgggcttcggccagaccgcgttgcgccattcgctgatgcgggacctgaccgcgctgctcgcccgcccgctgccggacgttccgctggacggccagctgatcgccaccgcgcgcgcgaccttctcgcgcgtgccgatcgccgagcgggtctattcccgcatccgcgattccgaggcggcgtcccgcgtgccggcctggacgccggcggcggcgctgggggctgccggaacgccctatttcgtcaacgccaccggcaagccgctgaccgatggcgtgcccggcttcttcaccaagcgcggcttctacaccgtgctgctgccggccctcacccatgcgacacaggatgtcgccagggaaagctgggtgctcggcgcacaggaccggatcaagccggattcgccgcagatgcagtcgctcgagcaggatgtgatccggctctatgacaccgcctatgcccggcactggcagtcgatgatcgacgacctcaatatcgcgcccctcggctccgcgggccaggccgtgcaggcgctctacgtgcttggctcgccccaatcgccgatggtgcggctgctgtcgtcgatggcggacgagcttacgctcaccaaacccccgaaagaccttgcgaaggccgccaagggggcgacgggcgccgaggcgaagctgcgggcaccggccaagctgaacgaagcggcgacgcggctgaagcagttgctgggcccgcaggcgtcaggcgccccggccccgaagcccggggcggcaatcaacgccgagttcgcgccgctgcgcaattatgtgggcaacggcgcggcaggctctccgctctcgctgacattgcaactgatcgaccaggtgcagaagcagctggcaaccctcgccgccacggcgcccggcgcggcgggccccgcgtcccccgccgccggcggcgatgcggcccagctccttgccggcgaggcgcagcacgatccgcagccggtcagccgctggctcggcgcgatcgtcgcgacatcgaacagcctgcgcggcggcagcgccgcggcggcggcggcggcggcgttcaaggcgccgggcggtgccgcggcactctgcgagaaggcggtgaccggccattacccgttcgatgcaagtgccgcctcgggcattccgcttgccgatttcgcccgtctcttcgcgccgggcggcgtgatggacaatttcttcaacacgcaggtgcggcccttcgtgaacatgaccgggcaggtatggacggtgcagccggtgaacggcgtggcgccgccggtcagccagggggccgtcgcggaattccagcgcgcgcaggaaatccagcagatgttcttcctgggcggcacgcagcccagcgtgcagttcacggtcacgcccgccggcctctcggcgggcgcggcacaggtcgtgctgcagcttggcggcgtcgatgtcagctacgcccacggcccgacggtgccgacctcggtgaactggccgggtgccaccggcatgcagacggcccggctgatcatcacgccggccgccggcggcacgccggtcacgcttcaggccagcggtccctgggcggtgtttcgcctgttcggcatggggcggctcacgcgtgacggcagctccgcccgctacaccctcaccttcgatcaggggggcatgcaggcgcgcttcacgctcgaggcggggtcgatcttcaacccgttcgcgccgggcgtgctgaacgacttccgctgcccgagcctcaaaggatga

SEQ ID NO: 2058 - DNA, 3531 bp, Pseudomonas aeruginosa PA7
atgaaaggcttcctcaacttcttcacgcgctgggtggtgccggtgctcggcctgctcgctctgagcctggtcatctggttcctcggcccgctgctgcgcctgggcaactacgagccgctggcctcggcgaccagccgctgggtgctgatcgccctgctgttcctggtctggatcggcttccgcgtgctgcgcatcgtgcaggcccggcgcaacgcggcgaaggtcatgcagagtctcgccgaggtcagcgcgccggacgccgccagcgtcgccaccgccgaagagctggcgaccctcaagcaacgcatggacgaggccctggccctgctcaagcgggccaagctgggcggcagcgagcggcgcaacctgtacgagctgccctggtacgtgatcatcggcccgcccggttcgggcaagaccaccgcgctgatgaactccggcctggacttcccgctcgccgcgcagatgggcgccggggcgatccgcggggtcggcggcacgcgcaactgcgactggtggttcaccgacgaagcggtgctgctggacaccgccggccgctataccacccaggacagccacgcccaggtggacaaggccgcctggctgggcttcctcgacctgctcaagacccagcgcaagcgccgtcccatcgatggcgcgttcatcgccatcagcctctccgacctgctgctgggcagcgacgccgagcgcgccgcccacgcccaggcgatccgcgcgcggatccaggagctgtaccagcagctcggcgtgcgcttcccgatctacgtgatgctgaccaagttcgacctggtgccgggcttcatggagttcttcgacagcctgaaccgcgaggagcgcgcccaggtctggggaatgaccttcgccctcgacgacggcaagagcgcggaaggcccgctggcgggtttcgccagcgagttcgcgctgctcgagcagcgcctcaccgcgcgcctggtcgagcgcctgcagcaggaacgcgacccggcgcggcgcgacctggtctacggcttcccgcagcagttcgccgccctgcgcgagtgcctcggcgagttcctcaatggcgtgttcaagcccaacccctacgaggaacgcccgctgttgcgcggcctgtacttcaccagcggaacccaggaaggcagcccgatcgaccgcctgatcggcagcatggcgcagtcgatgaacctcgaccgccagcacctggcgcggcagaccggcaccgggcgcagctacttcatcgagcggctgttccgcgaagtggcgttcggcgagcgcgggctggtcggcaccaacccgaaggtcgagcgccgccgcaagtggctgaccatcggcgcgctgagcgccaccgcgctggtggtgctggcggtgacggcggtatggatcgccagctaccgcgccaaccagagctacatcgccgcggtcgaccagcgcgtcgacccgctggcgcgcggcatcgagtcgctgagtccggcgcagcgcgacgtgctcgccgtgctgccgcagctcaacgcggtgcagaacctcgccaacgacgcgccgggctgggccgaaggctacgggctgtaccagggcgacatgctcggcgaggagtccgccagcgtctaccgcaagctgctgatcgcggtgttcgccccgcgcctggtgacccgcatcgaggaacagctgcgctccggcggcagcagcgacttcctctacgagggcctgaaggcctacctgatgctcggtagccccgaccactacgacgccgacttcatcaaggcctggatcagcctcgactgggaacgcaacctgccgcgcgacctctcgccggaacagcgccaggcgctgcacgcgcacctcgacgcgttgctcgagcggcggccgccgtcggcgcgcctggaccaggacctggtcgaggacctgcgccgccagttgcagcaactgccggtggcgcagcgggtctacgaccgggtcaagcggcagaggctgcccaaggacgtgcccgacttccgcatcagcgacgccgccggccgcgacgcgccgctggtgttcgcgcgcaagagcggcaagccgctcaccgacccgctcagcggcttcttcacctaccgcggctaccgcgaggtgttcctcaccgccagcctcagccaggccggcaccatcgccgaggaacagtgggtgctcgggcgcgacctgaacgatgccggcgacgccgccaacctggccctcgacgtgcgtcgcctgtacttccaggactacctgcggcagtgggacgacctgctcgccgacctcaccgtggtgccgatcaccaacgtcacccaggccgccgacgtgctgcgcatcctttccggaccgacctcgccgttccgcaagctgctcgaggcggtggcccgcgagaccgacctgcagaaaggcgaccggctggtcgccgcgcaggtgaagaaggccgccgacggcaccgtggacaagctcaagcagcgcctcggctcgctggtcggccaggaagaggagggcgtccgcgaacagccgcaacaggccgacagcgacccgatcagcgcgcacttcgccgaactcaacagcctggtcagcaagggcgagggcggcaacgagccagcgccgatcgacagcctgctggaggacatgaacaccctctacgtacaggtcagcgccatggccggagccagcggcgactcgctgctcggcgacgccaagaaccaggtggccgccgccgcctcgcgcgtggccctgagcgccgagcgccagccgccggtggtccagggcctggtgaagaaggtggtcaactccaccaccagcagcatgatgggcagcgtgcgcaaccagctcaacgcggcgtggatcagcgacgtggtcagcgtctaccggcaatccctggccgggcgctacccgatcgccgccggcagctcgcgcgacgccaccctggaggacttcggccacttcttcggggccggcggggtgatggacagctacttccgccagtacctgcaaccctacgtcgacacctccgccagcacctggcgctggcagcccggcgcggcgcagaagctcggcatcaaccccggcgtgctgcacaccttccagcgcgcggcggcgatccgcgacgccttcttccgctccggcggcatgcaaccgacggtgcgcttcgagctcaagccggtgaccatggacgcggcgatcagccagttcatcctcgacctcgacggccagcaactgacctacgaccacggcccgagccgcccggtggcgatgcagtggccgagcgccaacggcctcggcgtggtccgcctgaccgtgacgccggcgcccagcagcggccgctccgggctgaccctggaaggcccctgggcctggttccgcctgctcgaccagtcggacctggagcgcggcaactcgccggaccgcttcaccctgcggctgcgcatcgacggctccagcatcgcctgcgaactgcgcgccagcagcgccttcaaccccttcaagagccgggtcgtgtccggtttcagcctcccggagcgcctttga

SEQ ID NO: 2059 - DNA, 3639 bp, Serratia proteamaculans 568
atgctcagtacgttattctccatcatcaccagccgcctgttatggggctttgccggcattactgcgctggcgttcatcatctggatgatcggcccgttggtggctatcggcgattatcggccgctggagccggcactcaaccgccagttaaccatcggcgctatctatctgatctggttcctgtgccgcattattccacgcatctacagtgcctggttcaaccgccgcctgctgagtaacctgcgtgccgccgaagaagtcccggctgaaaacggcaagccggtagccaaacaggatgagcagttggcccagcgctttgatgaagcggcgcaattgttgaagaaagcccgcttcgcaccgggtcagggggacagcaaacaccgctggatgacccacttcagcagtcaatatctctaccagttgccgtggtatgtgatcatcggtgcgccgggtgccggtaaaaccaccgcgctggtcaactccggcctgcattttccgctggcggatcgcttcggcaagtctgccctgcgcggtgtgggcggtacccgtaactgcgactggtggttcaccaatgacgccgtgctgcttgacaccgcgggtcgttataccactcaggaaagccagcgcgaggaagacgccgacgagtggaaaagcttcgtcggcctgctgaaaaaataccgtacccgtcagccgatcaacggcgtgatggtgaccatcagcatcgccgatctgttgagcgaaagtagcgaagcccgcgccgcgcaggccagctcgctgcgtaaacgcctgattgagctgcatgaacagttggggatccatttcccggtttatgtgttggtcaccaagaccgacctgctgaatggctttatggcctatttcaacggctttgataaagcgcagcgcgagcaaatctgggggttcaccttcccctatgaggcatcgcgtcagccagatttcaatctgaatgccaccttcgaacaacagtatgctttgctgcagcagcgactggatgccgcgctgcctgagaccttgctggttgaacatgatggccgccagcgggctgaaagctacctgttcccgcaggaattcgcggccctgcgtccgctgctgggccagtatctggaacaggtgtttgccacctccagttttgaaacccgcttcaccccgcgcggtatttacttcaccagcggcacccaggaaggactgccgttcgatcgggtaatgggcgaactgaaccgttacctgcaattgccaacggcgaacagccaaccacacgccaacccggcctggaaccatgtggatccggccgcgcccatcccggctggcaaggggcaaagcttcttcctgaaagacacgctggaatcggtgatcttccaggagtccgggttggcgggcagcaaccgctggtgggaataccgtaaccgcgctgtgcattgggcgggctatatcctgctggcggcctgcctggcgatcctggcgattttctggttcaccagctacagcaacaacaaggcttatctggctgaagtggccgccaaggtacccggcgtagaacgccaggggctgggtctgacgcagttgggcaatggcgatatgctttcgctgctgccgttcctcaacagcgtgctgcatttgccggacagtcagaacttctcgctggaagatcccccgttcacctatcgcatggggctgtaccgtggcgatcaggtcagtgatgccagcgactcgctgtatcagaaagcgctaaaggagttgctgctgccacaggtggcacagcagatcgccacgacgctgcgcaacgacaaccacggcgatgccgattttagctacgaagcgctgaaggcctaccagatgctgtatctgccgaaacagtatgacggcaaattcctgcgcgcctgggtcatgctcaacctgcaacgcaacctgccgcagggcagcacccagaagcagctgcagcagattgaatggcacctgagccaattgctcgacgaacagatccaagcttcgccttacgccaaagatgaacctatggtggaacaggcccaggccgcgctaaaccgtgctcccctgtcgcagcgggtgtacggccgcctgaaacgcctgctgcttaagcaaaccgagattaaaccggtcagcctggttgacctggccggcccgcagaccgaactggccttttcgcgcaaaagcggcaaaccggtgaccgacggggtgccgggcctgtatacctcacggggctattggaaaaccttcaacgacaatattgatccggtgaccgataccctgcgtcaggaagatgtttgggtactgaacagcaaaaccccggatcagaaaaacgccgatttgatcaaaaccattcgccaactgtacatgcaggactttatcaacgcctgggatgaactgctgggtgatattcagttggcaaatatcggaaacctgagtcagcgcatcagcagcgcacgcttgttgtcaggcaacccttcgccgatgcgtaacctgctggttaacgtcagcaaaaatgtcaccctgcgcgacgagaaaagcactgctgactcccgttcgctgctggataaaaccgaagaccggctgagccagagtgccaaccaccaattggaagccctgttcacccatcgaccggccaacgccgacggcgatgtctcagcccagccggaacaactggtgatggcgcatttcgccgcattactggagctggcgcaaagtcagggagaaggcaacaaggcgatcccgttcgacagcgtgctgaaacaggttgatgagttgtacagctacctgaccgcggttcagggtgcggccaacagcggcatgtcggcaccgcccagcgatatcatcccgcgcttgcaggccgagtccggtcgtttaccggtgccgttcaaacagatgctgctgtcgctggcgattggtgccagcagcgacacgcaacgcaaagagatggaaaacgtcaagaaacgcatcagcgtcgaagtcggcagcttctgccgccaggcgattgccgggcgttatcctctggtcgcccgggcgcgtcaggaagtgacgccagacgatttggcgcgcatgtttgcgccgaacagcgggctgatggacagcttcttccgtgacaatttgcagggcaaggtcgacaccacccgtgccaactggcgtttcactcccggcgtagacggcaaaacgctgcccggtggcgaaggcatcctgcgttcatttcagcaggcgcaacgcattcgtgacgccttcttcgccaacggtaccgccacgccgtcttaccgggtgaccgtacgaccggtacggatggataacgacatcctcaacctgacgctggatatcgacgggcaactgttcaaatacagccacgggccgcaggttcctctggtgatcagttggccgggtacccgcaataccaatcaggtgcacctgcagctggcactggccaacggctccaccgccagcctggtcaccagcggcccctgggcgctgaaccgtttggtggatatggcgcagacttccgccggcagcagcagcctcggtcgtcaggcaacctttaacctggatggccaccgcgtaacgctggagttcactcccaacagtatccgcaatccgttccagttaccggcattctcctgcccgtag

SEQ ID NO: 2060 - DNA, 3657 bp, Delftia acidovorans SPH-1
atgatccgtcgcatcgcctcatggctgttcaaccgctacatgctggagcttctgggcctggtggccctgagcctgctcatctggttcgtcggcccgctcgtcttcatccagccctaccagccgctgggcagccccaccgtgcgctggtggatcatcgccggcctgttcatcctctggttcctgcgcctgctgctgcgctggtggcgcgcacagcgcatgaacgagcacctcatgaccggcctggcccgcttgacctcgccgcgcgaggcggacggcacgcccgcagcaggctccgaggaagtggccgagctggagtcgcgcttcaaggaagccctggacacgctgagcaagacccgcttcggccagaccgaaggcggcctgttcggccgctggaacaagcgctacatctaccagctgccctggtacctgatcatcggctcgccgggctcgggcaagaccacggccctgatcaactcggggctggacttcccgctggcggcccagttcggcaagcgcgccatccccggcataggcggcacgcgcaactgcgactggtggttcaccgaccaggccgtgctgctggacacggccggccgctacaccacccaggaaagcgatgcggagcaggacaaggcagcctggaagggcttcatgcagctgctcaagcgctttcgcggacgccagcccgtcaacggcgtgatcgtcacgctcagcgtgcaggaactgctcagtgccagcgacgccgagcgcgcccagctggcccagctgatcggcctgcgcctgagcgagctgtgcgaggagctgaccatccgcttccccgtctacgtgctggtcaccaagagcgacctgctggcgggcttcaacgagttcttcggggccatgagccgcgaggagcgcgcccaggtctggggcttcacctatccctatgacgaaaagacccagcgctcgcccgccagcgacccgcaggccgccagcgccctgtacatggaggagttcgacgcactggtcgcccagatcaaccgcctgctgccccagcggctgatgaccgagcccgaccttgcgcgccgcagcctgctctacgcactgccccagcagtttgccggcctcaaggacgtggtgcgcgacacgctggatgcggcgttctccgcctcgcgcttcaaggaaaaaccgttgctgcgcggcgtctacttcaccagcggcacgcaggagggcatgcccttcgaccgcgtgatgtcggccctgtcgcgccgctttgcgctgcgtggccgcctgccggccgatgccgtgccgcagcagggccgcagctacttcctggagtcgctgttcaaggacgtgatgttcaacgagtccggcctgaccgggcgcaacgccaagaaagagcgccagctgcgcctgatgcaggccgccggcctgtgcgcgctgctgctggccctgggcggcgcggccctggcctggacgctgagctacgagaacaaccagcgctacctgaacgaagtggccgacaacgccggcacgctgcgccaggccgtggaggaatccaaggccaccgatcccgacaacgtggtcgccctggtgcccatgctcaatcacgcggcgcgcgtggcgcagagcagccgcttcgaggaatcggccccgctgggctggcgctggggcctgctgcaggtgcccaaggtgcagacggccgcccacgccacctacctgcgcctgctggaagatgcctggctgccgcgcctgagcagccatgtcgcgcgctcgctgcgccaggtcagcaccggcagccccgaggccagctacgaaacgctcaaggcctatctcatgctctacgagcccgaccacttcgacgccaccttcgtcaaggcctggctgcgcagcgactgggaaaacaccctgccccagcatctggtgcaggctggcctggtggaccagctgtccgagcacctggaccgcctcatcgacggccgcgtggtggtctccgcccagcccatcgacgccaacctggtcgccgaagtgcgccagcgcctggcccagatgtcgcccgcccagcgcgcctacagccgcctcaagcagctgctgaacaccggcgacaagctgccgcccgacttcagcgtggtgcgtgccagcgggcccgaggcgccccaggtctttgcgcgtgccagcggcaagccgctcacccagggcatcagcggcctgttcacctatgacggctaccacggcctcttcctgcacgagctgcccaaggtcaccaccttgctggccaaggaggaaacctgggtgctgggccaggccgaaggccggcgcagcgtggcccaggaagtgctcacgggccagctggccaacgaggtcaagcgcctgtacctcatggagtacgcgcgcctgtgggaaaccttcctggccgacatccgacccatacgcacggcctcgctggagcaggccggcgagcaggcccgcctgtactcgtccgccaactccagcctggagcagttcatccgcgccgtggcacgcgagaccacgctggcccgccgcccggaccagcaggaaggcggcggctcgggcagcaccagcagctggctgggcgagaagctgcagcgcatccgcgaggaacagcaccagctcagccgcctgaccggcaagccgctgaacgtgggcggcatgctggccaccggcacgctggaggccgacatcgtggacttccgcttccgcgaataccggcgccttgccaccagcaacggctcgggcccggcgcccatcaccgccagcctgcaggtgctcaacgaggcggcggccgtcatcgcctcggcgcgccagcaggtgatccagggcggcggcgtgcctccctcgctgagcggcacgctggagaaggtgcgctcggaagccaagcgcgtgccgcctccgctcaacagcatgtacgaggccctggccacgtccacctcgtccttcgtgggaagcagcgtgcgcagcacgctgggcggcaacctcaacgccaccatcggcgacttctgccgccgggccatcctgggccgctaccccttcacgcgcagcgccacgcgcgacgtgaccacggacgacttcgcccgcctgttcgccaccggcggcaccatggacgagttcttccgcacccagctgcagaccatggtggacatctccaccgtgccctggaccttcaagcagggtgtggacggcacgccggtggggggctctgcctcgctggccgccttccagcgcgcggcctccatccgcgacgtgttcttccgcgcaggcggcaacacgcccggcatccggctggagatcaagccgctggacatggacgcctccatctcccagatggtgctggacgtggacggcgaaatcgtgcgctaccagcacggcccgcaaatccccaaggccgtctcctggccgggcacgcgcggcaccggccaggcccggctgcagatcacggccgccggcgcccagaacaccggcatcgtgaccgaaggcccctgggcgctgcaccgcctgttcgaccgtgcccagatcctgccgggcaactcgcccgagcgtttcacggccatcttcaccatcgacggacgcaagctgcgcatggaagtcaccaccagcagcgtcctcaacccattccggctcaaggccatggaggaattcgaatgtccggaccggctgtga

SEQ ID NO: 2061 - DNA, 3663 bp, Leptothrix cholodnii SP 6
atgaagacgctgctgggctggatcttcaaccgctggacgctcgccgtcgtcgcgctgctggcgctgtcgctgctgatctggatcgtcggcccgctgatcgcggtggccgaggtgcgcccgctcgacagcacgcgctcgcggctgatgctgatcggctgcctcgtgctggcgctgctgctgatggcggcgtggagcgcctggcaggcccgccgcgccaaccggtcggtggtcgagcagctgatgaagcccgccgccggcggtgcgccggccggcagcgagtcacccgacgtggccgcgatgcgccagcgcttcgagcgcgcgctgcaggtgctgcgcgaggcgcggttcccgtcggcgtcgaccgcggccggcggcgccccggtcggtgcgatcgacgcgcgtggcaaacccgccgcgcccaagcccggcctgctggcgcgcctggggctgcagaacctgggcgggcgctacctctaccagctgccctggtacctgatcatcggcgcgcccggctcgggcaagaccaccgcgctgcgcaacgccggtctgcagttcccgctggccgagctgaccggcgaacaccgcgtgcgcggcgtcggcggcacgcgcgactgcgactggtggttcaccgaccgcgcggtgctgatcgacaccgccggccgcttcaccacgcaggacagcgacgccgggcgcgaccagggcgcgtggagcggcttcctcggcctgctgcgccagtcgcggccgcgccagccgatcaacggcgtgctcgtcaccgtgtcggtgcccgacctgctcggccgcagcgccgccgagcgcgacgactacgccgctcgcgtgcgcctgcgcctgcaggagctgcacaagcagctgggcgtgcgtttcccggtctacctgctggtcaccaaggtcgacctgctcaacggcttcggcgactatttcgccaccctcgacaaggacagccgcgccacgccctggggcaccaccttcacgctggcgcagtcacgcagcggcgaccacacggccctggcccccgagctgaaggcgctgacccagcgcctgcaggacggcctggtcgagcgcctgcaggccgagaccgacccgcagcggcgcgcccgcatctacggctttccgctgcagttcggcagcctgcacgagccgctcgacgccttcgtgcgcgacgccttcgcgccctcgccgttcgagccgccgagcctgctgcgcggcgtgtactttgtcagcggcacgcaggaaggcacgccgatcgaccgcctgatgggctcgatcgcgcgcagctggcagctcgaacgcgcgatcctgccgccgcagggcgccagcgcgcgcagctacttcctggagcgcctgctcggcgaggtggtgttcgccgaggccggcctggccggcaccgatccgcgcggcgaacggcgccgtcgcctgatgctggtgggcgcctacgccgcgctcggcctgctgacggcgggcgcgctggcggcctgggcgaccagcgcggtcaacaaccgcaactacgtcgacgccgtgctggcgcgggtcgacgaggtgcgccggctggtgcaggccacgcccaaccgtgccagccccgacctgcagccgctgctgccggcgctggccgccacccgccagctggcgcaggccggctggggcgacgcggcggtgccgtggtcgctcggcttcgggctgttccagggcgacaagctcgacgccgcctcgcgcagcgcctatcagcgcatgctggtcgacgccgtgctgccgcgcctggcgctgcgcatcgaggagcagctgcgccagcgcgccgacgcgcccgagctgcagtacgaatcgctcaaggcctacctgatgctgcacgacccgcagcgcttcgacgccgacgcgctggccgcgctggtgcgcgccgactgggcgcagaacctgccgcgcgaggtcggcacggccgagcgcgagcagctcgaccagcacctcgacgccctgctcgcgctcggccccgccgtctcgccgctgccgcaggaccaggcgctggtgacgcagacccgcgccctgctcgccgccgtgccgctgccccagcgcatctacaaccgcctgcgtcaccagggcctgggcgagcaggtggccgagttcaccgccgcccgcgccggcgggccggccgcggcgctggtgttcgcgcgcgccagcggcgccccgctgacgcgcggcgtgcccgggctctatacgcgtgacggctaccagcagggcttccagcgcaaggtcgacgccgtcacccgcgaactggcggatgaagaaacctgggttcttgggaacgccgccaatggcggcggcggcgctgcgggccaggccacccgcccgagcgccgccacgctggccgacgacgtgcgccgcctgtacctgaccgactacgccaacacctgggaggccttcatcgccgacgtgcgcctgcgcccgacccagagcctggccgagctggtgcaggtcacgcgcgtgctgtccggccccgacaacccgctggccacgctgctgaaggcggtggtgcgcgagaccacgctgctcggcggcgaggagcccggcgccgtcaaggccgccgccgaccgcgcgcgtggtgcggtggccgcggtgcgcgagggcatccgcgcgctcggcggcgatgcggccgccgccgcgctgcccgcgcgcggtgtgccgctcgaatcgatcgtcgacgaccgcttcgcgatgctgcgccgctacgtgcaggccgcgccgggtgcgcgcgcaccgatcgacgacaccctcgtgctgctcaacgaggtgcagctgcacctggccagcgtcgagctggcggtgcgcagcgccaacccgccgccgccgtcggacctgccggtgcgcctgggcgccgagggcgcacgctcggccgagccggtgcgcagcctgctcggcacgctgggccgcagcagcgccggcttcaccgggctgatgcagcgcgaggtgctgtcgcgcgaggtgcgctcgatggtgggcgacttctgcacgcaggccgtggccgggcgctacccgctcaggagcggctcggccaccgacgtcacgctggcggatttcggccagctgttcggaccgggcgggcgcttcgaccggctgttccaggagaagctggccgcccacgtcgacacctcggcgcggccgacctggcgcttccgcgccaacgggctgggcgaggacgccggcacgctggcgcagttccagcgcgcgcaggtcatccgcgacaccttcttcccggccggcggcaacacgccgcagctgcggctggagttcaagccggtcgagatggacgccagcatcagccagttcgtgctcgacatcgacggccaggtggtgcgctacgcccacggcccgcagatcccgaccagcgtgcaatggcccggcccgcgcggcaccaaccaggtgcggctgcagctcagccccgccggcgccagcggcaacggcctgctcaacgaaggcccgtgggcgctgctgcacctgttcgaccgcgtgcagctcgaacccggccgcagcgccgagcgctttcgcgccaccttcgagctcgacggccgcaaggcggtgttcgagatcaccgccagcagcgtgcgcaacccgctgcgcctgcgcgagctggccgagttcagctgcccgaacggcctgtga

SEQ ID NO: 2062 - DNA, 3459 bp, Xanthomonas oryzae PXO99A
atgcgctttgtgctcgatttcctgcgcgtgcgctacctcgccagcgctgccatcctcagtctgttggccctcctggtgtgggtcggcggaccctatctcagcctgggccgctggcagccgtttgccagcgtgagcgggcgcctgcttgccatggccgtgctggtgctcgcgtgggcagggtggcgctatctgcgctggcgccgcgacagcgccaagcagcaacgtctggccgccgaactggtcgggcagggagcacgtgccgaagacgccagcggcaacgacagtcgcgcgcgtgcagcacacgagcaggtccgcctgcgtgcgcgctttaccgaagccatggcggtgctgcgccgtcgccgtcgcaacggtcccggcctgcacgtgctgccctggtatctgctgatcggcgcgcccggttccggcaagagcaccttgctgcagtcttcgggcctggagttccccctcaaggcacatggcacccacgccgcgctggaaggtgtcggtggcacgcgcaactgcgattggtggttcgccgaccaagcagtgttcctcgacagtgccgggcgctataccacccaggattcggacgccatcgccgatgccggtgcctggcatggctttctggacctgctgcggcggcatcgccggcagccattgaacggcgtcatcgtgaccgtgagcgtggccgagctgctggagctcgatggcgatgccggtctgtcgcacgcgcgggcagtacgtcatcgactgaacgaactggtcgagaaactgcgcgcacgcgtgccggtctacctgatcgtgaccaaatgcgatctggtgtcgggcttcgccgaattcttcgccgatctggatgccgccggccgcgcgcaggtgtggggggtgtcgttcccacaggcgcaggccgccggtgacaccgatccgttgacgcgattccccaccgagctcgaacgcctgctggagcggatcgatcagcgcgtgctggagcgcctgcatcgggcgcgcgatgcacgcgagcgtgccgcggtgctgtcctttccgcagcaattgcggttgcttcagccagcgctgatggacgtcgtgcagaccgcgttcggccgccatggctatgccggccagccgtggctgcgtggtgtctatctgagctcggggacgcagcaaggccatccgatcgaccacgtcatctcggcagtggcgcaacacttcggtgttgccgccgccggtctgccgcccgtcagcagcgcaccacgcagttacttcctgtcacgcctgctcaaggacgtggtcttcgccgaggcgggactggccggcagccaacccggcagcgcgcagcgccgtcggttgctgcagctggcctgctgggccgtgttgaccgccaccaccctgggcgtgctgtcgggcatggccggcagttacgcccgcaacgtgcggctgatcgggcaggtgcgcgacgcgctcgatgcctatcccgccggcccgctgcccgccgatgcaggcgaggcggccttctatgcaaaagccttgcagcgtttcgacgcattggcgcaggcgcgcgatgcggcgctgccgccgggcgcgtcgattccgtggtcgcgacgtttcgggctgcaccagggcacggccttggcgcgcgatgtgcaagaagcgtatctgcgcgacctcaatggcgcgttgctgccggcattggcgcaatcgctgcgacgcaagctggagcagtccagcaacgatccgcaacgtctgtatccattgttgaagggctatctgatgctgggagacccgacacggcgcgatgcaatgcatctggccacgctggcaggcacggtctggcgccagatatttcccgacgatgcatcggtgcgtgcggggttgaacctgcatctgcgcgccttgctgggtccggtggacggcgcgcgcgcgcttgcgctggatcggcagcagatcgagcagacacgggcgagcctgcgaaccgccgaactgccggcactggtctacggtggcctcaagctgacgcagcccggggtcgatgccggccaggccccacgcctggatcgccgcctgggcctgctgagtgatgtcttcgaacgccgcagtggcctgccgttgtctgcgccattgcccccgctgttcacccgtcaagcgtttcaagcacagatcggcggtggcatcgcgcatggcgtgcagcagtttctcgccgacgattgggtgttgggcacggcaccgctggacccgttggcgcgctcgcaactggagcgcgaggtattggcgctgtatcagcgcgactacatcgccgcctgggacagcctgctggccgatctggtgttgcggccggtcgtgcagaccgggcaggcgagtgcggtggccgccaagctgggtggaccggcatcgccgctgaaggcgttgctggtgttgctgcgcgagcacacccacgcactggggcgcacgcctgcagcgaaggccggcgcgggcgctgcagctgccgcggacactgctgctgcggccgagccggatgtggcagccgaaccgatcgaacgccatttcgaaccgctcactcgcctgctcgatggtgggccgggcgccagtgcgctggacgaaaccctggccgcgctgacccagatgagccgcacgctgttgggagccgccgctggcgtggctgccgaccagaacgccccggccttgctgatcgccgcgcaacaggccgaacagctgccgccgccgctgggcaactggatggcgaccttgtccggtcgtggtcgcgcattgaccgccagcagcgccggcgaagcattgcgtaacgcgcaacggcaagccgccgggcgtgagtgcgcgctgctggtgagcgggcgtttcccgttcgtgccgggcagcaacaacgagatcccgctgcgcgatttcgccgaactgttcgcacccggtgggcggatggaccggttcgcgcaacaggcgttgctcggcaaggtcgataccagcgggcctggctggaaatggaatgcaggcatggctgcggctggcgcagacgacgtgctggcgcgcgcgcaactggccgacgagatcaagcaagcattcttcgccggcggcggtgcgcagccgcaggtcgcctttactgtttccattccaccgcaagcagggattcgccggctgcagctggaggtggatgggcaagcgctggacgtgcgcgatggtgcgcgcgccacccagtcgatgacctggcctggtccaacgccaggtctggtgcgtctggcggcgtgggacgccagcggacaggctttgccagtggtcgaataccgcggcccctgggcctggtttcgggtcatgcaggccgggcggctgcaccgcagcggcgatctggattacaccgccagcctcgcgctgggcggcaccagcgtgcgcgtggacatacaaccggccagcctgcggcatccctttgcggcgtcggccgtgcagcggttcagttgcccatga

SEQ ID NO: 2063 - DNA, 3546 bp, Methylocella silvestris BL2
atgaacaaggaaatcatccgcatcatcgcctatggggtcgggctctcctcgatcgccgcggtggtctatctcgccggtccgatgatcgagatcggcggcgttcgcccgctcgaaaattcgatcgttcgcgacatcattatcgtcgtgctggtcgccgccgccgccgggctggccggctttaccttttggcggcgcaagaaaaacgctgccgagatcgaaaagggcatcgccgaaggcggcgccccggatagcgacgccgaggttttgggcgagcgcatgaaggacgcactggcgacgctgaaaaacgccagcaaaggcgcgaccaagggcgcttatctttatgaactgccctggtatctcctgatcggaccgcccggcgccggcaagaccacggcgctcgccaattccggcctcaaattcccgctgagccggggcgcgaccccggcggcggtcgcgggcgtcggcggcacgcgctattgcgactggtggttcaccgaagacgccgtgatgatcgacacggccgggcgctacacgacgcaggattccgacgcgcgggccgatcagaaaagctggctcgcctttctcgatcttttgaagaagaatcggccgcgccagccgatcaatggcgtcatcgtcgcgatcgccctctccgacatcatgaccgagacgcaggcgcagatcgaagcgcatgcgcaggcgattcgctcgcggctgatcgaggtcaacaagcagctgaaggtcgattttccggtctatgtgctgttcaccaaggccgatctcatctcgggctttcgcgagtttttcggctcgctcaacgagaacgcccgcgcgcaggtatggggcgcgaccttccagacggcggacaagaagctcaatctcgtcggcgaggttccggccgaatatgattcgctgatcgcgcgcctcaacgaatggaccaccgaccggctgcaggaagagccggtgccctcgacgcgcgcgtcgctgttcggctttccggcgcaggtcgcggcgctgaagaagccggtgttcaatttcctcaatctgatcttcgagccaacgcgctaccacgccaatgcgacgctgcgcggcttctatttcacctccggcacgcaggagggcacgccgatcgatcaactgatcggcgcgctctcgcgcagttttggcgcgcgcgaagtcgccgccaacgcctattcggggcgaggccagagctattttctgaagaatctggtcggcaaactgatcatcggcgaggccgcctgggtctcgaccgaccgcgccgcggtgtttcgcgcgaggctgatcaagggcgtcgcgctcggcctgctggcgctcgtctgcgcgggcctctcgctcgcctggttcggcagctatcagcgcaacagcgatctgatcgtgcgcacgcaggctggcgcggccgatttccgcacggtcgccggcccgctcgcgacggagcccgaaatttccgaccgcgatctcgccaagattctgcccccgctcaacaaattgcggttcttgccggccggatttgaaaccaagggcgagacgccgccgctcgcggcgacgttcggcctcagccagttcgaccggctgcaatcggcgtcaacgggcgcctatgacatggcgctcgagcggctgctgcgtccgcgcctgatctaccgtctcgaagagcagatggaggcgaaccgcggcgacccgagttttctctatgaggcgctgaaggtctatctgatgctcggcggcttgcatgcggtcgatcgtgatctcgtcatgaattatctgcgccgcgactggaccgaaaatctttatcccggctccgccaatgccgacgggcgcaggctgctcgaggcccatgtcgcggcgatgctcgacatgaagggcgacatcatcgtcagcctcaacgggccgctggtgtcggaagcgcaaaatcttctcgcgcggctcagcgtctcgcagcaggcctatgagctgctccgctcgcaggcggcaagctcggagatttccgattggaacgccgcgcggcagggcggccccgattctgcgctggtgttcgaggcgacgcagggcgctgcgcttgattccataaaggtgccggccttctacacctatgccggcttccgccgtctgttcatcgaccggctgtccggcatcggcgaaaaactcaaaagcgatcgctgggtgctcggcgccgcgggcgagcaggcggcggtcgaggatcagtacaaaagcctcagcgacgatctgctggcgatctatggcaaggattttatcgcggcctggcaaagcgcgctcggccggctgaagctgaagcgcctcctcgccgacaagccgaaatatgtgacgctggcggcggcctccgcgccgacttcgccaatcaagcaactgatcgtctccgtgcgcgacgagaccgcgctgacgcgcgagcggccgggcttcgccaagaaggaaggcgtcgatccgaacgccgctttgtttcagaaccgcgccgtcccgggcgccgatatcgagcaggccttcaaagcctatcacgtgctggtcgagggggaggccgggcgggcgccggtcgatctcatcatctcgaacctcgccgaaatctaccaaagcctgctgctgatgggcaatccggcgcaggctccgctcgcaacctcgcagctgcagacgcaggtcgcggcgttgcgcgccaacgccaaccggctgccgcagcccttcgccggcatgctgcaaacggcggggaccgatatcgacggcgatctgaccaacagcttccgctcgcagctgaaccgcgcgctgcgcgatacggtgacgggggtctgccagcaggtggtgtcgaaccgctaccccttcgcccgcaccgaccgcgaggtttctctcgtcgacttcggccgcctgttcggcccgcaggggatcatcgacaaattcttctcaactcagatccagcaatatgtcgacatgtcgaagccggtctggacattccggcaggacaataatgtcgcgcgggcgctcgcctcgtccggcgcgacgctgaaggagttccagcgcgcggcgcagatccgcgacgtgttctttgcgaccggcgggctgatgccctcgatgacgctgacgattacgccgccgccggcgccgcttcccgctctgcctgctccgccgccgcccgccgcgggcgcggctcaggcggcgccggccgccactccggcgcccgccgcgccgacggtgagcatcaagatggacatgaacggaacgccgatcatcagcccggcgggcgcctcggcgccggtcgtcgcgcaatggccgggcgcatcgaccaaccgtagcgcgattaccgtgacctcggatgcgccgggcgcgcagccctcgaccatcgagcggcgcggtccctggtcgctgttccggctgatcgaggcgggcgccccggtgccgcacggcgattcgatcgtcgtcagctacatcgtcggcggccgggagctacaatatacgttcagcgcgggctcgacgcagaatccgttcacgctgccggcgctgcgcgagtttcactgcccgagcgacctttag

SEQ ID NO: 2064 - DNA, 3615 bp, Methylobacterium nodulans ORS 2060
atgatcacactgccccgctcccgccctctctggctcggtcttctcgccacgctcgcaggctccgccgccctcgcggcgctcgtctggtgggccggtcctctcgtggccttcggcacagcgcgtccgctcgaaggcgacctcccgcgcgccgcgctcgccgccgcgatcctgctcgcggggctcgccacctgcgggcttcgcctgcggcgccacaggcggagcgtagcggcgctcgaagccgagatcagccgggacgagggcgacggcgcggtcctcggcgcgaccatgcgcgacgcgctcgcgacgctgcgcaaggtcggctcgcccaagggcgacccgctctacgaactgccctggtacgtcatcatcggcccgccgggcgccggcaagacgacggcgctggtcaattccgggctcaagttcccgctcgcgcgcgagggcgccgccgccgcggtggccggcgcgggcggcacgcgctactgcgactggtggttcgccgaggaggccgtgctgatcgacacggccggccgctacaccacgcaggattccgatccccgcggcgaccgcgagagctggctcgccttcctcgacctcctcaagcgccaccggccgcgccagcccatcaacggcgtcctcgtcgccatcagcctggaggacctgatcgccgggccgcccgaggcggtcgccgcccacgcctccgccgtccgcaagcggctcctcgaactgcacgagcggctcggcgtcgacttcccggtctacgccctgttcaccaaggccgacctcatcgcgggcttcgccgaattcttcggccatctgccggaggccgggcggcgcatggtctggggccataccttccagaccggtgagcgcacccgcaacatggtcgggtcggtcgccgccgagttcgacgccctcgtcgagcggacgaacgcgtggctgcccgaccggctgcaggaggagccgaacccgacctcgcgggtcgtgctcttcggcttcccgtcccaggtcgcctcgctcaaggacctcgtcgtcgacttcctcaccgccgtcttcgagccgacgcgctaccacgcggcggcggccctgcgcggcttctacttcgtgtcgggcacgcagcagggcacgccgatcgaccggctcatcggcgccctgtcgcgcagcttcggctcgcaggacgcggcgcccgatgccgccccggggctcgggcgcagcttcttcctcgccgacctcctgcggaaggtcgtcatcgccgaggccggctgggtctcgacgaaccgggccgcgttgcgccgcctgctggccctgcgcgcgggtgcctatgcgggcctcgcgctcgcggcggcgctcgcggtaggcttgtggtggacgagcttcctgcgcaacgaggcgctctcgggccaagccgccgcaggggccgcgaagtaccgcgccgaggcggtcgacgtcctgcgcgactccgtcgtcgccgaccgcaacttctcgaaggtcctgccctatctcaacaccctgcgctacctgccggccggctacgcgagccgcggcgaggccgggccggtcctggcgaccttcgggctctcccagcgcgcgcggctcggctcggcggcggagaccgcctaccatgccggcctcgaacgcctgctgcgcccgcgcctgatctaccggctcgaagagctgatcgaggccaatcgcggcaatccgggcgtcctctacgaagccctgaaggtctacctgatgatcgggcgccggcccgaggcacccctcgaccgcgacctcgtcctcgcctggatgcgccgcgactgggcggagttcctctactccggcgcgggcttcgccaagggccgccagctgctggaggaccacctcgtggcgatgctcgacctggaggatgcgggcgagcccgtcgtgtcgatcaaccaggggctcgtcgaggagacgcagcgcaccctcgcgcggctgagcgtcgccgagcgcgcctacgaactcctcaagtcggaggcgcgcgcctcgggccgccgcgactggacgctcgccgccgccgcaggacccgacgccgccctcgtcttcgaggcgaccgggcggggcgacctcgacggcgtgcgcgtgccctatttcctgacctacgacggcttcttcgacgccttcatcgaccgattcggcgacatcgccgaggcggtggggcgcgaccgctgggtgctcggcggcgcgggcgaggaggaggcctacacggcgcagtacggctcgctcttcgccgacctcctcaagctctacgcccgcgacttcgcggcggcgtggcgcagcactctcgggcgcctgaagctgcgcccgcttgccgccgaccggccgcgctacgtggcgctcaccgcgctcgcggctccgacctctccgctcaagcgcctcctcgaatccgtcggagccgagacgcgcctgacccgcgagcggcccgcggcccggcccgggacggaggccgatccccgcgccacgaaggccgctgccgtcgtggccggcgcgctgtcggcggaagccgagcggcaggccgcgggcgtgctgccgtcccgcgtggcctcgaccgcctcagcgctcgggcgcctcgcgctcgaacgcacgccgccccaggccgcaggcccggcgcggatcgacgcgagcgaggcgccgggcgccgcgatcgaggcgggcttccgggccttccacgccgtgctcgacggcgagggcgggaagcgggcggtcgacgccctgctggcgaacttgagcgacctgcgcgccgccgcgctggaggccgccgcgccgggcggggcgaccgcgccgctctccgcccaggcgcgcaacctgcgctcgctcgcgtcccgcttcccggccccgttcgaggccatgatccagggggccgcagccgagttcgagggcagcgtcacgggggcggcggtggcgggcctcgcccaggggctggccgagaccgtcacgcgggagtgccaggcggccgtcgcgggccgctaccccttcgcgcgctccgagcgggagatcccgctcgccgacttcgcccggctcttcgcccccggcggcatcctcgaccgcttcttcacgcagaacctcgtctcccacgtggaccgctcgcggccgcaatggacgtggcgcgccgacgaccaggtcgcccgcgccttctcgctcgcgacccttcgcgagttccagcgcgcggccgagatccgcgacgccttcttcgcggccggcgggaccacgcccggcttcaccctcgcggtcacgccgctcgcgctgaccggggacgcgacgcgcgcgaagttcgagctgaacggcagcaccgtcgaggcgggcaccggcgtgaacgcgcccgcctcgctcgcctggcccggcgcctccggcctcggccgcgcggcggtgagcgtcgaggggatcttcgggacgaacgcggccagcgtcgagcgcgcgggggcctgggccctctaccgcctcctggaggccggctcgttgctccggcagggcgacgcggtcgtggcgaccttctcgctcggaggacgcgacgtatcctaccgccttgccgtgagcgccattgccaatccgctcacgcttccggcgctgcgggagttccgctgcccgagcagcctgtga

SEQ ID NO: 2065 - DNA, 3495 bp, Agrobacterium vitis S4
gtgatcaatccactcagctggttttacaccatacgctcctatgtcgattcctacgcgggtgtcgtggggcggcgctttatatcgctgatctgggtcatcgccctttgcgtgctgatctggttctacggctatctggccgccttcggcagcttcaagccactcgccagcgtttccgcccgcatctggaccatggtggtgatctttgccatctggaccgcctatatgattgtcaccatggtccgcgccaagcgccaggacaaggaactggtcgacagtatcgaggcgcaggcgctggccaaccagcaggccgaagtcagcgaaatcagcaaccggctgaaagaagcgctggccttgctgcggcggattaccaagaaacgcttcggctatatctatgagctgccatggtatgtgattttcggggcacccggctctggcaaaacgacggcgctgaccaattctggcctgcaatttccgcttggcgacgcccttggcagcgatgccgtcaagggcattggcggcacgcgcaattgcaattggtggttcgccgatcaggcgatcatgatcgacaccgctggccgctatacgacccaggatgacctcgatggatcatcgaaagccggatgggaagggtttctcggcctgttgcgccgttatcgccgttcgcagccggtcaatggcgcgctgctgacgctttccatcggcgacctgttgacccgcgacccggaagcccagcgagaagaactgcgtgcgatccgcaagcggctggccgaactggacgaccatctcggtgcccgcgtgccggtctatatcctgctaaccaaggccgatcttctcaccggtttcgtggaattctacgatagtttcaacaagagcgaccgcgaacaggtctggggcacgaccttcggcctggaagaaagctacggcgcaaagacattgccggagcgttttgccgaggaattcgccctgttgcaacagcgtgtcgatgccatgctgatcgagcgtctgcaacaggagcaaagtgctgatgtgcggggccggattttccgttttccggccgagcttgccagtttgcaggagaagctcggtgaggcgatcagcgagctttgcaccggctcgtcattggtcgaggctccgctgatccgtggtatctatttcgtctccgcgacacaaccggatgaaaccctggcccgcaccacgacaaaccggacgcggcgcagctattttctgccgaaactgttcagcgaggtgattttcaacgaagcggccctggttgcacgcgacaagcgcctttcctctcgccaagtcctgctgcgccaggccgtctggggtttggctgtggcggcggtggtcattgtgtttgccggatggaccatgacgtttttccagaaccgggccgctctcgcccaggccgaagaacatctgaacgcctatgacaagctgatccaggatgtgccggtgcgcaatgtgtcggatgccgattttctgcgcgtcctgcctgcgctggacaatctgcgtgcggttccaaccggctttgacacccgctatgtctgggccgcaagtttcggcctcagccagcgcgacaagattgccggtcgccagcgcgacgcctatcagcgcgcactgaacagccttttgttgccccgtatgctggtgcaattgcaaaaggacctgaccggtgaaagcgatgtaacgcgtaccttcaatgcgctgaaactctatgaaatgctgggtggactggggcggcttgaccgggaattcgtctccgcccaggcaacccagatgtttaacgccttgtatcccggcgaaggccggacagcggcccgcaaagcgctgatccagcatgccagtgccatggcagccggcgtattgccgccagtcgaaatcgacagacggctcatcgaaaaggcccgcgacaccatccgcaatcaaaccgttgccgaacgtgctttcgacattctggccggatcgaaacaagcgcaggcgctgatgccgtggcaaccgtcgcttgcctttggcgcgctgggtgaaaaagccttcatccgtaagtccggcgcgctgctgacggaaggggtcgagggactgtttaccgcgaccggctaccgcagcgtcgtcctgccgcatattgccgacgccgcccgcgaagcgctgcaagaagaatgggtgcgcggctccaatgcgcaattgcgggggcaaacgctggagtcagtggcccaggcggccttgcaaatctattatgaccggcttgaacagcgctgggcgtccgtgctgggagatctagccgtcaggccgtcgcaaaacctgggcgatgccgtggaaaccacacgcatcctttccaatgaccgcaatatcgtcgcccaggccgccagatcgatagccgatgcgacggatctgcgcccgaagggcgatacggcgggcatgaccacgctggtgtcatccgccagcggcgacacagttgctgccatgctagcatcctccatggccgcccctgatccctatagccgcttgcgcgaggcgctggatacgcctgccgcagacgatagccgcaaggcaacaacagataaacaggataaacccgcctcccaggtcgaggcgatattgccagttatcacggcgctgcatgaccagctggcccgctcggttacgtcctcagcggaggtggcgaaagtattcgatgtcgatagccaactgacacgggccaatcaggacctgctccaggatgcccgccgcctaccgggaccgctggatggctggatggccggacttgccgccgataccggctcactcgccgtcaaatcggcccgcagccggattggcgacctgtggtcgagcgaaggggcgggcctgtgcagctccatcgttacgggccgctaccccttcgaccgcgcttccagccgcgatgtcgccatgaacgacttcatcaggctttttggaccgaagggcctgttccagacgttcttcaagcaaaggatggagcccttcgtcgatcagtcgatctccccctggggttggaagggcaccttcggcgcggcaggcattcccagcgagggtattgccgagtttgaaagggccgaccagatcttccgcgccttcttcccaaatggcagcgagacaccggcgattgccatcaatgtcaagccggtgtcgcttggcgagacctcgacggcggtgatgctggaaatccagggcgaacgggtggtatatttccatggcccggtccaggcgaaaaccataacctggccatcgaaggatgccgccagcatgtcgcggattgccttccagcccggcggctggcaacaggccaaaaccgaaaatggcgactggtcgcctttccgcctgtttgacgatgcaaatatccaaaaccaaggcgacgatctgtttagggcgaaattcaccaacgataaccaggtggcggaattcgatgtgcagtttggttcggtgttgaatgccttcaggctgaaggcgctgtccgaatttacctgcccgacccagttctga

(The sequence listing continues in the following parts.)

What is claimed is:

1. A method of killing a microbe, the method comprising contacting the microbe with an isolated peptide comprising an amino acid sequence of a toxin as set forth in SEQ ID NO: 3001, thereby killing the microbe.

2. A method of killing a microbe, the method comprising contacting the microbe with an isolated peptide comprising an amino acid sequence of a toxin as set forth in SEQ ID NON: 2773, thereby killing the microbe.

3. A method of killing a microbe, the method comprising contacting the microbe with an isolated peptide comprising an amino acid sequence of a toxin as set forth in SEQ ID NO: 2774, thereby killing the microbe.

4. A method of killing a microbe, the method comprising contacting the microbe with an isolated peptide comprising an amino acid sequence of a toxin as set forth in SEQ ID NO: 2775, thereby killing the microbe.

5. A method of killing a microbe, the method comprising contacting the microbe with an isolated peptide comprising an amino acid sequence of a toxin as set forth in SEQ ID NO: 2776, thereby killing the microbe.

6. A method of killing a microbe, the method comprising contacting the microbe with an isolated peptide comprising an amino acid sequence of a toxin as set forth in SEQ ID NO: 2777, thereby killing the microbe.

7. A method of killing a microbe, the method comprising contacting the microbe with an isolated peptide comprising an amino acid sequence of a toxin as set forth in SEQ ID NO: 2778, thereby killing the microbe.

8. A method of killing a microbe, the method comprising contacting the microbe with an isolated peptide comprising an amino acid sequence of a toxin as set forth in SEQ ID NO: 2779, thereby killing the microbe.

9. A method of killing a microbe, the method comprising contacting the microbe with an isolated peptide comprising an amino acid sequence of a toxin as set forth in SEQ ID NO: 2780, thereby killing the microbe.

10. A method of killing a microbe, the method comprising contacting the microbe with an isolated peptide comprising an amino acid sequence of a toxin as set forth in SEQ ID NO: 2781, thereby killing the microbe.

* * * * *